United States Patent 9,487,797 (GENOMIC PLANT SEQUENCES AND USES THEREOF) - sequence listing, part 38

SEQ ID NO: 62290 - DNA, 24323 bp, Oryza sativa
gcgagctcgattccggcgaggaggaagggcggcgagaggcggaaacagatggaggaggtgcggggagggattaaatagggttggaagggggagagagcggccggcggggaaggaataagcgcgggaggtccggccgccatcaatggcgccggcgagatttgcgggggcaaatccgcccgtttgaacgcgagagagagagggaaaaatggggggaaagggagaggggatcacggggagtaattccccccactttattgcatgcgggaacggcggaaggcggcggaattccaaccgccggcgcccttaggcccagggaaggcgccggaaccggcggaagaagggaataacaattggccccacccgtcagggagggtggcgggtgggcccacccgtcagcggcgcgcgcgcggggagaggccggatgggccgcggggagaggagagggagggggagggatatgggccgagccagcccaagagggagagggagggaaaagggactttttagagtttttctttttataaaatcattttaactttgtttatttcttaataattattatttgtgctctgaaaattccactaaaatttatttacgcattttaggcttttaggaaatatacaaaaatcctccaagccttatttgacttttaactttgcacattttaattgttggaggctttcacatggattttaattattctaggcatcatttaaaggatatattttagagtcgttttgggacgtggcaaacctaccccccttaaacggaatctcgaccccgagattcggaagaactggcgaagagatcgggataggctgccttcagctcgtcttgacgctcccaagtagcttcttcctcggcgtggttgctccattggaccttgcaaaaacggattacccggttcctagtcctacgctccatggtgtccaggattttcactggcctctcctcgtaggtcaagtcttcgcgaacctcaatctgctctgagtcggcctgctcggacggcactcgaaggcatttcttgagttgcgacacatggaacacatcatgcacgttgcccaaggaggcgggcagctccaactggtaagcgacttccccacgtcgagcaatgatacggaaaggacccacaaaccgaggtgcgagcttccctttcgtctgaaacctgtgtacacctcgcaatggcgtgacccgaaggtacacaaaatcgtccactgcgaattccagattacggcgtcggttgtctgcataactcttctgccgagactgggccacctttagattatcccgaatggttttgactttagcttcagcttctctcaggatatcagtcccgaacacttggctttccccaacttggtcccacaatagcggtgtccggcatttgcgtccatacaacgcttcatagggtgccatttgtatgctggcttggtagctgttattgtaggagaactcggcataggggagactcttatcccaggtcttcccgaaatctaggacacatgcgcgaagcatatcttctaggatctgatttagacctcggtctgtccatctgtctgcgggtgatacgcggtgctgaaatttaatcgggtacccagctcttcttggagcttcttccaaaagtgagaggtgaattggcttcccctatcagatacaattttcttaggaatgccatggagactcacgatcctagcgaagtagagatcggctagtttgttccctccacaggtggtcttcacaggaataaaccgagctaccttggttagtcggtccacaactacccatatagaatcatatccgccttgggtttttggaagtccggtgatgaaatccatcccaatttcatcccatttccattctggtacttggagaggttggagaagtccggccggtcgttggtgctctgccttgacacgctggcacacatcacaaagggccacgaactctgcaatttcccgcttcatactaacccaccagtatttctctttcaagtctaagtacatcttcgtactgccagggtggatggaataagggctttcatgagcttcctgaagtatcaactgtttaagttctctgtcgtctggaacgcatacccgatttccgttccatagggttccgtgttcatcctctgtgaaaccagcggctttaccttgtttcatattcttgaggagtccacgtatatccggatcattcttctgagcctcgcggatttgatcgagcaaggtaggcttggcttccagtgtagccaagaatccacgaccaactatgcttaggttcagggcttccatctgttgattaagttcaggtggaatgccacggacgccaagagtgttgcaatggctttttcgacttagagcgtcggcgaccacgttggccttaccaggatgatagtggattcccacatcataatccttgatgagttctaaccatcttctctgccgaagattcagatccgattgagtgaagatgtatttcaaactcttatgatcagtatatatttcacagctattcccaatgagatagtgccgccagatttttagagcatgaaccacagcggctaactccaaatcatgggtagggtagttgccttcatggggccgtagctggcgtgaggcataggctaccacatgaccttcctgcatgagcacgcaccccaatccttggcgcgaagcgtcacaatacaccatgaagtccttatgagtatccggtaagattaaaaccggcgaggaaaccagcctttccttgagagtttggaacgccttctcgcattgcgggctccacacaaatttctcttctttcttcaacaactgtgtcatgggtcgagcgattttggagaagttctcgatgaacctctggtagtatcctgccaaacctaagaagctgcgaatttgagtgactgtcttgggttgcttccaatcagtgacggcggtcactatttcggggtccacagcgactcctttagcagatatcacgtgccctaagaatttgacttcggacaaccagaactcacacttgctaagcttggcatacaattgatgttcccgcaactttcccaacaccagacggagatggtgctgatggtcatcctctgattgtgagtacaccagaatgtcatcaatgaaaaccacaacaaacttatccaagtattccatgaacactttgttcattaagttcatgaagaaagcacgagcattggttaaaccgaatgacatcaccgtgaaatcatacagtccgtatcgcgtggtgaatgcggtcttagggatatcttcttcacgaatacgtaattggtgatatctggaacgaagatcaatcttggagaatacagtggcacctttaagctgatcgaacagatcatcgatccggggaagagggtacttgttttttatggtaacttcattgagagctctgtagtcaacgcacatcctctttgtcttgtctttcttctccacaaaaatcacaggagcaccccagggggaagtactcggccgtatataccccttttctttcaactcttccaactgtttcttgactttggccagttcattagctgccatacggtagggtcgcttgtacagaggagtggttcctagagcaagatcgatccggaactcaatctctcgcttgggcggcataccgggtagttcttccggaaacacatctccgaactctctgacgatggggatttccgacagtcttatctgatgaagttctgaactaccgacagaggttgggggtgcaaagaaaacgaccggttgttccgtccctcggtacagagtgacagtgcatcttgcacaatccactacacattggaattgagccaaccaattcatcccaaggatcacatccaagttcttggtgtctagaagaatcagatccgagggaaaaggaattccctggatttctataggaacggcagggctataatactttgctgtcataacccctccaggggtggtgatgagcagagggttcctaagcctttctacccccaactgatttctccccacgaatggcacagatataaacgagtgggaagctccagagtcgaacaaaatggtagcagggatggaatgaatgaggaacgtaccaacgatgacgtctggagttgtcagcacgtcctcggccgtcacgtggttcacacgaccccgaatgacatccttaccaccgttgttggagcggggatgcgcttggccttgctggcgcctcggctttgggcatttatccgcaaagtgcccaggcttgaagcagttgaagcacagacgctgctgaccttgaacgtccctgcggccttgaccaggctgcacggctggcataggaggacggggcgcacgagtcccttgctgactctgctgttgctgcggctatgggacgcgcaccacgaattgaggacccggcgcacccgggctcgcaccggccggcgccgtgggccccacgcatcagccgcacccgagggcgcgggcggctgacggccaggccccacgcggcagccgctcggtgcgcccgaaggcggccacggcggcgcggccggcgggaggcggcgcgcgcgcgcccctacggtcgccggcggcggccataggcatggcggagcggcggccgagagaagggagggaaagggggaaacgaggcggcggtccacggctcaccctaggtcgacggcgatgacgaaaaggcggccggagcggaggaaggcggcggcgcggctcgggtcgaccgggacggcggcgctccggtggtcgacgagcgaaacggaggggtggacgaggtcgtcgaggatgtggcgaagccgaaggaggcggcgccgaggtgggaggtggtccggggcgacgacggcggcggaccggagctcggcggcgacggcggagagagagagcgacggcgcgagctcgattccggcgaggaggaagggtggcgagaggcggaaacgaacggaggaggtgcggggagggtttatatagggttggaagggggagagggcggccggaggggaaggaaaccggcgcggcgctctcgggctccatcaatggcgccggcgggattaggggagggtttccaaacgaatccaagggagagagggagggaaaattggggggaaagagggagggaatcacgggactgggccacctttagattatcccaaatggttttgactttagcttcagcttctctcaggatatcagtcccgaacacttggctttccccaacttggtcccacaatagcggtgtccggcatttgcgtccatacaacgcttcatagggtgccatttgtatgctggcttggtagctgttattgtaggagaactcggcataggggagactcttatcccaggtcttcccgaaatctaggacacatgcgcgaagcatatcttctaggatctgatttagacctcggtctgttcatctgtctgcgggtgatacgcggtgctgaaatttaatcgggtacccagctcttcttggagcttcttccaaaagtgagaggtgaattggcttcccctatcagatacaattttcttaggaatgccatggagactcacgatcctagcgaagtagagctcggcggcgcggagcgaggttgctgctgctgttgctgctgcgaggacgatccccctggatagggattggtgtagcggaccctttgattagccccctgttgattgcggaaattcgccaagcgacgcttgtgcgactccagttccttgtgcttggcttccaagcggatgctcttgtcaaccaaacgctggaaatccggatagtccccggagaccagacgcacggatagctcagggtccattcctgccaagaacttctcctgcttttcctcatcttcccgtacatcctccggggcgtaccgggccaggttgttaaactcatgcaaatactccatcacggagcggttgccttgcttcatctcccggaattcccttttcttaagggccatgactccggcgggcacatgggttctccggaaagcgacggtgaagcgggcccaagtaataggttgcccctctggctgcgtagcctggaaatggtccctccatatagatgcgggcccctgcagttggtgggcggcgaagatgactttctcctcatcgctgcactgcacggtgtctaactttttccccacggcatgcaaccaatccaacgcatccacggggttattggagctagagaaggtaggcggacggatgcggaggaactcggcgagtttagaatgttgtgggggtggtggtggagcattatgttgtggcggattttggatgtggtggaggaaaccagtcatcatgttggcctgctgggcgaggatttgggtgaggatggcgttggtgtctggtggtggtggtggaggcggaggaggaggtggaggtgggctgccatggttgttgtggttgctgccttcgaggtgactgccttcaccggtagcagcacttctcctggttgtcaccatctgaaaacccacacagaaccagcaaacagagagagctgacaattaaagctaaccacccacgactaccataattcttgaatttattactgctattaaattggttcattaaggttcaagttgcttaagcaaataaaataaagacatgctccgacatagttataccacacaccggcataaccatgccctatatgactctagcagaaaaacaaacgagaagaacacacgcgcaagcctactaactgctcgtctactgctacgacgggccagggcggaaggtgagcagcaacgcatcctctgtgctgccaacgccggaggctccatcctcctgaggaacaacgggggcgggctcggcacgaggggtctcgacgaagcaggtccacgccagggactgacgaacaagctcgggcctggaggtactcttgcgggcggtgatcttcaggctgcggcagacgcgacgacgcttggggcgatagacctctccctgggcgatcttgagctgatgcagctgcgcctccactgcgtctaggtccttcttcagctgcagattctcctgacgcagctccaggatcttcatgttgttctcgaccaacccgcgacgcaccatctgatggaagtcgatacgggccacgtcgtacgcctccaccatgcgcgccaggtgcatgatggtagcgtcatcctccgagctagcatcccggaaggtggcgtagtcgcgggctcctccgcgacgagggtggtagcggtagggcgagtgctgcaactcgtccgggtagcgctggtgaagagtgccgatggcgaggagtgcggcgttctggcaagcggcggagaaggaatcaccacccgcggtgactgccaacgaagtcctctcgggtgagccagtgaggatcactgcagtaacctcccaagcagcgtggggctctgcatcgtcaccctcttgctccgggagctgcttgccctggtaatccactccatgcggataccctaggacaacgcacatgccccgtagctccaaaacgaagccagtcaggtccagaccacgacggttgatgctgctggccatctacaaacaaaaacaaaagagaaaagcaacattttaaaggttagattttgacgataaatgaagcagcaggacagagagagactagaggattttcacaaataagaaaggatttttattttgaaaatattgctaaggcttgggatctacggctcgtcctagtgtcaagggggctctgataccaacttgtcacgaccggaattaacccaacgggcgttccttacgtgcatgtattattccttgtcccaggaggcaaggtacaccaaaagttgatacatttcagagtttatcaaacggaaccgtaaatagttaatttattacatgggcggcgaaggcccagcacacacaaagacaaacgagaaacagcggaagactagggcgacgaccacaagcgcttgacggcaggcacgagctagacaccaaagccttcatcttccaagggctcctcttctgggtttgggaaaaattgagcaagactgagtacaaccaccgtactcaacaagacacacccacaagtgcaggataaatgcaagggagtacaagggggttataatataaagggttagggtttgcagtaaacagcattaaaagacacttagttgctcaaagctattttgtaaacacgattctagagctatacaatattattaatcaaggtcgtgaacccacacgaacctgccttaacccaaggcctacgatgattcagaccgaactggcaacccgaccctgggtcccagctcgtcccaagccaacccaggccaaccattccacattttagttgttaagcaggttttaagaattaaaacactaacttgggtacattgctcggcttgcccataaccgagggcgcggctattcgaatagattatactctgatcagaggtgtacatctttacctacaagacacatcttcctcacgtgtaaccacgtcccgcataccaccacggtatacggacggaagacgtgacatagtttccaacccatcctagccatagacaagagtaccgacccaatcccacctacggccggaacccccgggacaggtaggcaggactgagccccttgcagcaggacaccggccctgtgccatgacatctcgactaccgggccgcagctcgtgtagccttcatttgtcctagagatgtccatcgacccccgacttcgtccatctccatccgtgtacttttgtttataaccagactaagccacaaactaagccttacccactagacatgtggaagtacggtagtgctttgcaacagaggcccgaagaccggtccttatatggccgaggcgctactatcaaaaccatgcaccccgagcccagcctaaaaccattttgaggattttgaatagagggggaggtgtgaatccaattccacaataatccaaccattccatactgtccaggtgatatgaatattccaaagtctagagttgtaaaaccacctaatgttgcctatttaaccagcgaagcatctatctaaaatcatactagtggtaccgtgagtagagtgtccactagttggggttttgtttattctagggtgaacaaggaaataataacaataacaataataaggtcataacaaaggtaaataggcatggctagataaaacagtgataacgcgggaatttaaataaagcgataatgcagtaatttaaatcaacataaatttataaactgggattcaatatgttcaaggatgatgtgacttgccttgctcgctttcccaaccgtcggcttcaacttccacgaagagcggatcttccgaagctgcaacgtctacacgaccaacggaaaagaaaaggcttttactctaataaactccatataacaagcagcaacaaagcacaaaaatgggttcatgatttcttaaggaaaaattagagacttgaacggtccaattccgagttcaaatggccaagttatggctatttgaagtttatatgctctttaagtgaatatttgcgaatttcttcatttaaattttaatttaaaaaaaaagtttattgcgtcagccgagggagagggggcgcgcggaccgggtccacgggagtggggcccatgcggcagcctcacggtccacggtggaccgggcgcacccgggctcgcaccggccggcgccgtgggccccacgcgtcagccgcacccgagggcgcgggcggctgacgaccgggccccacgcggcagccgctcggtgcactcgaaggcggccacggcggcgcggccggcgggaggcggcgcgcgcgcgcccctatggtcgccggcggcggccataggcacggcggagcggcggccgagagaagggagggaaagggggaaacgaggcggtggtccacggctcaccctaggtcgacggcgacgacgaaaaggcggccggagcggaggaaggcggcggcgcggctcgggtcgacggggacgggggcgctccggcggtcgacgagcgaaacggaggggtggacgaggtcgacgaggatgcggcgaagccgaaggaggcggcgccgaggtgggaggtggtccggggcgacgacggcggcggaccggagctcggcggcgacggcggagagagagagcgacggcgcaagctcgattccggcgaggaggaagggcggcgagaggcggaaacgaacggaggaggtgcggggagggtttatatagggttggaagggggagagggcggccggaggggaaggaaaccggcgcggcgctctcgggctccatcaatggcgccggcgggattaggggagggtttccaaacgaatccaagggagagagggagggaaaattggggggaaagagggagggaatcctggggaataattcccccctattgattgcacgcggggaggacgggggcggcgggagtcgcggcggcggcggcgctagggcgcggcgaggcggcgggagcggcgggaggaaggggatgacgggtgggcccacccgtcagcggcgcgcgcgcggggagaggccggatgggccgcggggagaggagagggagggggagggatatgggccgagccagcccaagagggagagggagggaaaggggactttttagagtttttctttttataaaatcattttaactttgtttatttcttaataattattatttgtgctctgaaaattccactaaaatttatttacgcattttaggcttttaggaaatatacaaaaatcctccgagccttatttgacttttaactttgcacattttaattgttggaggctttcacatggattttaattattctaggcatcatttaaaggatatattttagagtcgttttgggacgtgacaaagcaacacccacgggggaaatcaaggccgacaacaccatcaaattcattaaagggatattttgcagatatgaattgcctcaccgcatcataacagataacggttcccagttcatcagcgccgatttccaggattactgcactggactgggactcaagatctgcttcgcctcggtttctcaccctcagagcaacggacaagtcgagagagcaaacggcatagtactacacgggatcaagacccgtgtctacgacaagctcatgtcacatgacaagaagtgggtcgaagaactcccctcggtactctgggccgtgcgcaccacaccgataacgtccaacaaggagacacccttctttcttgtgtacggctcagaagccatgctccctaccgagctacaacaccagagtacacgagtacagaagtactccggcgaggatcagaaggaacagcaaaacgacgacgtgaacctactcgaggaacctcgagaacgagttgccgtcagggcagctagttaccaacaagcccttcgccggtatcacgagaagcgcatccgagcacgcatactttcgatcggcgactacgtcctccggcgagttcaaagccaagcagggcgaaacaactctcacccaaatgggaaggaccgtacacgatcacacaagtcttgtggccaggcgcattcaagattgcagacggtgatggtcgcgagttagaaaattcttggaacattgaccaattgcgtaaattctatgtataagtcaatagtatccatacttgtaagacatcttacgacttcaataaagcctgtcttcaggtacagatttcaatcaaagtgtcccttcccgatgatccctcacccagatcacacctagtgttgaaactgatcctcatgtctctttacgccgtcttgacaagccctccaaggaacctaaggaacttctgctggagacgcctagagctgataaggccttgtcggatcctttagagacgaaagaccatgtaagatcctggccgcatgcttggaggggatcgcctccatcgccgtcgccagctccgcgagcgaagccgtcagcgagaactcgtcagggttcgccgggatggtggtcttaacaccacactccccgacgagctggtgtaggccggtgtaggtgacccacagcgaaccgcggatttccgacaggttgttctcgagttccgacatgcggttcttgagcccctgccattgccgctcgttgccggccaccagctccttcattttctggaggtcctcacgaacctccgtcaagtcatgcgccagcttgtcggcgcgtttgttcaccgacgacgctgccgccgccctcgcctccgctatctcgcgaactatgccgcgagcgccggcctggaggaggcgccccatctcgacttggagctcctcccaggtgaggacgtcagcaggagggcctcgagcaggcgcaagatcgccgacagggccgctgggcgtcgcctcacggctcctgggcacgaccacgacatctgtcgaggccacggccggagacgcgctagagttccctccagatccatcttgcgctgctttcacccgcgccgccctatgaaaggctgccatcaagacaggatgcgagagttcaacgaaataacaaaacctcgaattcatccacttacttctcaccaagcgtcacaagccgctgccgtcgcggaggtggcggagacgcatccgaggcctagagtaaaacgagcatgatgtgaggtcaaggttttccaactacgcgatgaaggaccatgagagcttaccgagggggtgggcatctttcgacgatttctgagcacggaggagaacatcctccctcttctcggaacgttgctgccactcgttgtgacagcagcggcagcaacatcggatgcctccttggcaatgtcctccttcagcgacgccgccgcctgatggtccacgagcggcccgatgatatcagtcagagggagagcctgcactacatgaagtcacagtgcgatcccggaagaaaaaggcaaaagggtcgctgagtacactcacgttgattacggcttcgcgttcggctgcccccttcttgcaaagagggacagggacgttgctcgccgttgaagggccgctgatcacgacttgaccgacgcggcgctccacggtctcgccgttcaaacctgtagatcgagaaccaaaatcgataagtcaggaggaacacacacttaaggagtggagtccaaaatactagaaaaataccccgaggagaaacccgagtcacatcctccagcccagaatagtcaaaggctggatgggctcgagcttggagcggctagatccgcctaccaatgaagtcggcggcgacttcataccccgacaaccctcgcactcggaggtcatcgatgacatcgataaaagactgaagggaaggggttaaggtgggtttggcggtccaagacgaaatcttgtctggttgttcctcaggaacaacaatgactggatctgaattttctatctgaagatagaaccacctcgcccgccatttactacgagaagaggggcactagaaggggatgtagcgtgacttcaggccatcctgaagtcggaaaccgacgcatccagataccctgttggattccatccaacgcaactcatagtagaagcgaaagaggtcatgaaacggctctaccccaatgtaggcctaacaaagatgagaaaagatgatgaggaaggcgatagaattggggttcaaatggagcaaggaaagaccgtagaaattcaagaccaaaagaagaaactcggagggaggaggaagaaaaccacagagaatatagtcctcaaccgcaaccatgcggcccaggacaggttcaggttcagtacctcctggttccctctccatggtcccgcgaccagggagagcgccttcctcctgcaacttcttcagggacgcgctggtggaagtggacttatcaaggtccattgccgtcggagatcgccggagaagggaccgagatgagcaagctagggtttgtgcgggaatggagaagacgaagagcacttggaggcttgaaagttttttcgcaacaggcagactccaaaatggatccccaaaactcccttaaatagacgcactaccgacgatgcgaattccaaggaaagaagagagatgcccgccgaaaatttctgggtctgttacccacgacagtttttggacttcaatttaaattcactcacgcccattgaatttcacatagcgttgtcgattactccttgtctctacgatcttcacgccgagatcgactagtcgagaatgacaataaccccgacatcggaagtcgcgatcggttatatgagttcatttaagcagaagtcgggggctactgtcagggttacggataaggtataccctctacccttggatatacgctttacatctgcgcgtgtacggacgtccactgtatgttctaatgtcacaccctaaaaatccaaaatatataaattgttgtttaattggaattattagaatttattttaaaaagcctagaagagaagatctaattttaattaataaattccaatataaaatggggccagataaaatttcattaaatactttgcttaattctataattcctagatttttctgggatttatttgagctaaggaagtattttgaataaatggaattgcatttcatgaataatttaaattgaaaaaggtttttaaaagtctctttttgctttgggccgaaagtcggcccaaaacccctctctttttctctctctcctcggcccaagccggcccgcaaccgagctgccgctctcctctctctctctcccgctgacaggtgggccccacctgtcggactcgtcgtcctcctccggccgcccgccgcccgaaccctagcgccgcgccgccgccatctccttccaaattcgctcgcgcctttccttctccggtgaaatcaatagaggggaaatgatcttcggaatcccctctatcttttctcttatggaatcgtcggctaatttcgtttggaaattcgcggattcgagttcgattcagatcgatctctctcctctgaaccctagaccttccttcgccgtcgccggtcaccgtgggcctccgacgctgccttccaacccctttaaaaggacccccaagtccgccgctacccgtcgccacccttgccttcgtctctcgtcgtccgtagcgccctagccccgtgagacctcgcgccgccgtcgtcgccgccgctccagccgtgcgccgccgtcgctccagtcgtcgtcgtcgctcgggaaggtcgccatcgtggtcgccgtcgcgtcgccgtcctcgtccgcccctccgccgttgctgtcgaccgccggaacaccgccgtcgtcgtcaagccgaaggtcgccgccgcttcttcctcgacgccgtcgccgtccgttgatcttccgtcgccgttttggtcaccggtgagtttgccgtgccgtccgctacccgtaggtgctctccgttcgcgccgccacgccgtcgttcgccggtgagcatgcgcgcccgagccgccgccggtggtgacgtcgtcgctgacgtcatcgtcgtcgtctctcgtggtctggccgtggaccgttcgatctcggccgtccgttttggataggatcgatctcggccgttcgtttccgtgagccgccgccgtgcacccggtccaccgcaaaccctagccgctgacgcaataattcctttttcctgttcaaaaataattcattattgcgtcataattcaattaaaatccatataagtgttttaatctgatttaatctttaaaaattcataactaattcatcttagctcggatttagttggttcaagtctctaaatttttctaaaattgagatctacatgttaaaaatatccacatgtactgctcatgcttgttattgtgctgttttggtgattttgctccattctgtttagattccgatgtttccggagagtccgttttcgcaggagaagaatttgaagagttccaaggccagcaaggcaagtcacacagatcccaaacaaccctttgagcatgttgatcccgtttaaagctactgtttctattcaactattgcatttatttttgaatgtcattgggtggaattaacctattgtttgttatagccctttttgttcttgattactttactccttgataccttgggtgattataacttgactagttgggctatatatattggttcagctagatattagatatgattgcttagccatgcctagaaacattagcacactattgggataacttatgattcactattatttaatgatggcttaatgatagttcacgatggtcaatcgtgattggttaattaattatttgccaactaaaacttgataatggtgggttgtgagcacatggttttgagagtcgtgctcatgacaattaaggaccggttcacgagtttcggttgtgaaacattaaccgtgccaaccacaagccagcgtgggcaacggctttaccttttgtatagcatggttcattgcggagcaccagactgagaagtggcggagataagcccacgggggtcgctggggagtccatgccttgtttataagggggtgattatgatccaggaatggtgcgctgtggtggattgtgttgtgcgaggggtactatcacagctcctttccgaggtaccgtggtggtattgaggcacatggtgacatgatgtggggctgtgtcttgtgggtacagtggtacacctctgatcagagtaaaactattcgaatagccgtgcccgcggttatgggcgggtctaacaatgtctttcgtgattagtttcacacttctcatcataataaaagatgctataactgatagtaatttgattagctcctggtttggaatggtatattcctggtttggagatagaactgtgcagccgggatggttgttcagaatggttgggcctatgcaacagggtatgttgtatagcgttggattaatattgtttaattatcacttaactgttttattaaattctgaaatgtttattaaatgctgtttatgcaaatgaaaccctactatgccatcctttgttatcctgagcacttgcatatttgctgcgtggcttgctaagtatgtcatatactcaccttgcaatcattcatcagaggaagagttctacagtgatgctgatggtgtggaggattaggtgtagccttggtcaagctgcctgtggagtggagtcgtctgcgccgtttatcttattttccgctgcttagatctttattgattgagaggaactatctacctctgtaatgacattttattcgcttattaattagagtaataattgtactctattatcaatttgttattgtgtgcctcggctgattcctggacgagggttcacacacatgtaagcgtttggaattttggatagaaattccgggcgtgacagctaaggaaattcatcatggagtccatagatggagagattcctacttggataggactgggttgtcactgtatcgtgtagggtccgatgtctccgagtcctacttggagaccacctgatctgcggtataaaaggtaccccccgggagaacctaaggcatcgaatctcagaactaagaccaccacagcttatgaagacggagcctacaggagccaagtcgccgggtgatttagtcgaaccaactcaactacgatctcgtcggtatcatcgagttctgttattccctttgtaacttgtggtttccattatataatcccataccaactggattagggctattacctataaaggggcctgaatcagtataatctttgtcttctgtttccttgatgtcgtactacgtagatcctcgtaccagcgtaccccagtaccctctatatccggtctacgggtatcccccgtcgacaattgtgccgatgcattatttatcacaaaatttatttttagataaataaataaaaaatatgtatttactttttaaaagaaagttattaaaaatgaggagcattcatacaaagttaggactaccaatgctcacaatatgttttttatgaatgctgctgatcaaaaatatccgttgtcctattaaaatttcaaatataaaatttaatttattacatttgtttatttttcataatttatgtcaaaattttgtacactaattatttagtctcattagtttcataaaatgcacatactatgcacttgaacaaaaatttcaatcgtttttcaagcatatattcaaacctaaagcatcaagagtaaaaatgacatttgcaaccaaacgtaatagtgaaatgatggaaaatgtaacggtaggggcatggaagggatcaagttgaaatttcagggatatagaagggatcaggtaaatttcaggggtatgaaagagattgagtgaatttttaggggtatacagggaatttctcataatatgaatgatatattggagtaggaagatagatacagaatgatctattttggatgactattcagaccaagatatggagtaccgatactctagtgtgtgatatggagggtaaacaaaggaaaatagtataattataaacagtgttccttgttatgaaatctatcttattgtggatgaattaaattatgaatgcgaagcttactacagaagaaagcttacgccagaagccaacttacagaggaagccagcttacggcgcaagccagcttacaggagaagcccgcttacggcgtaagccggcttacaacgcaagccagaaggtccaaggcttacgacgtaagtctccaccctcctccgcctataaatagggcccagaaggtccaaggcgaggacaaccgatcttcggtctcctgcttctcctcttatagcttgtactcaaatccagaagaaataaagcttccactcactcatactttctatgttcaacaactctgtgtttggtttgcttgtgtgctgatcagtagaatagactggtttctcaacacgttatcagcacgagactctaccgagctaaaaaggtaaacaggtgagaaatcagtttctactgatcatcttgctctttatatgcaaatcattcttctgctatagttgaaataagcagaagagcatggtacctgaagtaccatcccccgatattatctcaacgatacacaataacatcatggcggctctgccgccattatcgttgaattgctacagttgatacatcctctcagcaacgcccggtaacatgatggcagctctgccgccattaccgtccaaaggcttgagatggtacatccccttagcactatttgataacacaatggtggctctgccgccgttatcgtccaaatggtaggggcgatgtaggtgcctgaagcaccggcatggcaacttggacggctccgcggccgttgccaccaaatatcggaggcaaacgaaccttctgcacgaccctgaagtgtcgttttggatgtcctttgttttatggacatcacccatatgggcccttgatgccactaaggtcggctctgccaccatgaagcatgggctcatagtggggaagtgctacatggtttatcttactttttacagtctgcacaatatacatgaagttgtgcccatgtatactcttcgttttgttttacatgcttactttgttgtttgcatgtctttcataacatttattttattgttatgaaattgatttcctagcatgattgataatagttaatcaagcaatatgtaatcctgaagattacttaagttaatttgctaggaaagattctatgggaaactgtgtgataatcctaaagattacacacactagtaatcctgaagattacgcatgaccaattcatgtcgaccctgcacatcgtatttaccagtcgtaaataccaaattatgttgcagaacatgtcggacataacaaagaaggaattcgccgagcttgccttggatggtagtaactacctcacttgggcattggacgttgagattaaactcgactccattggtctcgatcatactattgtgctgcccgaacttggcactgtggagtctacgaaggccgagaaagcaaaggcattgcatttcttgcgccaccatctccacccagacctgaagtctgagtatatgaccgagaaaaatccactggtattatggcaatccctgaaggatcgctttgaccagcaagggtcaattgtgctcccacaggtacaacatgactggatcaccctacacttccaagactacaagtctacggcggcgtataactctgccccccataggatcatttctcagttgcgtttttgtggccagaagatcactgacgctgagatgatcgagaaaaccttatctacctttcatcccaacaacatagtgctgcaacagcaatacaggaactcaaagtacccgaagtactctgatcttatctcagtcctgttagttgcagaaaggcagaatgaagttcttctaaagaatcattctgctagacccactgggtctatggcagtgcctgaagcacacgccaatgttgttggaaactcgcgtggccgtaaaagaggccatggtgagaagaaagggaaaggtaagggaagtatcaaattcaagggcaagagcaagggtaaacccagaggtaaaggcgaactcaagaaggttacaggtgaatcatctggggaaaagcaggataactgctatagatgtggaggcagagggcattggtcccgtaactgccatgtccccaagcacctggttgagctctaccaacaaagcatgaatgagaaaaagagccaacatgagtcccacttcaccattgagcctgaagctcagattgaaaagcatgatgacatgcttatcaatgttaaggatggtggggacgtccgtatggacgatgattggaacaaccttcttgaaaaagatgataacatatttggagacctgaagtaatctcctatatgtcagtcatatgcagtgttccgcatgagtagcacatgtagaactttggtcataaataatgctcctgaagagcaagcttagtattttactgggcctgaagtccttgtaatgtttcccttaatagaatcaatttactccatgtttaatttcatttatgtttatgttctataaacagaccttatgggaatcccatggcagaagaggatatatgtctagtagacaatgccaccactaacacaatcttaagggaaactatgtatttccacaccttaactaagaaaactagaaatattatgaccattgccggaagcaatgctcatatagtaggcaccggaagtgctactctagttctccctatgggtacccatatctttgtaaaggatgctctattggatcctgattcaaagcgtaccctcttaagctttaaagatatccgtgcaaacggtttccatatagaaaccgagattgagcaagatgctgaatatctgctcataagaaaaatagatggatatcaaaagcaagtggtggaaaggctcccttcattgccatcgggtttgtactacacgtacataaaacccactgaggaatatgtggcgatgaagaccatatttagaaacccagagtcatttagagtttggtatgacaggctgggtcatcctgggttgggtatgatgaggagaatcatcagcaattctgctggccacaatgttgaaactaatgacttccctaatcctgaagattttatttgccctgcttgtgcaaaagggaagttgatcattaggccatccctcctgaagattagggatgagtcacctgttttcctggtaagaatacaaggtgacatatgtggacctatccagcccctgtcgggcccggttaggtatttcgtggtactgattgatgcttctaccaggtggaccatgtggacctgttgtccacaaggaaccatgcttttcaaagctaattgcccaaatcatcaagctaaaagcttgcttccctgatagccgcgtacaatccattcgaatggataatgctggtgagttcaggtcgaaggcttttgatgattattgtttagccatggccatgggcattaaggtagaatattcagtaccacatgtccacactcaaaatggcctagctgaatccttgatcaagaggatcaagttgattgcacagccactgttgcaggattgtaggttgccaaccagttgttggggccatgctgtgttgcacgcagcaacactaatccaactcaggccaactgcatatcatagtacatccccccttcaactagtgcgtggaaaagaaccaagtatttcccatttgcgtaatcccaccaccacagcgtacttctatgggaccccaccagaagttggggatatacgttggttatgagactttgtccataatcaagtatcttgagcgtatgactggggatcttcatatggctcggtacgctgattgtatctttgatgaggactattttcccagcattagggggagaaaggcatccagaagaatgccgagatataatatggaatgcaactgggatgcagtccttagatccacgcactagtgaagctgaactagaagttcagagaatcataaatttgcaaaatattgtaaataagttgccagatgccttcactgattacaagggagtgacaaggtcgcatatacctacagtaaatgcgccggaaagagtagaggtaacccagaaggttactgactctgctcttaccccccatcctaggaagatggggagacctccagttgaagaagctcaacctgaagttgagaaagccccagaagaggcaactcaacctgaagttgagatggtcccagaaggacaccatcctaaagatggagaacccagtgccttacgcgcgtaccttggctctggaagatcggaacactccaactcggtcgttatgggaaatcacgatgagctggaggaaataaatgaggagatttccactaattgttctgatacaggagagttacatcatagaaagaccactatcgtcgacattcactttgcctcaaagattgttgtcataatggatccagatccagaaccaaagtccatgattgagtgccagaagcgctcagattgggacaaatggaaagcagcaatagaggcaaagatgcggtcgctttataaaagagaggtttttgggcctgcagtcccaacacctccaagaatcatccctgtaggatgcaaatgggtcttcctccggaagaggaatggccaggtggtgaggtataaagcaaggctagtggcacaatggtccatgcagagacccggtattgactatgatgaaacttactctcctgtgatgagtggaatcacgttccgatacttgatctcaatggcaactaatatgaacttagatatgcagttgatggatgtagtgaccgcatacttgtatgggtcactagattcggaaatttatatgagggtccctgaaggactcaagattccgaatccgaaaggaaatcgcaacatgtatagtgttcgcctgcagcgatcattatatggattgaaacaatccggaaggatgtggttcaatcgattaagtaactatctcctgaagagaggttacttaaacaatgatgattgtccctgtgtgtttataaaatccctgagatgaaggacttggggaaaaccaagttctgcttgggcctgcagctcgagcacctccctgaaggagtgttcatgtaccagtctacctataccaagagggtccttggtaagtttaatatggataaatgtcatcctttgaaaacccccatggtggtctgatccctggaagcggataaggacccatttaaacccaagaaagatgatgaggaaatgttgggacctgaagttccctacttaagcgccattggagcactaatgtatctagcctattgcacaagacctgatattgctttcgcacttaatctattggctagatatagtgcaaccccaaccagaagacattgggttggcgttaaaactatcctcaggtaccttcgaggtactcaagatcttgggttgtggttcccgaagaaccaagatccatccatggtgggatatgtggatgctggctatatgtctgatcctcataatgccatatcccagactgggtttatatttctttgtggtaatactgccatttcctggcggtctgtaaagcaaaccctggttgcaacgtcaaccaaccactcagaaataattgctctatatgaggccacacgagaatgtgtgtggcttaggcggatgatcggtcacatccagaagtcatgtggcctaaacattgataacacccccaccattatctatgaggataacgctgcttgtgttgcacaaatacatatgggctatgtgaaaagcaatttcacaaagcatattgttcccaaattcttttatccccacgagctccagaagagcggggaaataaatgtcctgcaaactaagtcatgtgaaaatctcgcagatttatttacgaagtctctgccagcctcaagtttccacagatgtgttcgtggcattggcatgagacgacttagtgaattgcaaggatcagggggagcaaag

SEQ ID NO: 62291 - DNA, 2941 bp, Oryza sativa
  unsure (1)..(2941): unsure at all n locations
ttgagtggctgcccatcatgtagagtttgaggcataggtttctgatggaggtgtctctctgtggcacagatagcaaactcgtagctgctttggtgagagctgacatagcttgatccatgtgcacagtcgttatgctactgaacgctggggcatgtaggaattctgcaacatccaaatccagcttagttaactaccaaggtaggtgcctccaccgcgttgacagggcgcttgtctttgcaaccgtactaatgttgagtctcgccaagatatccaacaaaatatcgtcaggtagattgctgagcctatcgccctcctccgcttgctacaataattagattacacaaaatatgttagtggcttgaagcattaaaactctaaagaatactccctctgttttttaatagataacgccgttgactttttcttacatgtttgaccgttcgtcttattcaaaaaatttacgtaattataatttattttattatgggttgttttatcactcatagtactttaagtgtgatttatatcttatacatttgcataaaattttttaataagacgaatggtcaaacatgtgagaaaaagttaacggcgtcatctattaaaaaacggatgtagtacttataattgaaaccaagaacttacaaaggtgtgtccattatctatctccatgtggaatctgacttgccttctgcagcgaagctgctatgttgaaagcccaaagcttacgacctgacttttttatgcagcaacgaagttaagagccctttatgcgcntaggaagccaagaaacncaatgctngtgtttgttgttcatgacaaaggttcggctgcccttttgtgggggggacatgagcattgagagtccgactagaataatgatatgcccaagggctcccaaatattcccaaattttcttggttccaatagtcgccgccgatccgacaatctgcccctggaaatagcacactttctcctcggaggaggcaggagaaaggatactcaaaaataaccgacaatagtatatgaaagcgagaagatgagtagagtaaccacaggcgagcggcggcgtaccataccgtagttcggaaatcttagcgtggtagacgccgggcagggtggtgacgggcggagcggcggcgggcgcgcggcgggagatggggggattggcgaccgacgagcctaagaggaaggaggagacgaccgtcgggagatgggcgaggggagaggcttcatcgtttggcttattcatatatttacataaaaaaaataatttgtgaatacaacttttatatacgtattcttaacgatccaaaagtagaggctaaaaaataaacttaggtgaaaaaaatcccaaaaccaactctaaattaaatgttaaaaatttaaattttggctgataagcaaaagatggggctggaagtgcgaccatgtcgcacacacgggccacggcctcctgacctcaacaagggaaagcggagatgggccgatggctactcgtcacggcccataaaagctcgcttgttttgggccccatatattgggccgggcatcctcagatttctttttctcagagaaaattctgaccggagaatctctcgatcaacagccaacgtggtaactcaccgtgcaggccggaccgccagcagaattcctaattcccgcgtatgcgccgtcaacgcgtacttccggcccacacacgtgtttctttttctcttttttttttggcgcagttaatgtttgcagtgtcataattgtaaatcccccatttgctaccgccatgtttcttcctttttttttcacagttcgatgtcgcacgggtaggagaaaaaatcataattagtttactagtaatttttaaatcttaacttaaaaattttcagatttggtcttgaaagttttcaaatctcgagttgaaagttttcaaacctcgagttaaaaatttttaaatctcaagttgaaagttttcaaaattttcaaatctgaacttgaaagttttcaaatctcgagttgaaagttttcgaatctcgagttaaaaattttcaaatcttaagctgaaagttttcaaaattttcaaacctggactttaaagttttcgaatatcaacttgtcaagttgaaagtttcaaatctgagttaaaagttttcaaaatttgactttaaaatttgaatcttaaatcaaaagtttcaaatttagtttaaatttttgtcaatctgttaataaaaaaatctaaaaaaaagataaaatctttaaaaaaattcctaattactgttattaatgttaactaatagagatagttaagtgggaagtgcgcgctagcggcacactcgcctgctagccactgccactgccacagtgcaggttgcatgacttgcatcccaaaaacaaacaattaaccaaaaacaaaaaatcaaagcagtatagggagatggtgaggcagctttcggcttggacacttggacgtatacaccaccgactggctccgtccatgcttggctgctctgcgccgttgcctctctcatctttgaagatttgaagaggatgcaggcaatgcagctcgagacgaagccaaaaacagcgcctatgcaatccaagcacggactctctgtaaaataatacacactcacactactagtagtatactaccactacggtatactactatgagacgacgacgatggtaaaatatcataattcgataacgtactactcaaagtcaccaggttttttcttctctcttttttttgttgatgttttgtccacaaaccaggcaatacaaattccaatgttctttttgagaaacttcaccagttacggtggaagaaacaatcaacaataatacaatgtgaccatatatataggtacatggtacactaaactcagtaacagattctgcgctcccgcgcacgatacagccatacagtgcatcataaaacattac

SEQ ID NO: 62292 - DNA, 1846 bp, Oryza sativa
tgatcaccctctgatataacaagtccagagaagtcctcatttgcccaatcagtggccattacatcaccttcctcatcggatgatgcgtcgtcgtccgcttcctcattatccgaatcttccctctccatttcatcaacaattatactgactctctccccctcatccgccatgcccatagcctgctcctcccttggttgattttcctcattttgcatcgatggtccaacaacatcccctgcattgataggaccctctacatcttcggtttgcattgaaacatttatatctttctcttgtaccgacacaaatataacgaggggccatgaccgttcaaaagccatttccacataccgtctccaagcatcagtgctgtccatcggcattagttcccaaaaataaccttctgttgcacgactcactacaactgacactgacattgtgtagacttcttggtctattctaaatcctctcaacaaccaactataaattgactgaaatgttctctccgcaggcctatcgatgcccttagatgtcattacaaaatctgacagatcaacaccatctggaccaaatctaatatttccttcaccgtgaactatctgaaatgtgaccttacttgacattgtgcctgatgaaaacaataactgcgttaacctcgcatttctgtactacgccctaagttacattctctacaatattgttctctaaatttctaaaattacgttacattctccagatcaaactaaactacatcttacaattaacactactgtctatgtctcaattcatactattatattctatgctctggatctacacatatgtgttgtgtgctacagatgtgctaaaatatatggaactaaaactaaaacgcaacatatatactcaaacataacatattagtacaaatgcaaaagatgtatgggagcatacctgtgatgaattgagcgaaccagcagggcttcgccgctccccttctgctgccctcccctctctctctttcgtttttttggatttttagtgaatataatgaaatttcacagaggagggactgggctttataggggggaggcaaaaatcgccctcccccagggcggcaagggggccgcctgcaaaattccatgccccctcgccgcccatttgcaggcgccccccccccccacagtacaaaatcgccctagcggagggcggcaagggggccgcctgcaaaattccatgccccccctcgccgcccatttgcaggcggccccccgcacagtataaaatcgccctagcggagggcggcaagggggccgcctgcaaatttcgttgacggccgtcgcccgagagcgaacggccgtctgccacgtcattttcgccgccctctgagagggcgatttttcccagagggcggtaggcgactacttccgtcaattttcaaaatggaaattatttttgtaaaacttttaataaaaaaaattataaataaaaaaaattccatataggactactactcagcacaatgaggcccaggcaggctgacgaattctcgcgggcctcacacgacgtactactactctgcagcattctcatgaaaaaccttgtaaaattatcgtcgaaaccggttcggattcggtctcatttggaatgaaatgctcttatgaaaacttcacaaaaatttcattggaattggttcgattcccgcatatttggtcccatcatctagctatattgctgatgaaaactccttgttttcgaatcaccatctctctaaactagtgtaataatctgtactcatatagtgtagtactagtagtatatagaaggctaagctagaagtggtgatgcttttctaatattttcaagc

SEQ ID NO: 62293 - DNA, 833 bp, Oryza sativa
tggtttgcgtgatagagaaaacataggattggagaaaacgcgtgatttaaaatggtacccttctctaatcatatagaaatgaaacccatgcaaaaataatagaaggccccttaaatgccataggaaaaatgaagaaaaataataaagaaaaggtgagacctctaggtaattttccgattaaaatgaaatgtacaaatataataatatggaaagttttcttccttttccaagtttaatgtaagaaaaaatattttcactagaatttgaattctatgaaaatcttttgccaatccttagtagcttcagatcaagcaagttttgtttaactataacatttttagaacggaaggcttatcaattgaatgatcaagtaataaataataaatttgggaagcacccgtggtgacttcatgacaaccaaggttcaaatcctgatacacgagtcagggtgtgcatttgcaagtatatgagtgaggtatgcgtgtttgatgatatacacgtgcgtatatgtctaccgtacaataacgataaaaaagagagtaaaggtctgttcactttgatgccaggttgctaaaaaaaatagctatatttagtttgctgtcaaattttaataaatataaaagaaaacctaccaaaattttggtaactatactaaaattttggcattaaggttttttttacatcaaagtgaacatgccctatataacaaaatccttccgcgaaattcagttgaacagcatcgccatctctgcacaaaattcagcgaatcagcgagagaaggaccagttccaactccgaagtttacgcggtccacaaagaccaagtgcaccgaa

SEQ ID NO: 62294 - DNA, 1521 bp, Oryza sativa
  unsure (1)..(1521): unsure at all n locations
agaagaaagacatctgaatttgagttaaaaggacaccaacntaggtggtgtgctgtgcatctacacctctcagttttggttttaattcctcttcactcaagacttgtaattgtccagaaggattttattattaggaacaaactgagactaacccttgtttgtgcaatcatttaaactcatcggtgtgctttgtttctgttttttttttctcttttcagctttgggtacaacctgaacaaaaacaattctgccctgcattcaacaatctaaagactttatctattctttgtgtttatgttgaatttgacctgttatgggctttaaacctccttgaagctgcgccatccgttgagctacttttcattgatgtaagttttcctttcgttttttcaaaatgtaacaacatgacagtaaatgtagctggaaattctcactatttgcaaaagatttacacaaaccaatttctcacactaaatgcagacctgggaacatatatgcttggtggaccaaatggatgaagagggaagaaaggatatctatggagaaagaacacatccttcatgggagatatccgagtttactggcaccagaaaatggcaattgaaaaaactccagttcactggctttaggccactcaagcaacaattggtctttttaaaggccatcatggagcaagctcgcaacctgcagactgttattctgaaagaggaagaaccatgcgaggactgtgaggcattaggcacgcctctttcttgtataaaagatcatgacttcccaaagtcgaaggatgagcaagacaatgtagtcgagcagctcagagagaagatttcttcggattcgcaaataattttccagtgtttgtaacatccccttcccaaattattttcctatagttttggaaaatgaatatatcctatgtacatccccgtgtacttgctacttgcaacggaggagttgtttgtcactgaataaatatctggaatttctattttagcttcatcctgatatccaaatacgtgtggaagtagttcaatgccatacgtactggtagcattaagaagaaccattgtaaatctaaccaaagatattactacctccgtcccaaaataagtgcagctgtaaatattcgtgctcaacgtttgaccgtccgtcttatttaaaaaatttgtgaaaaatttgaaaacatttagtcacacataaagtactattcatgttttatcatctaatagcaataaaaatactaatcataaaaaattttgagtaaggtgtattggcgatccttaaacttgtagggttatatcatatagttccctaaactctcaaaatgcatatccagatcctagaacttgtcaaagtgtatcatctgggtcccaaattaactcatcccctctaggatcctacgtgacgctgatgtggcaatgccacatggacgtgacgtgtccttttctctttttttcttcttttctttttagttttcttctcattcttttttttccttttttctgtacggtccacagcgaa

SEQ ID NO: 62295 - DNA, 889 bp, Oryza sativa
gtgtggcgacggcgatggtggaaccgacacagcgtacgccaacactcaacacgacgcggcggtgggtaatacgcagcgccagtgcactacgtacgtaccttacctcattgtttgctaaattttaatttcagaattgattttaaaatttttttaatgtagttttaaaatattagtttcctgaccacatatttacccctatattataacttataatcagctcttaataactaaccaatggaagagtgaatcactgtgcagtcgcagttgagtcacttacacaggacatttaaactatttgccacctttaatatgtgatgtttaataatttattactcacaatctatgacgtgcccttttacatatctacaagtacgtagtaaattgttaaatgtccacttacatataagccccgctctaacttttgtgcagttttcgacatttcctgtgaatattataactgtaaactgtgtatctctataactgtgtacaaggaagcctcacccaacaatggagttgtggttcattttagcaatgaagggcttttagtacttccaattctaacgcaacatattgaacgcacttaactgtatgaatatatcggacgcactcctacatcccgctgcgatgcaagtcgaccacggattcacgacccagagatccttttaacccctgactacaattttttgccaagattttcctgactcgtatttgcatacactcgaaaaacaatcgcactggttccaaggctaaacatctgcattcatgctctgaaactaaatctctttataaatatcaaatagagcactaatacgagtaaagctaaaagccgatatttcttatctacatgatgagactacgactagttcacggttgttgccaaataaggtta

SEQ ID NO: 62296 - DNA, 736 bp, Oryza sativa
aagcaaggttccagtatctaaggaaaagagatcccagaatgtatcaaagagtcaacgtaagaaatatctgcattgatctccataaaatacaaatatagcaaaaagactaatccagagaataaggttcattcaagtaacttacttgagaaatatggttgatgttattccggatgaagaggcggggttgcttttctaagactttgttcataacatctaggccctgagcaagtgctgttgcaggatccttggactgagaaggtgtcaaattcccaagcaatttctcaagataattaaatttaacattggcatttggccagacttccaaagcttgagtcagtagatcaagagcttgcttgtacattgagctagattccttatcctttggttcaatcaccagcgacacctgttcaatcaacaaaactatatgagtattcaagacctcagatcaaaaaagttctgctgaagacactagtaaggtggcacaaagtgatcaacattctcattatatcagaaaggttcacatgagaggatggaaccactaataggaatgccttgtcaatccactactgcaatcaaatgttacactgtgctttgtctcttttcaggagaaaaggcaagccaggccgcatgcctcaaaagcaatcacaatgaattaggcaatgaggcaccaacaacaaaagcaagtaccatcagaatgtccagtattattttttttaagaacattatcatgaaatct

SEQ ID NO: 62297 - DNA, 1023 bp, Oryza sativa
  unsure (1)..(1023): unsure at all n locations
ggagctcgccgacgccggcaaggtcttgcaggacatcaaggtgttcgtccagagcaacaggcggcgcgcgccaccgcctgaattgagattcgagagtttgatctgcttcgtaccgtacacgcgtcgtacacttcatatacttgagattttgaattgggatttctgtgattcaaggtgaaagtttaaggccgcagttaaaagtttcgtatgattttatgttgaaaactgtataatttgagtatgaaggttttaagttttcatatgaaagttttaaatttgaatttgaacggtttttaattcaaaaatgaaaaattgaggtcacagctaagtgtcatgtgaaagttgtatgaattaagatgaaagttgtatgatcatgcattgccaccgcgatgaaattttggcatttcatacgaagcgagtgtaagatcacttggctaagtttcatgtgttgaaaacatgctcaccccaacatgtcatagacttactagggtgttcgtatttgcagctaactatttttaccctttttttaatggtaggtgtcatacccgctttatactgaaagatgttggatcagtctttggagatgttcatacggatagagagtgggtttacaccggtgcagtccttggagatagtaaggagtaagtgtgggtacgtatgtaagtgtttaccccctccgtccaaataaaccaatcctaactattaatctggatatatgtgtgtccaggttcatttttagagtttgttttttttttgacaaattagtatgtttgtaccgtgtttggcaaaaataaaaaataaaaaaaaggcatttggtatagaaattatgtatgagtcgacgactcgtaagagtacatacctccaatagttacgcattcgggaatgtattttctacactcangtgtatgcatgtagtttaaatagttatataaaaatttcataaaatttgataagatggactacgataatataagatactacaaacatgtaagtctaaattcgatatacacatgaaaaacaaaa

SEQ ID NO: 62298 - DNA, 1087 bp, Oryza sativa
caatgcacggacatttttttagtatatacatatattgtcgacgttggatgtctcgactacggtatttggacagtatggggatcgttggtgctaggatatacacgagactgaggtaaaagagatggagacagggatttttatacaggttcgggcccctgagttgtcaggtaataaccctacatcctgttggccgaagccggtattgctcttattcactataatcacaccagtacaatatgtaggtagcctatctaactgttgtcgacatgtcggtctgaaggtctgactcgtagtcgacaacagggtagtcttcctcctcgaatccgtgcccagcgagatcagagatagcgctttcgtatctcctgacggtatccggagacactgtaggggaatagccatgcctatccttgaagtcgatatccggcggcgtgtcttggcgtatgtaggcttgtatgttgtggcttctagtgggcgtgtgttgattgtcatgggtgtcttccatggtcctttcatggtggttgtctctccctctgtcctcctaggagggcttgtatttatacccataggtgtccccttgtccaagtagaactagggaaaccaatatggatacaattcgagtagtccttgtcgtttccatgtagaactctggttgtctttccttatctggaactccctcgaggtcagtttccgtataagacatggtatgtggtggatcctgccgagatttagtcaactactattatgtatgtggtatccataaccctaacagtagcccccgacttcgatgcaaatgaacgaattcatattctcaaccgcgcgcagacattggagtaactgttatcgagctcatgtgaccgttctcggtgagtttagagataacgttgaacttcctttgtcagcctcgtgcgggcaccgaaagggtttgtctaagttaatctctgatgtcgactgagaaagtatagagcgtacgactaagtctcatgtcttgctgtaatcgagaatttggattgaagtcaagaaattttatctcggcgggtacaccatctcttcattccgtattccttgtcgagatccagcaaccattctc

SEQ ID NO: 62299 - DNA, 13206 bp, Oryza sativa
agaagtgaaagtagtgggagaaacgttacatcgctggtcgaggaccaggcagtagtcgtaactcgaccacttgaagcaaatgtacgagagatcactacgatcaactggttgagaaccggtgagtaggtgtccatcgatcatttggagtcgtggtacgaggaccgctacgctgccggtcgaagaccagtcgtagctgttcctcaaccatctgaagtcatggtgcgaggaacgctacgctgccgtagtcgtacctcaaccatctgaagttaaggtgcgagagattgctagagcagaattatctctcgaacaccaatggaagttgcggtgtgagagattgctacgtactggtgcgagaaccagtgagcgagcagaattatctcttgaacaccaatggaagtgctagagttggtttattgcaagtgtatctcatgtggccagcatgacttacgtacccaacttatagcatatctggatgtccgttcgcaatcatgtcgggtgatcaagccgacgacgttcgcgaggaattatccgttaacaaccttttctcgagtagtccagccatggccgatgctatgagataggtcatcggtctttgttggtaggttgggtgcgatatctccgcatttgtcgagaatgttctcgataatggagtgtactcgaccataacctactcgagtgctcaattgttcctgaaattattttctagaaggcaagacatatagcagataatatcgagtatgtactcaaaaactgtgtggatcttctagtattatcatgatataacgagcagattaaatatcaggcattatgtaaaccataaacaagcatgatttatacagaagagaacggagtgagcccctagcgttagaccatagttggcctatcatcggaagtactcgcacaacggatattgtataagaagcatgctctaggtaaacataataaattatagatctgacaatgctgtatgatctgaataggtacgataaattgcatataaaatattgcgtacctttgtagatatatgccggatatatctacggcattagtagatcaatttgaaaaatcaatctaccaattaccttattgcgtactcgttcgacatcatatgatctgacatcttttggtacgccgcggagcttgagggttggataatctcgatagaccaagttgtcgatgacgatgatggttccgatctggtcggaagatgtattttagtcgggttagatctcctcacagccgaagtcgtcgagtagcttgttgtcggagagtccatctcttaaacctatctcgtcgaaatcctagagcaccaaaatccccctacctggcgcgccactgtcgacgtttgatgtctcgactatggtatttggacagtatggggatcgtcggtactaggatatacacgagactgaggtaaaagagatggagacaaagatttttatacaggttcgggcccctgaattgtcaggtaataaccctacatcctgttggccgaagccggtattgcttttattcaccataatcacaccagtacaatatgtgggtagcctatctaactgttgtggacatgtcggtctgaaggtctgactcgtagtcgacaacagggtagtcttcctcctcgaatctgtgcccggcgagatcagagatagcgctttcgtatctcctgacggtatccggagacaccgtaggggaatagccatgcctatccttcaagtcgatatccggcggcgtgtcttggcgtatgtaggcttgtatgttgtggcttctggtaggcgtgtgttgattgtcatgggtgtctttcactttcatggtggttgtctctccccctgtcctcctaggagggcttgtatttatacctataggtgtccccttgtccaagtagaactagggaaaccaatatggatacaatctgagtagtacttgtcgtttccatgtagaactctggttatctttccttatccagaactccctcgaggtcagtttccgtataagacatggtatgtagtgtatcctgccgatatttagtcaactactattaggtatatgtggtatctataaccctgacatatatatatatatatactgttatacacatacgtatacgcaggggcgaagctacagccattcataggggtcagttgaccccgacgatgtttcacgaacctctcgtacctctctttattttaccatctatgaccccagcgaacagaaaaactagaccccggtgattttgttgattgttccgtcaaagccaaactagcgactgggaacgatactaacaaacaacaaatagaaaatttgctagcacttatgatttatacgtgagcccaacatacatatacgatagagatttgggtaaaaaaaatccacaaattctcttgttgcgtcatcgtattccttcgatcactttaatttgtcctgctccggcgctgcacatcttaacatcttaattatatcatcttatttctagcagaacgaaaggcaagaaattagtggatttgataatctttggtgcatttggtgtctttaacaaattaataatgtatactccctccatactggtaaaggaagtcgtttaggacagcgacacggtctccaaaacacaactttaacttcttgtttctacaaaaatatttattaaaaagtgatatatgtatacttttatgaaagtatttttcaagacaaatctatacatatattttttacattttcaaactcaagagagttattcatgatttatattcctaaggtttgactaaacgacttcctttatgagtatggagggagtagtttttaacaaatttgtagacatttcattttatcataatgtatttcattaattttgttttgtattatatatagtcttagatcattaattacaaactagatgacatttccgatttagtgttggattccaatgtagcgatatgacatttttcaccaaattttaataagttttgatatagttttgtcgtgaattctcaaaaaacattcaaaactccgctcagaatatacttttcgtcccacgtcgaaacatcaaaattacatgatttttggtgggttttggtcgaaaacataaaccctggttaatactgaccccggtgaccatttatcctggcttcgcccctccgtatacgtatattggactgttggactggaggggcgcgcatcagccacccccgacggtgaagcggcgtcctgactcctgacactcatttggcagctacaacctgctggcggccattcatgtcatggtcatgggaactgggagcaggtgggcagaaccagaagcggagcctgtcgaggcggcggtacttgatgccgacggtgagcacggccatgacggcgccccagatcaccacgtccatggcgagcggcgtccgcgactgcgacgtgatgaacgtgagcacgaggctggagtaggacaccaggaacggccactgcacggcgcgcgacctcgacggcacgccggtgagcagccccagcgtgagcagcatcgagctcccgaacccggcccagctcgctgccatgaacagccagtaccgccgccggttcttgtcccgcatgatcgggtcgccggcggcgtggctcccgtcggcggcgtcgtcctgccagtacccgcccgggacgttcgtccccagctggtacgtcagcgccgtgatcagcgtcgccaccaccagcagcgtgtcgttcttgttcgcctcgaaccccggcgcgtgactgcggcgcccgccgccgttctcccgccgccggttgtcacccagctcagcgtcgtcgacaccgttcttctgccggctggtctcacccagctcagcgtcgtcgacaccgttttgccggctgttgtcacacagctcgccgccggcgcggccgtcctcaactgcgccggtgtccatcttacctaaccactcttaagcctatgtcaaagtgcaaaacttagatcagagaaagaacagtaaaattctagcaggaatttgatgacgccaatgcttcgcaagaatcacaaagcctgtgttcttgttgtgtcaaacatgctatgcatacgcacacaaaaacacacatttatactggaaattttcttagttaggctatgtttagttcccacacaaaaatttataccctatcacattaaacgtttgaacacatatatgaaatattaaatataagctaaaaaaataacaaattgcacagattgcgactaatatgcgagatgaatcttttaagcctaattgctccatgatttgacaatgttgtgctacagtaaatatttactaatgacggagtaattaggcttaataaattcgtctcgctgtttgctgacggattctataattagtttttctattagtgcctgaacaccccatacgacaccatatataatacctgatgtgacacgccaaaactttacacccctgattaaaacacccccttaattactttgcttatctctaacaatcattgagaggtaatttctcagaagcagatgggaagcacaaggagtggctcgtttagggcctgtttagttcactaaaagaaaatttctgggtgtcacatcggatgtttgtccagatatcggaaggagttttcagacataaatgaaaaaactaatttcagaactcccctgtaaaccgcgagacaaatcttttgagcctaattaatccggcattagtacatgtgggttattattgtactagcacttatagctaatcatggattaattaggctcaaaagattcgtctcgtgatttcccccctaactgtgtaattagtttttttaatctatatttaatgctccatacatgtgtctacatattgatgtgatatttttggaaaaaaaatttggaactggccttacttgtccgagagctgcaactctagtcgagcgaggacttctatgctctaactagtcagtcgtcatcaagttgccgtggaatttatgcagttagaagttagaacaaacagaagctgatgtagtggatatcttattcaaaacctaaatcaacgcatcccctctcccccatttcacacctcggaatccctctgattatcttagtcaattcaaaataatctgaacttggatttccttatctgacagagaattcaggaatatccaacttgtcatcacagcttatctcatcttatgtacaactgtaacctccgttgtataatatatgacgaagttgaattttctcttaaaccattgctgaagcatatctcatttcatcacgattaatggctaagattgcatcgataatgccatgggatcctggtggctgctgcttcctcaagttattagctatatcagctttgtgggcaagctacattttccaggccatcggattgttgttggacagttgagtgatagttctatccttcacaagccaaacatttcgatttgcttgagctgtcttttgggatgctcgctctgttggcaagctgagaaatgaagtccacatttctaaagctttatgacagatagagggtttgtaatgtcaaaagttcacttgccgtaaacttgtagacaagtcgaatttgaaggagagatttgaacgagaggagattgaatttgtaggagagggggattctcaggagttattgggtttagggatggcaataggttaggtcaggcacgagcatagcaaatccatacttggcttgagactcacgtgcccgtgtccgacccacgcctgcgaagtctcttgggcaaaaccccatgcccgttgggcacgggcatgcccaacggatacccattgggtatcacagtaaatatcttaaccccatgcccgtgcattgccgtgtcgccagccgccgcctgctcccatgcgccgccacctgtgccctggcgccgccgcgtcgccatccacagcagtgccgccagccatcgccttcgcccgtgcgccaccacatcgacgcctgcgcttgtgcgccgctgcgtcacgctgccaatagcctcccgcttccttcccgtgctccaccgtcgccgtgtgaagacactggagaagagtagaagactgagagagtgagaggtggcagtggggaggaggataaggttaggggcttggggattttcaggctagggttttattgagtgaatatatattgatgctgtatacaaataggtcaaatgagctattgggtcataagagaaaggttaaactattgaaggtctcaaggatatacatggactaaaaaaaattaatttttggctcaagctgtcaagcatgggttacccgcgagtgaagtataaaacccgtatgcttctaataaattcgcaggtatcgggtgggatatgcccaatgataaaaataggtacccactcccatatccattggttcgagtatcatgaatacgcgaacctaattggattgcactttgcacccttggctgttcggaactgcgaaggtcacattggtgtgtttcaaacggagtctcttttcgaattaattttgcccgtccgtgcttgggctcgtgacctgagaaattgtgtccaatgggctgtcgcccacgctcttcgccagcttggtccatgggctctctctctctctctctctctctctctctctctctctctctctctctctcattcatcctggaggaatggcactaattcgatcaagccaatctatgtaaccgcataaacccatttgcataaccactcggaatcgatggactcactgggggggcaggcagtgtgtgtgatgatgcgaatccaggaggagcctgcagcggcaagcaatgcaaaaacgaagcgaataaccaaccttgagtgtccgtgctgctgccaccgcccactgaagtggctgctcgtctctacggagtaggagtatgtgggatgtggcctacgcctatggtttttttggtcggtccagctagcctagctcatatgccctcgtccacccatgtaaaccgcgacggaagcatggcacaatccggcacaccaactcgtcgattcttccggcaaattcttgcttgcgtgaggcccgatcgagcatcgaccgacactagctaccaacatgtcctaacaacaaactgtcagtacacaacagcaatagttagtgatcgatactggtcgcattgttatcttgtactctagaatgtcatggtcaaatatcaaatatttgtccaaaatcgttcgtttcgtttgacctctgacgacctcagccgagttttgtgctatccatatttagttttcttcttcttcttcttcttcttcttcagcagcgaagccggtgacagtcacgcttttatttacaggagtattttttacccgtcctctacatctaattagatatgtacagtattttaaaattgaaaacttagctcctaaaacaacacaatccaaaattcgctctttttaaattagaaccatagccacttaaataacacaatctaaaattcgcttatatagagatttgaattcaatatcttaggatgctacttaggttaccgcaatcactagactttgcctttgacaataacgctagccgtgctgcacaatcacacgaagttagttaaattaagccaatcattgggctcaaatccgtgtccctttcctcgaaggcgaaaaggagttgttgataaaggcttcgatgctgcacacgacctttcttctgcagcaaactataccttgcctccatttgcaccaagaccagagcacgcacgcttgccactctatatactggcacacctcgcggccatggcgagacacactcctcgctcgccagcaaactgctgcttgcgaccgcgacaatggcgtccaccggcgcgctgcttctgttgctcttgtttgtgcttgcgtgcggcggcaatggcggcgcggccgccgcggtgttctccgggtgttcgttcgagagccaggaggaggccgaggcgttcgaggccgcgctgctgcagcaggcgtgcttcaacgtgacggcgttcggtggaggcggaggtggaggtgggggcgagggcggctgcgtgtcgcggctcgacacggcgcgcggcggcgcggggagtggccccgtgccggtgctccgcgcggcggtccgggacacgctcggcgaggcggtgggcgccgtggcggccgtggcggggctcgcgtcgctgtccaaccacgcgcgggaggagatggccgtgcgcgactgcgtcgagctggtggggtactccgtcgacgagctcgggtgggcgctcgacgccatggccgaccccgacggcggcgtcgccgcggcggaggaggaggatgagacggagccggagacgaggcgccgccgccgccgcggcgcgcgcgccgaggacgacatccacgcctggctcagcgcggcgatgggcaaccagggcacctgcctcgacggcttccacggcaccgacagccgcctcctccgccgcgtcgagtcggccgtgacgcagctcactcagctcgtcagcaacctcctcgccatgcacaagaagctccgcgacatcacgccgcagcaccaacaccaacaccaccaccaccccggcaacaacaacaacaagaacggcacagccgacggcgccgccgccggaggggatgacaccggcccgtcgtcggatctaccgccatgggtgacggacgtcgtcaacgatgtcgaggaggaggtcacggcgacgcgcggacgagggaggtcgtcgtcgtcgggaaggaaggcgatgcgcgtggacgtggtggtggcgcaggacgggagcgggcggtggcggacggtgagcgaggcggtggcgcgggcgccgagccacagcaggaggaggtacgtgatctacgtgaagcgaggggtgtacgaggagaacgtggaggtgaggaagaagaagacgaacatcgtcatcgtcggcgaggggatgggggagacggtcatcaccggcagccggagcatggccgccggctggaccaccttccggagcgccacgtttggtaaattctagtgcaccgcagtgatttaatttgtctttttgctaattactcctacttttgctactcattttggttacacactcgttacttcgttagtattcatatacgaataccccgctgcgttgctgcaaaaaattaagatgcatatactatatacaaataaaatataatttaattaaaaactaaaacaatttgatataattgagcttaaaataattgagattgtagattttttttagagaagaaaaaagagacaatttagactatagatctatcatccaaatgctagaaataatttaagtgatgtggtttaatgagagaagagaaaaatatcattaactatacttagtgggatgaactatatgagtatataggattagaccaacatgatcgccaaatatatagttttgaaaggctacatatatccagttggatatagaggctgggtaaaaaaatatcattctctaaaaaataaaaaaaataaaaatatagttttgaaaatatttttgttatttaaacatgtttgcaaaacatatagcccaatacctatgaatgtatatcaaccaaaagtcattgattcgagagtattgtatagaaccatgatatttgtggtctcaaggttttactaaacccttcacttttagcaagaaaatacggagttctctaaaaaaattagtgataaggaacatcctttatactctagaacaatcataaaagcgatcatacgtgcatgtatagcagcttatacctttccagcctattatctactcctatagatcgaaccgaccgaccacaatcgtgaccgcatgcaaaagtgcgcggcggcacccagtaaattagccgcacacgaaccattatgacagcaagattcacgtgtgctttgcttgcatcaagccctcatctaggctggcagataaaccggctcgtgcatatgcatgcgcgctaagaaaagaatatccttagagcatcaccaaccgtctatctatataattccccaaaactaattttgagggattttaatccaaaaatcagctccaacagatcccctactctcctacctgagttttggagttcccttcccccgattcctcgctccgtttatatgcggacgcgaaagtcgcacccaatcacgcaatcccgcctctctcccttgttcccgcgtgtggaaaatagcgatctttctacgcgtgaaagaaaaaaaacagaattttctcttggtagtttaacaaaagggtccacttttaagttttggggattaaatttaggctatctgttggaggaaggagttttttcacttcctattttcagtttagaaaacccaaaaacaaatttttaggagaaaattatagataatctgttggtgatgctttaagatgtcctcttgcaaaaagttttccatcctccacatatctagggtttgtttgttcggtttattccggactattgactattacgatgtagtagaattaattattcccttttcaaaccccctctaattcatgctacttagggattaaccgagcaatgccttagagttgatgttgtacttaaatttaaaccgcggcacaatgaaatcaaaacataaatttgaatgagattttaagtggagttaaatttgtacttcatccgtttaagttatttgaccttttcttagtcaaacttttttttaagatttgatcaagtttgcataaaaatataataacacttttaatacaaaataaacatattatcagaatatatccaatgttaaatttaattaaactaatttggtattatatatgttattgttttttcttataaatttgatcgaacctaaattttgactaactcaaatgttttataatataaaacggagggagtaactgaatttggtttgtgtgtgcgtgcgtgcagcggtgtcgggggcggggttcatcgcacgggacatgacgattcggaacacggcggggccggcggcgcaccaggcggtggcgctgcgcgtcgactccgatcgctccgccttcttccgcatcgccgtcgagggccaccaggacacgctctacgcgcactccctccgccagttctaccgcgactgccgcgtctccggcaccgtcgacttcatcttcggcaacggcatcgccgtcatccagcgcaccaccatctctaccctcccgcccgccgccggccagaacgccggcagcgtcacggcgcagggccggagggaccccaaccagaacaccggcttcgccctccatgcttgcatcgtggaggccaagtacccgacctacctcggacgcccgtggaagcccttctcccgggtggtcgtcatggagtcctacctcggcgcaggtgtccagccgcgcggatggctggagtgggacggcgacggcggcgagctcgccacgctattctacggggagtaccgcaactatgggcctggcgccaacatcggcggccgggtgcggtggcccggataccacgtgatcatggacgccgccgtcgctgtgcgcttcaccgtgcggcggttcatcgacggcctcgcttggctaccctccaccggcgtcaccttcaccgctgacctcaacaggaaatgacgacgtatacacggatgcagatgctctgattgaacttccccctgatatgtgggcccgcgaacggtggggcccacatatcagtcactacgttcctctgactttacgtcagagaatcccaaataccacatacacacacaaaatcagttattcatttggtttggttaattataaattggatatataccagaaagaatatgtttttttttgaattaagtatatactaagctagttatacgcatagctcatatatatggattcatgtaattgatgaacaatagatatatatacaagtttcatgtgaacatcctccaaacaaaaatttctgggagtacttttttaggtctatattaaaaaacttccgtaaattttgttggtgaaaacgtttaaatgtaactacaatgtcatttatagtgtatattttgatccttgccctcgctcgatcctgtcaatttttattcacccaccctagcacaaatcttcaacatctgacggttagaaaatcgcaagtttttttaaaaaaaaatcaccattttttttaaacaaatcctttttttttctagagattttggaaatgtattagaacttgagaaaagtggttgcaaaatcatttggtcaaaggaggcaaggcccaagaaaagtctaaggcccaggaaaagtccaaggcccaaggactgccctgaccctgacacgcgccaagctgttcctccagtttccacgattcttcgtcgtcttctctacttctccctctccgccttcaaaagcgacgctctccacctgcgtcctcgtcatcctcccctagacagacaaactccagctcctcctcctcctccgcgctcgagatcccgcctccgcctccgcctcccccagtcgccggcgagcaactccggtgaagcgcgagctacggattaaggtgcgccctccccctcctcctcctctcgctaccgagcaagtggtcacggatcttggaattggattggattggattgttcacggatcgggggatctcatctcccccttgtccccggttggatccaactcctcctcctgttgttgttggtggtggtggtggtgatgtgagggggttcgctccaagcataggtagatctccccacctttgctgtttgtttgctcgctccccgggtcgtcgtcgcctcgcgcggacccgatctgatcccgcctagagcctcgaggggggatggtggatcatggggggggggggagtggtgagaggatctgtctctgtcttacggattgtggcgtggagcgctgttctcgtgggcgtattacgtatttacgtgttgccttgctttgatcccatggattgttttgggtttgggggggcttcgctgagatttggagctagaattttggtagtggaatacttgcttatgtgccaaacaggttgattatatactgtgccctccaaatttcgctatgaacagcattggggaataatgtctggtgatttgaggcgacatgctggtgtagattacactcgtgcggtggattacacctaaagagcaaatggtccatatgtttgttgctgctagcatgaactggagcaagatagagcttgctgttgtacttttactagcgaaaacgtttgctgtctgcaaacctgtttatcacataatcacattgttacatcctcccccaagttattcttaatgatttagatgttttttttttcacataacatttagatttatctttcctcgttttaatctgtcag

SEQ ID NO: 62300 - DNA, 1343 bp, Oryza sativa
aactaagggtgtgtttagttcacgctaaaattgaaaatttgattgaaattggaacgatgtgacgaaaaagttgaaagtttgtgtgtatgaaagttttgatgtgatggaaaagttggaagtatgaaaaaaaagttgagaactaaaccaggcctaagcacggcctatctggtctaagctttcacaccttctaagccttatattcctttcatcttccatctaagaaaaattttcactattgtactagaaaaccgttgctccttgtattgagattgttgctacattgaaactgttgctgattgagctaattgaggtggtttgctaatgaactggtgtcagaactacctattttgcaccaaatctaccataagtagccaagagtctatggaatccaagtgtacgcaagagaagattgattgttgtatattttggagagactaaaagaaatggaagcaaaatagggacaaattctttgaggagatcagtgcctccattaaggcaactactgttgtacgtcctcatggtttcaatcatcttcaccgcctatggcactgtctcctttagcacttacaaaattgttgatgatgtacccaaacaacagcatcacttgggtaacggcaaaacacggacacaatttattaggtcacaagccaaaacacggatggcccaaattaatttgaaggaagactccatttgaaagacaccaattagacatgaatttttttagagggtacgggataccgttagaatggtacactttaataaatccttttcttttctctacctacctgagcaaccacgcataaaacaaataaagcagcggtgctcatcttgctgcctcgctcagccacatcaattgcaaggaaggaggcaggcattgagaagaggaaggatgaagaagagccaatgggaggtccatcgtcaggcgaccaaaaagcaatgacatgtgtcccctctctccttgacttgataccaggtacctagggtaccagacatgatacatataggtaggtactaggtatcggataccttgatactagactttggtaactttggtatcgagtgggtaccagaccatggtacccaaataccaagcctgatacttgtaggtatcacttatgatatcattaggtatcatgcctgatacctgagtatcatggtaccagagtaccaaaccatgtacctaaaaccaagcctgatacttgtaggtatcacctataatattgttaggtatcatgcctgatacctaagtattatgataccaggttaccagaccatggtatccaaatatcaagcctgatatttgtaggcatcacctatgatatcgttaggtatcatgcctgata

SEQ ID NO: 62301 - DNA, 2052 bp, Oryza sativa
gagaaaattcctacagatgacatttcaaattttcagccagcattgcaaaagatgcgaaagatcagatgattcaatacttaccagaggagggggttgaaggcatgataaggcaccattggcagtatgtgcgagtaatcgactacaatgccggatgagaaaatcttatacatcctgtctttcataatcttaaattcaagagactctggatcttcgcgtttgggatcactcttgccatcaaactcaaaggcagtacgggatctttccttaataggcgccagccagctcttgataaagtgccgagtgatttgctccccatgcagaccttgttccttgagcttcagcatgcgatttagcagagtgagggcttgagcagcttcatcttctattggaagcgagttccatgtatcttgatatgttggaggaagacaagagtactcgggaagcgctggcttaggattttgcatataaaaccaatttgcatgccaacccttattggatgttttgaaaggcatggaaaaatatttctggctcaaagtgcccctcagttgaaaaccggctcccccaacaacacactgcttgctcttgtttggttggggcttcaggaagaagatgcaacggaatagggcaaagtgcggcctaatccctagaaaggcttcacaagcatgaatgaagtttgcaatatgaacaatggagttggggttgagatggtgcaaactaatcccgtagaattcaagaatccccctgaataatttcgaagttgggagagaaaaaccaccatagaagaaatgggagaataccacgacctcatgcatgtccgaggtcgggaatgcttcgccacacgccggacgccagccgatgatttccttcgccggaagaacaccgtgctccaccatttccttcaagttctctgttacatcggtgggtgcccattgactctcaaagctttctctctcctccgccatggatgcgagatgggtgatgggatatggagcaagggcggcagcgaatgaaaggaaaattgaagcggcaattgcgcagatgattttcgcaagcccacgaagcttcgggagaggtggattgatgtggatttgctagccctaattttcgccggcgtggttgctacactatagcgaaggatagggagagtggaggagatctcggcggggaagacgaagcggcgttttgttcagcggttttttcgctggggtatcggaagatgctaatgggcctgggccttcttagtattttcagcccatttttattatcggcgtggctagttgtgatccttagggattttggcgtatattttttctttggtaaaaattgctcacgacagaatagcctagtgccgttaaaatcctttttgacgcagttagataattcttgggaattactacgatgcaaataaaaaggtgcccaacagaaaagtgttatactaattttgttggcctttttaggctacaaagttgtttgggttttattaaggtgactaatggtcattctctcggcatgttatatgcttcatttgataatggcgtgggtcgtagcttaggctatttatacttgccatttatcattttttatacaacatttgataaatcctttaagagttttactcggatttttaatcatatatgttgattaacagatctttagagtgttttcactcggatctacctatgccttttgagcatactcaagctaaagcagtcggctgaatgtttatcaagtgcctcatatgcttagctatatcattgctttggtaattcagttataaattcactcggatggatgtttaatatacaactaatcacatagtcgggggctacacctaattaggtgcatctaatcgatgcacccgatttttttttttattttagcccttcacagtctttgattcaagtactaggtagcccaaggcaggaatagttgaagcactcggattatcatcttgaagattacaagagaagattatttcgtcgtctgtaaaggtctcaggggctactgtggagactatgcacaccccatacccacatggcatgtatatccgac

SEQ ID NO: 62302 - DNA, 20613 bp, Oryza sativa
aacagtacatataagtaatttgttacaaaatacttcctggatacagtaatggaaacctacttgcttaactagatgtcacaagctaatgacatagaaaagtcaaatcatttttggggcaatatagttgctggcgactaatcctaacaggattaaccaaaacagatatttccagaacctaacagagctttggcatctgtcagtttgttcttgcagctccactcgattctgttcgttgtccttcaacttagcagcattgtcctcaatcagaacatggcacttctcaatgtcgtcttgaagacgatgaacctggtttctcttctcttccaactcatacttcaaagtactaatgatttcttcgccggattgtctggcgccattgattcagtatgcaaccatatcatcgacatactgaaaaaggatgtcctcccaaatccaaaccttgcaatgatacttcgaaatgtctgaacttaccttctttgcgcatttgagaaaacgcctattgggattccgagctgtatgggatgcgaaggttcgtattgggtcctcacacgcacacttgagctggggcggggataagccatagaagaatgtatggacctgcaagaatgtagaatagaactgggtggattgttgggtggatggaggaagatgcactgtgcatcgccatggctgctctaccaacagagtgcaggatgctagggtggagaatagtcaagatattcaggctgctagggtgcagaggagtaaagacgagagagagaaattcattcaaaagtacagaacggtacatttatgggcccggttgacttgacatatatgtttggtacacgggggtagaaaatgtgtgaaacagcgatatacgaaggaatacgcctggtgtgtgggaccaggagcacaaatctcaaagagaaacgggcggtgatgcatgtaggggaacgtccccttaaccgatcagaatagtttgccggctaatactctctccattccaaaatctaagtatttttagtataatgacaagtcaaatatttttaactttaactattaataacataaaaataaacaagatcatacatgttactatatttatcattaaacagactatcataatatataactctttttatttaaaatatctttttatagatatttttagttaaaacagaatctctaaagccatggcagagtctaaaaatatttatattttgggagtgggagagtactcatcaaagcagaaaatatatatggccttgtttagttccaaattttttcttcaatttttcaattttttcatcatatcaaaactttcctacacacaaacttccaacttttccgtcacatcgtttaaatttcaaccaaacttccaattttgatgtgaactaaacacacacactatatatacatatatacatatatatatatacatatatatatatatatgtatatacatatatatgtatatacacatatatgtatatatgtatatacatatatatatatgtgtgtatatatatgtatatacatatatacacatatatatatatgtatatacatatatacacatatatatatatatatatatgtatatacatatagtgacagaccgacagtatgctactagagcagaagttcagactgagagaacagtaaagtgagctgcaaggtgaaacagaccgaaaaaatcatgcttaagcatgcagagctgtgcctatgggcaaaaaaacattacaaaatatacacagcaaaaggaattcatacgaggcagaatcagtgggctttgttcactgtcaaatgttgatgcacacattgcaaggccaaaatacacactcctctgaatctctgatgcatcaatcagtttgcgaaaagaaaggcagggaagagggggcagcggccatgccataccgtagctggctaggcaggtactctgagtgccctggggagcaaagtgggcagggaaagacgacagcggagcgagcaggtggtcccgcctccgtcgagaaggcgcttctggcaccatctgcaccgctgggccgtcctgccacggatggggatcaatctcgtgctggtggcgctgctgtggagaatgtccgcggcgagttcggcgtcggcgatgctctcccagacggaccatagccaatgaccacgcgaaatctgcacgcacagacccatccttgagtggaacacgagtgggagcagatggtgatggtggtcgtcgcagtggcagtccccatagagaaaggcctcgcgacacgtggtgcagaataggtccagcagctgctcaggctgagctgagcagccaacttccaagagagacagaacccacgggtgcgccgccgcagcagcagcgtggtcagcatgcgcccagcaagatatcgtacagagcgtggccagcctgctgtagagaccatcgagcgaggcaatgtcggagcagaccctgcagcgggtgcccggtgatggctgaagcaagtacggccggccaagaaacggagacgggagccggtcactctgcacccatcaccattggcattgcaaacaacacatgagcaaaattttcaattcctccacaagcacaagcacaactgcacaagaagaagcaacaagtcaagcatttcaattacctcgattcctaggaagatgggcgccatcctctcggcccctgtcaaccatgcgcaccagtcacctcggaacatgccgaggacgagcacctcgtgatcgtggacgccgccacggccgaacgcgtcgcaggacgggcagtagtagagcatgcccactcctgcggtcgcgtcggcgacggcgctcatgtcgtcgacgcagaccaccgatgatagcatcctcctcctcaggcatactgagcagacgcctccctcaccctcatcggccacctgccgccgacgacagacgacgcacctcgccacgagcgcctcctcctgaacgccatccgcgccatcaccatccgggcccacctcgccaccgccgccatgaccgcgcgccgccgccgcgccggcctcgcccgcctcgccgtggtcgcctgcagcgccgccgtcatgcgtgccctccgtgccatccaatccggtctccttggccgcggatgaggaacgtctgcaaaaaaccatttccaatcaagaaccattcttttggtcaagaaatctggcaagaatcgatttcttaatgaaaccatggaattcagttctcttcttacctcggggagctgtcggccaacaagaaatccgccacctcgccaccgccaccggtcgccgcgtcgccggcgccgctgctcttgccgagctgggccacgggtacccccatcctgaaagaacgcaggagagatcgaaacaggcgcgcgtcgggaggcgaactcgaggcgccggtgcggaggaggaagaagaggagagccaagaaaggggagacgaagggcgcgcgtcgggaggcgagttcgtctgagacgaagacgaagcggagacaaggaagatgggcgcttgtcagtcagtatacatggccatatgggccgcccggccgtgcctgggccgaggcttgtcgggtcggcacggcccgacggacgcaccgggccgtgccgtgccagcccacgtgccgcactcacggcccaggcacggcccaacacgcctcgggccgtgctgggccggccccaaggcactacggcccatcgcgctttacctcagcataagtctaatttttctccctcctattgggctgtgacatatatagctaaaaaaagtctattttacctccctcttctttgggctgtgatatataaggaaaaagtacaccgaaggtccctcaacttgtcatcgagatacaaaatcgtcccctaattacaaaaccagatacgtggcatcctcaacttacaaaccattcactcagtggttttaaccccggttttgtccgacgtggacgctgagtcagcgggacccacatgggccccacatgtcagacagaccacgccggccaagtcccggccgcgccgctcgccctcaccggcgccggtccatgaggctgagggtgcacccagcgtcgcggaagcgcaccatcgcctgcagcggtggtgcggggtctccgcagtggcggcggggatggccggcgggaagaagctgaggccgctcgcccgcgtcggctgagtcccggccgcgccgctcgccctcgccgtccctctctgctctctactctcgcagggcatggggatgccggtgctagggcacccacggcggcgcgcgcggccggcgacggtggctcccgaggcgacgcgagcttcccccaggcggcgcgcgggctcagggcagcgcgagctcaagacgtgggtctccgaccgcctcgcggtccagctcgtcggtggagatgaggagggagcgggagtggcggcgggtgcgggagcagcagtcgcggtgcggggaggtggcgggcgggacggcggcggagtgcgccgcggtttgctgctgcttccccttcgccgtcgttgagcttgtcgtcctcgcggccgtccacgtccccgccacgccgtctgtggtgggcgccgccgcggtgtccgctccacgaagcggaaggagatgggcgagctcctcgccctggacgtcgcctccccaaggtcgctggccgtcgcggccaccaaggctaggaaggtagaggccgagttcccagccacgcccatgaccgaacacctcgtcgacatggagaagcaggtgtgggcgagcttctacagcgccggcttctggaggagcccctcgcaacgagaggacaggaggtgatcgccgccgccgctctcttcttcttctcctccttccccacggttgttggtttcttggctttctcctcccttttcttcagaaaagagaagacaaataactcgatcttgtgattaatttaaccgcaattgacaatttttttttttttttgcaactggctgtgttcttctctccttccaaaaaatttgtcgattgggaggaaagatacctgctcgtgctcattgatgtcctcttctttgccgtgccgattatctccattccattgtgcttttgttattttggtgctcatcgttggcgatgccgtcgtgcgtggcaacgcctatagcacgaggcggatgacgctcagcctgatggcgccgtcgttcttgacgaggcccagcatgaggctcgccggcaccccgtcgatcagcagcaccagccatcggcctcgttgccggcgacaacctcaccgtcccgctcagctgcgcctgcccctcgctgccgcaggtcgccgtggtggtggctcggcagcgccatcgttgagctcgccggcgagggcgagcggcacggccgggacgcggccggcgagggcgagcggcgccgccgggactcagccggcgagggcgagcggcgtcgctgggactcagccggcaagggcgagcggcgctaccgggactcggccagcgtgggcgagcggtgcggtctcctccccgcccgtcgcacgccatgccatgagagaagagagagacgaggaagggagaggagagggaatagagaaagctgacgtggattgtctgatatgtggggctcacgcatttgaccactcctcttatttaaaattttttaaaattattatttattttatttgtgacttactttattatttcaatactttaagcacaccttttcgttttttatatttgcaaaaaaaaatgaataagacgagtagtcaaacgttgcaagaaaaactagaaatctcttatattggatggagggagtagcaaagattagttccaacaaccggtagtcattaattaccaaaacttcttctaacacacggttataggacttgctctttcactggccggggcggtgaagcctaaccaacggtgtggtgagggattaatcggccgacagcatggggagggagggcaagctatagagagagacaggaaaattatcaactcattttcaaaaactttttaaccgaatcatttatttattatattacaaaaaataatgatatgcactatatttaacattcacgctaatgaacagggacatgtcagcgtttgacggaacttctaaaaatcataaaaatgaaatccaacgagacaataaatctaaaaacgacagggtctactttttaaaagttccaaggagaatgaatagaaagagtggtagatcgcgcaagcaaataaaggagacgtgacaaacatgtaaggggtataaattttaaaaactataaaattaaaaatacaaggataataaagtttggtctttcatagtgttaaaacaacgagatagctatttaacaaattttaagtaaaatcatattaaaaatagataattttgtatgggtgctagccgtgcaattgcacgggctacctagctagtttatttattatattataaacaaaataatgatatgcactattattaacatcaacgctaatgagcgcgggacatgactttgtgagcatcggcgggagcgttacacagacaacgaacgcaggccaactaaagcgtcctggcaggggacacgtaaaaaatgaaaaggaaatcggaatccgattgggaggcgagtaggcgaccggccggcctgatcgagttcggaatcggaatctgaatcggcgcggttgtacgtctcgtgtggacatatatatataccacctgtccacccgtcaccagaagacaagcgtacgtgcgtcgaactatggcaatccgcaagcaattagtgcaagtgcaaccgaaaaagatcgagatgtggcagtggcagcctccgcctctccatccaggggtcgtcaccatggcgaagcacaagctacagttggaggacctgtcgcagacgtgccggcgagaccactactgcgtcaggtgcgtccacgccttctgctcccactgctgcgatgaccaccacttcgtcccgctcggctcccacatcgtcatccccatcgccggtgtcgacgccgccaccggcaagcccgtcatccccgcgcactaccctcgccgccccgacctgcccatcaccgacttcgtcatcggtctcatcaacgccaacgacttcgccgaggagcaccccagggacgcctactgcatgtactgcttcatggccttctccaccgcgctctgccaccaccaccacacctgcgccgccgactgcgtcctccgcatcgtccgaagccacgacggccgccactgcgtccgctgcaccggcgacgagccgtggttcccttacatggagagcgtcctgggcgaccccgtggctgtcgaggaggaggagggcgacgacggcgaggtggtggctgtgctgctgctgctgcccgtgctgaggaggagctcaccgaccgcgtgcgtacactgcggcggcgaggtgcccaaacacatgcgccgctcggtgctctgctcgccggcctgcgacgcggcccaccaactggaggtcgcccagcgcagggagcgcagggacgccgtgctcgccgcgcgccgcctcgccaagctgaacatccatgccgtttgatcaattcttgtactgtattagcgctcattgatttgatctcgtaattctcatatctgtatgttgacccgtgtcttttttttttcgactccccgtgtctataaactattattagtaaattactttcgtgccggcaatatcttttaattcttctcttgtgcattggggttgattaaccgcctaatgatgcaattttcatttcacaaagctaaagctattcatctacaggaacgtttagcagggctatagtttcagctttatctcttttgaagctaaaactcaactaaactgtttcagttttatcaaacaagaaagcggagcaaactaagtgataaaaaaggaaaatttttatatgcatatctttaacgatttaaaagttaatataaaaaagggagtagctatatttatggcgccaaatttttcgtcaaaaaatagtcggcatgtatttacattataagtccctaaattacatttgtaattttagtgtatttacaatgtaaattccaaaattacatatgtaagtcctaaaattacatatgtaattctcaaaattacgtatgtaagttgatgtaattcccaaaactataaatttgtaatgacacagatatttagtttttaagattacatatgtaagcccacctatcatactcctattccactattcctctctctcttctctctctcacccttcctctctcttctctcactctctgtctcacacgcgcacagcggcgaaggaggtggcgagcggcggcggggtgcggcggaggaggcgaggcgaggcgaggctgcggcggtggaggcgaggcgaggctgcggcggaggaggcgagacgaggcggcggcggcgggagctcgcgctgctcaaggcgaagtgaggtggtgccggcgggggtgcggcggaggaggcgagcgcggcggcagaggaggcgagcgcggcgacggaggaggcgaggcagcagtggcggcaaggcggttggccggggcgacggacgaggcgcgcggcgtgggcggggctcgagaggagatggccacggcgcgcgggcggcggggttgagatgccgtggaccgggtgctggcggtggtactcgccatcgtagccgacgatgcggcgggacctcctcgcgtggtccgcgtggagcccgtcatcctcctcatccgccgcgcgggggaggcccgaggaggaggtggcaatggcgtggcccgagtaggagacgaggctgcgggcggcggggatgactggctcgggcgcgtcatcgtcggtagtcgcgtagctccgtgcgcccacgctgtcgcgtagtcattcagctccgctagccgtcgcgacgagctcccgccgtggagggccggcaccgctcgtgccagctgctgctccgcgtggcgcgccggagaaggcaacgatggcgaggcagtcggatcgcatcctgctccgagctccgtccgagagggaagagggaagccgcgccgagctccgtccgcccgcatgccaccgagatggaggggagaagccgcgccgagctcctcatcccccgccgtcaccgccgccgcgtcacgcgctgccgccgccgacccgtgagactgtgccgcgagagagaggaagagtgagagagagtgagtgagagaaagagaggagagagtagtgacaggtgggtaccacaatttttttataaatagaatgctgattggactaccacgtgtacgccacgtagaccaaaaccaccgcggattgggtcgagggggtaattcgtccggtattcatagttgggggtgaaaaatgtctggttttgtggttcgggggtggggggtaattcggatgaccgcgatagttcggggggtaatttgtactttttcctagataatatgaaagagcatactacggatacatatggcgttcatcgtgcaatatattccttttgattcatagatcacaacatgtgttacacgcgtatggttactagtagggttaatttgattcatgtcattacaaatatggcatattagaaaaatatcattacaattcacgttattgattagattccactgaaaaattttaaatttggaaccatgccacttccttcattgtttccgtactaatccctcacgtcctcaccctcacctaggggtggacagaaagctcgtggctcgtatgctcgctcggctcgtgacaagctcggatcggctcggctcgtttgattttcctaacgaaccgagctggaagtttagctcgttagagataacgagccagctcgagctagctcgcgagccttaacgagataggctgccagaccacaaaccccttaggcccatttatttagaaggcccaatagaccaaaaaccaaaaccctagcttcccttcccctttccctggtggtggcggctgagctccccgtctcccccacacgccggcgccacgcgacgcggcccacgcggccacgcccaacgccgccgctctgcgcctccaccctagcaaccgacgccgccacctaaccccagcgcccgacgccgccgatccgtcgctctccgcctctccctacccccacgcccgacgccgtcggcgagctcaagctcgtcccacgcgccgccgccactctccgcccctccccttgtgcctgacgccgccggcaagctcgagctcgtcccctccgccgccaagttcctccccgtggtcgccgcctcgccggcgagctcgagctcgtcccctccaccgccaagctcctccccgtggtcgccggcgagctgtcaaggtgccggcgaggttgagctgcttccgtgcctccgtggtcaccggctgcccccaaagctcacgagcctaacgagctggctcgagctttcaaacgagccgagccgagctgggttttttgctcgttaggataacgagccgagccgagctagcttgttaggataacgagccagaggtctggccaagccgagccgagccaagccggctggcccaactcgacatccaccacccctaccctcaccgtcagtccgtcacgtgagcgcgcggggagaacgctcgccagcgccggcaccggcaagcatcgagaggacgaggcggcgcaggcgagcggtgagaggacggggagatggagagacggtgccggcgagcggcgaggacgaggcggcagccgcaccctctcaccacgccctctccacaactgtcctcgccgccgaagccgccaccgtcgcagccggctggaacccttcagcgtgttggatagtataggaagaggggaataatgcaaatattggatacattgtattgagcctcagggggccgatatatataggagtacatggggaagagataaggaaggattacagatatggaaggaatccaaacaaaccaatcctatcctaatatgactctaactaccatatactctaacatcccccgcagtccaagcgtgagcagcgcggacacttggactggagaataaaccggcaagagtgctcaacacggatgatagccctttgtgccatggtcgacgtagccaaagcgaaggagccgagagagccgtggtcgatgaagccgtgcgcagaatagccgtggtcgatgtagccgaagtcgggaagctgatgtcgaggtagccgagccgcagggagcgcatggggcgccgtagagtggtcgtggatggactagagggcgtcgtggaccaaggtgcgtgaggacacgcaggagacgaagacggggacgcgatcacgacggtcgttgaggaagatgacgtcgaagagccgatgtagtcgaaccgtgaaggacaagacgtcacaccaggtttgccagacccggggacaactcgggacgaacatgcgcgccggtgttgccaataccgcgcgggcgagatagaggaccaccatgaatcatacaccaatgtcggagaagaccagcagagaaggcctccgggacggtcgcggcgcgagaacggcgtagagggagaattgccggagcagcacgcagttgccggagaagagcgaagtgtagtcgaggaagatacagcaacgctggcgatgagtcatgctggacgaagtagaaggcgaagtagcgggaccaacggcctggacggcgacgtcggtagccttgtagaggtagctgcaccaccggcctagagtggcgacagtggcagcttggagatgcggcggcgatgctcgaagtagaggaagaagaccctgagcggctgacgatgaccagtgcggacgacgaggttgtcgatgcgtgaacggcgatgaagacgacgaaagcggcgaagctgcggtccgagaggacaacacagctgcagctccatgtcgatgcagcgacgagaagtccaccggtgatgtagccatgcttaggagggcacctctcagcactgcaacaaccagtggaggcgtggaccacaggcggcggcactgtggcccgagggggcgacgcagcggcaatccaaagcttgatggtgtagacgcgtgctcgatgacgattggttgtagaagtcgacgaggcggtgggcgacgcaaaccgatctctgatcggaaaaggaaaataacagcagcaagcagcagcgcagtacggtagcacatcctctgttcctccatggtcccgatccatagaccaagtccagcagccttgcagcctcagccgtgccagcaggaagccatgaccaagtcaacgaggagattaaatccttcacttggccacagcctattcaccttctcccgaatatccatccacacacatgcagacagacagagataagggagggagaggagctgtgcgcctgtgctgggagacgcattgtggggaggtagcagcggctggacgtggagtcggcgttgacgacgaaccggcagcctgcccccaagcagcgtcggagacggtggggagggcccagattcgatctgcatgtaggtagccgatggtttggtagctgctgcatgtttatgaagatgaacgacgacgcagaacgctagagattgatctctccagcacgatggaacagcgacgaacaaaacgtccaccggaggtgatcgagatcagtccctcgcagcggtggaacaagacgatgaaaaaaaaaacgaaaaacggtggccgcccccaggagcgagatcacctccgggggcgacggcagcggaagtggtgagcggcggccgtaggtcgtccgctctgatactatgttggatagtataggaagaggggaataatgcgaatattggatacattgtattgagcctcagggagccgatatatataggagtacattggggaagagataaggaaggattacagatatggaagaaatccaaacaaaccaatcatatcctaatatgactctagctaccgtatactctagcaccgcgctcggtggtggtggtcacgcccgcaaacaaggtcgcattgacggtgcgctgctcctgaaatcactgaaacaagcagccaagcaaacacccaacaatctgagctaaatcaaatcaagttgggatgaggagagagagcaagcgagcattagatcgatctcactggacagcagcagcgcgggctgcgcgtgcaccggagacatccgggtcgcaaagcatggagaccaccttgtgctcctccttgtgcccgtgcgactcaccgccgtgccccgcacctgagctccaccgccagaggatggttttttttagagaagagtattttctacccggcctctatatccaaccggatatatacggccattgagatagggaacttagccccgcaaataacccaatctaaaattcgctccataggagatttgaactcaggaccttgggccagaggatggatggtcccgacttctctctgatttggggaagctggcggctcgcttcgctcgggcagtcgtcgtgctcgccggagagctaggatgggagaagggcacgctgccgctgccgctactcctcccgctccccgcgtgcaccgtgccgccgccaccgctgctgctgccgctgaaatatttttgaagcgctgtcgccgctgctcctccagcgtgaggatgatgacgtaagggagtaggacggaaacatccgaccaataacgtgaattgtaacgatattttttaatatgccatatttgtaatggcatggatcaaattaacccttactagtaggagtaaaatgtgtatttgtaagagcgagtgtgcttgagcatgtatgagtgaatcagtttgtttgcgatgttaaaaaaacaaaattaaacaaaagccaccaacatttaagtaattagatcacgtccactgtgtttctactttctaaaagaatctgaataaaccaagaaaaaagcaactccaatgacatatcttttcaatattcgttactccgctacttcctccgtccaaagaaaaatacaaccaatactaaaatatgacatatcgtagtataataaattgggacatactctgtgtttagactcattgtactaaaatgtatcacattctaatattagattgtctttttttttttaacagagcgagtgaagcaataagaatggatattatgaaccgtggagcactagcagctacgatttctctgatgatgtcctcatgcgcgtgaactactttgtaggagcaatcatattcatacctagtgagcgataattacacggaagtagattagtaaactaatctgtgccaagaagcaggaacatcttgtgattcctctaatatttgtacacaaatgttaaataattgcccacacactagctaagagggctatgtttggggagctttatgaagcagctgtttggtagctagcttctgagaatctggaaaagctctgaaacccagtttctccaacttctggcttcttagtttatttttcagaatcagtaactacagattcttagaaactgtggattgtttggggctgcttctagcagaagcagctttttccaaaagctgcagctgggagaaactccccaaacagggcctaggacccattgtagtacctcggaaaattacctcgcgcacgtgtcgcggcgcgcgttttctggggagcagcttggcctagattagttctagataatgatgatattttctgaaagattttttttttacagattgaaaacttttgaaataaaatttaaaattttaacttaaattttgaatactttcaactcaaactttaaaaattttcaacttgtaagacaaattttataaactttcaactcagatttaaaaattttcaactttagatttgaaaactatcaagtcagatattagaaaacatgtatgctaaggattaaaaaaaaagcagaaaaaagcagaaaaaaaggaaaatcgcaaaaaaaaaaaaatggagcgggagggcgtgcttgctggcgcgcgccctccaattagccatccccactatacattggccgcctcttcttgttaaggcactcaccatgatccaaattcccgctcggctttctcctctcgaatggcctcctgccgccagaagccacgacgaactgctgcgctcttcccatgtcgcacgttgctacgtagctgcagtgcggtggtatgggagatcgccacaccagcacgtcgaagcgcggcgtgtccacgccgggcaccacgcggccgctgagcaggtcctgcatcgtcaccgtcggtgtcgtgctcgccgccggcgtccacgtcgtcagcttgcgcctgccgtagaacaggcagtgcggaccgtccatggacggcctgtacaagtagtacgagtcgtcctcgtccctgaccgggccgtgctcgccgcggccgccgtgggcgtcgatggccgcccgcgcgatccggcgccacgaacgcgcggtcatgtcggcgcgcagcgccgcggcgtgcgcgttcacggcggcgatcatcgcgaagtgcttgacgccctcgaagagctccgcggcgatggcgaccagctccggccgatcctccgggtcggcgccgccgaacgcgaggacgcggaacatgtaccagagctcaggccggcgcaggttgtccagtgtgaccggccgcggcgccgtgcccaggcgcgccgcgtgctccgccgtcctgcagatgatgaccaccttgccgtccccgttctcccggcgaacggacgagcacaacctcctccatggctcctcttccacgtcgccgacgacgtcgaccacgacaagggaccttgcgctaggatcgatgccgaatctccggtgctcgtcgtcgtcgccggccgccatcagatcatcgctgctgagacggtggatcttggcgaagtactgcctaatccgctcgtcgatgcagacgtgttcgaccagcgtccgcttcccgacctccggaccaccgacgacggggaggacgccgggattcgggtcaccggccgacgagcacgccgggcgcagcaggaagtcgacgatctgctccttctccatctgccgcccaaacatgcaccgctccatgaacaggtaggcgctgtacggctgccggctcaggcgagggcagccggccaggagcacgacgagctccttggcgccgcccagcgcggcctccaggctctccatgaccgtggcgtcgccgtcgccgcccaagctgagcagcagcggctggcaccggcgacgacgacggcggctcgccgccgccgccgcggcgttccgtatcctcagcgcgtcgagcgcgtacgcggcgcggcacatctcccacctcagctgcctgcgctgccgcagcatggccgggctggtgacccgcctcccctcggcctcctccatgacgacgcgtgctcgcagcagcgctcgctgcagcctgcttgcgccgtcgtcgtcgccggcgcgatgctcctgccacttgctgatgaggaaggagatgagccgaccgacgaggtcgctggccgccgccgcgagcagagcgtcctttgctgctgcgtgcgtcctctgcaacttcgtctctcggctgtgatttgttaaggttggagggaggagatttttgttcttctaaacaaatcgacgagggtacaggagaaaactgtacaaagaaaacaaatttataagtaaacacccggagacctgtggactcggtcttgagtcttgactaaaggtagccagtccgcgagcttccttgcgcccgcgagggcctagtttttgctgagggacgagattctcaggtggtgtttacgtccagggactccctgtctctagacattaatttagagtattaaatatagactacttacaaaactaattacataaataaaagataattcacgagacaaattttttaagcctaattaatctataattagagaatgtttactgtagcatcacataggctaatcatggattaattaggctcattagattcgtctcgcaaattagtccaagattatggatgagttttattaatagtctacgtttaatatttataattaattttcaaacatccgatgtgatagggacttaaaagttttagtcccatctaaacagggcctcagcagcacacaaacgagataactcattaagggcttgtttagttccaaacttttttttaaaacttttaacttttccatcacatcaaaacttttctacacacataaactttcaacttttcaatcatatcgttccaatttcaaccaaacttccaattttgacgtgaactaaacacacccaaacacatattcgttgaaaaattcaaattctaaaaattgaatttaaacatataatttaaatcattttgagacgtatgattaattaatttaagtattgactattacaaaccagaaaattagatttatttgattttttaaagaaatttttatataattcttttcaaatagtttgaaaatgatgctagaaaaaaaaaagaggaatttatagtttggagtggaagaaaaaaacatgctctcagtgagcacttatgagtggtacgcatttatatatgagatgcattttaaaagaatttgaaaataaaaaaaaggtgaagaataccgtattaccgtagagcgtagtttatggtttctacaccgagtttctttcgcatatttaaccatgcggccctctttcggcttcgcaagcgtaaccacgaagagtttgaccgtaagacgagcatgtttgtgttgttctgttaaagtttgtaaatacgtatgctgaccggcatgtggttaatttgactgtttagtacttcagtggaagctaggtattcgaataaatcaagcgaagaaaattcaattcaagcattgttacattttgctaattgcaaggacagagaggacgctggcctggttttgcaagttgccatcgcaatgcaggttttgcaggctggcctagaaaaaaaaatagtggagaaaataaatactccctctgttttttttatagatgatgccgttgatttttaacatgtgtttggtcattcgtcttatttaaaaattttatacaaatgcataagatataaagcatgcttaaaatatttttagtgataaaacaactcataaatgatacttatgtacttcctccgtttcacaatataagtcattctagcattttccacattcatattgatgttaataaattattctagcatttctcacattcatattgatgttaacgaatcgtgggaaatgatagaatgacttatattgtgaaacagagggagtaaatgttttgaataagttaacaacggcgtccattaaaaaatactaaagatagtatcacaaagtttgctagaagtaggcatgttttgacaataactaattgttcactgctgcatttttgggattcagctagtacagctcaccaattccatgctaattatgttattggccaatgcaaagaaattttttccctactaatattaagtagcataaaaaaaaaccttgtccgtttttggcataactaaatttgatagcaaatgaaacatcatggggtactcttgtttgaaattttttatgcaaattaatatggttttaatccaagctagtccagtatggttcgagaattcacccaacatttatcttaagaaaacgaccttgagtttttctacagaatacttaacgtagacaagaagtataatgacactcttgtggatggggcatggttcccctagcttgggatgacgacttcttggaatggtgactatcgtcttgaaagcagatgtacaagtcaagcatgaagtacttgacagttgacatggatgataatcctaaacacctgattgatacaaaatggacgtaaagaacccaactactctacgatcgcagaggaatggagaacctggaacgaagtaagggccctttgaatcaaaaggatttatattaaaattttatattattcaaattttataaaaaaaaatattatttgacactatgatctaaaggattcaagctttacaaatcttataaaattcctatggaataactcattgcatgtagattttggaggaaacttagcaaaagctccgatctcttggaaaattttctgagcctatctctccgatccaattcttctgtttttccaaacgatcatttctatgtttttcctgtgttttgcaatcatctgttttacacttgtattcctatcagaatcctatattttttctattcctccgtttttttcaatcttatgatccaaaggctaatagttagagacttagaaggctagaatagagtgtagagacatggggcatgcattggtcataaactcataatgtaagagtaagactacgatgcaagatcttttagtgcatgactaactccgttgggcgtccaatagggttcgaggacgtcagcaagccgggcgtcgttggcaacaagttggagttagcttgaccacaagaatgaccgaatcgactccatggtgtggcggaggacggtgaggaagcggtgggaatgaggccagagaggtggagtttgtcgaatccttcgccacatccggcgccacctacggcggagtagcttggtgaaggtgcggaccaggttgaccgccttctgctattgctgatgcggcagcggatgtaccgcggtcgccatttgtacgtccatctagtggcctctcgtagctagcgggaggatttctcctcctcaacatccgaccgaaggggcaattccgtctcatcatcgggtggaggagcgaaaatctatttgggaatgaataaaacggcgaaaatgacaaagtgacagtaggcacacgcttcatgttgacattttatcgaatcgtgttctgagaataatattccaacgaaatcacgttttaagcgtgtccaaatgtccaattttttctcgacgacggtagcactgccctagagactgcccattttcgagctggaactggaagtggaggaattggctcgccctccccccttccccttgaacccccacccccgccgcgcctgcactccgctggtacgcccacgcccacggtctcgtctccccgaccaccacaatccctacccttttcaaaaagaggagagaggggatcggaggagaatttctccacttcacccccaacaagcatcccgaccaccaccaccccccgctaccccaggagagattcacccgcaatgtccgacgaggccaccaggcgcttggccgggggcggcgggggcggcgcggcgctgagggcctcctccgacgtcgaccgcaagccggccgccgcgggctccccgcctcctggcgccgccgccgccgcggggcacaagatccagctcaagagcgccgacatgaaggaggagatgcgccaggaggccttcgacatcgcccgcgtcgtaaccactcgatcccccgcacctccctcctctcgattcccttgttccctgattcggattgctcggtttgcgatgtgaaatggtttttgtgttttttggttcgctaggcgttcgagaagcacaccatggagaaggacatcgcggagtacatcaagaaggagttcgacaagaaccacggccctacctggcactgcatcgtcggccgcaacttcggtactcctctctctctctctctcgcctccccctcttcttgctggaaatttctttggtaccgcatcatctggtgatttatgtcttgtcctctcctgttgattggggtatccgcggcacaattccatgtgctctagagcttgtaggctaccgaatggtatagaagtcgatgtgtgtttggtcgataatgacaaagaaacaaccctcgtgaaatcttcctccttgtgttttggttaaggcaagccaagttagcactagggcataca

SEQ ID NO: 62303 - DNA, 2340 bp, Oryza sativa
cgacgtggttgggcgtgtcttcctgaagtagagtatctagaagggtgatcgctgctaccgcgttctgctgtggggtgcgaaaaaccgctgtcccctcaacgtcttgttgtccgatgagttcgcgtgctcgccgtccagcctccaaggcgcgttgtcgccagtcctcagcctccttcgcagcccgctcgcgttcctgctgctcacgctgcagccggtctcgctcttgtgcttatcactcctcttctagtcggcgacgctcggcttcctgtcatgtgcgttgttcttctgcttcacgggcttgacgctgctccactgtctcgttatcagccatgaaaacaccgaaaaagagaggcgtataattgtcttcataggcttcgtcaaagtcgtcgaggttgctgaagtcgtagttgtagccgaagtcgtcgtagtcgaggatctccgttggccgtgagtcgacaccaggagagctgaggtagccatccaattcttccgttgaaaccgtcccgagaggctgaagtatgacaccgacttccctgaagctagattggatcggagccgaggccggatcccatctagacctacggggagaggacatccttgtggtgaagaccgcagccaaatcatcggggagcttcatcaggatcgatcgattggccccatcatcttgattaggtcatgttggagtagatgagatcacgtttgagtggtttgaagccaactcggatcagatgatcttggagtagatctcggccgagttcgggagaccgaacggggcggagacctcgtctcttcctgactagtttgaatcagagtcaaggagagagatcctgccgaagttgtcggtgatgaagtcgaggctgctgaaccggaacgcctgcccgagagggaagacgaagtcatcgatgccggagacgaatcccatcgcactaatcagcgagaagcttgacgcaacccctacctggcgcaccaactgtcgaaacaagatttcggcaatacgaaaaggggtggctatcaagcaggaaaagtggatgggtttggagacaatgaattttatataggtttaggccctctcaatgagaagtaataccctactcatgtccggggattgatccgccgagtttgttattgatcgtatgatctgggagaaaagttatgccccaagaggcacccggacccctccttatatagtgtaaggagtccgtattacagcatacagcccatattcctaatggaataggcaagtaaagatagaatacaatcataaccgactaggatcccggatatttccttaatacacaagttaggaatttaacccgagccctttaaagatattctatctacatatggtacctctgtacccagtcggatatacatgccatgtgggtatggggtatccataatctccacagttataaaatgtgaaccaagataatgaaagccctaaacttgtaaaataaaagtgaaatatttaacaaaattattcattatactcaacttaattaagaggtaacatgttctgaacatgcaactctaacgtcatgcacatatagaatactatacacctagaacacgttataactccaaaaattgtgaaaccaaaagtgttagtcttagaaaacacatccctacatatctgtggagtcaaagttagtaagaatcacttcataaaaatattttataacactacctaggtaaatactatcctataccgagcaaacttctaaaattcataactcacaaataaaaagagataaaatagaaattcttgcacctaaattcatattagaccggtacctattcactgtgcacaaatcatgcattttagagcattttgaatttttcgcatatttcaatgtttaattgcataatgtgtactttatatagatgattgcttaaacgatgaagaagtgattttggtgctgactttttctagttaaaaggcaagtcccacctccctctctctttgatcactttgaacctatgttttgaaggttattgaaaatgtttgcaaatcttacatgtcgattgtacactaatacattaaaattttgttaaacttgttagacaaactcctattatttgcattatcaccttaatcccgcatatatccatatccctcattcctaaccttaggaatcatatcctgttactacttggaatatgagttacactagtttactatattgcttagccaagcttagaatggttttacttatcacttgggctcatattaacatgaaaaatgattttattaagattctggacagagatgaataaatcaagtatttgacaaataaaatgatggaaaacatggattttaggtttgggcctcaagtggtg

SEQ ID NO: 62304 - DNA, 539 bp, Oryza sativa
ccacggggccgagtcacctgcggggacccgaccctacgagggcgagggtgggttaagtttctgacccgcgggggaggcaggggcggggctccgcatttttgcggggaggggacgggggagacagttcacccgcgagtgacccgcgaggccccggggggtgtatattaaccctttaaatgtagctcataggaggcccaaaagagcccaacccaataaaatagagataaaatgaaaaggaaccctagccttatcctcaccagtgtcttcccaactcccctcccggctcccgtacgcatcacccacaggcggaggcggcgctaggggcaagggcacacgagcacacggcgcacttctctggatctcgccggcaccggtcgccctctcccctcccctccagccttccgagtcctgtcctctccaatatccctctccggctctccctcaggtctgccgacgaggcgacgaagcacaggcgcacgggcgcggtgagggcaccgtcgagtggcgagggcacgccggtcggcgaaggtgtggcgcac

SEQ ID NO: 62305 - DNA, 2726 bp, Oryza sativa
ctcgaggcgtcggatgtttcattatgtttgtttgatgacttgaattattcacttcatccctcaactataatgaaaggtccggagagcctgcgacacgaggcatcggcgtttgggagttgtggagatcgctagtgctgatgctgtgtcttcgggagtaggagctttgctatgcgagagaacataatagataatatcaggcatgccaagctgttgggcattatatctgttgggaatctctcctctctgaatgtttaagtactaatcactagcactaacataaacacttgtatttactcggtggacacaaacacacaagaactgaacaaaacacacaggcttttggttgatgtggccactagctcacatcgttttcttgtttatatagactcagtacatacaaagagattacaatggccaaacccactcagccacaactcacgccatgcacacagacgtgggatgcccatgcactaagtaactaactaatcctacttatttgccaagaaatcccaatacatgattaccactaatcgcagcatatgcggctaatcactagcaacaactaaatctcatgtacagctaggaccgattcactcggctcatactgaccttgtcttgcttgcaattcggctacttctcgcagcactccacatgcagttgagcttggtcttcatgaacgttgtttgctccattctcgcaccaccgcatcgcacggcacgtcggcatctcgccaatgagctggagccaaactaaatatgcagtgacatatactacatgtaaacaaaatagaaccatgcatatattctaattaatgacaagattaaactctatcaatatctatacagtatatataccaggattggggccctcgtttgggctgggcccttggccgtcgcccttatggccctgctctagagatggcactgcgtccacaccttcaccaaattcggcaagcagcggagctccctcctcgccgtcaacccgagacagccacctctccatctccgtcgtcgtcatctcctcgctgcctgaagaccccaaaacgtcgctcccatcaccattgtctccctccggccgttgttcctgccaagacgaactgctgcccatcatcgtcgtcaagtccgcagcaccgagtcctttgtcatccacctcctcgtcaagcccgaagatcaccagagccgccttctcgccgtcaatccaaagcatcgtcgctatcttgagctcactgccatcaaaacctcgtcgccaatccctctgtctccgcttcgtcgtcatcttcatggtgaggatccgctttctaatctctccctcctattgtcctcatcttactacgctgtcgtgccactgtgtgtcggtgacctccggtcccgtgctgccgatgtcggttgtcgtcttcctccagtgtacattcacgtgtttgtgcacgtggttttacgcataattgtatagttgcaaaaataatttaacaatacgaaaatatccacttaaacagaatataacttcggatgttcacttcttggccatacatactctaaattgacatgttcaagtctttaatttcaagttaaatcatgacgcacatatttaggtgctttttatgtaatgtttaggtcctttacttagtgttttagtcttgttttgtttaagtcactttgatcctacaactgataagatgcataaattgaagatcaaatagtcgatgggccaataagccgatatagcaatgctagctgatgccgataccatccgatgttgatagggttttgaacaatcggctatatgtcgttggactcattcagattacaatagtttcatgagatttttgaaggaatactattgatagattttttttttccttttcctaccattcagaccacaaaaaccaatcaaaggaaaatcgcaggaagatttcctacactgttaattccatgggaaaagcacggggaagaatcaatccactccgaccctttttttggttttcttcgcgttggaacgaggcaatcaaacactatcagtgaagaacggactgaactggaggtgcttgcgtcaacgaatgaactgacctgaagaacttgaaaaacatgtggaggaggcatcgaggagactggacggcgcagtcagcgacgtcgaggaggccgcgcgtggaggtcgacggtgatgggattgaggctggcgtccggcgtggagtggatgtcgtgctggaggttgacggcagcgagcttggcgccggagtcagaaaggaggagaaaaaggttgtgtggtgctaaggaagctgggcagcactgtcatcggcatcgaggaggctgcgccgcgaaggccggtggtgatggggattgaagccaacgtccagcctatagtcggagttgaggggaggaagctaggtggcgcagccaaagcgttgtggcctgctgttgttcggctcgtaaagaaaacaacgggaaaagatgggtgtcggggttatccggattatattcatattgttctatctagttctacttggacaaggaaacacctatgggtataaatagaacactagaaggagagggaacattccacaagaccaagatcaacatagaccaatacacaagccaacacacgccaaggcaagccaccggatatcgatattagagataagtctagacaaacccaatatgatgtctacggaggccaacaagagggatctagcactatgtctaatctcgccaagtgcagactcgaggaggaag

SEQ ID NO: 62306 - DNA, 2537 bp, Oryza sativa
cgatatcgaacgtcgacgaagagtttgtgcattactgttttttcggctcgtcaagaaaacaacgggaaaagaagagtttatgcattactatttttatagttcggctcggtgagttagtgatattttccacactcatattccattgttttcaatcctctgttttacctataaatttttttcctatttttatgatttttctatcttatgttttttctagattatttttgaaaacttatgtgccaaactaatttaatgatctggtgtgctttggtcccatattttcagctatattagatagacctatcatataacataagcatattccactcaatatggtgagctactttagtgatttggtgaaggaattttatgattcttaattgttgcaataaatgattcagtaataaatttgttttttcattgcagacaagaagatccgttattacaagtggtggtgtgttcacgctcctcattatatgttatgagtggtggcggggatacatattatgaaaaaaatatatctcttaatattattgcaaataattttgataactacttctccataaccatccttcggagctttaagatcctcagtattgacaatggttgagaaaacaatctcccatatcatggcggtttgtaattttatagcaatattttaaatataatttttccaaattcataaactatataaaattacaaaactaatagttaaataattttaaagcagaaaaataaataataagactacaagattgataaggaatatatagatataagtgtttattgtaatctctctctatctttccgtatgttatgaacaacattttttttaatagttatattatttagcttacaaaaaagataattatttaccgcttagcacaaaacttaaaggaagtaacgataattttagtaataacatcaaattataaatagggtaacaaaagaagaaaagcttagagaaatttttactaaagtaacattcgttgaaaaaagattatttgcaactataagtagtaagaatataccaactatttacaaataagttgatgtccaacaatatcattgtcaacaataactggtttactcataaaatcttacttaatctctcaaaatattagactgtttatcttttttagttttgtatcagcagaatcactgtatatttttgttatttatattatttaaaacattttgttaagaaaatctaaatgcatttaaaataaaaaattaataatagagggtttctttttataaatcatatagtttctttaatatattttttaaatatgcgtgattttattatttattctttatacttaatttaaaataatttttattttacatcaataataaacaacacactaaccatcatctctcatatttcaaaagcgtttaatagcattttatatcttaatgatattttaggattatatattgtcattgtaatgcataattttttggtgttgttgctgcaattatcgctaaatatattcttctcattttctcttatttcataattttgtcagactcttattcctttgtctttcctaatcaattttgaatattctttgattagtcatttttacctagcaagagaggggtttaaatttattttgttgattggcaagaaaggactagaaagggagggtcttatatagttatgcttatctgttggatttggctgatacagcttatgttgatgggatgccatttggcagtttcataaacgcgtagttagggatgcttctctcctcaacctcaaaaccacatgataccctcaacctcctcggtacggccttgtggggaggacgtaaatatatacgtttgatgaagcccgcgtaagcagggtatgcccatatcaattcaagagtattcatatgtataccaaataattttgaaaacataggtataacctatgtgtatttaaaaaaattaaaaagaggcctcaaacaggccaagaaacaagcatgccaatcttcatggggaaaaattcatctaaggtcccttaacttgtcaacgaatccgattttcgtccttcaaccggaaaaccagatataatgggtccctcaactgttaaaatcggtgcaaaataagtcctaaggcggttttaacggcggtttcagctaacgtggcacctacgtggctaatttaacttggtcttcatctaacgtggcacttacgtggcaatttgatttggaaaataataaaaaccgtgggcccgcataccagttacacaaaaatattttaaaaatggtggggcccacgtggacctagggatggcaacggggcggggcggggccgggttgggctggaacggccccacacctgacccccgacttcatcccccgcccccggccccgattggagatgcggggacaaatctggccccgtccccgatccctccggagccccgcattgggtagcatctccatccaatcaacacaaaaattataagacaatcatcaattcggcaagaacaaatattgtacataattaacaccataaaaaataaatagcatcaaaaaattcag

SEQ ID NO: 62307 - DNA, 6672 bp, Oryza sativa
accccacatgtcattctcaccccctcctttcttcctcctctctcccatttccccatgggagagggcgcggagagctcgtgagagttggggaaaaggtgaaggggagaacggggaagctttttatagagcggggaggcggcgaggaggtcgggatgaggtaacaacgaccagcggagtggggcatcgacgtggggtagtggtggctcgagttggcgacagtttttgcgggagagtgggggaagaggggcgagagatgtagatgagtggaggggactcggtgctatgtgatttggacgaggatgtgggcggcagcgcgcgtgaagggcattgacgtgggcgtcgaccatgtgacggggtgacgggaggtagaagaagaagctgacaggtggggcccacagcgagattgctatttggctatcagtcacgcgcagtgagggggcggcggacgcgccacgtgggaggaggagggaggagcgggttttccgattttttctggttttttttgggttttttttcctttttttccaatttctcttctgttctggtttttttttaagatgtatgaatacaaagtttgtattagtacgtatagaaagtttgtatacgtgatgtattttctagttttttttattatgtatgtatataaatacatacatacatacatacatatatatatatatatatatatatatatatatatatatatatatatatatatatatatatatatagtaaatttgtttggtgctccatggtgcccgggctccatgattcaaattgtgtatatacccaattcaaatgagtataaaactttttaaaatgtttaggtattaacattaactactttactaactagttcaaagcaagtttgaactgaatttaaacatgtttttattagaatttgattctaggtatatagcatccaaatatataattagttaggtatgtaatattggattgtgaaataaagttaaatttgagttgttttgtttctaggtataggtataaatcgaatacttataactagatatatactcacaatttgaaaaatttaggttagtttgtgtatttcataccatggtgccccatatgagtgtcctatatatatatatagacacacacatatacacgtatgtgtgtatatatagtatatacatatgatgtatatagtacatatgagggagactagaggggggcgactaaccgcgcgcgcgcggctgatcgcatatcagcgcccctcgggcccacggtcccacctttcggcgatagggagagaggaaggaggcggtgtggactttgagggagaggggggggcgaacgggccaaggaggcatgggctgtcggagggagaggagaggggctcggcctgtgagagaagagataaggatgagcgagtgagctgagggaggaaaggcagacttgggccggaaacagcccaagaacaaggaaggagaattttagtttgttttctttttatttaattaattaaatgaagtttgttttattaaaattacttcttgagctctgaaaattcatgagaaatttcagagagtactatagggcatggaaaataatattacaaaaatatttgtagccatgatttttaaaagagattttaattccctcattaattatcttaattaattgcaatagaaaatcggcgcgtgacaaacatgtccatcaattcatgatgggatctcaccaagcattctcattatatatcaacatttgactctctttgatttctaatgtgtgaggtatcatctttcttgtcatccatccacaatcctatcagttgatccttacatatgagccatcaaccttattgcttgatgcctggacaaactcacagcaaagattagttccaacaaccgttgtcattaatcaccaaaactcctctcaaaaaagggttagaggactgacagcgtgggtggtgatgcctaaccaatggcgtggtgagggattaatcggctgacagcgtggggagggagggcaagggatagagagagatacaagaattatgaactcatttgcaaaaacttttttactgtatcatttatttattatattgtaaaaaaattaatgatgtgcactatatttaacattgacgctaatgagcacgggacatgtcagcgttcgagggaacttctaaaaatcataaaaatgaaatctaacgagacaataaactctaaaaactattagctctaatttttaaaagttataaggagaatgaatagaaagagtgatagatggagcaagcaattaaaggagaggtgacaaagatgtaaggggtagcaactgacgtaaattttaaaaattataaattagaacattagggaaaataaattttggtctttcaaagtcttaaaacaatgagatagctatttaacaaattctaagtaaaatcatattaaaaatagatgattttgtatgggtgctaggcgcataatttatttattatattataaacaaataatgatacgcactatcattaacatcaacgctaatgagcgtgggacatgactttatgagcatcggcgggggcgttgcacgacttacacagacaacgcacgcgggccaatctctagtctctactaagatgtttttgtcagaattatggtatgtcattcgtgtttgaaacggttttaattttatgtttcgattttaatctatatctctacttaaaaacaagaaattcccgtcttctgtaaaaagggaaaaaaaagtccgactcaaaaaaggtaaaaaaaaaagtccgaattaacaagcgataaaaaaaagcttccgtcgtcgtcagtaaaaaaaaaagaaaaaaatcatctcttgtccgactcatgtagaaaaaggaaaaaaaatctcccagtaaaaaaaagtccgttgtttttttggcaccagtattttttctgttgttctttgcacgcaaaagagttttttatgcgcacatgctaaggctttaggttttttttttgtcccgttttattaatctgatctgtccactgcgcgcctcctgggcgcatttagtttttttcgtcaatcttttttgtcgccagttttttcttccgtgcgctttttctttttctcatccggtttataatcccatctgttcgccgcatgccttccaaggtgaaccctagcgccgtgccgccgccatatcgatcatgtgatttctcctccaatttgattgcaaaaaccgattccccactcctctctcatcattttctccatgattttcccttcgattcgtctttaattgccggatttaatatctgctttacagttgctaatgatgacggcaatcttccccggtcatttttatctcgagttttacgctctgattttggggaaaacggaaagagtacatcgaggggatatcgatcaaaaaccctcgaccaattttggctaaccgagaaagattcggctggatttgatggggatatttgctccggcaaacgtacgggcacgggcacgagattatcttcgggaggttgaagatgatagtcatatttggaaagttgaagatggtagggtcgaagagaagcaaaccaaatggaggtatagatggccatatggcccgaggcccacagcccgacccaagcacggcacagcccgactgggtcgtgcccgtgctggcccggcccgacagccgggccatgcctgggctacatcctcgacacgatgggtcggcccggcatggcccgatcaaataaaaaaatatagggacgcaaaatagacttatataaccatataaggcaacccaaagaaaagaggaatacaaaatagacttattttccagccatttgaacacagccacagagttgagggatgaaaaatagactttttatgtggagaagcacgatggaccatcgtgccttcgggccggcccggcacggcccgagtagtattgggccgtgtgtttacgaccaaatttagtaagatatgaaccaggtttgatgttgggatcgaggcggattcagcaaagagatgaattcgaagaacagagtatgcatcggctggaatctgcatcggctgatatggatcggacagaggacagccgatagaggtgatgcagccgattccaatgacgatggtttcagagctgtttctagaatcgatcaatatgcttcatgaggattgccacgatagagataaagctatcagataggcaattgtatctattaattaggatgtctcgtgtaattttcttagagataagtttgggcaaaagtctgtcgcaaagacttatgatatcttagagtttgttagagataggggtcgtgtccggcaaggacatattttgtatttcgggtataaatagaatccgaacccatgtaatcaattaacaacagttcaatataatatcggcgcatcgccaccctttttttttgttctatttcgacgagttcttgctttcgggttgagctgcatcgattcgatctttaactagaggtaagcttgtcatggcagcttgcgttatcgggattagtgcttccatctttacgacactctaatcttgtttaagtaattcgtcgagttatcatatacacattgtaatctttgttagttgcactatataacttgttatcggctggttcttatcgttaggaagtgaccgatagtgttatgttttgctattaatctagattatatcatgtatttatcatctcttatagtttttatcatcttgcctagatcttatacttatctttatgcttgatgctcatcggttgagttcgatctattaagtaatatctataattgtaacatctggcttgctttatgatcattgagagagagatagcatcggggtttcagctgatcttacctgatttagctactttacgtcctatatgcttgattgatatgctaaatccgccctttatattaagatcttattgcattaaaatatattaggcttcttgtttgatatattctatctgtaatatagagtggtatcggagtattagccgatacatgctagatctatctgatcggctatgctataaacgtttataatctttgtgttaatgtatacttcgatctaagtgatttatactgtctcggcatgacgaccgatctatcccaatcaattggtttaaatatacatcaacagaaggattatatatcgttaatatctacaacagttaatatctacaacagatcgagtagatttagtcttatcttatttacttatgactgctgatcgatcccaatatgacatcggctcaaagataaatgatatgtcatcggcagctagccgattggctatcttttatggatttaaccgtgatttttcttgtctttttttcttgttgattgtaggatcaaatcaactggcacgctcacgaacctaaaagcaaggttttggacctgcacggaagttaagcagatcttccaggccagtgtatgtttttcgcatcaacaccgtgcatgggccgtgtatgccactcgtggactggcacggcatggcccgccgactgtggactggcacggcatggcccaccgtgtcggtcgggccgtgccggcctgactagccttggcccaggcacggccgggcttgggtcatgacgtgccaggcggcccagtcagctatctataaatggagggaggagcggactagcctagggctgaaaaagaaggaatgctttcggccgaaaacccaggaaatattttcattaactttttttaattataatctatagcgatcccaatgttaagatttttattaactttttcaattatagtgtatagtaatcccaatatttcaatttattacttagctcttaatatatcactacaaaaagtctttacccgttgcaacgcacgggcatcttttgtagtattataaaaattgaaaatgtttttgctgttatttttagtacgtcatctgtgtatgagtcgatttttaagttcgtttgcttttggaaatacatatccgtatttaagtcggttttaacatcgttcacttttgataatacagaaggaatcatataagaaatctgtttaaaaaaactcgcatgctaactaagacgatcggactactaactgcacctaataattttctaaaaatatatatatccaagcgaactctcacattgaatttcgtattaactaaaccatataacaataataataagattaaaataaacttcactcgtcgcaacgcacaggcatttttttctagtaataaaaaaatgttagggacacgtaaaaaatgaaaaggaaatcggaatccgattgggaggcgagtaggcgaccggccggcctgatcgagttcggaatcggaatctgaatcggcgcggttgtacgtctcgtgtggacatatatatataccacctgtccacccgtcaccagaagacaagcgtacgtgcgtcgaactatggcaatccgcaagcaattagtgcaagtgcaaccgaaaaagatcgagatgtggcagtggcagcctccgcctctccatccaggggtcgtcaccatggcgaagcacaagctacagttggaggacctgtcgcagacgtgccggcgagaccactactgcgtcaggtgcgtccacgccttctgctcccactgctgcgatgaccaccacttcgtcccgctcggctcccacatcgtcatccccatcgccggtgtcgacgccgccaccggcaagcccgtcatccccgcgcactaccctcgccg

SEQ ID NO: 62308 - DNA, 23149 bp, Oryza sativa
gaaagtcttataacttgaaacggaggaagtatctaggaagcgcgggcgacgagggatgagcaagctgccagagggcgtcctcttgcgccatagctgcaacaacgtcagccaggactgtgtgcaattgttgaaaacgccgctgttcttctccttccaaatggaccaagcgccaagggtcacgactgtgtcgaacccgcgacagcactccctctgaaccttgagcagactggagcagagccgctcgtggaaggccgctgctccagaagggaagcattgggggaaggccgctgcagacagcgatgtagtggtcatccccggaaggccgctgcgcacaagcgtcaccgacaaacactcgcctaattgtcctaacaaagattgtaaaatcgttccagcagacagcagctgttcaccacttttaagttgcgtggaacaacaaccatcaatgttgctaggacagaagaacatagcttcataattgctctgatttttctactacgagtactaacttgcaacccaacccatcaatcttaattgctaggggacctcaataatttcattgttctgcctgcgtcgtacaaaaattcagaaaagggattaaatggttgctgttcacctggaagaagcagatgtagtggccgtccccgcacacggccctgagggtttgtacggggctcctcgtggggttccgcgggtggtactcgacgctgagggcgacgaacgccgtgacgaggtcggggcggagcaggcacagttgccacgccacggcggcgccccagtcgtgcgccgccacgaacacccggggctggccgacgtcggcgatgagcgcgacgaggtcgcccacgaggtggagcacggtgtaggagtcccggcccggcggggcgtcggagtcgccgtagccgcggaggtcgggcgccacggcgcggaacccccgcgcggcgagggcgcgcatctggtggcgccacgagtaccagagctccgggaagccgtggacgagcagcacggcgggcccgtcctccgggcccgcctccgccacgtgcaggcgcaccccgcttgccacctccaccgtccggtgcctcacctccgccgccgccatgtcgcgcgctcgctaccacggcggtggttgggcacctcacctggccgagtagtagacgactagtaggagagtagagtagtagcggggagctttgcgttccgaggatttgggcggtgtgggtcgcatgactcgcgctctgctgccgcttgcttggttgctttgctcaatgctcgagagaatatcgggtgctaccgtgctaccaacgtcagaaaatacatccaaaaagttgcaaaaaaatgtaaaaaaaaatcagagatgtgtagctctaagacatgtagcatcacacaaaaaaatcagtttaaaatatgatgtaggagaaaaataataataaatttgtgctccaacagtgttcaagcatgtcactttaccaatcaactgtgatttatctttttttccctacctacatagtattttgatttgattttttttatattttttaatatttttcatacctacacatctccgaattttttcatatttcttttgcaactttttggatgtattttttaacattgatagtacagtagcacttgatattcttctctcctcaaggctcgtagacccaaaagtcagaaactcctggacatatatatcgttttgggaaggggtgagggtggtacgaaaattttctgaccacgccgataactttctgtaaactaatatcataataatatttttatcgactattattgtttctaaaaaaatagtttttctcaattctgttacattgaagttaatactagatagttaaattcaaaactatgaaattttccgactgttttcatagaaataataaaataatgatattgtttccgaccatttttatcccagtttggatattcttacgatctttgagatatagttctaatcacgcatttataccttttcataattaggtaactacaagattgcctcattcagttttacgcggagctatataatgcatgtggagttagacttaatatacaactctaattttttatattcataccattatatgtaggggtatatttgattttatataccacacttagcttctatttttctattaggtctggatttgcttaaattttatatacaactcacagcttctatttctatttatttaattatgttttgtatacaattatatcaatcaatatgtatcattgtagtttggacttaccataatttaattcttaagatcttttttttctttttatttgattaatgtgataatttctagccttcagaattaatgcggtgcttactttcaaagctatttttaataatatactactttcgtttctcatattatatgtcacttctatagaaaaatatattagcatttccaatatgaaacaaatatattatcaaaatatattcaatgttatatttaatgaaactaattcgatctataacaacgtttgattagaaaaaattaaagtaagttataatatgaatcggaggaagtaatagatagatagtgttacgaaacttatctcccgaaaaaatcggatttgtagtgaccgtgaggtcggcgccgtgatcatgatggtcatagtaccctcctgcctcctccttttattcttcactatccttagggatgaagtaggcttatacaaaatatataaatatacatgtatgtattcttatagcactctattctatcatgggtataaatacagtagaggggttgagggaaaagttaacctgtaacagagagaagacagcaataaaagtttatagcccctccacttttgtgttccgtgtattcgtgtgtgtgtttgtgttctattgttgacaacgtgaacaatgtagatagatacggtaatatcatggtattggaaaaggtgctttttaccacaagaaatccataccttcggttattgtatatttaatccaaatatttctatcaaagtagcagctttcaagacaacaacatgcaactgtacccgacctcctcattgcaacgtgttacacggtgatattgttccggtgtggtcgctgtcgcgccgagatcccgcagtactacctttgtcccaaaaataagtgcagccatgagaatccgtgtctaacgtttgaccatccgtcttatttaaaaaatttatgagaaaattaaaataaattagtcacatacaaagtactatttatattttatcatctaataacaataaaaatattaatcataaaaaaaattacaaataagatgaacggttaaacgtgacacatgaacagtgcaaaactgcacttattttgggacggagggaatacgagtgtactacagaccaggttcgacatttgggactgaaattaatttgggagatttcggtcatttctaaccccttcaatacgatattatttcggccaaaacttctagtatttttttaattttggtaatatttgttcaaatttaactaaattttattccaaagttcgaatatcggcaccgctcgatacaaacacacggtaaacgaaaagttgaaccctgcgagagactggtcggtttgcactgcggcaccgcccctccagtcagtctcgcgccttcgagttatgctaaggacgcggtgtcacgttcctaaatagcgggaaatgtatatcttcgtaaaatttttaaatgcatatatgcaagatcgaggataacaatgtatattttaaaatttaattgtctattacattgctcttgatcgtttcagtcggctgtgggttccatagtttagctaaatatggataatacaccgtacgacataaaaaataatttgtgagtaatatatgtatatatatatatatatatatatatatatatatatatgtatatgtatatatatatacatatatgtgtgtgttctcttacgacttaaatatcaatactggaaaataaactttgataaaaaaattaaaatcaattttaaatttaaattttggaagcaagtaatgctgtatacaggaaacaatgagacgtctcctgctgcctacagctataacagtcagtttgttccactcacgcaaagtgaggtactgaggtgaggtgatctcgccatctcgctagctacctccgtcgatctctgaaaaatttggagagagaaagacctattagtgttactctggtcaagagaacacagaattttgcattggaaaagaaaagagagaaatataaaagagggtatgtttagttcacactaaaattaaaagtttggttaaaatttgaaccgatcaaagcagtagactgtacgcatgcattgactcaaaaaacatgcgaaggttcacggtgctcatgaatgaccggcaagcgtgttgccacattgaacaattcaagtcaactagtcaagcatgttttggcggaagttatgtcatttctgcaagcacgcatgtaaattttgctagaatttcataggaaacaaaagctctgcataggtgggattgaccagaatttttaagctccaaattaacatgtctgtagagtgtagaaatataatactactatctccgttttttaatacatgacgccgttgatttttttataaacgtttgaccactcgtcttatgtaaattttttgtgcaaatataaaatattgtaagtcatacttaaaaacatttaataaatcagatcataataaaaaaaataatgattatataaatttttttaataaaataaatgatcaaatatatcttaaaaaatcagcgacgctatatattaaaaacaaagggaatatcatttataaagtaagtgtatacatgttcgctcctcttgtagtacgtactccctctctttctccgttatctagatttatccattaatcaataaatatatatattttgtatatatgtctagatttattaatatttatataaatttaggtaatgctagaaagtattacatcgtgtaacggaggaagcagtgattattgacattgcttctccatctttgcaatcttggtaagatgtaacggtctgaacggatctaatgtactaccatgcatagatcacgaatgcgtcgaatgtctcatgcgtgacaaaattttccggccattttaactaccgccgatgaatttttcctaggagacctgatcaagtccacggacaccatgctcgcctcgccggggagtaggtagctcggttgggcattgagggatttgagtcaaacagtaaattgaaaagaaagtttaacttcaaaccgaaagtaattaatcacacgaaaggaaaccggttttgcagtaaccggatgtacaattgattgtacacagagcaacatgaattcctgtttaatttcttacacttttcacaatgcaaagcaaggtgctgcaaagaaggttccgtttcattaaaattctgaatgagtacgccgttcgtgagtaactgccagttttttttttttttgagttgtcaagctttgaccaatggtatcaatttaaatatgcaacaataaaacagtgtcattagatagcgatcaaatatacctttttccaatatcttttgcagaacaacgtcggtttcttatgttgcttggctctgttctttttagattatcgtaacagattatttactctacgcttcaaaaaaattcattttctaaagaaactttcttctactatattatttagattatcgttttaagctgttttataaatctattttctaaacatttgatttatttatgtaactaagtagataatctatcataatatttcgttgaataatccaaaaggaacagagttagtaagtcgaagccgggatggcatgaatataatacaagaaattaagaaaaaggtatggcgtcaagtttcagcagctagcgtataatcgatgaacggaggtagcatgcatcctagtagcacatctgttcgatatcttgatgagaagacgagatggagaagagaactcggctacgttgtccattcatttcacggcctgcccatcattagtccatgcccgtgtcacaccgagacagagaagacagggtttcacagttgcgaaaaagcagaacatccatgatcgatccagattcaaaggcacctggttcctcaaaaaaagattcaaaggcaccttgtcccctctggctaaatttttagtgtcatcaaggagaatttgctggttgtgcttacaataggttcactgagcgacgaaagccggttttcgtgttttttcgatgcggctcgaaattaattttcggttagaatttgaaatgcttttggaatctaaatgccaaacagtaattttaatctaaatttaatcagaatttattgaaaactgtgataccgacatggctcgaaatttaatggtcaattggtatggtaaaccctactaccttacgtataaagctctggatcataacttctctaaataaaaattctttttatctaaatatataatgttattgtctttattctgttaaacctatttaggtgtatttttgtctagagatagcagactttctatcctaacatcaaaatacacagcgatcaatgttacacactaaatatacacaacaaagtaaaacaatatcatatattaaaatacaaaggcaatactttataaaataacatctcacataagcggatctaacacgagttaagtagagaacctcatccggcaaaaaccatgaacgaacagaacaatgcttaaaggagtcaattcaattaagagaaaaaaaactcaatttatcatgttcacaataggccatggaaaatgacgtgcaatatcaaaagattttatagtcggccgccgtgccatccacaattcctcaggttgaactgataatcatccaaaggttccccatccttctcactaatctgctttcctcctgccttgggtttcacgtcgccgttgccgccggtctctcccatccgacaaatagattgttaattactcttaccacttgctcaaatcaaaagcccaacctgtcaagctcttacttaaatcaaaattaacccacgatgctgtcccaaactacctaagagtttcagatgtactccaactgataaatattatcgaaaattctaaaaataaataaacacgttactttcattagtattatacgttcatgtaaaattttattttcaaacaaaattgctgtagtagagaaagaagagtatcagtggtattactattagagcctgtttaattcccaattaaaaatttttacgctgtcacatcgaatgtttgtatatatatagagtattaaatgtagacaaaaaatatataaaattacatagttcgccatgaaattgcgagacgaatcttttaagcctaattgcgccatgatttaacaatatgatgctacagtaaatatttgctaatgacagattaattaggcttaataaattcatctcgcatattcctggcgggatctgtaatttgttttgttattaggctacatttaatacttttaaatatgtgtccgcatatccgatgtgacatgtaggggcaaatttttttctaactaaatagacccttagttgatttacaaattccacgtgcaccgaagtgggcgtagctcaaaagttgtgtggtagaatcaatccactcaggttcaaatacatactcgatatgagtattcacatttacagttatttattctttcagtgatagatagcgtatccatggacaacgagacgactcatagggggttggatgtatgtgttttttttatatttatgtatgtttattcatttagtggtagacatatgtagtcgatagtgagacgactcatatgggtcgaatgcacatatgtgttcatagagatgagtgatacgacttatagagctgtttaatttttcagtggtagacaacatatatatatacaggtaataaggcaattcatagagatcggatgtgtatgtatttataggggtaagtgagaagactcatggatatcgatctgcgggtgtattcataggggtgagcgaccgcacgtttgagggtgtgtacagtgtactgcgttgtaaaagaaaaatccacgtgcacagttaacagctcaattaattaatcgcccacaccgaagcgcgcaccacgaaaggcagcgccagcgccagcgaggctgacctgacccggacggacggaccctgccgtgtggggcccggatcccagcgcggaacaccataatttagcagcagcgccagcgtcccgagccttggctccacccggtatcccaacccgagggaattgcggaatccaacaccaccaaatcccccaaattaactccacgccaaggaaacaaaacgcccccccaattccagacgccaacgcgaggtcgacgaaggccacgtctccgactccggctcgatttccaccccccccaaatcctcctccggcgagcggccggccgcgagacaccccggactctcccgcgcggcgattcttcggtaccccgatcggaggaggaggcggcggggagggaggaggaggatgagcttccaggacctggaggcggggaacgcccgcgggctgccgcggaggggcggtggcggcagggcgggcgccgcggccgccggggcgggggcgtcgcaggccgtggcgtcgggggtgttccagatcaacacggcggtgtcgacgttccagcggctggtcaacacgctcggcacgcccaaggacacccccgacctccgcgagaggatgtgaggctccccccgcgccatactctctacctaccccacgtctgtttggttttggtttgatttggagcgggggtcgggggatcgattttggttcgatttggagcgggggattgggggattttgcgatccggggctccgattttggatgcgcgtgatgaattttgggggggaattgtgcggctccgctgcatgatttgcgatctcgattaggttatatgtttatgcggtcgattcgcgtgatgaacctatgtctctcatattatgtgttgcttagggatcgcttctccccttctcttcgtgatatctctcttattacgtgttgcttaggattgcttctcccttctcttcgtgataattatgtattagtgataattagggattcaatttgcgagccctgcctgtagtttatctactagcaactcatgtttgggtgatagccgctgaacttaggtagaattgatgaatcatgccattcctggtatatgaatagatccgatggcctcgaataagatgttttctccattcctttctactgaaattgattcaatttatgccatgtatggcctggcatgctgtcttatagtgtagtaacttgtattatgccttaaccctttttctgtactttagactagttatttttttggtttgatgggtcgatttactttctgttggtgttgcttgcagacacaagacacgtcaacacataacacaactggtgaaggacacatcggagaagcttaaacaagctagcgaggctgatcatcgtgtcgaagtcagcgtaagtattctcttgcatctttgtccaagttgcttttttctcaaaacagaattggaactgtttctatcttgtatgtttgaaaccagaattatttcagtactcttcaccttttgcatcaaaatgaaatggaattgcaacatgtgatgctactttttgaaccagaaaaccttcaattttgacattttccttcaaagtacagaagagtgtaataatgcatattggtttggaaactgaacctacccagtccttatattctgactggaaacatcacttctaatttgggcattttttatctgtatcagtcttagttttgcctgactactgtgaacagtgatttgcctcagcacataaaacaaattgttttcttaaatactcaatatgctccagtcatgatattttcaagtgtgttgccatgccactggagaaataatctacaagcagattttagaatcatgtagagatcaaatgtagcatttgcatttcttatatgagctgctttatgtagtattgattgcctatgaatctatgatcattactattttaaggaacatttctatgttccatttttgctgatgtattacacaatgtgtgttgatgacctcgtttggaactacaggccagcaaaaagattgctgatgcgaagctagcaaaggatttccaagcagttctgaaagaatttcagaaagctcaacggttagcggtagaaagagaagctgcttatgcacccttcatttctcaagcgggcttgccacaaaggtagtttgctagtcagctggtgtacttctttctgtaaatacttgcttatttttcttcctggcatcttatgtttttgaacaaaagtgcacttactacaataatataattcatggcatattgtttatcattttcttggtagtgtactaatgctacagcatcctgttacattttacttactctgcagaataattttgttgcatactctctcttgaacaaataaattattctacgtcaagttttaaaaaaatttcatgaaaaaaatattttcagtttgactggacttaacactggattatgttttctgaggtaaatggaataataataacactggattagtgcttttaatctgccaagtgcttgatgaccctaatagttaatgccctggtttattccaacctaatacaataccttctggtgcgcatttacaggatgagcattcatatttgatcctatccaaatagttcgtattgctgttttgatctactgtagcgtataagtttctctgcctgttttacccttaaatatctagcgttttgttcatggtccactttctcagcccccaggccctagctttcaatatcataaattcattttctgactaaacttgcgatgaagtttgtcttattcatagaactcagaataataaaaccactttcaagtgtagcctgtcttcttgggtcttccaagtaaaacagcaaaacattattttcttaaaattatctccattcaatggtactttagatcattgcaaaattttgtacctcacattcattatatgttaattttctgtaataataataacaacatatttttgaggctggtctatgataatatattgtcaaagtttttccagtatgttgtcaacatatgagtaatctaggatggcttgttctttgcagctataactcgagcgaggtgaacaatggtgctgataagttggctgagcaacgcacggcgcttctagaatcaagaaggtgaattgatagtactatttggttatgctttggactatttgttttcgaacatttctataaagtattcacttgttttgaaatgaatgaacaaattcactcctttgcaaatgtgtgaacatgataacctcaatttttttctttactgtaggcaagaattagtcttcttggataatgagatcgtgttcaatgaggccgtcattgaggagagggatcagggaatacaagaaattcagcaccaaattactgaagtaaatgaaatcttcaaagatcttgctgttctagtccacgatcaaggacaaatgattggtatgtggtaccgttggggatgatagatgggattatgtgctatttgatacgttgaagcacgaggctgctcatatatctggtatgttatatctgattgtgtatctcctcctatactgcagatgacattgacacccatatcgagaatgctgttatagcgactacacaagcaaaaggccaactctctaaggctgctaaaactcagaagtcgaactcttcgctggtacttttagactcctttagcactcattaatatatttcactggcactcacttcaacatgtgaaacattgttcgattctcattttatgttgcagatatgcttgttgctggttatattcggggtggtcctgctcatagtgataatcgtcctcgcagcctaggcagcagcctggaagaacatgggactcctagatctggttgagcttagagcgaagtattccttcctgatttaattttgctgtgaagtcgggaatgtatcctgatctcctgcctggaggagggggttgcgttctggtcttgtgccatggtggtgtatgtgatgatgaatggtgtgtctggaatgcatggtttatatataagtaattaagtataatcgcttggtgtcactctagtgcctcctgccttgctcgctcgcccctgtttatatcttgtgatgtatcgttgagtgagtgttgtaagaacgaggagtttggtctttgcattataatagttgcttaagttggtcagtaaccgtcgcaatttgttgaaacatttcgtttttctctcccttctctcctgtcctcgttctactgttagtatcttgttttcgcgcataaaactgctcctgtcctcgttctactgttagtatcttgttttagtgcataaaactgagttgtggatgttcactgttcagtatatgtaattacttcctccgtcccaaaagcatctaacctagttagggatgagacatattcgttagggatgagacatattctagtatgatgaatatatgttggggatgagacatattctagtatgacgaatatagatatatgtttatctatatttatcgtattagaatatgcttcatgtttcatcctctaagatttctgttttttttttggacgaagcgaatatgtatttgtagccacgtccaggggatccagagccgtatgtgtaagttacagatttgcgcttcgccactttggctgtggttagttcagcgtaaagtttggattttggttgaaattagagatgatgtgactgaaaaattgtgtgtgtatgacaggttgatgcgatgaaaaatgactgaagtttggatccaaactttgatctaaacacagcctttaccatgctatgaccaagagctgtgacgcgcttggaccctgtgcaagtcaaggtcagctcaactctggttttgtctcagttttcttgtcttgatatgaaaatggaacagaattagagtgagcatcttcagaaatccgatcatctttttcacattcgtacatcttgataatgtacgtgtaactctgaacttctctttcagatgagtttttgtttaagctgtgtttcttttttttttgttgaagttccaacacatctttctcgttttccaaactattaaacggtgtatttttttaaacaaaattatacgaaagttgctttaaaaaatcatattaatcattttttaaaaagctaatacttaattaattatgtgctaatgatcattccgttttacgtgcacgatatattagttccgtcagcaaggaacgaaagcaacctacgagtgtactccctttataaaaaaaaaaaagctaacctaaagagatctctctcctactagtacaatgaaaatgaatctggacaactatgaggggttagtttttttttttttggcataggggagtatttgaaggggggagaaaaaaagaaatttgagaaatatgtaaaacgatttaaaccattagcgtataattaattaagtattaattattttatattttttaaaaaaataaatattatgattttttaaagggagaatagctaatatggtccttaaagtttcgctcctgggtcattttagtccttaatatttcatattgtccaaacaagtcctttaaatttatcatgtggactgatatagtccttggtcccaccaaaatcaccacatggacattgtcggtgatatgggaccgggagtatcatgaccagaggcttgaggcagacgcaatcgcccacatggcctggcaccttcggggacgtcgggcccgagggtgaggtgtccgccctcctcctgatttcccccgagggggggtcgggttgcgcttgccccggccccgagggccgaggcaccccgaccccttaaggaagtctgcgccacatatatgggataagtgagcacagctgtgctcacctaacagcatttattgcagtctggtcaagcgtgtcacgctgcatgcaacgcagtacagcgcgttcctttatccggtctgtgaccagtcacagaccggtcagatcacgggttaggtggcgactggcggtctgacgcacaccttgccccatcccgtcaagacgaaagcctctaggcactcgtctcaagccggagctagcgtgttatctcttagagatggcacgttagccctggtcagatttataccaggcttcatcctaaccattacaggcaaggtgttacacgaagaagggcaaacatgcacgttgttaagctgacgcgtggtggacaagaatgaccggtctggcactggtcgcgtcatcgacagacagccacggtcccgcgtcatctctgtcttcgggggaggtgggggtaggtgtgggctgtcccatcagaagggctcccggatggaaaccgtaccgatctccgcccattaaagagaaaaagaacagtccagtttggaaagagaaaggtgcatgtggtatccccttgagatataaaaggaggaccttgcccatttagtggggggactttttcccttttggaaggcagaggggaaaggaagtgaatactttgtagctccctcatacacagatccactaaaaacacaggagtagggtattacgcttcccagcggcccgaacctgtatacatcgtccgtgtctcgcgtttcttccgggcacgcgatcttcccacatacagagagagcttgagatctcaccctaagcccccggccgaactggcaaaggggggcctgcgcggtctcccggtgaggagccacgagctccgtcagacatgccatgtcacattcctatgcaaaatctatatgatttgtccaatttacccttacgcacaggaaaataaaaaacaaaaggaaaaagttaaaaaaaatacatggtatatgtaagagcaaaaatatacctctaaagggtgaaaaaaagagtatttttttcctatggctatgtctaattcacttttatatttatttttctatgatatacataaggttaaattagacaattcatcatagattttgcatgaatgatgacatggcatatccatatgatgattttggtggacctaaggagtattctaggccttatgacaaagtttaaggatttctttagactatttaaaaggttaggactaaactgattctataaagaaattttagggactaaagtagctgttctccttttttaaactaattctcttaaaagaattttataaaaaaacacatcgtttagcataagcgtcagtgcgggaaaacagaaaacagatatattttttcctctctcagtctggtgcaacaaacgcagccgtacgagtgtgttcgggaggaggtagagtggaaaacggaacttgcattcggtatgatttaaaatactttaaaaatggattaatatgataagcagaacccagcatgtagtagactccacgtggacttggcgttgacgaggagagactgaatagttcagtcttcgcccgatcggaccagagctccaggtcctttttacctgaacgcgcgatatccacggagctcaaggtcgtcggacagaagacttgagtggactagcaactccgtgctgtgcttcccatctccttcagagaaattacctcccaaaccgattggcagcgatcaagaaagtacgtgatttaactatgaaatttctcctctatatatggcggtgcgtgtgtttgtgtgcatatgcactcagcatgtttgaaaacaagaacacaagataggagtagaaaagaagatcttagtagacaagaagtattggcttcgtctaaattgctgcaaaaattttactgttctttctccgatctaattaagctttgcagctggacattgagttaggggccggcgtggtgaggtaagatggacgccggagcagttgaggacggccgcgccggccacctggcggaggtcggcggggagctgggcgacaaccaccggcgggagaacggcagtgtcgccgccggcggcggcgggcggcggccgcagtcacgcgccggggttcggggcgaacaagaacgacacgctgctggtggtggcgacgctgatcacggcgctgacgtaccagctggggacgaacatcccgggagggtactggcaggacgacggcgccggcgacccgatcatgcgggacaagcaccggcggcggtactggctgttcatggcggcgagctgggccgggttcgggagctcgatgctgctcacgctggcgctgctcaccggcgtgccgccgcggtcgcgcgccgtgcagtggccgttcctggtgtcctactccagcctcgtgctcacgttcgtcacgtcgcagtcggggacgtcgctcgccatggacgtgctgatctgggccgccgtcatggccgtgctcgccgtcggcatcaagtaccgacgcctcgacaggctccgcttcttgttctgcccacctgctccgtgaccaaacgttgatctacaaattaatattggcatgattagttagctcttttctgttctcgttgggctagccgagcaccctgcgtggtggcagcggtagcgcgtccgagtccgagtccgagtcgcgcgctacgacggcacacgcgggtcgcggagcgctcatggcgcgcatatggaatccgggtcgtgtgcactctgagcgggatgcgtgggatggcgcgtgtcgtcaaccgcggagtgtcgtggaacgctgcatgaccatctcacggccaccgccatcgcagtgacgaggccggcatagaggggaaggtgggttggggaaagtcccacacactctcatagcggattggcggtcgacggtaggagctgacttggctctaatactacttgttggctcttgtctatgaatcacacacgcgaacgtgtggttgaaacatcaggtgtttgtcccaaggttcgtgtgtgttatttgtatcgagagccaacaaatcatatcagagccatatcggctcctaccacgaattgtctcgtgtgtagatcaaagaccctattatggaccccgcaaaaaaaaaagatcccattatgggccccaagggtgctccacctccctacatcagccttggtcgtgcaacgcttggtcaaggaggttagagggtcaacttcgtacccaatgctcacgaaaacggcctataccgatggagtgctgatgacttgctcacgaggtttttgttgtaaaatttagaaaataaattagaagccaaaagctgagaaatttagctttgttatattctcatatcgaagctgattgccaatcgactgctttttagaattttaaagctcctcaaatatgttatatatattggccaccaaatagggtatgattttacaagaccaagttagatatgaccatgacttgtcatgagctgatcaaaattctctctacgagtacctcaagagtacaggaacttagagatacgaataccctgtaaggtcaagacaccaaggccctgtttagttcacatcaaactttctccaaactcccaacttttcatcacctcacatcacatccaaaactttcctactcacataaactcctaacttttttccaaactaccaactttccccaaacttctcccaaatttcaggaactaaacacaactcaagaaatcaccgaagtaccgaactatcatgcataagaagccatcaacaacctcaagccgaagaccatatcattgaccacatcttgccactgcttacctcgtcgagttagtcgactaggtctagataggggtgtgatcggtcaatttcaaattggataatggctaaactatatcatacacgatataagttgagacggattggaaaatgaatcgaatgtgtgtcaagtgagaatacaaatatgatgtgtggagaatatgtgaactagaatcagttagtaatctattttggtccgaatcgaatacctaagtagtttcatttcaagttttcaactatacaataataacaatgtaagcacttacatgagataatttagaatatttgatactaaattgatatattttgctaactattaatggtattgcgacaaaaaaaggtaactaattatattctcaaattcaaccggatgtagacttagacggacaaaaatgttatttggatgtcaaaatcaaaaccattatcgctcccatttatttagaccgttcaaacatgaattcgagtggatgagattttattattcagatcagatgtgaaaattattatcattccatttatttccattatgtaattatcaggttcattaatcacataaattgagataataaatatctaacttgcactcatatatcttactctatagttcaacaaggtgtttcactcatcactcattctttcattactcatggaacggtccagatcatctctgtgtaaaatccaacgctcaggatcgtctccacctctccaccgcgccatcctctccgccccctttctctcgctctcacgcgtccccgcccctccccaaccgcgcgccgctccccaaccctaatctctccctctcacgcggcaccaccgccgtcgttgccgccctcgactgccgcagctccgccgtcgtcgcatccgtcgtctcgccgccaccgatccccgcgccaccaccgtcgccgccgccctcgactgccgccactccgccgtcacccatcgtcgcatccgtcgtcgccgccgccctcgactgccgccgctccgccgtcgtcgcatccgtcgtcgccgccaccctcgactgccgccgctccgccttcgtcgcatccgtcgtctcgccgccaccgatccccgccgccggctcgccctcaaccaatccccatcaccgtcgtcgcatccgtcgtcgtccaggatttacgtcaccgttccgtcaccgcacccacacgatgatccccggcgacggaacgggtcatggtggccttggaggatactcgggcccgacgagctctcggcgtctcaggtaatgtcgccgaagacaagaactccggtcaagctcctcggccgtgaggacgcaagcgtgtgagtgtatcccttttccctcaaatttaattatgtactctgttacttagttctataattcatctgctcagttagtgtcccatcacaatcgcttggtcaggattgaatgttctgtggattggattgggagttgtttgctcaaggagcaattagggaatattttagttggttgcggctgcaaataccatcagaacaacaatggagtatttaacaagagccaacagccttttgtttcagatgaattccctctgaagtcacccgtcaattgactaatgttagacaatctaccatctagaggagatcattcctgaacccaatatggtgataagccgcctctgttgatgtgttacactcattgttacttgttctgaggtgtacaccttgcttgctatattggaagaatgaatttaattcacatggatataatattttgcaatttttgtatatgaaattatatgcatgttcttgtgatgtgagaaggttaaattcctttgtgggatgcccatttaatttctggttgctaattttactgaagaatgagagtaggttatgatgtcttgggttttgataagtagggtgtaaatttttatagtacaataaacatgcgtgctggtcattctgttatgtgggattgaaacaagtgatgctggcaattcaggtgcagaccagcttttggttctgtaaattattttctcaatttaaatagatcatgtattgtgatgatgcgaatataatattatgatgttatcatgtgttcaacagagcttaaaaaatactcacaaactggattctcgtagttatacagtttaaataagttataagcacgatttgggtttgatgtcttccatttgatttttagcgctcctccctcttgctccgatctggccttagtgatgccgccctgttttcgcggttgatcccggcaccagccccttcctctggccgcgtgcgagttcgagattccaagtcccggtggtcggatttctcaaccccggcactggcctcgcacaggctgcgatccgctcgccaacaaggtaagtcattattgggatgtttatatctgaaaatttagataatttcttttgaacttcattgcttggtcaacaacataacccaggaaaccaattaaattgatagacatgttgtgtgctctcttaagagatcaacatccaaattgacatccaagttaaaagaagaatttaattatctaaatcatgatgccaatattgagagcttcttttactttccgttgtatacattttctgtgatgtgtaccgaaggttatatacataatgagattttacttcaatggtggaattgtgctctattgaaccacatggaaagttctgatttgtgcagtgataatttttccctttaaaaagtcaaatttggtttacatttttattcatgacacctgaatatgtagaatgccatgcattagtaatgtgcaagcactttcaatgtattgtctaaactctaaaggaacaacttaccagtttattagtgaatttatgaaaaaaaaatcagatgtttaatgtctgaataaattcagattctcttctctgcttcatgccttcatcaggatgaggtagttagtgttgtactgtagttgacgaatcgatttgttcgcatcgtgataaggcgcagaaggtaaggcggaaattgccttggtttatcctctccccctaaatttcctctgctgcgattggttgattggttaatgaaaaacccaatacttgcaagcagattctgattagattcttaattattgggattttctagagttagtttaaggaaaagtgagttaattatcgacgatgaaatatacacttccatgattagaattatatatcgtatagacaaatatgtgtatgtattaaaaatatctgacaaattggactgtatgattataatgcctttcaaccattgctttgtgcaatgctcattatatctcccggaaattaatcgatttctgcttttgtaccatgtgcaatgtttacttttaaactgctcaggttcattctatcttattttctggtgcttctgaagcgatgtatatttcttcatttttaaactgctcaggttcatgaatgccaccatcactgaatgcacatctggtcctcccttattttcgttcgtatgtagtatgtacgtaagaactaacaagtttattcattcaaagaaaaactaacaagtttatgttaagcttcctttttaataatattttacattactgatatttagtgcagtgaaaaatgctgcaaatctctgatatttagtgcagtgcaaaaatgatacatagcttgattggatgctctttctcattatggccaactgcttgatggaattttttccatgtgaaaacaaatgtttactctgtttcaggcttgtgtagagaagaaaaggtggaattgtggaaggtaatcgcggggagttttggttcattttttgaagatttctctaattggtacgtactaattaaccaattggagttttggtctcgttactcactgtaaaaacatgatggtaaaaaaacagtttaatcctattggtactcttttatcccattgaacattttgtcgttgtgtcattgactactatcaaaaaggaaaaacagtggatgactctttcaggaaatataggatagccccattgatggcacattttgaaccgttcatgatccctgatttattctcttgaccatattctgcactgctatgcttgctaagtaatacaaatatatttatatccctgtagcatgtcagttactctataagacaattttttttacataactaattaacatttttactaaactcttttattttgacaatcactctaagacgtatgcaattgcgtcttacgaaagcaagtgaccctgagagcactgatctttgtaaagatgcacacagcttactgcaggagaggataacaaaatagaagtctataaaaatctatagaagggatcaaatatgcttgactgaatgatagagatggaaaaatgaagaagtgatgactgttgtttcacaatgtattcatttcatctatcctataattgtagtggtgtgtcaatgtgtgatacttctagattttcccagctccattttgccagctccgtgtgtgttaatgattcagaagtcgtggaattgcttggaacatgtaatttattctcaaccattttttgtggaagtgtggatgtgcattgtctaatatattggtattgaagtgattaaatatgattattgatcgttttgaattaatattttagataatataatatcactgtactttgccttgatatctgacctagatcaaaataaagctcaattgggtggattctaggaaacatatttttactacttcctccatttcacattatgtgtctagattcattaacatctatatgaatgtgggcaatgctagaaagttctataatatgaaacggaggaaataacgtgtaattcgttaacaaaaatgtattataacaccgtagagttagcacgggcagattactagtctacattagtgtcatatatgtactttttatactttgtatatatatcctagtgggccgtaggggtatttccttgaatgggggcatgaacctatataaaatcttctcggaaaatatagggattgatacctttctagtttgtacaattaatcacatctaggtatatgtaaaacatttattccgctactaatcattgacaaaaatctttaaaaaatcagaaaatctagagaacggagtcccgtagacacgggatactactagtaaatatccagcaccactactcacaccacctatttaatcttatcctctccttaatctcttccccttcccctccacacactctttctctctctctaccacccacatgagcacggaggcaatgacggcagctggtcatgcagggtggcgcgtcgggcgtcgaggaagttgccgtcttgatcgccgccgttgctgttggtggaggtgtaaactgagtagaggaggagatcacgaagttgtttgtggggtaggtgtccgagcacatgacggaggtggagctgctcaccacgttccaagatgcagccatcgtcaacgaggtcactaccatcaaggacaatgcccttttgtggtgtagatatgtagaccaagatctgggttcatgaccctcaagctcctgccttggcttgctttggggtttgatttaggtttttctacatgttctatgggtgtttctacag

SEQ ID NO: 62309 - DNA, 6018 bp, Oryza sativa
cattttctaggcggttggtaaatcctttatgagtttatttactcggattttacaccacatatgccatatatttccaggtatggtgaaaccatgtgtcttctagggacttaagcacatgtgttaaagcagtgtgcgcatggcgtatgcccaatactttggaaatttctttattcacaatatacaagcttctttatagctattttgctatatcactcatcatattttacaaagcagttggtatatcactcggatcatgttatttggaggcttcacaccgcatatgctatatattgatatcaagtcacttggttgattacgattatcaaaaccactcggttgggtggattatttattccttgactatatgcctggtttgctcaattaaccacattgtcgggggctacacctattaggtgcatctagtcggtgcacctgactttattttccagccctccacagtcttcagatttggtaaaaggtctcgggagaccatgacaaagatgattgaagcactctgctttggagtgatctggttcgagagaagactatcttttcgactgcaaggtctcaggggctatctgggatattatgggtaccccatacccatatggcatggttatccgactagtcataggggataacttatatctatggaatatgtaataaatcatgactcgggtattacgtttccttatatattacggaacagcctaaagtcctggtttgataatattgtaaagtagatttaggaaaccgataccgtattggttaaggtttctatcttgtaatcctgccccccaccctatataaggtgggcaggaggccctctagggggcatgagacaacctgatcgtcagatcaatacacactcggcggattcaaatccccaaacaggagtagggtattacctctcattgagagggcctgaacctgtctaaatcctttgtctccacatccatccacttttaggtctcgtgcgctaccccgttttattattgccgaattcatgtttcgacatcaggtgactgaaaatattaaaaacaccggtcgaatatactcaccatcgaaccatgcacaagattcatgctcttgtcgccctccatagttctggcgtctctccgactacacaccgcagtgaagcagagatcacctcaaccatgagggaggagggtgttggactggtgatcgtagcaagcttgatgatagaagccgctagagaatggggagatgcgggatagggagaatcgtgctagagtggaaaatgagggcaggacaagagatagggaggcgggaaggaggagacgaaacatatggcaacggtgtgcattagcatggtgggaagagaggagggaagcagatcgggcatagggaagtgaggaggttagaaaggggtagcgatgaattaggcaaagaggtacaaagatgggagagaggccggcggtggcggtgacggatcaagcaaagggagtggccaactgataaaggagggattaggttaggtttatagtatgggtgcacccttagtttataagagtttcccaaaattttaaagaatttctaaccattcaaatttcaaaaagtaatttttttaaacaaaatcaaatggctagatagacaatccactcataattgatgcaatcggggccacagaccacgtgtttccatcagccgagagtaatactataggtgcggatctcctagagttggtaacttcacaatgtggatttgagccaatatcaaccattgtcttttatctacggtctagatataatcaaacatcactatctttgctatatctgttttcatcccatcaatagctccatggaaaaagttatcctctactagtgggggtcaacaatgacctagatgaccaatcatcatagccgtcggcgtagcacacagagtcacagacaacttgccaagaaaaaaaaacactggccaagcttgaagcatgaaggaacgtatcgggtagcgcatcactgcttttcttatttgaagcctccatcatcatttgaattcatattcattatttagaaattaggcacaaccgattgatcgattagctagtgaccactgggtagcagcaaatactctcactttgcctcttacttctgccttctactgaattgttggcatgtggaaacactagttcgcaaacactcgcgagatgtccatctcacaaacgcgtcccatccacataacgacaagccccaacttaagattagcgttagaactttggtggtggagtgagtggaactagggaggggaaagtgggggatcagacttagagggattggctaggggcagcggactgacaatgggtggtgaacaagggtggagggcgaggcggcgacgacgccacgaggtcggtagcaggcggtgggccgacgttggtggcgggggcatagctgtcacaccctaaaaatcctaaatatataaattgttgtttaaatggaattattagaatttatttttaaaagtctagaagagaagatctaattttaattaataaattccaatataaaatggggtcagataaaatttcattaaatactttgcttaattctataattcctagatttttctgggatttatttgagctaaggaagtatttttaataaatggaattgcatttcatgaataatttaaattaaaaaaggtttttaaaagtctcttttggctttgggccgaaagtcggcccaaaaccttctctctctctccccggcccaagtcggcctagtccgcagccgcagccgcccgcgcgagctcgctgccgctgacaggtgggtcccgcctgtcggagtcgtcgtcttcctccggccgaaaccctagcgccgcgccgccgccgccgcttcccaaattcggccgcccctttccttctccggtgaaatcaatagaggggaaatgatcttcgggatctcctctaccttttctcttttggaatcatcgtctaaatcgctttggaaattcgtggattcgaggtcgaatcggatcggtctctttcctccgaaccccaatgtttccttcgcgtcgccggtcgccgtgggccttcgccgccgcctccttgcccctataaaaggatccccaagctcgccgctacccgccgccaccctcgcctttgtctctcgtcgtcggaagagccctagcgccgtggatctcgtgccgcagtcgtcgccgccgctccagccgtgcgccgccgccgttccggtcgtcgtcgtcgctcggggaggtcgccatcgtggtcgccaagtcgccgccgtcctcgtccgccccttcgccgtcgctgtagatcgccggagcaccgccgtcgtcgtcaagccgaaggtctccgccgcttcgacctcgtcgccgacgtcgtccgttgcccctccgccgttgctttgatcaccggtgagttcgccgcgatgcccgcatcgtcctagtgccctccgttcgtgccgaagcgccgtcgttcgccggcgagcttgcgcgtccgagccgccgagccgccgccggagatgacgtcaccgctgacgtcatcagggtccgtctgccgtgagccgccgtagacccgatcgatctcggccgtccgttttggatggatcgatctcggccgttcgttcccgtgagccgctgccgtgcgcccggtccaccgcaaaccctagccgctgacgcaataaaccccttttccttttcaaaaataattcattattgcgtcataattcaattaaaatccatataagtgttttaatccgatttaatctttaaaaattcataactaattcatcttagctcggatttagttggttcaagtctctaaatttttctaaaattgagatctacatgttaaaaatatccacatgtactgttcatgcttgtttatgtgctgtttggtgattttgctcttttctgtttagattccgacgtttccggagtgtccgttttcgcaggagaagaatttgaagagttctaaggccagcaagacaagtcacacagatcccaaacaaccctttgagcatgttgatcccatttaaagctattgtttctattcaaatattgcatttattttcgaatgtcattgggtggaattaacctattgtttgttatagcccttttgttcttgattactttattccttgataccttgggtgattataacttgactagttgggctatatatattggttcagctagatattagatgtgattgcttagccatgcttagaaacattagcacactattgggataacttatgattcactagtatttaatgatggcttaatgatagatcacgattgtcaatcgtgattggttaattaattatttgccaactaaaacttgataatggtgggttgtgagcacatggttttgagagtcgtgctcatggcaattaaggaccggttcacgagtttcggttgtgaaacattaaccgtgccaaccacaagccagcgtgggcaacgactttaccttttgtatagcatggttcattgcggagcaccagactgagaagtggtggagataagcccacaggggtcgctggggagtccatgccttgtttataagggggtgattatgaaccaggaaaggtgcgctgtagtggattgtgttgtgcaaggggtattgtcacagctcctttccgaggtaccgtggtggtattgaggcacatagtgacatgatgtggggctgtgtcttgtgggtacagtggtacacctctgatcagagtaaaactattcgaatagccgtgcccgcggttatgggcgggcctaacaatgtctttcgtgattagtctcacacttctcaccataataaaagatgctataactggtaataatttgattagctcctggtttggaatggtatattcctggtttggagatagaactgtgcagccgggatggttgttcagaatggttgggcctatacaacagggtatgttgtatagcgttggattaatattgtttaattattacttaactgttttattaaattctgaaatgtttattaaatgctgtttatgcaaatgaaaccctactatgccatcctttgttatcctgtgcacttgcatatttgctgcgtggcttgctgagtatgtcatatactcaccttgcaatcattcatcagaggaagagttctacaatgatgctgatggtgtggaggattaggtgtagccctggtcaagctgcctgtggagtggagccgtctgcgtcgtttatcttttttccgctgcttagatctttattgattgagaggaactatctacctctgtaatgacattttattcgcttattaattagagtaataattgtactctattatcaatttgttattgtgtgcctcggctgattcctggatgagggttcacacacatgtaagcgtttggaatttcggatagaaattccgggcgtgacaatagcgaggcgatgaggagagcaaggaggctggccaagtggggccgctctggtaagttgcctttcaggactgatgaggtcgaagggcgacacggtagggggttgttgacccccgattttggaaatcggaaatcttctgtgtttatccgtaccaatccctggatcagtagttggtacacacatacatagttggatcacaacatatcacgaatgaatttaggctaaaagagttaaatacttacattagggccaggtaggccaacaactatcagagaacaacagcggaagacaaaataatataagagcccggttaacatgccacaggcagtcgactgggaaacgagacctagaacaagaccgcactccgatcatcttgttggatacacaagcgtaccgacaagggcttctcttcaacactctcctaaaagatatatgaatagcaagggtgagtaccaaccatactcagcaagccaccacaacaacaatgcatatgatagagggtatttcaaggaatggcttcaggttcttttgcataaagctaattttacaattcttttcacaagcctgaaacctagcatagactgatcaaattttagtaccagtgttcacttcaaacaacgacggttctgt

SEQ ID NO: 62310 - DNA, 9207 bp, Oryza sativa
ccaccatgtgatttattttaattaaccaacaccaaagcggtggcactaatccaacaataccattagaaccaacagtctaaacattaatagaattttccccattgtgcactagttgaactaagcatggctaagcaatccctagtccaatctctagtcatgttataaccccaagctgacaaagggacatggtacaacaatagcatggctatgacaataggtaaacaccccatagtaacattataaaacaatgcaatatttgaagaaaaacaatagagcatttgcaatataggatcaacatgttcaagtgacaagcatgacttgccttgctctgctgctggaggaacctcggcgactatttcgaagtacaccggagcgtcggaggaaccggaatctagcgacatacaaggcaaacattgcaaacaggctataagactactgaaacagggaacaaaaccatttttaatagattctacacatttttcttgatttactgagacttgaatgggcttaaacggagctcggatgaattagttatgaattttagaagattcactgtgtttattactataacaaaaagtccttaaatcatttattgcgcaataaatcccagagctgacgtaatcaagggggggcgcggcgccggcaagcgggccccaccggtcagcggctcgggagagagggaaaaggggcgccggcaagcgggccccactcggcagcggcgcacgagtggtcggtctaccgtggaccgggaccacgcgggtggtccaccgccggtccacgggatcgacggcccggatcagcccggggccgatcggacggtgcggcggcggcctggctcggctcggcttggcacaaagccggccggccggccatggcaagggtggcggcacgcgcacatccaccggcgacaggaagcggcggcgcgggcggcggtagcggacggcgccccggcggtgacggcgaccgaaggcgacgacgagcgtgggtggcggcggcacacggggaatcggggaaggagaggaaaggggagggagtcctcaccggaggggacgacgacgaccggcgacgaggagcggcggagggaggtcgacaagcggcggacggggaccgggacgacctaaagaacgaaaaggaaaagattagagagggagagaggggccatagaaggcgggaacgccggccgaaggcggcggccatggcgactctcaccgtcgcacaatgggaatggcgctccggcgacgaacctcgacgaaggaggggtggacggggtggatcttggccacgcgaacccgacagcggcaacggcgcggtgcggcggcgagcctagcggcggctagcggcggccggagtgatgggaaaggcggcggcgggtggatgcacggtgcgggagtgatggagagctcgggagagttcggcgaaatggggaaaaagagagagaggatgacggcggagcttaaatagggagagagggggccggacgtggccgggagaggcgggaatcgccggccaacgtggggggagtgggagaggagagagaggcgggattcgaaaatcgaatcccggccgtctcggaagcgcgggcgagcggtagagaggggaaagtgggcgcgggaggcgtgggtgcgagggcaacgtggacggcgtggcctgggaggcacggacgcgaggcgcggcggcggttgcgggcgcggcggcgagcggctggaggttgggggaggacccgacaggtgggccccacctgtcggtgaccccgggagaggagggggcgcgggctgagctagggcgtggcctccggccggcccagcaaggcgcggggagagaggaggggaaatgggccggcggcccactaagggaaaaggagaaagaaaaggaaaaagaaagaaaggaatttccagggatttaaatattgcctgtgctcaattttaattgattaaaattatttctagggctctgaaaattccactaaaaatcctgttagtgaatttcgacatgtagaactcaagaaaaattccacatgtcagattcgattattatttgtattactttcttagggttttctcttgatttgcaccggcattttcttagggtcatttataaattaaattttaggcttgggaggagaacttcagggtgtgacacgctctccgtgccgtccgcccatggcgtgccgatctgccggatgtcttgccagtggatggcgacgttctccgtcggcaacgagttcttgacgttgacgacgatggtgtccccctggacggcgtggatggtggggcccaacgtgtggccgttgatggtgacggccagcttgcggacgtagtccaggacgtgaactggtagctgatgtcccagtcgtcgccgcggccgacgcgacactacacagcgctgcgatggcgaggaagaggctgcaaaggaggcggcggctacaccgcatcatgtcccctcttgctcgcagtcgcagctccattgtttgctttgcttttggttgctagctgctctgcctgtgcgtcgttttgagcagggccgaccctagggggggtcaggctgtgcggccgctcgagtccctcaaaatctaggggcctttatacgtacacatatagtatatatattatgtattgtataattttagttcttgggacatgggcctatattaagttagacagctaaatagcccaacacagaaaatgaattttagtccatcgccaagtttgtttcagcgaagccgaagcgatcttcatcttactcccgtcgcttcgcctcgatcacatcatgcatgctactcacgtcgctcgctgctcctgcgctctcggcgacttcttagcgtctcgcaaacgaaaacggcaagtcggcaaatcgcggctcaccagtagccatgctcgtttgtgtcgatcgtccaccgatcgccttctttgctcgctactgctcattgctcgctgcccctgccacctgctgcctggactacactcctccaattcatcagatttcaaggtcctacactcctccaagtccaattcatcttatctgatgaatttctctatctttttttctcttaataagactatataaataaataaatatatatatatatatatatatatatatatatatatatatatatatatatatatatatatatatattagtttatgtatatataggggactccatataagtttttgccctaggcccccaaaaccccaggaccagctttggttttgagctacacaggtggatttggagccccgcgacaacgggcgaagcggcggcgacgacgggcaaggttgaaggcggcggtgccgccgctgctctcggcggagatggagcggatgaggcgcctgacctcgtcctcccggaaggagcggaaggagagaacgtagtggtggttgggtgtagagagagaaaaagagaaagaatgagagagggagaaaaagataatgaagaaaaaaaaggaaaagaaaaaaatcaaagggtagaaacataattacacagttatttctctcttcaattcttcccgatataataaaataatcacacgggtatccattagctaattactatttttttggtgcctacagcaaaaacgcgttcttgcggtgtcttctaactaattacacgtttttttagatgtcctgtagcaaattttgccaatttatatagattctcccctttctttgttggaataagttcacttaggtccctctatttgtcgtccagtctgattttcgtccctgaaccgcaaaaccgggtacgacatgtcacgcccagaaatttagcccaaaatttccagactattttgtgtattaaatccctgtccaggaccagccagggtacacaaaacgacaagtaataaacagtcccaaacgtaaataaagcgtaaaatacttacagaagaggcacttagtcctcacaccgaaacaaaagcagcagcagcggaaaaaggcgatcctagcggggcttcagctccactccacaggcaaaactcaactggggtctgagccttggtcctctaactccatcttcagctcagaagcactacacttctgaaaagggggaataatagcaaggctgagtacaaccaccgtactcagcaagccacaccaacgatgcagacgtgcaaagggaacacaaggacggtttgtggctatttgcataaaggcggttgtaaaacattttatttagcaaacagtaaaactgttgagtaatttaagtaacattaaaatctccactgatcaacgctacaccacgttgaacaggcccaaccaacccacctgtactacagtgcattgggtcgatttattaggtgtgagactaatcacggtgaatctggtcgatcgcccataaccgcgggcacggctattcgaatagttttactctggccagaggtgcacaactgtacccacaagacacaacccaccgacatgtcaccgcgtcatcatgtgcccatgatgcacacgtcaccatgtcgagtgattgtgacgagacccttcgcataaccctcccctaaccatccacaccacgctaaggtttcacccccacccctcaaaaggcagtgggcggtcccctcttgcgccgcggtgaatccggcagctggacaaccggacaccccggccgacccaactccatcacgcccaccctcgccaccggtgcctaggaaagggtcgagctatacttcagatcaagcagttacccattcccgcttgtggcaagcgctgtaagtcttccagggtttcccgtgaaccggtccttaattgccatgggtgcgactcacaaaaccatgcacccacagcccaccattcagtcgcattttagttggataattacgaccataaaacatggccagatgtctcgagcacgcggctcaacaagatactagaatgtctaatactgcaattatcccatcgactgagctagtggtaattaagcatggctaagcatatagttctagctaggtcacataagtaacacaagctagtcgatttatcacccaaggttgacaaaggacagatatcaagtaaacatggcacaagcgagcagataggtaatacccggatcccatgtaattagcaaaacatgcatatttatttgtaaacggtaaaacatttataaattgggatcaacatgctcaaggggaatgtgtgacttgccttgcttcttcactttgatcttccgaactcttttcctcgcgaccgcggacttccgaaacgacgggaactacacgctggcacgcaaaacgaggaaaaactctaataaaaaccaaggaaacagtacataaaaagtaaacaaacatgtagaactcaattttagatggattttgcaagttgaatggctcaatttggagttcgaatgaattagatatgagttttagaaggttttgagccattttaatgaatttctataattattatcgaattattgcgcaattaataattattttctcaaaggaaaaggactgccgctgacgtcagcaaagggccggcgccgacaggcgggccccacacgtcagcgagtcaaagggggagggcgctggtacacgggcccactcggcagcggctcaagggggggcacggctggcaagcgggccccacggctccggctccacgagccgatgtaccggccaggcccggcatcaagccggccgggcggccatggcaaggcggcggcgcgggcatgcgaccgccagcgacggcgagcgcgcgaagagggcggcggcgcacggggaaaaaaaaaagaagggaaggaaggggagggagacctcaccggaggggcggcaatggccggcggagaaaaacgagggaggcggcgaagaccggcgatgccgaggtgcggacgagcgacggcgacacctagggaaagagaggagaggaattagggcggaggaaaacccccacggcgaccatccacgccggccggagtcggaggggagagagaactcaccgacgacgcgagggaaatggggtttcggtggtattccggcgacgcagagcagcggccgggaagggtcttgcggcggcgaagctagtggtggcggtggcttagtgcggcggcggctctagcgacggcggcacacggccggagtgcggcgacgggcggcggcgtaagtggcggcggtgcgagctcggtagggggcacgggatggagcggtgagagcggaaaacgagagaggagggcatggggagcattttataggcggagggggaggcggacgtggccgggaggcgctccgatttcgccggcgacgtgggggaggagagagagaaggtgggggggagattcaaaatcgaatcccgcccctctcgtgcgctggcgcggccgggagacgcggggagagggcggcgacgtggcgtgggcgcggcgaaagcggaggaagtgggtgcggcggcggtttcggcgcggcggcgcaccgggatcggcgggaggtgggggaaggacccgacaggtggggcctcgggggaaaggagagaggaggagacggttggggggagacgatgacaggtggggcctcgggtccacctgtcggcgaggggaggagggaggaggctgggggttatgtggacttggaggagggggagccgagctgggccggcccacgcggagaaaggagggaaggagggaagggagaatgggccgagcccaaagacaaagaggggattttaatttcttttctttttattttaattgattcgatgaactttgtgccattaaaattacttcttgagctccgaaaattcacggaaaattccggagagtacattagggcacaaagaatattacaaaatattcccggccaatgatttttaagggaaaaattttaattctcccattaattcacttgattaaattgctttaacttttatttaatttctaggaaatgcattattaattgatttttaatcccgaacgaaaatcggggcgttacaaatctaccccccttacaggaatctcgtcccgagattctgggatggctagaaagaaagccggtgctgatgggcggtctgactgatctgcaccttgaactgccacattctgcttcgaactgattgattgactggttgatcaaacctgtacgattgaactggctggattcgacctttctgttcctttgctttgccaaaactggaccgactggttttgcttgaactgacccagtctaggactgcggatgctcctgaaacttacttagcttgggctgaactgttgaggttagcaattttggtaacctgagaattcaccacgctagctataagaggatgaaaatggaatctggcatttataaatcatttaccctatgtccgcttcgactggtcccaattcaaataacaagtaattccagaaaaacctgcttgacctgtctttcgtctgaactgcaaccatcctcgatgctacttctctaagctgaactgttgacctggcctcaagggtgtacattagaattgaacctgttgacttgagattgggagactctgctagtggctcgcaacggactcctttaattactaaccaaattgctgcactgggttgaacattcaagtgaaatgccgacgaggtaaaccaaaactcatctctgagacctaccccccttacagtgggtagtcttactttcgcctgactgagaacctttgaactgttgtcctcgaaaaaatgaccaacatttctcggatttacagatgccctgactttgaagactgaaacttcatcggtccatcaaattgaagcaatggcgatgcactttcatcccgacaagatttggaacttaagccttagttgatgataggaaattccacataaaagtgactctcatttagctcatgaacacactgactcttgactgcaacacactactgctggagttctttccgctactcttgaccttgcatcgagctttgcatctcccgcatcaatacatccatcatctaatcttggacaccaaatgttgatcacgagcagggttcttctggcactgggataccttgtagctttcaactgaaccattgattggtgactttaattgatcttatctctgacactgaccatccgctgccaggacggaagagaggtggaagagaggggttgctaaagataaggtactaaaccacttgcctactgatatgttgtgagtagacttttattcttcaagttgcttaagcaaacaacctagtatggtcgcatccccaccaatgatgcaaaccatacccctacacacaagcaaacaacacacgatctagaaagctaacggaactactcttctgggaaagattgggtttaggtcaacttcgggaaaactcttcttgatcttcacggaacgacgactctgaaccgaccttctcgctctttgctgcacgaagcttgatgcttgacttgacttccgaacagacacgaagctgacagtttatcctccacggtttaacaactataagaattggagggacagggaggagaattttgaaaaactgtttcgcaaagaaaagccgaagggcgaggggagacatttttcaaatagggttttcagaaagcttgtccttagggtttgaccatttggctcaacctacagtcgagttggctctgataccactttgtcacgcccagaaatttagcccaaaatttccagactattttgtgtattaaatccctgtccaggaccagccagggtacacaaaacgacaagtaataaacagtcccaaacgtaaataaagcgtaaaatacttacagaagaggcacttagtcctcacaccgaaacaaaagcagcagcagcggaaaaaggcgatcctagcggggcttcagctccactccacaggcaaaactcaactggggtctgagccttggtcctctaactccatcttcagctcagaagcactacacttctgaaaagggggaataatagcaaggctgagtacaaccaccgtactcagcaagccacaccaacgatgcagacgtgcaaagggaacacaaggacggtttgtggctatttgcataaaggcggttgtaaaacattttatttagcaaacagtaaaactggtgagtaatttaagtaacattaaaatcttcactgatcaacgctacaccacgttgaacaggcccaaccaacccacctgtactacagtgcattgggtcgatttattaggtgtgagactaatcacgggaatctgggcgatcgcccataaccgcgggcacggctattcgaatagttttactctggccagaggtgcacaactg

SEQ ID NO: 62311 - DNA, 4049 bp, Oryza sativa
caaagaggggattttaatttcttttctttttattttaattgattcgatgaactttgtgccattaaaattacttcttgagctccgaaaattcacggaaaattccggagagtacattagggcacaaagaatattacaaaatattcccggccaatgatttttaagggaaaaattttaattctcccattaattcacttgattaaattgctttaacttttatttaatttctaggaaatgcattattaattgatttttaatcccgaacgaaaatcggggcgttacacgacacgtccctcaacttacaaaaaccgggcaaacgaggtccctcagcggttttgatagcggttttggctgacatggcgcatacgtggctaatttgattcggtcttatctgacatgtcgttgacgtggcgcttacgtgtcaattagatccgaaaaaataataaaacctacgggacccacatgtcagttgcacatacaaaataataaaaagggagtacctatacatctttcgaaagatttttataatcatatcacacagatttttaatctttgtattaaaatccgatagatataataaaaagcaaaaagcaattaagaaacaccataatgaacattaaattaccatatcctctagaaaaagaccaaatccaatacaaaatttaaaatttacatgtgaagattcaaaaattacagtgtaacttacaaaagttacagtgtaagtttcataaattacactgtaacttacaagaaaatgcactgtaaatttaagtgagaaaatcgagtgagagataagaaaaaatctttcgagtgagatatagcaaaagggagtaactatacatctttcgaaagatttttataatcgtatcacacagatttttaatctttagattaaaatccgatagatataataaaaagcaaaaagcaattaagaaacaccataatggacactaaattaccatatcctcaataaaaagaccaaatccaatacaaaatttaaaatttacatgcgaagattcaaaaattacagtgtaacttacaaaagttacagtgtaagtttcataaattacactgtaacttacaagaaaatgcactgtaaatttgagtaagaaaatcgagtgagagataagaaaaaatctttcgagtgagatatagcaaaatcgatagcaaaatcgtaataaaaaatggtgtgacccacgtgggcccacacgtcatcctcactactctctatcccctctctctctctctccctcttctctttctccagccggcggagcgtggtgggcggcggccggagcggcggcagagcagagggatggaggaagagaggggcgaagcggggcgggcggcggccggaacggcggcggaacgtgggcggagcggcggccgtaccggtgcaccacgcgcatcaccccctcatagttccacatcagccctgacagtgatgccgcgccgaggtgtagcggcaggtgcctgcacaccaccgcagtttcccgccacagcaccgaccccgcagcacgccgtcgagccaccgcagctgcgcctcacagacggcaccgttgaacatcacgaaccgcctggccacgccggcaaggccgctcgggttgttcttgtccgtgttcgggttcctcttgtccaagaatctccccgctgccgcggccatcgggtggtcgcgcgaccatcccacggcgttgaagtcgtacgcgtcgaggaagcggtcaaactcggcgacgacggcctggacggccagcagcgacctgtccttggggcagaagccgtcgacgatgtcaccgaagttgacacaaaagcggacggcgccaccgccgccgtcattggatgcttgtggttgtgggcattccaggagcggacggctctctggaggacggtgaggctgtggcggtagtagcgggggacgccgaggaaggagcggccgtcggggatgtcagtgtgctgggcgtcggcgttcggcggctgaaccagcatcggtcgtcgttgccgaatgattgccaatcggccgacgaccaccacaagtttgtcttcctctccggcgagcggtgaccactggccagtgaccaagagaggggaggaggaagaggagtatccgccgcgtccaccgctcgtgtcgaggtggacgatgtcgccgaagcgtctccaagtcggcgcgctctgccccttttccccgccggccactgctcatcgtcccgccgccaggttggccgccgccgcatggatcccgccgctgggtcgccgcattgggagaaggaggagacggcaagagacagcgagattggggaggagacgtgggtcccactataaatagtttatttttagtcgaacagtcacttacacgtgggtcctagtttttttttttttgccacgtcaaacgaaaccagggactatactgccgagggaccttatttgcacgggttttataagttggggatgcgttgtatctggttttgtgctgcagggacgaaaatcggactaagagacaaataaagggacctaaagtgaacttatgccttctttgttacagtttgtcagcgctgctgctgagacggcccaggcccacggcccacattcctcctctctctttctctctcgcttctccaacgccacacagcgagaaaaaaacgcaacaacgctggcgaccttcctgacgacgccgacgagctcgacctccccgacggtgaggcgatccaggtcagctccgcgcctcctcctcctcctcctcctccacatcccctcgccccgcccctccgccgccgccgccgccggtcctctgcctcccaggccatccctctaagaccatggaatccatcccccacttcctctcccccggaaaccctaaacccaaacccccattgccgcgttcagacattcgcggattaaggttttcgggcctagtgggacgtggtgtttggagctgccactcactttctcagatagtgtttggagcttggttctgattaacattgatgcatacaggcgttttcaggatgggcagtgaggacacaaaagatatgctgaagaatgtggactggaaaacagttggtggttcggtgagcaccgacccaagccaaccagttgttaaaaagcgtctcccgaagaaaatcagacaagttcctgaatgctattttctgcctcggcgatctttgccttctgcattggcaatctatggcgctgcgtgtgctgctggagttggcgcagggatgctgcttgaggtttggataaacaaaaagatcaaaggtgcattcttgttttatttggtagcaggaggggccattcaacttaggaaaagtctatacgtactaactttttcttactaaatttttactaacactgacatgtcatgctatgagtccatctagattttttataacttccatctgcttaaatcaaacggttgatatgattgttagtacaaatttagtaagaaaaaattagtacgtgtagcagtgctcttcaacttacgttcttgcaaagtaactgttttcttgaaaacttatgatgttgtattatacaattgaaagcattactcttcttttgtcttggataatgttgggttgaacaattgaaagcatgtaacacctttttgtttgttgcctgtatatttttgtacatatacttactcttcttacttgctgatgcagaggacagtgccattgtctgggaaatgggcaaatgatttgattgctacctctgaagagttctccttgctcgtgttcagctgctaaagctgcatctcagaaataatcttagctatattggttctgattatcttttgattcccagacaaagtaaaactatcctttctaatgtatgacactgccttacatctacatttctggtttcattttgaatgctagcataacagtatggtgtaacaggaaatatcagaaataacggtgttacggaatgagccatttctgtttggcattatcagttgtacgaattaattgattgtgtggacagtggtagttacatgctctgatggaaatatcaaaaatcatttggcctacaaagttatgaagtgtgctctctgctcaaac

SEQ ID NO: 62312 - DNA, 593 bp, Oryza sativa
tacagtagttcatcactgcctcaccctacttttttgtcatgtccataaaccacataggcacaggcccaaccaaaacaggttgttagctagtcaagtttgtaagatcaagagtggcctccaagaggttcagtcaaaattagaaatagccagtttatccagggatgtgaatgcaattctcacctgaattaaattagacccctaatttaattctcaattaaccaggtactgtcctaataattttctcccaacatccccatcgatcctgactttgtctgatccccactgttttttcttttccttttggccactctttgatttcttttttcaattctattgcgggtggagactttttggtttggccgcaatccaccaccccattcctatccatcctccttcagcttcttctttcttctcctcctcctccttgactgtcctaacaaaaaaatcgattttttgttctcctcttgatggttgctgcgaccttcgatgtccctatgcggaatgaaatctcctgctggggcggctaaaaatcggagattttctgtctttttgatccgtctttagtggagctttttgagcctgatttatgcgat

SEQ ID NO: 62313 - DNA, 2514 bp, Oryza sativa
agaggaggagcgatgtcttcgcgcaatcgcgcgtggatggagagtagtcttcgcgacagtaaatcgggcggtagtgaaatcgtgtgtgcggatggacggtaggattgatccggatgatttcacacgtaggattggagacgtaggattggagggtgcaactcctcctttttatattagtatagatgattccttatgcgtgtccttcgatttcgaaattttcaccagccataagctgtaaggcatttacatttaatttaattaaacagctaattacttggtttttatatatacctaataaaaaaatacgcaaagctttatgtttattttgtctgttcggttttttatggcgccggtatttttttctatcatttttttacacgcgaaagagtttcttttgtgcgcacgctctaaagctttttattggaatttaattttattttaatgataatttttagtcattatgtgtgggttttgggggttttctgattttagatcccatccgggttgttgtaccccgcgccttccacgggccgaaccctagtgccgcaccgccgtcatgttaatcgtgcatttcctcctccaattgattataaaaatcgattccccattcgtccctcatcattttctaaatgatttcccctttcgattcagttttaattcactggatttaatcttcattttaacagtcgcgatgatgatcgatgggcgatcttcctcgatcgcttttatctcaagttttacactctgattttgggaagaacggaaagaggatatcgaagggatcaaaagccctcaaccaatttttggagatcgagaaatgttcgaccggatttgatggggaagatctgctttggcatcatacgggcatgggaccatgttcgagaggttgaagacggttgtcggctgtgcaagttggacctgcaactccacttgtgagatgggcggaagggaggcaggccgagcaaagggaggtaaaggtttggcttagggctgaaaaggaaacattgaatgggttttcggtccaaaaccaaggatgaattcttattaacttttttaattgtaatgtatagcaatcccagttttaggatttttattaaatgtttcaattctaatgtatattgatcccaatatttcaatttattgctcggcttctaatagttgttgtatcgctgaaaaaatgactttcccgttacaacgcatgggcatttttctagtttgagccaatcataaccgtcatttctttcaaatggacttgatattgccacgtcactcatcttcctcgtatcactagttgaccgctcgagcaagagcatcccaatgtccgatgcaacctgatacactttgtggtatcatcattctcgatctcatcgtgtagatcattggcaaagcacatctcatagatgcgacacatggccatagcccccgtaccagtgggttggtctaatgggcaagcccagcagcccagcccaactctctctctctctctctatctctctctctctgtctcgcaccttcctttttctctcgaccgcgagcgacaacggcggctgcaatgacaacaaccctccggcgaggtcactccacatccttcggcaagccccctcctccggtgagctccctccaatgaaaaagaaggcacacagtggagcggtgctcctctggtgatgacgatggcgaaggcctctctctaccgagctccctcttcctccctccggcgagcttcctctaatgagattgtcaagcaacaaggtcagctccttttccaccgccacccctgtaacatcctgaaaattcaaagacaataaaaatcactaaaattttgaactttttaaaacttttgcatcatgctggttgttatgattgctattgcttgccaaaccgtaaatgatcacaaagaaagtaaagtaaggatctaaaatttaagtaatagataaatttacgagaatataatattgttaaccctacaaataattacgcacaagaaaacaaagccagacaaatggaaagttaattactaatttaaattatggattaaatactaaatacgtgaaccatgtgttgcgtgtcatgacgtctaaatacacatgaaatgatgaccatttataatggaactctatctatgacatagtttcactaggagtaattaatgggatattactaaactctaatggtctatataaagctaaaccaattcacatgaaataatggtcgtataattaaattaagctttataaaattttgtgaggttttaattaaataattagattaatattgtgccgagtctcaatttactatttatagaataaatagattgaacctatccgtgtaaaatatattgctatacaactaaacttaaccaatctgctaatgtattaatcatgacaagtcgttatattaaatttaatagtaccccaaagtcttcaaaaatatataagttcaccttagggccaataactcaaattaatctaaaaagaattcatttgtgcgataaataaataaatatgggtaatatta

SEQ ID NO: 62314 - DNA, 5424 bp, Oryza sativa
ctcgcgcctcgagccgccgcgcgcagtcacgtcgccgctgtcgcgcgcgccactgccgcgccccatagcgctagtcgtgccgcgcgcggtcgccgtctccggtcgcatcgcctcgaaccccacccctccgcgcgtcacgccccatagccatcacgtcgcccatcgccgccgtgccgccatcaccgcgcgccaagccccgcgccgcgccgcgccgtcccatcgccgcgtcgccgtcccgtcgacgctccgccgtcgctgtcgcgtcgcccgtcgccatcaccgcccgccgagccccgagccgtctcgagccgcgcgcccgtcgccgtcacgcctcgcgccgcgtgcccgccgcctcgcgccccacgcgccgcgcgccgtcgcatcgccatggagccggccgcccctcccccgcggcctataaatcccctccggtcgcccttccatcccacatcacccccctccttcccctcctttctttccccctttctctccaccgcgccgccgcctacgtgccgccgcgccgtcgcctcgaagccgccgcgccgcgccgagtgccgcgccgtgcgtcgccgccttgcgccgccgtcgccgccgccgccgtcagtaagccgccgcctcctccccttgctcggtcgccgtcgccagagagccgagggagagaggagggagaagaagccgggagggagagaaagagagaaaagaagaaagagagaggaaggagaggagagattagtgggccccacgtaattggtgaatagtaaccctcttcttaatctttattagtagtgtctattacatgtgggtccgggtggttaaaaatctaattatagaagttttatggtctcgagtctatgacatgtgggccccacttgtcattagctcttcctatttccctttagaaaataattcggtaggaaaaagaaataaacccggggtcccacttgtcagttggtacaaggctgtggatatgtcttggattaaaaataaatcgtttatgaacagtagcttttcgcaatttctcggattaattcaaatttgaatctttacactagcataacttattcattttaactcggatttaagtgaaacttgaacctaaattcatctaaattcataagctttccaatgatatataattcactatttaacaaaatatatttataattataaattaattaatatcaaatgattagataatagttaacctaaatagtgtgccaatgaataaaaatggatattgtacagtagcataattatctttaacatgtcttgtcactgtagcaactaaataaattagttataatcaatccttcaaattaatgggtgtataggaaaatattagtgccatttactagtctatgtccaaatataactaaatccatgacttataaattgtttacataaagtttagcctcatattttgtaactaaaatataaacacacatagatgaatctttaacttgtttaggagagtaatcacagagctagttgtatttggaccacttaaaagtttgtcgatacaatgtcatgtgaagtagaatatatgtatatagtcggttgatatccattagttaaccaaacagagccatcttaaaatcaacatgtattgtatagcttacagtaaaaagcaactactcaaatatatgatccaataataagatattgttgcttacacatatactatacatcccattatagtggtacggtatagtattaatttgcgtgttgcatatattaaattaagagggagtgtatgacaaacatgtatattagataaatactagttataaatcttgacctcatataattataattatagttcaactgtaaattaggattattcattgtaaaattatgtgataggataatctgtaaccataatatgattaacctaaacaactctaacatacaaagcatggataattattaaccttttataatttattgtgacaagtaaaatatgttcataattaaagtaaagcttccataaataaaataaataatacaaatgattcactgtaattatttgattgatcctaaatccatctaacaacagaacctctagtaaataaccgtcctatgtagatagatgcatgcttagccataatccttccatagccatttgatagactaaaccaccgattagccaaatatatatgtatcctataaatgctatgttggttaactcctaaataggccacgttgacaatagaaagattaagaaaccttagcccctagcgtgattggaatccattagtagacatgaatagtatattttgttgtgcatatttggttgttatttgaatattggtttttcttgcgtattatagaccttgtgcatcggttagtcgtgaggcaacgtctgcaacttccaggaggtgaaggttgatcaagattatatcaataataaggattatcctgagcaaggcaagtcatcactattctttgaacatgttgatcccaattgcgaaattgttttgtttacaaataaaattgcatgcaatgataaacatcctacttgtgattatgccatgccttgattattgtttaccccttattccttcgtaaccatgcttacgtatgagtccctagtcaactatgacaattgcttagaaatgctattctagaatcatgcatactcatatttatcaaaatgctttatgcttgggcaattacctttgggaaggtaattgagatgcggcatgtggagacatgagcgccacattgccatgatattgatgacatgatttgtgaaaggagaaataaaactaaaacaactattttcgactggggctatagttggccatatggcccgaggcccgatggcccggcccacggcacgggaatttggcccggcccaagcacggcacggcccggtagcagtcgggcccgtgccggcccggcacgactattgggccgtgcctgggcctatggctgggcacggtgggccggcccggcacggcacggaccgaggtcggcacgatgggccggcccggcacggcacggcccaacggtcggcacgaccacggcccgtaccaacggtaggcacgagcacggcccagcccaacagacagccaggccgcaccgcgtgcgcccgcatatataaggcagcgaacgccgcgtcgccgcccctcccctccccagtcccctctcgcctctcgctctccgcctctccgcctaaccctaaccctagccgccaccgctcaaccgcctccgccgatccgcctccgacgctccaccgcccaccagatctcctcctccaccgtccgtcgctcactcgctcagggcctcaggcgcgcaccggtgagactcaccgagtcgcctcccttccactcttccagatccagccttcctcttcgtctccgatcgatgcctcgcctgactcgcatgaggggcgcatgaggatgggggccaccggccacgcatggtcgcctgagtcatcgtccttccactcttctagatccagccttcctcttcgtctctttcccttttgttcttcttcgccagatcccttggtcttctcgtagatccgtgagcctatcgtcttcaacggcaactccggtgctccggctgcgcaggtacaagcatggaaccattgtttttctttttttttctccatttccgaccctaaccttgagtgttgttggctgcttgcaggtcgcaagcccgttgcttagcggcagccgctgttgagggaccagagtgcctgcgatggacgacgatcctacctctgtcaactacgagttgaggactatggggatgcgcggtgatgacgatgatgatgtggaggaggatcgtgtggaggtgttcggcaatacctccgacatcccgatccatgtgaatgtcgatgacgacgacccgccggtcgacgacagtggcaatgggacgccgactggctctagtgcgacttgtaccaacaagaagaccaaaacctccaaggtatgggatgactttgaggaactttatgaaacgaccaatggtaatagggttcgagtctctgctaaatgcaattactgtcataaaactttgagtgctcgttcttctgctggcactggacatttgcttaggcatattaagtcatgcaaacctagaaagcttgggtctaatgctttgcctcagtccatgcttagatttagtgcagatggttctgttattccatgggaatatagtcctgaagatgctaggtttgaattgtgtagattgattgctagagaggatcttccaatcagttttggtcaatctcctgcttttgtgaactatattaaggctgctcataaccctagatttgttcctgtctctagacaaactactaccagagatttttataagttgtttaaggatcgtcgttctgttattattgatcgtctcaattctgctagctctattgctttgacatctgatatatggtctggtcatgctaaggaagattatttgagtgttgtagctcactttgttaattctgattggcaattagaaaagagggtcttgggtcttaggcttattgatgagtcacatactggtgctaatattgctgagcgtgtgattgctgttgctgaagaatatggtattactgataaggttttctctattacattagacaatgcttctgctaattctaaagctatgatcacccttactcctgctctgtttggttatattggtgatttatttttgcatcaacgctgtgcatgtcatatcatcaatttgattgttaaggctggacttgacaagttcaagcccatgctaaatgacattagagctgccatttcattcttgaatgcatctaatcagcgcattgctacatataaaaatgtttgcattgctgcgggttatcgtcctcgtatgtttggtttggacatggatgttagatggaattcaacttatctaatgcttaagcatctcataccacatagggaaccattcacagtatttattagtacacaacatccttttgttaatgaccatccattactcacagacttacattgggcatgtgctgaatctgttttgtgtttccttgaacaattttatgattcaactgttgttttgtctggtgtttattatccaacatctccattaatcatgcatcacattttagagattgctggacatctaaacacatatggcaatgttcaaaacattgcaaatgttgttggtcccatgaaaactaagtttatgaactattggtctaaaattccaattctttattcatttgcatttatcttggaccctagggccaagattagggggtttagtaaagtgcttcagattatggctcaactcattggtgatgattattctgcttatttaacaactgttagagcttcattgtttgatacttttgctaagtatgaaagaaagtttggttctgttagattgcatagttccactattccaggcccttccactggtaagaaaaggact

SEQ ID NO: 62315 - DNA, 2651 bp, Oryza sativa
ccgatggatgcagggttttgagggaacggtggagattcacaaccaatggcggttggagggtattaccgacctttccaaccgccataaccgtcattacctgcctatttaagaagctcactctcttcacttcaacacgcacctcaagcaagagctctctcattcctctcaagtttagtttagtattatctagctggtggaatagaattagaataggaatcaggagtccggaagccttcagaagagttcgggtttggctctagtagctttcctttcctcttttgtaagctttgtacttttattacaatactcttctaaatacattaatggtattggaatactttccgagtatataagtacctactttacattatgttcatgttatactgagtatactgctagcttatctgggagatgctttggtgcgggtatagtgtttgcttatgcaattactctatgtcatgacaatgatattagagtagtatctggtagtttagacgtggtgtctagattagaggatatcattatttggggttatatattgaagacgagaggtgggccactgatactgacagctcagtacgggtattcctcctcgcctatatataatcctaagttaatttcctggggagggtattcctccgtatttagccccggttggatggtcatgacaggctgtcgtaaggaactcggcagtcaagggtggcttctcaaagtactaggaggccatcggatagagggtattagctagtataccagttaactagaatgtatgtatactatgtatattagaggtataggaatagattctctttctctttttttccacctagcttagattaattattatgaggatgagtagtaatgcttatgtgtcaaactacccttggattatcttaacccctgcttagaatacgattatcacaagtaatatgtatgttattagttgagttctctctacatgatctttccacgggataaaataaatacgataccctttgaatactctcgtgtgaaataatacaatggtatatccgtgctcttgtggatgaactctgtaaccataatataccagaagtattgatgcgtcattgctgtgaattatatttctagtaatgtccttacgaaataccaacagtaataattttaatattatcgatataataaagatgtgtctttttatcatgtttgtgtggtgtaccccggcttatcctgtgacggggattaatacactagtgttctggaaaagctatttttccggatgcgacaaagagaaagccaagttagatatgctctctgccgggccaattcagccgaacatagatcggcttgaagcccgcaagattgatctcatagctcaacttgaagaatgtaatgccgaactagatctggacaagcaaaagttagccaatcttccaaatgctgtcgaagaacagaaatccagactgaaattggctatcaagaatgtagctgatatgatcaagtacctcaaggtcatttctggaaccgatgctcaagatatccaagctatcgaagaagtagatcaaatcaggcaacgggctgtgtcggctatccaacgctacttgtctggataattaccctgtgtaataggacttagcaaattttgtaatcggctcagaaaccttgatactccttttgtcactgaactgttgtgccgattaatataacttctcaagttgctcaaaaatttgcaacttttgtatatatgtgcccccctaattttgcaatgatgaaggcattgataaaattataatttggactaagggcgatataaccatatcggccattgtacatcggcaaaacacaaccgattacaacaagaaaacaactaagggctatataaccatatcggccattgtacatcggcaaaacacaaccgattacaacaagaaaataactaagggcgatataactatatcggccatctcaaggcgatgtaaacacatcggctatcatgtatcggcaacatccagccgatcgtgcattaacctaaacactggggtaatatttcttcaagtacttgccattgagcgctcgtccataaacttctccatcaagtccttgcaacatataagctcccttggacacaaccttatggatttggaacggtccttcccaatttggtgaccacttgccgaatttattatcacgagtccctatcggcaaaatcaatttccaaaaaagttcaccttcagaaaaagactagggcaccacttttttgttgtaacgtcgagcaacgcattccttatccttggtaacttttacaagagctctcaacgtagattgaactaagtcttccctttcatcggccatgagattataatattcatcggctgtcaactcattttgcaactctgttctccttgggtgtcacaccctgaaaaatcgctaaattataaatcattgtgaaaaagaaatttttagaaattacttaataattaaagcaagtgtgtgaataaaatctatgaaaattttgaacattaagttgatatagataaaattgtattaaatatttttaatgtccaagtattttaaggatttttcccagaattatttgagcattggaagtatttttaataaatgaaagatcattcagtgattaatttaattggaaaagaattaataattctttc

SEQ ID NO: 62316 - DNA, 793 bp, Oryza sativa
gaacgggtcgattcgaagctcgtatgaccaagatatgatcatccgaagtttaatgctgtatatggagattggcggattattataattgagctttgcaactataaaacaggtgtaagcgctagcctggaaaagacaggaaggctgcgccgttgacatgcggaccccacatgtcaacaaaaaggaccgcggtagaccgagtacacagagacggtccaagggtcgatggaagcggatcccgtgtgtcaaccgaggcgagtggccgacaaacggactccactagacaccacacgggttacacacgtggaaaccacgtggctaccgagcgggcacactaacacggtcaccacacgcacacatggacgactactgacaccggtgcacgggtaccggggccgacaaccgcacaacgagcacgggcgacgccgaaaggacgaggacggggcagcgagaggacggatccttaccaccacgcgacgagtcgtgggaacgacaacgacgaacgggcgcggcggagacagacgggcacaacggagacgaacggcgaggggacggcttcggcggcgatccttggacgaaggcgagacgcggccggcacgaggcttgacgacgcggagccgaggacgaagacgacgacggctacagcgaccttgatgaaacaccgaggacggacgagaacggctcggcggagggacgaacgccacgacgaccgggagcgacgagaggacgacgacgacgacgaccggggccggcgaggaggcgacgagggcagccggcagcggctgcacggaggcga

SEQ ID NO: 62317 - DNA, 1495 bp, Oryza sativa
cccattgctccttgcaaaagcttttctcatcctcccttccccgtctttcaacttgctttagatgaatcccttcaaggagaggttggaaaagatgatggcacactttgatgaaatttggggtgatctgcagacaaagattgatcagattaatgagaggagagaagctctggaaagcaaggcattattctaaaggaagctgagaaatatgggaacgatggttttacaagtgagctttgtcgtatgacgtatgatcttggatatgaggttccaccaatgtacactaaagtatctacttatgttggagaccaattgcattgaaagacaactgttactctcgtttctgacaaggaagatcttctccaactatcatttactagtgaggccgattgtttcttctatgctcgtgaaggagttgtttacgaagctttgtgtcgtctccggcatcatctcaaggatcgtctggggaatactatatatcactaccatctaaaacatggtgatgatttttggatgatttgtgcacatagtcgaggagaagagaatcaaactatggtacctatgactacaaggttggatgcactttatgacctccacattgattacaagactcaagccttaaatcagaagcatgcccaacaggagaaaattgccaagctatagaagatggttgaacaaatggaagatatgtctcaacctgaagatagtgacaccgccaagatgttgaaatatacagaagctcgctttgcccggtatcgcaaaggcaccaatcgtaagctcgttcttcgccagaagagaatcttcgaattagaagatgcactatggaagttgaaaggagaaccttaatcggaaagacgattatgaagatgtgaagcctattcatgttgtcaagcatctctgcactagaattatttttctcatggaaggtcgattcccgtgaagatgagtcacttgagaagcccaagttcaaatgtaaaatgaagaagtcttaaagcacctatggcagaacctaagctttaccctcaagagtagtggtctcttgtttagttagatcgttgtgttagcttgcttgcttaagttttgtttgtgtgtgtgtgggttttagcgtatggagtatatcgagggttgtgatataaccatactagtttcagtgttcagttcagtgttaaagaacaacctacctcacatcaataaaagttaaagtttagtaaaaaaaaaagtctattctattctgagtctcctatctactttcttaacccttcctttctctctcttacctcctacctaagagaatggatttaaggaaaggaagttttgtgctcattagtgccagtggttttaacaagttaacagctaaggaacaatgtgtctggatctccaaataaaattcatcctgaagctaatgtggacaacacagtctgtcatccaaggaaagtaaaaagtcagaagctcaagggataccattgaaaaaaaaatcaagagaagggctgcaggaatt

SEQ ID NO: 62318 - DNA, 2435 bp, Oryza sativa
ttaattcatggccgaagatgactttattttcctatgggttataatttgactagcatggaccttatatattggattggttcagctagatgttatttatagttgcttagccatgcttagaaacaatagctcattaatgggatgaatcatactacattattatttatggttatatttaatggtagctcacgatattcagtcatgttatgataattaattggtaattaaaatatgattaatggtgggttgtgagcacatggttttgaaggtcgcgctcatgacaattaagaaccggttcgcgagctattgttgtgagacattaaccgtaccaaccacaagccagcgtgggcaacggctttatcttttgtatagcatgattcattatggtgtgccagactgagaagtggtgagaagtccgtgggggtcgctggggagtccattgcctctggttttgagggggaggttatgatccaggaatggtgcactgtggtgagttgtgttgtgcgaagggtattgtcacgatttcccccttagcagtgccgtggtggtacttcggggcatggcaacatgtgtggaatcgtgtcttctgggtacaatggtacatctctggccagagtaaaactattcgaatagccgtgcccacggttatgggcgagtctaacaatgtttttcgtgattagtcccacactactcattaatgttaataatgtgatgattaatttgactcctggtttggaatggataattcctggtttggaggtttgatctgtacgatcggggttggttgttcaggtttggttgggcctgtgcagcatgggtgtgctgttcagtgttgattaatattgatgattaattgctctactgttttacaaattctcaactctttgctaaatgctgctttcgcaaatgagcctatattatgccatcctttggtatccttgtgcacttgcatacttgctgtgtagcttgttgagtatgtcatatgctcattcttgcaataatcatcaaacctcagttgaagaaaaggatccagaagtagaagacctttggcttagaacccagttgagctgcctgtgggagtggagctgaagcttcgctagattttattttccgctgcagatttcttcatggtgaggactaagtgcctcttatgcaagtatttatcgttttagttattttgatgaatctgtatattaaattgtcagtttgtgttcctcggctgattcctggacgagggttttaatgcacaaattagttcagaaatttcttgcgaatttctaggcgtgacattgggccgattctgacttcctatggtaaaactgcctcatgtccataaagcttatagagaggaacttggatcgaaccatgacaagccatccgataggaccacaatgctttggccaacctagtgtgtcattgccgaggataatcagagatctttctcttaatgaacttaatcaaactcttattagatgcctcggcttgcccattagcttgtgcataatatggcgaagaattcaacaatttaatacccatgctatcggcaaactgaacaaactcatcggacacaaaaatcgagcctcgattggttgtaatggtctgaggaataccaaatcgataaataatatgcttttgaacaaattgtatagcatcccctgaatcaactttcttcaaaggaatcgcttctacccagttggtaaagtaatcggttgccaccaatataaacttgtgtcccttgctcgatggtggattaatcattccgatcatatcaattccccaacctctgaatggccacggtttgatgatatgattcataaccgatgctggcgctctttgaatcgctccaaacttctgacaatcttaacatcccttgtaatatcggaagcaatcttccaacattgtcggccaaaaatatcctacccgccgaagcaaccacttcatcttataagccgattcatgagtgccacatataccacgcctatcgcaaccttggcttgataggcactcaaacatttaagcaataccccatcaatcgtccgataatacaattcatcatccaacaaggtgtatttcaaagctttatagcgcaattttcgtgaagccatgcattattttcgaatgtcatcgggtggtgagcctttcccagataattaatggccgaagatgactttattttcctatgggttacaatttgattagcttggaccttatatattggattggttcagctaaatgctataagtatagttgcttagccatgcttagaaacattagctaattaatgggatggatcatatatactacattattatttatggttatatttaatggtagctcacgatggttaatcgtgtaaagttaattaattgataattaaaacatggttaaaggtggggttgtgagcatatggttttgatggttgggctcatgacaattaa

SEQ ID NO: 62319 - DNA, 6541 bp, Oryza sativa
ttttgctttaaattaatgcattatcgctttatttaaattcctgtgttatcactgttttatttagccatgcctatttacctttgttatgaccttattattattgctattgtttattattaccttgttcaccctaggaaaataaaaccccaactagtgggtaatctattcatggttccactagtatgaatttaggtagatgctcgcaaaataattaggcaacattaggtggttttattactttagactttggggatgctcatatcatttggacactgtggaatggttggcttgtgatggaattgaacacacacctcccccctctattcaaaactcccaaaatggttttaggctgggctcgaggtgcagggttttgctagtagcacctcggccactataaggaccggtcttcgggcctctgttgcaaagcactaccatactaaccacatgtctaatgggtaaggcttaactcggtgctcagtctagtctggaacaaaaggacacggatagagatggatgaagtcgttgcgacaatggatatctatgaggcaaatgaaggctacgcgagctgcggctcggtaatcgagatgtctaggcaaatgaagactacacgggtcggtgcccgttagtcgagatgccatggcactggactagtacgcgggtggtctcaccgctatgtgtgtggcgcacccggtctagatcttgttgctaggggctcaatcctggcctgcctgtcccgggataccggccataggtagggttgggtcggtacttttgttcacggctaggatgggtgaagggttatgtcacatgtttacgacgggttccaaggccatggaatgcggagtaaagatgtgtcttgtgggtaaagatgtacacctttgatcagagtaaatctattcgaattgctgagccctcggatatgggcaagcctagcaatgtacccaagttagtggtttaattcttaaaatttgcttaacaactaaaatgtggaaaggttggcctgggttggcttgggacaagctgggacccaggtcgggttgccagttcggtctgaatcatcgtaggccttgggttaaggcaggttcgtgtgggttcacggccttgattaataatattgtgtagctcttggatcgtgtttacaaaatagctttgggcaactaagtgacttataaatgctgtttacagcaaaacctaacccctattattatccccttgtaccccccttgcattaatcatgcatctgccgatgtggcttgctgagtacggtggttgtactcattcttgctcaatctttcccccacttcagtaagagaagctttggagaagaagtcttaggtggtgtcctggcttataccccagttgagcgcctgtgaagatggagccgtaggcccgctagtccgctgctgtttttttttgtttgtcaagcctgaggtgcctttgtaataatgtaaatattatctttataataaagatgtgtcttttatatcatgtttgtgtggtgtaccccggcttttcctgggacggggattaatacactagcgttcgggaaaatgcaaattttctcggtcgcgacaacattgatgtgaatcttttggattacttcaacaaaacgagtcaatagatggcgcttcttttgacatcccattagttcctacaggcttaggatatggcagatcacgagtggacttacctcccctcgttgtgatcgccttaacattttcaatggaggagtcgggttgccccggaatcctcccagattcatttgtagggactaaagatgccaacggagctaactgggtttcgatcatcttattaaagctcagctagttttgaaatgcggaagcaaagccatctagcttaacatttatgttctctaagatcttatcattggcagcaagctttttgcttagtgcatcagtggtttagcttgcacaaaaagaagatccttcaaggagggttggttaaagaagttactgttattattacctccttgataatatgggcgtggttggttccactcctgacctccttgtggacgatacccattgttgttgttgcccatgtacatcgcctcctcacggatttccgggcagtcgttcccagaatgacccgtgccgccgcagacttcacacgtgatgtgagagtccaaggccttgacggtgccttgtggccgtttctcatggtcgtccaatcatttcatgaggaggtccagcttggcagcaagtaactctgtctccttaacggtgtgcatgcttcgctgacgggtctggagtcgttcctcgctccaacccatattggagaccatcttctctatgagttcaacggctccttgaaccgttttagagaagaaggctcatccagatgccgcgtccaggtgatcgcgggacatcagggtgagcccattgtaaaagttctgtaggatcagacagtcatccatcccatgatgaggacgggctagcctgcgccatcgtgatgaggctggacttcaaatcgaaatccacatctcctatgttgacttgtggcccgatggccacattgtcagcagagggagcagcgaactcgcgaagagtcttggtggcgctggtacggctggtttctctgtcggtaaagttttctgcgaagcaatgactcgcggcctgatgctccggaagaaaacttatggattttctttgaagttttccggcaggttggaaccagtcatgcactaccaacggaaaggaaaatgattatacagaggaaaatgcactaccagttattttcacaagaaagagtgaaaacaaccaagataagcctgcaaaggaaaatgattatacagaggtaaatataaagtattagttcaagtaatctctatcatgaatcttccccggcaacggcgctagaaatgcttgctggtatttcttaacgacattactagaaatataatttccagtaatgacgcagaaatacttctggtatattatggttatagagttcatctgcaagcgcacggatataccattgtagcacttcatccgagagtattcaaagggtatcgtatttattttatcccatgggaagatcacgtagagagaactcaactaataacttatatattacttgtgataatcgtattataagcaggggttaagataatccaagggtagagtgacacacaagcattactactcatgctcataataattaatctaagctaggtggaaagaaaagagaaagagaatctattcctatacctctaatatacatagtatacatacattctagttaactggtatactagctaataccctctatccgatgccctcctggtacttcaagaagccacccctgactgccgagttccttacgacagcccgtcatgaccatccaaccggagctaaatacggaggaataccctcccatggaaattaacttaggattatatataggcgcggaggaatacccttactgagctgtcaccatcagcggccaacctctcatccgcaatatataaccccaaataatgatatcccgtaatctagacaccacgtctaaactactagatactactctaatatcattgtcatgacatagagtaattgcataagcaaacactatacccgcaccaaagcatctcccagataagctagcagtatactcagtataacatgaacataatgtaaagtaggtactcatatacttggaaagtattccaataccataaatgtatttagaagagttttctaataaaagtacaaagcttacaaaagaggaaagggaagctactagagccatacccaaactcttctaaaggctttcggactcctgattcctattctaattctattccaccagctagatactactaaactaaacttgagaggaatgagagagctcttgcttgaggtgtgtgttgaagtgaagagagtgagcttcttaaataggcaggtaatgacggttatggcggttggaaaggtcggtaatacccttcaaccgccataggttgtgaatctccaccgttccctcaaaaccctgcatccatcggcttcacgggaggtttggccgaaccaccaggttcggccgaacctggggccagcccaaccagcccacattttcgctggtggcctcctctgctgctttactttgtagacttgtgaattttggtctgattcgtcgtgtcaattctgagttcttggcccattcatacataagtctggacttcgacatcgttcgattgatttatcatttaagttgatgtcgattctccttcattttattgtcattctctgcaaaaggttagtaaacccaatactagtggaatattattattctaacatatttatgcattgcaagcatcactagttctcctctattttggtaatattgacggtcgaaactaatcaataacgaccgtcaacaattacaaaggcgcttcaggcctgacaatcaaaaataaaaagcatcggactagcgggtctacggctccatcttcacaggcgctcaactggggtataagccaggactctacctaggacttcttctccaaagcttctcttactgaagggggggaaagatagagcaagaatgagtacaaccacagtactcagcaagtcacaccggaagatgcatgattaatgcaagggggtacaaggagtgataatatagtgttaggttttgcagtaaaacactatattattaatcaaggccgtgaacccacacgaacctgtcttaacccaaggcctacgatgattcagaccgaactggcaatccgacctgggtcccagctcatcccaagccaacccaggccaaccattctacattttagttgttaagcaagttttaagaattaaaccactaacttgggtacattgataggcttgcccataaccgagggcgcggctattcgaatagatttactctaatcagaggtgtacatctttacccacaagacacatctttactccgcattccatggccttggaacccgtcgtaaacatgtgacataacccttcacccatcctagtcgtgaacaaaagtactgacccaaccctgcctacagccggtatcccggacaggcaggccaggattgagcccctagcaacaggatctagaccaggtgcgccacacacataggggtgagaccacccgcgtactagtcctgtgccatggcatctcaactaatggacaccggcccatgtagccttcatttgcctagacatctcaattaccgagacgcagttcgtgtagccttcatttgcctcagagatatccatcgtcgcaacgacttcaaccatctctatccgtgtccttttgttcaggactagactgagcatcgagttaagccttacccattagacatgtggttagtacggtagtgctttgcaacagaggcccgagcttaatccttgtattggccggggtactacttcccacaactgacatgcacccaaaccccaccggaaaataggttttaggggttttgaaagaggaagagaggtgtgtgtccaattccaccaaaagccaaccattccatagtgtccaaatgctatgagaactcccaaagtctattgttataaaaccatctagtgttgcctaattaatcagcgaagtatctacctaaattcatactaatggaaccattaatagattacccactagttgcggtatcattttcctagggtgaacaaggtaataataaacaataacaatgaaaagactataacaaggattaataggaagtgctaaataaaacagtgataacgtgggaacttaaataaagcggtaatacaataatttaaatcaaaatagttttacaaactaggattcaatatgctcaagggtgatgcgatttgccttgctcagatagaacagccttgcgaaccttcggcgacgactgcgaaccacgcttcgggaacctccggaacgaccaaagctacgcgaagcacacaagtaaagctacaagcctataaagaagcaataacaatacataaaaagaaagcacatggttctttaggttataacaaacattaagagacttgaacgggtcgattcagagttcgtatgaccaagatctggtcatccgaagtttaatgctgttatatgaagatttgtggattattataattaggttttgcaattataaaacatgtgtaagcgctagcctggaaaagacaggaaggctacgctgttgacaagcgtaccccacacgtcaacctaaaggaccacggtataccgagtacacagagacagtccacaggtcgacagaaacagaccccgtgtgtcaaccgaggtgagtggccgacaaacggactccactagacaccacgcgggcttcacatgtggaaaccacacagctaccgagcgggcacactaacatggtcaccacacgcacatgcgaacgactaccgacaccgatacacgggtaccggggtcgacaatcgcacaacgggcacgggcgacactgaaaggacgaggacgggggcagcgagaggacggatccttaccaccacgcgacgaggcatgggaacaacgacgatgaacgggcacggcggtggcggcttgggga

SEQ ID NO: 62320 - DNA, 1053 bp, Oryza sativa
cgtcgcgtggtggtaaggatcagtcctctcgcttcccccgccctcgtccttccggtgtcgccccgtacccgttgtgcggtcgtcgaccccggtacccgtgtaccggtgtcggtagtcgttcacgtgtgcgggtggtgaccgggtagtgtccgtgttagtgtgcccgctcggtagccgcgtggtttccacgggtgcaggccgtgtggtgtctagtggagtccgtttgtcggccactcgcctcggttgacacacgggttccgcttccgtcgacccgtggaccgtctctgtgtactcggtctaccgtggtcctttaggttgacatgtggggtccgcatgtcaacggcgcagccctcctgtcttttccaggctagcgcttacacctgttttatagttgcaaagcttaattataataattcgcaaatctccatataacagcattaaacttcggatgatcatatcctggtcatacgagctccgaatcgacccgttcaagtctcttaatgtttgttataacctaaagaaccctgtgctttgtttttatgtattgttattgcttctttataggcttgtagctttgcttgtgtgcttcgcgtagcttctgtcgttccggaggttcccgaagcgtggttcgtggtcgtcgccgaaggttcggaaggccgttctctctgagcaaggcaagtcacatcatccttgaacatattgaatcccagtttataaaattatgttgatttaaattattgcattatcgctttatttaaattcccgcgttatcactgttttatttagccatgcctatctacctttgttatgaccttattattattgttattattattaccttgttcaccctagattaaacaaaaccccaactagtggacactctactcatagtaccactagtataattttaggtagatgcttcgctgattaattaggtaacattaggcggttttacaactctagactttgggatattcatatcacctggacactttggaattgttggtttattgtggaattggattcacaccgccccctctattcaaaatcccc

SEQ ID NO: 62321 - DNA, 557 bp, Oryza sativa
tttgtgcatttgataccatggtgcccgggcaccatggtgccccatatgagtgtcatatatatatatatatatatatattaaatgttagatttaataaaattaatttaaagctataaactatatttttctataaacttgatcaaaattttaaaacgtttgacattagaaaagccaaatcgactttgtcgttgttttagatcacgactacggtatttgcattgtatggggatcgttggtatcaggggatatacaaggttgaggtaaaatacatagagataaagatttttatacaggttcgagccccttcatcggaaggtaacaacactactcctgttgggcgaaaccggtgttactcttattcatcataatcatacaaatacaatatttgggataacctatctagtcgtcgtcggcttggcagcatggaacaccaacacatagtcgatgacggggtagtcttccgcctcaaatacgtactcggtgagatcagagatagcgctagatccctcttgtccgcgtttgatgcgccagattgggtatgtataggctaatctctg

SEQ ID NO: 62322 - DNA, 7333 bp, Oryza sativa
  unsure (1)..(7333): unsure at all n locations
tgaatttatcaggacgtgacaacctatgtcaatttcttccaaatcatcagccgacacaaaaccctgtccttgcttgtcatcgagatcatctaatgtgtccttagtgtagacattcgaaccctccacgacgccctcaaaataatagcttgggttctccatcttcaattggctgtatctcagaatcggacacttttagaaaatctccatcccaaacttttccagataaacaatctagaccatccatctcccaaagagctaaatcggcactggcaacattgactgacctgtcggctggcacaatttcaatcttgtcgtcttgccactgaatcaagcattgatgcatagttgaaggaatacaataattggcatgaatccaatcccttccgagcaacaagctgtaagaacccttcccatcgatgacaaagaacgttgtagggatggttttgttgctgactgtcagctccacattcaaaacccctttggtttctgatggattgccgccaaagtccatgagcaccatgtttgtcttgatgagatctttggcatttctgcccagtttcctgaacgtggtgtaaggcatcaagtttactgcagccccaccatcgaccatcatcttggacatcggcttcccattaacgtaaccatctatatacaatggcttaagatgccgatgctctgtaccctctggcttctcgaaaactgcctgctccggtgataaaatcaacttagccgattcgtcttcaattttatcgacatcggcttgtttgatcccaatttcaacaggcaatgtgaaaaccatgtaaccgaagcagttaccacacttttccacttagccaaccttcttgcttcatcatccgtggcttcatcagctacaggcacttgattcttaacacgccactcctgcctcggctttgttttctttagccgatgattgatttcctgctcgacttcctgaaagcgctccctgttcctcaatatttgaacccttctcttctgattctttgtaaagataccagaaggacaccattgagttttcctgttttcattgtcctcctggccacgaccttggtttactggacccaatctttgatgaacaggaaccattgtctgccttagccgattgcccctgctatacaatcggcttgagctctccgcaatatcactgcacccaggacagtcctcaatagatggcagccttataccttcattccaataaaatctaaagaactcgcaaccccaatgaggatcaaagccatcaccaccttcctcataatgcttctcctgctgtttgtcatacttcctctgatatttgttgataatcttagccgaatttacctgaaaccctcttgcacgacctccatcggctgtccagccagctgtatgtaccatattgacaggaaaaggattgccatcaaccttcatcggcctcttagaatcatcaaacttgattttgcctccttcaatagccgcttggactgctgcctgaagaccttgcaatcattagtagtatgagacccagaattatgccacttgcaataccttttcttgcccaattctttagccgatggaattgtgtgaccagcgggaagttgaatctgcttttctcggagtagcaagtcaaaaatcttgtcagccttggtgatatcaaagtcatacctctcctcttttctagaattcttcacccattggtatggtataacctttttgctccttacccattcgagtgcagctatcttagaatcatcatccccatcatccgatccatatatatatacatatatatatataaggacaaacatgattaacctttctagaattcttcctagcctctgcaaacctctgttcatgcaaggttaccttctgtgtaagatgtgacaagctttcgaagtcttcagatgagaatttctccctgattggagcaatcataccctgaaaagccaaatcgactaactgggcatcagtcaaacttaagctgtagcacttattcctcatttctctgaacctctgaatatactcatgcacaggctcatcatgtctctgcttgattgctgtcaaatcagacagtttcatctcatgtaccccactgtagaaatagctgtgaaaatgcttctccaaatcggcccaactgttaatcgacccatatggcaaagaagaaaaccaagtgaaagccgatccagacaaagacaaccagaacaacataaccctcaaggcatccatagccgatgcttcaccacactgagataaaaatcggctaacatgttcataagttgatgtgctatcttgccctgagaattttgaaaaatctggaactttgaaccgattaggtagaggaactctctcaaaccattcagggtaaggttgtcagtacaaatttctagcaactttcggcctaagcccaaactgctccttcatgacatccgcaattgtcacgtcccaaaacgaccctaaaatatatcctttaaattatgcccagaataaataaaatccttgtgaaagcctccaaaaattaaaatatgcaaagttaaaagtcaaataaggcttggagaatttttgtatatttcctaaaagcctaaaatgtgtaaataaattttagtggaattttcagagcacaaataataattattaagaaataaacaaagttaaaaaggttttataaaaagaaaaaccctaaaaacccctctcccctctaatgggccggctgagcccatctccctcccctctctctcctctcccccgcggctcattcggcctctccccgcgcgcgcaccgctgacgggcgggcccgcccgccaccctcgctgacgggtggggcccacccgtcatccccgacctcccgccgctcccgccgccccgcccgtgccaagcgccaccgccgccgccgaatctgccgcatcccgccgtccccgcgcgcaattaagtggggggaattattccccgtgatcccctccctctttcctccctatttttccctctctctctctcgcattcaaatggccggatttgctcccgcaaatctcgccggcgccattgatggcggccgcacctcccacgccggtttccttccccgccggccgccctctctcccttccaaccctatttaaaccctccccgcaactctctcgcccgtttccgccacttgccgcaccttctccccgccggaaacgagctcgcgccgtcgccctctctctcctccgtcgccgacgacctccggccggccctctccgctcaccgggaccatctcccgcctcggcatcgccttctccggcttcgccgcaccgccgccgaccccgtccaccacctcgccgagctcgccgaccgccggaacgccgtcgtccccatccacccgagccgcgccgccggctttctccggttcgggcggcttctttgtcatccccgtcgacccggggtgagccgtggaccaccgcctcttttcccccttcccttcccctctctcggccgccgctatcccgtgcctatggccgccgccggcgaccataggggcgcgggcgccgcctccgggcgccccgtgtgcccccccagtggggcccgaccgtcacccgcccgcgccctagggtgcggctcacgcgcggggcccacggccccgcccggtgtgagcccgggtacgcccggtccaccgtggaccgtgatgctgccgcgtgggccccactcccgtggacccggtccgcgcgccctcacacctcggctgacgcaataaaccctttttaaattaaaatttaaatgcagaaattcgtaaatattcatttaaagagcagataaacttcaattggccataacttggccatttgaactcggaattggaccgttcaagtctctaatttttccttaagaagtcaagaacctatttgtgtgctttgttcttgcttgttatatggagtttattagagtaaaagccttttttcctttccgttggtcgtgtagacgctgcagcttcagaagatccgctccacgtggaggttgaagccgatgtttgggaaagcgagcaaggcaagtcacatcatctttgaacatattggatcccagtttgtgaaattattttgatttaaattaatgcattaccgctttatttaaattcccgcgttatcactattttatttagccatgcctatttgcctttgttatgaccttattattattgttattgtgattattaccttgttcaccctagaataaacaaaaccccaactagtgggtactctattcatggtaccactagtatgaatttaggtagatgcttcgctgtttaattaggcaacattaggtggttttataactctagactttgggaatattcatatcacttggacattatggaatggttggattattgtggaattggatgcacaccttcccctctattcaaaaccctcaaaatggttttaggctgggctcggggtgcatggttttgatagtagcacctcggccatataaggaccggtcttcgggcctctgttgcaaagcactaccgtacttccacatgtctagtgggtaaggcttagtttgtggctcagtctagttataaacaaaagtacacggatggagatggacgaagtcgggggtcgatggacatctctaggacaaatgaaggctacacgggctgcggcccggtagtcgagatgtcatggcacagggatggtgtcctgctgctaggggctcagtcctgcctacctgtcctagaggtttcggccgtaggtggggttgggtcggtactcttgtctatggctaggatgggttggaaactatgtcacgtcttccgtccatatgccgtggtggtatgtggcacgtggttgcacgtgaggaagacgtgtcttgtgggtaaagatgtacacctctgatcagagtacaatcaattcgaatagccgagccctcggttatgggcaaggctagcaatttacccaagttagtgttttaaattcttaaaaacctgcttaataactaaaatgtggaacggttggcctgggttggcttgggacgagctgggacccagggtcgggttgcaagttcggtctgaatcatcgtaggccttgggttaaggcaggttcgtgtgggttcacggccttgtttaaaanccacgccatgttctaggatcgtgttttaaaagcagctttaagcaactaagtgtcttttaaaagctgtttagtgcaaacccaaaccccctatattataactcctttgtactcctttgcatttattctgcacttgtgggtgtgtcttgttgagtatggtggttgtacttagtcttgctcaatttttcccaaactcagatgaggagctcctagatgatgaaggctttggtgtctagctcgtgcctgctgtcaagcgcctgtggtcgtcgccctagtcatccgttgtttttcgttgtcttcttgtgtgctggtccttcgttgcccatgtaataattaactatttacgcttccgcttgttaaactctaaattgtatcaacttttggtgttccttgcctcctgggacaaggaataatacacgcacgcaaggaacgcctgttgggttatttccagtcgtgacagcaatcaactcggcccatggttgttgctaaggtgctccttgaggttgctgtggcatgggctcaaattgattgtattgaggaacaaactggggttgagccgatcctgcctgctggtattgaacttgcggtgatggcggctgttactgataattcaaattgcccccctggtaattttgaagatcctgctgaatattgcgcaccaaatgcttgggaataacttgaggtatcaccgtgccatctagttgtacatgatgaaccaaatgctccgggacaacttgatttgcagcatgctgcacaggctgaccaccaggtgtcgcaaacctagccgatgcattcattaagccttgttgctggatccgctggacaacctgctgccttagtggcgtctattgaattggctgcaaaacctgccgtctgtgtggcatatgctgagctggttgcacaacctgttggattgggggtgtttgttgaatcggttgcacaacctgctgccttggcgttgtttgctgaatcggctgctgctgggttggatcaacggtatgttgaggaggtaagaacatagatgcaacctagtcttgtgttagccgattcacgttctgtccgctgtgttgtggttattctctcaccagcaaacggggattaaccaattggcctggtgccgacggagctgcaggaggtgcgggagccgatactggtgccgtcagctgagccgatggtgcattgtgagggattgactggacaactggttgattatcggtgattaatggccgataattcgggaaccctcctcctggtagataaaccggtcctgtagcttgatgctcagccattgaaccatcaaccattgattttaccatgcttgccaaagtattggttaatatgccagattgattgatcaaagcatggtgtacaacatagtcaacctgatcttagaagttgttgaactacaactgtgctgtattgctatcttgattaacacctccaccttgaactccctgagcaccatcaccttgaactccctgtactccttgagagttgtcaccttgatttccttgagaaccatatgtagcacctttatcactcggttgagccgagccatctggagcttgtttcacctctccatccttagaagaaccagtcctaggaacatcagcaactacctttaccttatacttctgcaccaccgttctcttgcgcgtttgcataaatgaacttaagaactggttacgtgcttactgcatcattgcttcaaatccttcttttgatcaggtgtcagcttgtctggagtgatggtcacgatgttgctctcattaacctcggacaggcctaactgctggatcttctctttaacagaaccggggctagccgaggacggtgatgctggtggcttctcctccatggagaaaaactgttgtcgcggttctgacttcttatcaggtccaactaggcgtgccaaaagcgtgttgatgaaaaacacgaggcttgggagatccgctttgttccagtgcaggtccaaaactcgcctccgggtatgctaacgtgccagttgatttgatcctgcaattaacaagaaataaagacaaagaaaccgcggttaaacttataaacgatagacgatcggcaaaaggccgatgatatatcatttatctttgagccgatgtcatatatgtatcgatcggcagtcatgaataaataagaaagaactaaaactactcgatcggctgcagatattaacgatatatactccttatatcgatatatacttaaatcaagtgattgggatagatcgg

SEQ ID NO: 62323 - DNA, 6491 bp, Oryza sativa
aacaaaagcctaatatacttaaatgcaacaagatctcaacataaagggcagatttaacatgttaataaagcacataaaacaaatatagttaaatcaggtaagatcagctgaaactccgatactaccccaatcggcaaccaagaagtaggctagagattgagattctaatcacgactcataagatcaaacaactgatgcagctataagtatgaagggaagaacaatatctagacaatcaagccgctggaagtttcatagagtggtggatatcttatataatctgaatcaacatcgatatttaacctaatcggctgccctctatcgacagatgttagccgattgtaagttaaatagagatattgctagagattatgtaagatatatgataactcgacgaattatataaacaagattagagtatcattgagatggaagcactaatcccgagaacgcaagttgtcataacaagttttacctcttgttgaagatcgaaaccgatgcagctcaaaccaaaagtaagaactcgtcgaaataaaactaaagcaaaaagggtggcgatgcgctgagattgtattgaacgtgtatgttcaatgattacatggggttcagggtctatttatacccgagaatcacaaactatgtccataccggacacgactcttatctctaacatactctaagataccataagtctttgcggcagacttttgcccaaacatatctctaaggaaattacataaaatatcctaattaatagatacaattgccttctcaggactctatccatgcatggcaatcgtcttgaagcatatcaactcaacccgatgtcgcacaccaaatcgtatcgtcggaatcggctgtatcggcttacccagtctgatcggactcagccgattctgatcgtaaccgatttggactccaaccgattcttactgtgtttccgcaatgatcttcactttcgattccgcttcgattcaatcttcttctccgatactaatattaccaaactttaaaaagtagggtcaaattggtagctagatttaaagcggggtcaaataagcaattgccccaaaaataaaaaatgggtgcacccctataagatttaaaatcggcaccaatgggtttctctgcagtagtgagtataaactatgtttagtaatttatatcttaacgatccatcttatcaatttagtatttcatatttttttaagtacaagtttaacgtacacacaacacaatcgtgcaatcgctcacatatctaccaggactcgttttgtgaagattttaaaaaaaatttatagctatttagattgcatgtatgcaattagggccatgtttagatttcaacttttttcaacaaatttctaacttttccgtcacatcgaatttttctacacacaaacttccaactttttcgtcacatcatttcaatttctttaaaattttaattttgacgtggaaatcacaacctaggtgtgtatatgtactttggtgaaatactttctgcaagcacgaaatcctatagacacagctagcatacgaatcataagattgaacagagctgatcgacaaaagaaataaagaacggggaactacgttctgccgcaaaggatgccgtggcagcatcagctttcaacggcaagtttttcccatcccgcggcagacagtcaaaacaacggcgggtcgacaagtcaatgtttttgacacgacgaacaccataaaactttaaaacgtgtttgagagttgacgaaagaaaaaaaaaacatacccagaaaataacacaactattagctatgattaattaaatattacaacaattcttttaaatttaaaatttaaaaatacaactttttaaaatttcttttgtaaaagaaaatatcgtttagtattttggtaagcgtgaggttgaaaaaagtaatttttttctctgtgttgttgctgaacgcaacctaagatagcattaaagaagtactcatgggacaaaactttaacgaagtaaaactgaataaaaggatgcaaagtgcaaaaactaaaaagagtatcagtgactaggatctaatttttcaagctgttttcttgaatttagatatatatataaaaaataacttatctttaattaagaactcaccaggcatgtactagttggttgtcctcatgcttaattaatttggttaatctcatctttaatttggccaaaaacttgcttgctactccatatcgttatcaaccataacgaatgagattaagcaaagcacgagggtcgttgttgaagctgagtacatatttgaccaaattttttaatgtttagtggcacgtacatatatacctacagatacatctctttggcatgcgcacagtgttgtttatagagagagagatgcgttctagcgggatcagcgtaattgttgtcgttcgccacctggcgtggctggtgctaattttgtgctcatggccgcgggttgcagctgctcaggctcaacaagcaccaaaaactgatccagtcgaaggtttgtattgagttgttttgtttttccccatataaatcgcaggagtatagtacacttcggttgatatatggtgtcctctcttgccgcattgacacgagaagagttggaggaaatttgattcattaatcgcctagttttttcatctacatgattagtacttcatgacgagttaaccacacagcggccgccctgaacacgatcctagggagatggggcaagaaggcatcgtgggagtggaacattagcggcgagctctgcagcggtttcgcctctactgaaatcgactgggattactaccccaccatcaacccgttcatcaaatgcgattgcagtttcagcaacaacaccctctgccatattaccaaactgtacgtttgttttcatcagttgtgcaacatgtatctcgatgcggtgcctgaaaaatataagcaaaggaacatgtcagattatcgatacgtctgttttcaccagttgtgcaacatgtatctcgatgcatgcagtgcctgaaaatataagcaaaggaacatgtcagattattgattactagtatttccaattcatagagccatcacatcggtttatcctaaattgggtcctccggctccagtgacctttctttaatttgcatcttatttaggcaaaaccaaatatatcccaattagcacaattctcatatataggtattgcatgtctattatgcagaagggtatataaattgggagtagttggtcaaatacctgcagagctacagaatctcacccacctagagtatttgtatggtatctaagtcttttctccttaatcttgataactaattgttacactacagattaaggttttgccgtaaatataaattatattccatgttctttttgtgaaaacagacagcttatgctttttttctgctaattgacctagtgtttctttatgttgtcttcaggaactttaattataattacttgactggtgccattccatcattcattggaaaattcagttcaatgaaatatttgtaggagttacacatcacattctagatttatgtactatatccctttcatattataagtcgttttcagttttccaaatcaaatttctttagctttaatcaagtttgtaaaaaaatgtagcaatatttttctacataaaacaaagaaactattaaaatgttttcaatgttagatttaataaaactaatttggtgctagaaatattgctatattgttttataaacttgatcaaactttaaagaaatttgattttaaaaaagtcaaaacgacttttaatacgaaatggagagagtaccattcaatggttaatgttttttcttaattctgtttcatcatttgaagggcattagcttcaaattcactgtccggacaacttccaaaggaacttgggaacctcaccaatcttctctcgttgtaagataatctttcccatggcaaataaatcatcaactatttacttggactgcctcaaccaatataatacaacaaatattaatcgcataacttctcaacaataataaattaagtaataaaaaaccataattgcaaaaatatcataaactactaaacaacatgtaacagacaagtcagtgcaattccttttccatgtgttgcatcgtttgatcaggaaaacacgatgccccctttcttctattatatagttgaactaaaaaaatttaaatcactgctgaaatatttcattttcaattaggggcattaacttaaataattttaccggtgtacttcctgaagagctgggcaacatgaccaaacttcagcaattgtaagatgcttcgttagttcctaacatccaatttctacttctaaaagaattaaaatttgaaaagagcagatctgttgttgaccatgatagttacttcaatgttccaaaagcaggtatgttgctagttctggattcagcggtcggtttccttcgacgttttcaaagcttcgcaacctgaagttattgtacagtcaataacagagactcacctagtatgtttatggtgttttcttgctgaatgtcaaatatttttgtgtgcttgtaggagagcatcagacaatggattcatagggaagatacctcattattttggcagcatgactaatttagaagatatgtaagattaattatgtatattaacttgttaacatatcattcgctctatcctaatcagagacaaatgaaattttgcaacataaattttctgcatatatgattttcccattcgaatttgagcaatataatagcaaacatttccactcaacaaaattgcacacatctctatcacactaaatttatccagggggcatgttactacatcgagattttatgaaataaaaaaggaaaaaaaaactgttgatacacatacagcttactttaaccttactttaaataaatggtggcatgtattctttctaaagtatgagctttagtggtttcgaaggaaactcatttgaaggaccaattccagaaaatctgtctaatctgaccagattagaaaacttgtaagtatacttttttgtggtattgatctctcttgaagattgacaatgccaacgctgatgagttatttctgaaaaatacatgtgagcagacggattggagatatagtaagtggggcctcttcattggcatttatcagtaatctgacatctctgtaccaactgtatgtgatgtttttgcttcaaattaagtttacagtgtataggcaaatttgcaagttacaaaagttggatttcgttcttacacaggatattaagaaactgtaagatatcgggtgatctcagagcattagatttttccaagtttcgaacactaatatcgctgtaagtctcccaaccaccggctatggtgtcacatttcctcatgtagtgaaccatatgtactccaagtaatttatactatactgttgtggcacagggacctaagttttaacaatatcacagcccaacttccttaatccatcctacatttgtcgtgaattcctgtaagaaattctttcttgatattaattgagttttttcaagcaccttttaagcagatgagcatgttagatctcacatcttcaattgtgctcaatttaggtttattgggacaatttatgtaaggatgcatgatagtaaaagctcttcacatagagcaatgtatgtcaaaaataataatcagcggagcagtatagcacaaatattttgataatagaatgatgtatcagtatctatatatgatacagttctgcaatgcttaggagattatttttgtacaattctgcagtactggaatcttcccttcctcggctacctagaataatttgcagttctaagtataaaattaccatatttgtgtttgagaggaaaatttagatcattgaatatttattttgtgaaatgattttggtaacaaacagcttttacttgttagtattacacccaagttggtatccacgtacctagaatactaccgtgccaattatgatagtctgcgaagtctgaaatttattaaaattttcgataaaattcactcgcagctctctggtttgacttgtgagcattggtgacatcatcttttggtgagttacgatttgagcgggatgttgatgaccacactataactatacgggacgcagttgtgttgtgccttagcgatcgatatacctctttataggttgttgttcttatcggtgcagatcaaccttatacctgcaagcaaatcaaaaaataagctaaaaaaagataaaaacaatctaaattgcaaatactaattaagctcgcgataaatttaacacccaataaggtggggtgccgaagatgagtgattaagcggtcagccaacatgcacaattacgaggtaaagtagaaataataaacttcaatctatcaaaacccaaaaaaaaaagtaaaattcacaaaactacacgttttgtggtccaagttgtagaaaaccacacacactttgacacttggcacttaagta

SEQ ID NO: 62324 - DNA, 3028 bp, Oryza sativa
acccctcgacgacaccagacgatcccaaggcgatttcctctccgaccaaacttccgacctgcgatgatgtcaacttccgccatcccgtctgccgcgccatcgaccgaatacgcagaggtaagtacccatcggctagattctctcctttatgcagtagattggttcttctttgtcttatcttgttttcttcttctcttttcttgtttgcatctgtagcacttgtccaacctggtcgcaattcccagtttgtcacatgaacatcactactttctcggtccaatcggcaatcccgatcccactaagtttattattgctggaaccaataggatcccttttagattggccaacccaatcctaagtcactggaagaataccttcaagtcttggccttctcttgagaaaacttcccctgagaaaagctggtctgtgtggtataagcgtgtattagccagcaagcaagttcattgggacgaactaggaatcggccatgcccttgctcttacattagcaaattcggctaaggacaaacccttgatggcctctccagcctattgttggtccaacgcccttaatgctttcttggttaatcaagggccgatgactcccactctgcttgacatcaccatgattactggtctagatgtgaccttatcggctaaccccatgagtttgaataccaagaatcaatttgattttaggaccaacagcataggtggttggtctggctatgtagccgcatatatgggcaaaggatctgccaccccccgagagcacactgcctttctcttcatgtggcttgaaaagtttctgttctgtggatcaagctgcggtcctaccaccaactggcagttcttagccgaagcccttgaaagcaagagacaattccctctaggcaaaatccttctcggctatctgtaccaaatgttgagtaatgcatcggctaagatagccacaggctcagtagtgggtgcgggtggaccatggtgattgctacaaacatggcttaatcttgtcgttatgaaggttgtgaatcggccgcctctgatagatgctgaattcccaaggctggagcccaccaccaatgatgacagggaagaagttacccatcgccgatgcctgtcgtatggtgaagctacatcaacaccagccgattctggagcaaagctatcggctcaactgctcaaggactggttctgcagtttctatgaaggcttccaaagagatgctcgagtctggtttccatatgaggactcagtaaactttgatctcccatcggacttcagatttgaagacatcaactctgaaaattccaaaaatccagagaagtcttctcggctgccattagtccatgcatccttcctgttggcattcaccaagggagaaacatacaagtatcttaggagttataccatccaatgagctcggccagacaatttggaatgggatagttgccgatcggcttgttctttgccgataagatccagtgcagaggagaaatctgatcaacattgatgatggatcggctgctcaatatcctaggaccccctttgggtagtattgataacatagagctggcaaggttcaggagcaggaactttgaaagatggtggggtgaatggaagcaacatatattccatcagctagcctctatgtatatgacagatctattcccagatattgttcctcaggtatatcgttactctgtcaattctgttgtaataaaagttagccgatttgtacctttaactaatctcttcgtttattttgcagacaatagaatcttctcctcctcgcaaaagcaacagtggcagagatatagaatatgtcctaggccttctaccaaatggaggtggactagctcctcctgtcattggctatcatgcccccaggaccacaagtctgcttcaagagcaaatgagagaaccacccgatattcgtaagaagagaaaaaccaaggcatcggctattgatccatcggctctggctcccaagaagaagaccaagaagaataaacccaagccagccgatgacctgcctactttagatccatctattgagcaagcctgggatgaagaagagatcgaagaagatgtttgtcacaccctgaagttctcctcccaagccaaaaatttaatttataaatgaccctaagaaaatgccggcgcaaatcaagagaaaaccctaagaaagtaatacaaataataatcgaatctgacatgtggaatttttcttgagttctacatgtcgaaattcactaacaggatttttagtggaattttcagagccctagaaataattttgaccaattaaaattgagcataagcaatatttaaatccctggaaattcctttcttcctttttctttttccttttcccttagtgggccgccggcccacttcccctcctctctccccgcgccttgctgggccggccggaggccacgccccagctcaacccgcgccccctcctctcgcccggggtcaccgacaggtggggcccacctgtcggacccgtctcccacctcgccgccgcgcccgcaaccgccgccgcgcgcacgcctccgcctcctccgggccacgtcggccacgcccgcgcgtgcgccgcgtctcccgcgcccactcccctctccctcccgcccgcgcccgcgcccgagatggccgggattcgaaaatcgaatcccgcctctctctcctcccccactcccccacgttggccggcgattcccgcctctcccggccatgtccggccccctctccccctatttaaactccgccgccaccccctctctctttttccccatttcgccaaactctcccgagctctccatcactcccgcaacgtgcatccacccgccgccgcctttcccgtcactccggccgccgctagccgccgctagactcgccgccgcaccgcgccgtcgccgccgtcgggttcgcgtggccgagatccaccccgtccacccctccttcgtcgaggttcgccgccggagcgccattcccactgtgcgacggtgagagtcgccatgtcc

SEQ ID NO: 62325 - DNA, 788 bp, Oryza sativa
ccctgttatcatcggtaatggaatatcaagtgaaggctcggttcataaaagacttgtctttcaattaatggaatggatcaggagataatgattgctagcccaatttagtaatagtcaggctcgtgaatgatggcagaagttgtaatcgatcattcgatggtttcttgttgatggcagtaatcatgacattatttctgttaatagtaaccatataatactatcagatgtgatcaacaaaagtatcatcaagaaaggtcgcgctcatgacaattaaggaccggttcgcgagctattgttgtgagacattaaccgtaccaaccacaagccagcgtgggcaatggctttatcttttgtatagcatgattcattatggtgtgccagactgagaagtggcgagaagtccgtgggggtcgctggggagtccattgcctctggttttgagggggagattatgatccaggaatggtgcactgtggtgagttgtgttgtgcgaagggtattgtcacgatttcccccttagcagtgccgtggtggtacttcggggcatggcaacatgtgtggaatcgtgtcttctgggtacagtggtacatctctggccagagtaaaactattcgaatagccgtgcccgcggttatgggcgagtctaacaatgtttttcgtgattagtaccacactactcattaatgttaataatatgatgattaatttgactcctggtttggaatggataattcctggtttggaggtttgatctgtacgatcggggttggttgttcagtttggttggg

SEQ ID NO: 62326 - DNA, 8555 bp, Oryza sativa
tttaatgcatattctgcttggaattctattcggtaatttctgggagtgacaggaacggccgggggtggcccgatttcgccggccgacgtggggaggtggaggtggagagagaggtgggattcgaatttcgaatcccggccatctcgggcgcgggcgcgggcgagagggagggggagtgggtgcgggaggcgcggcgcatgcgcggggcgtggccgacgtggcccggaggaggcgggaatcgtgggcgcggcggcggtagcgggcgcggcggcgccggctggaggaaggagacgggcccgacaggtgggccccacctgtcaacgaccctaggggagaggaggcgggcggccggctcggctcagctgggcctcggccttcggccggcccagcgggaaagggggggaaaggctagtgactgcacctgtgttagtcttgcctgatcctaggaaaggttttcaagtgtactgtgatgcatcccgacatggtttgggttgcgttttaatgcaagatgggaaggtggttgcctatgcatctaggcagttacgccctcatgagaataactacccaacgcatgacctagagttggcagcggtagtgcttgcattgaagatttggcgtcattatctttttggtaaccgtacggagatgtatacggatcataagagtttgaagtacattttcactcaacctgatttgaacatgcgacagtgaagatggttagagttgatcaaggattatgatatggaaattcattatcacctaggtaatgtgttaccacgatcggaagaatgtgagcagagttttcaagagttgaagaatcgcttgatatcagctcctattttgattttacctgatccaaagaagggtttccaagtgtattgcgatgcatccaaacttgggttaggttgtgttctgatgcaagatgggaaggtggttgcctatgcatctcgtcagttacgtccgcatgagaagaactaccctactcatgatcttgagttagctgcagtagttcatgcgttgaaaatttggcgtcattatcttttcggtactcgtactgaggtgtacaccgatcacaagagtttaaagtatatctttactcagccagacctgaacatgagacaaaggagatggttggaattaattaaggattatgacatgggaattcattatcacccaggaaaggctaatgttgtagcagacgctcttagcaggaaaggctattgcaatgctacagaaggacgacagttgccattggaattatgcaaggaatttgaaagattaaatttgggaattgtcagtagagattttattgcagccttagaagcgaagcccactctaattgatcaagttagagaagcgcaaattaatgatcctgatattcaagagatcaagaagaatatgagaagaggaaaagctatcggtttcttggaggatgagcacggaactgtatggttgggtgagagaatctgcgttcctgacaacaaagatttaaaagatgcaattctgaaagaagctcacgatactttatactctattcaccctggtagtatcaaaatgtaccaggatctcaaggaaagattttggtgggcaagtatgaagcgcgaaatcgcagagtacgtagcagtatgtgatgtttgtcagcgagtcaaggcagaacatcagaaacctgccagtttgctgcagcctttgaagattcctgaatggaagcgggaagaaatcggtatggattttatcactggtttacctagaacgtcatcgggtcatgactctatttgggtgatagtcgacagacttaccaaagtggctcatttcattccggtaaagacaacctattccgggagtcggttagcagaattgtatatggcaagaattgtgtgtttgcatggcattcctaaaaagatagtgtctgatcgaggcagtcagtttacttcaaatttttggaagaaacttcaggaagagatgggttctaagctgaactttagtactgcttatcatccgcagacagacggacaaaccgaaagggtgaatcagattttggaagacatgttgagagcttgtgctttagacttcggtggaagttgggataagaatctaccttatgctgaattttcgtacaacaacagttatcaagctagccttcagatggctccttacgaagcactgtatggtcggaagtgccgcactccgcttttgtgggatcaaacgggagaacgtcaggttttcgggacggatatcctaagggaagcagaagaaaaggtgaaaatcattcaagaaagattgcgagtggctcagtctcgtcataagagttatgccgacaatcgccgcagagatttgagttttgaagaaggagattatgtgtatcttcgtgtcacgcctcttcgaggggttcatcgttttcacaccaaaggaaaattggcaccgcgttttgtgggaccttataagattgtcagtagaagaggagaggttgcttatcagttggagttacctcaatctttggcaggagtccataatgtgttccatgtttcgcaattgaaaaagtgtttaagggtacctaccgaagaagctaatcttgaacagatagaagtccaagaggatctgacctatattgagaaaccaatccgtattttggaaatagatgagagaagaaccagaaatcgagttatccgtttttgcaaagtccaatggagtaatcactcggaagaagaatcaacttgggaaagagaagatgaattgaagtcagctcatccatatctgttcgccagttcttccgaatctcgaggacgagattctgtttaaggggggtaggtttgtcacacccttgaaaatcataaatatataaattgttgttaaattggaattttttagaaataattttaaaagtttttttttataagatctaattttaaaaattccaatataaaatggggccagataaaatttcattaaatactttgcttaattctataattcctagatttttctgggatttatttgagctaaggaagtatttttaataaatggaattgcatttaagaaataatttaaattgaaaaaggttttaaaaagtcttcttttggctttgggccgaaagtcggcccaaaacctcctctctctctcctcggcccagccggcccagtccgcagccgcagccgcccgcgcgcgagtgcgctgtcgctgacaggtgggtcccacctgtcggagtcgtcgtcttcgtcgcgccgccgccgcccgaaaccctagtttcgcgccgccgccgttcctttccaaatccggtcgatcctttccgtttccggccgaattgatagaggggaaatgatcatcgggatctcctctaccttttctcttttggaaacatcggctaattcgttttggaagttcgtggaatcgagttcgattcggatcggcctctttcctccgaaccccgaagtttccttctcgtcgccggccgccgtgggctttcgtcgccgcctccgagcccctttaaaaggacccccggtgtctcctctacccgccgccaccctcgccttcgcctctcgtcgccggaagagctctagcgccgtgtgccctagcgccgccgtcgccgccgtcgctccagccgtgcgccaccgccgttccagacgtcgtcatcgctcgggaagaccgccgtcgtggtcgccaagtcaccgccgtcctcgtccgccccttcgccgtcgccgaagatcgccggagcaccatcgccgccgtcgacccgaagaccgccgccgtttcttcgtcgtcgccgtcgtcgtccgttggtcttccgccgctcctttggtcaccggtgagttcgccgcgtcgcgctctacccgttggtgtcctccgttcgtgccgaagcgtcgccgttcgccggcgggcttgcgcgtccgagccgccgagccgccgccgccggtggtgacgtcatcgctgacgtcatcgtccccgtctcccgtgagccggtcgtggaccgatcgatctcggccgtccgttttggatggatcgatctcggccgtccgttcgcgtgaaccgccgccgtgcgcccggtccaccgaaaccctagcccgctgacgcaataaatccctttttccttttcaaaaataattcattattgcgtcataattcaattaaaatcaatttaagtgttttaatccgatttaatcttcaaaaattcataactaattcatcttagctccgatttagttggttcaagtctctaaatttttctaaaattgagatctacatgttaaaaatatccacatgtactgttcatgcttgtttatgtgctgttttggtgattttgctcttttctgcttagattccgtcgtttccggagagtccgttttcgccggagaagagtttgaagagttccaaggccagtaaggcaagtcacacagatcccaaacaaccctttgagcatgttgatcctattttaagctattgtttctattcaactattgcatttattttcgaatgtcattgggtggaattaacctattctttgttatagcccttttgttcttgaatactttattccttgataccttgggttatttataacttgactagttgggctatgtatattggttcaactagatattagatataattgcttagccctgcttagaaacattagcacattattgggataacttatgactcattacttaatgatggcttaatgatagttcacgatggtcaatcgtgattggttaattaattaatgtgccaactaaaacctgataatggtgggttgtgagcacatggttttgatggtcgtgctcatgacaattaaggaccggttcacgagtttcggttgtgaaacattaaccgtgccaaccacaagccagcgtgggcaacggctttatcttttgtatagcatggttcattgcggggcaccagactgagaagtggcggagataagcccacgggggtcgctggggagtccatgccttgtttataagggggtgattatgatccaggaaaggtgcgctgcggtggattgtgttatgtaaggggtattgtcacaactcctttccgaggtaccgtggtggtattgaggcacatggtgacatgatgtggggttgtgtcttgtgggtacagtggtacacctctgatcagagtaaaactattcgaatagccgtgcccgcggttatgggcgggtctaacaatgtctttcgtgattagtctcacccttctcaccatagtaaatgatgctataactggtaataatttgattagctcctggtttggaatggtatattcctggtttggagatagaactgtgcagccgggatggttgttcagaatggttgggcctatacaacagggtatgttgtatagcgttgatttaatattgtttaattattacttaactgttttattaaattctcaaatgtttgctaaatgctgcttttgcaaatgaaaccctattatgccatcctttgttatcctgtgcacttgcatatttgctgcgtggcttgctgagtatgtcatatactcaccttgcaatcattcatcagaggaagagttcttcagtgaagctgatggtgtggaggattaggtgtagccttggtcaagctgcctgtggtgtggagccgtctgcgccgtttatcttattttccgctgcttagatctttattgattgagttgagaggaactatctacctctgtaatgacattttattcgcttattaattagagtaataaatgtactctattatcaatttgttattgtgtgcctcggctgattcctggacgagggttcacacacatgtaagcgtttggaattttggatagaaattccgggcgtgacataggtaaagcaaatgtggtagcagattctctcagcaggaaaagctactgtaatatgtcagaaggatgacatctaccttgggagttatgctaggaattggaaaggttgaacttgggaatagtcaacaaaggttttgttgccgctttagaagctcaacctacccagtttgatcgagttagataagctcaagtgaatgatcctgatatccaagaaataaaaaagaacatgagaagaggaaaagccatcggatatgtggaagatgagcaaggaattgtgtggctaggagaaagaatttgtgtgcccgacaataaggagttgaaggatactatcatgaaagaagctcatgaaactttgtattccattcaccccgggagcactaagatgtatcaagacctgaagcaacaattctggtgggccagcatgcgacgagaaatagcagaatatgtggctctatgtgatgtatgtcagcgagtcaaggcggaacatcggaagccagccggtctgttgcaaccgttgaagattccagagtggaaatgggaagaaataggaatggactttatcaccggtctacccagaacgtcgtcgggacatgattctatttgggtagtggttgacaggctgactaaagtcgctcacttcatacctgtcaaaacaacctacacgggaaataagctcgcagagttatatatggccagagtggtatgtttacacggtgtacccaagaagatagtgtcagacagaggtagtcagtttacttcgaagttttggcagaaactacaagtggagatgggtactcgtttgaattttagtactgcttatcaccctcaaactgatggtcagacggaaagagtgaatcaaattttagaagacatgttgagagcctgtgttctagattttggtggaagttggtataagaatctgccgtacgcggaattctcttataacaacagttatcaagctagtctacaaatggttccatatgaagcattgtatggccggaagtgttgtacgccgctcctttgggatcaaactggtgagcgtcaagtgtttgggacagatatcttgcgagaagcagaagaaaaagtgaagattatccaagaaaggttgcgagttgcccagtcgcgccagaagagctatgccgacaatcgtcgtagggatttggctttcgaagaaggagattatatatacctacgagttacgccactgcgaggagttcatcgttttcaaaccaaagggaaattggcaccgcgttttgtgggaccttttaagatcgtgagtcgaagaggtgaagtagcttatcagctagagttgcctctgtcaatggcaggaatacatgacgtgttccacgtgtcgcagttaaaaaaatgtttgcgtgtacctatggaggaagcagatcctgagcgtatagagcttcaagaagatttaacttatgttgagaagccagttagaatcttggaagtgagcgagaggaacaccaggaatcgcgtcatacggttctgtaaggttcagtggagcaatcattcagaagaagaagccacttgggagcgagaagatgaattgaagtcagatcatcctcatctttttgccagttcttctaaatctcgaggacgagattctgtttaaggagggtaggtttatcatgccctaaaaatcgcctaaattaataatgcatattttaaatcatttttagaaattattttaaaagcctacaagttaatctctaaaaatctaggaaaattttcaacataaaattgagctagataaaatttcattaaatattttgcttgttcctctattttctagatttttctgggaattatttgagtaagggaagtatttttaataaatgaaacaacatttcacaaattattttaattgaaaaagtgttaaaaaccctcccccaagccgttgggccgatttatccctccctcctcgcgcgagccgcgggcccacgccgagcccagccgagccaccggcctccccctcctcacagccgccgacatgtggggcccacatgtcggggttgtcttcaacctccggccggccgagtccgcccgagccgccgccttccgattggttgaggggttttgatccccttgttgtcctctatctttacccccaaaaatcggagctaatcgcttcgtatcttacctgaatcaaactcgttttcgagtttatccccaaaacctaaacctagtttttcccggtccgattactcgcggttagagtccgatctctccaatctaaggctataaatagcaccctctagtcgccctctttcgtttgccctaactcccgagccttcttgtgccccgtagcgccgccgccacgccgtccaagccgccgccgccgccgtccgacgcccagccgcgccgcgccgtcgcgttcgccatcgccgccgttaggtgcgcacggaggtggggaacctcggccgccccctcgccgccgtcgccggtcacaggagatgtcacgaccggaaataacccaacgggcgttccttacgtgcgtgcattaatccttgtcccaggaggcaaggtacaccaacagttgatacaaatcagagtttaacaagcggaagcgtaaatagttaattattacatgggcagcgacggcccagcacactcaaagacaacgaaaaacagcggaagactagggcgacgaccacaggcgcttgacggcaggcacgagctagacaccaaaacctccatcttccaggaactcttcttctgggcttgggaaaaaattgagc

SEQ ID NO: 62327 - DNA, 3099 bp, Oryza sativa
tgtctatattcatataaatgttaatgaatctacctgtctaagaaaatataggcaatactagaaagtcttataatatgaaactgagaaaatagtagatattactattttttctataaatctaatcaaactataaacaattttactttaactagagtcaaaacctctttacctaaaacggagggaatactttccatattcatttcgcgcttggccccctcattcgccgaaagaatccatcgggcccacctgtcagccactcatacggctcaccgagttcgtgctggtgtgcagtgtgtagctgctctgatcatgcgcgttgccggcgatttcttctacgagctctgaatctctcgtgcgcatgcgatgcaggtgaggcagctgctgaagaggagcgacgagggccgcgtcgtcgcgacgtgtcgcgcgccggattcagccgtggagcttcagaagctgaggcaggagcacgagcagcgcctcgccgtgctcccgctcgacgtcaccgacgagagcaccatagaggtatagatatactgtgcactatatgcagagattgataggtagtactccctccgtattgtaatgtataacgctgttgactttccgaccaacgtttgaccatttgttttattcaaaatttttgtgtaaatataaaaatatttatgtcatgcttaaagaacatttgataacgaatcaagccatagtaaaataaataataattacataaattttttgaataaaacgaatagtcaaacgttagacaaaaagttaacggcgtcatacattaataacggcgtcgtacattaaaatatagaggtagtagtagtagattagattattctttgcttggattgctagtcgtacccggatagacaatgttgtgttgtgagcagagttacttgatattcagattcagaaggatgatatgaggttttgttttttctagtctgcacagcttgtttcttggtaggaactactagattatgatgctagtgaaggcatgctgaattgagacttgagagttcttaggccattcacagtgggatgatctgtcattcagcccaacgctgccacatctgcgagattcttcaatccagtgccacgtttactcctgggcccactaaattagtccgcgtgaccaactttggtcacacgttcttcggctcaaaaagcgagataggaagcagaaaagcgagagagagagagagagaggagctcccaagccagaaaagtagggaaaagcattacttggtgggcccactttagatacccatgctgccaatctgccatgcattgtgagccgagtagctttgagcgtggtttgcttacgtggaggtagaaagcccctgctgattccgcggcgcagtgtgaatggccttatgtaaaattttgagtcttccggtgacaggcagctgcggcctcgataggagagacccatggatctctgaacctgctgatcaatgcaactgggatcctttcaattccgaatgtgatacatccaggtttatagttgaaatttgagcatagcttttcaggttgcatttgattggttggttggttgttgcttgctgaatttgggatattttcatgttgtgttacagagactacatttagcaaagttcagaagtcatccctgctactggcatatgaagtgaacgctgttggccctattttagtgatcaaggtataaataataactcactgtttcacttccgttttcatattcttgtcgtgatgtggtcggatatcatctgttatatagacatgcttactctaaattgatttgttctatcagcatatgtggccattcctgaaggctggaggttgctctgagaccgggagaggattttcattggttgcaaacatgagtgccagagtcggttcaataggtgacaatggcctaggaggctggcattcatatagggcttctaaaacagcactgaatcaatgtatgcaaatactaacatgttccatcttgtctgcactagcctgcttttggcactaatcttaattttacagataatttgtttccatcagatttacaaaatgttttgctaattttgtgcagtgacaaagactgtatcagttgagctggggaaaaaggacaacattgcctgcatcctgctgcatccaggaaccgtggacactgacctctcacgcccttttcagaagaatgttcccaaggataagctcttcacaagggagttctctgttcagaagctactgtccatcatcgacaatgtcaagaagagcgacaacggcaagttcttcgcttgggatggacaagaaatcccatggtgatatcaatcagcacttcagcagagcaagtgagcaacagtgtccaaaatttgtgctcaatattttctcagcctttattgtgttgttggcaccaaatagatcgtgtcaatgctcgatttgaattctatttggatctacgatgatctgaacataacaaaccaaaatccattttcttttcgcttcctttttagatgcatacaaatgatcgatgtaactttcttttgccactggtggcacaacagttaacccagtgtaattagctgcaacgtattctgatggatgtatatgttgaaaaacttccagccaatttctcaactactgcatcatgtccatatcatatcctgcgacgaccattgacttgtaaagtacttcaaatctcctccatagtactagaaattatagaacattatatgctaccacaggagactcctggtagtctatcattgatgccggattgactacggccatggccggctggggtacgtccaggaaagaagtcgccaatgccagatgcatggaagcttctgtcgataagttgacagtgacgtggtctcccttgcacgatacttgaatcttatgtgcactaatcaacgaagaaaaatatatagtgcaaaccccatatgtactaaaaatctaaaaactactactagatctaaaaataacgtctgataccaatagtaaaagtttgagttaatttgatccataccattgtaaatgtgtatattcagaaaaatatcattacaattcatctatttcgaaccgtgccattgaaatttatgtaaaattagaagtgtgccactg

SEQ ID NO: 62328 - DNA, 13000 bp, Oryza sativa
tggcactgctccctgccaccgccgccgcaaaagtggacgtcgcggcagctgggcaccgctgcctccttgaacatggctctcagcgcctggacattggccacaagcgcatagaacctctccatctgctgctgatcttcctctcctcgctcgtcgccgtcgcgtgggaggccgagaaggagtccttgagcgcgtcggcgtcgcgcgaggagggagcggtccagagcgaggcgagcagcggctcggggcgcccgcacgcgaacgtgcgccgcacgaacgggcccaggtcctccccagcggcgatggcgatggagagctgggcgaggtcggcctccgacgctgccgccgacgccggcgcgtcgccgggctgcttccgtcgcatcaagatctggtcatccctgtcgagctcttcgtcgtgttctcgtcgttcagcagcaaggtggcgccggcagggcctcctctcccagctcgccgtcgacgccaccctcacccagttcgccatcgacgccgccctcgctaggaagtccaccgcggtggtcgggatgaggacggtaacggagatggatggaaacgtgatgacagtgggagacttctaatctatctatctatctatctatctattatctatctatctatctatctatctatctatctatctatctatctatcgattttctagaaacgctctcataccgccatgtagcaccctacaaacactcctatgccgccacgtggcgctctaataaatttagaattctaaaataaatctggtgaacccattattttttaccattggatctataataaaaataaccaatccgatttatcttaaaaaggcccacgtaacccccataggtggataggtgcatgtacgtacgtacgtacgtcatgcacggccccacgttcatcttttctccttttttcttttttcgatcataagaataaaaaccgaattaattatttcagcccatagatattaaatccagcctatatatatgcaaaaatatatgtacatgccaataatatattatttttttcatatattatatatattatttagtacgttgggccccacgtccctccttttcttttttttttctttttgactcgcatcacataaaactcaaattaataaataataattattaatctatctatcttctattatatactaaaagtccattagactttctagaaacgctctcataccaccatgtggcactctacaaacactccaatgccgccacgtggcgctctaataaatttagaattctaaaataaatctaaccgttagtattcatttaatctggtgaacccattattttttaccattggatctataataaaaataaccaatccgatttatcttaaaaggccataaaccgtcgtgtggcatctacaaacgctcctaagccgccacgtggcactctaataaatttaaaaaaaaatactataaatccggagaaaagaacatctaactatccactttcacttaaattgatgggcccattattattttaaccgtcagatttaatctcatacaaacagagagatggaaagaaagaccacgtaccttccccacctctcccctcagtcgttgcatttgccctctccccccgtacacccctctctctccctcccctctacgtataattcttttttcctatattagctaacggcggaaattcgattgaaaaatttcaacatttgtaacatctaaatcatatatcctgaaaaataaacatctaccctttaatttttattaaaattagtggacataacacttcaagccattaaatcagatttatgttttctcatccttaaaaaaaaaacgtacatcctcctctctgttttcttttaggaaatcctctatttttttccctcacattctctctttatgaaagcttttgcaacaataaattttaaataagcatacttctaaatacataatatttgcaacagtaaattttaaattatactaactttttaacttttaaattataagttcaatttttttatctatttgtaccattgtgttatttatgattaaaatcacaattagaatttatgacacatgttgactatattttaaattgtaaaattatattcatttaagttttgttgagaacctttacatgttattcaaacatatatgaacaattattaaaagaaagtgacattatatactatttcatcatatatcacttcaccagcatgcataactaaaacagatttatgaacttcaaaaagttctaaaaattctgaattatgagaaaaacaaaatatagattataccataatttgatgcatcacaaaacatgcataactaaataagatttacttaaaaaataatgagtcatatcctagctgtttgtccacctatatatcattcagagcttaagatagaaatgacctattatgtaccaaattctacttgataaggccatagaaattatatggaagtaaagataaagctaaattttatttctatataacatgataatatgttcagttttagaacaagcaagcaaaagctgcatgtgtattgtcctgtgtatctatctattatatatgaaaaatccattaaacttcctaaaaaaaactctcaagccgccacgtggcattctaataaattagagaaaaccttacaaattttgagaaaaaagaaaaacatacagccctcgatttttatttaattcggcggacccactatttttaaaccattagatttatttaaaatacatctcaaataataatatatatgcgtacttccgtactatactactcacggcaaaaaaaagaaaaaaacgtaattaccattgtaagaagaaggattaaccctgccacagtcccacctaattggtacgagagaaatgtatatacgtactgttcacctaaaaaacccaaaaaactataaaaaagttctcacatgtacaatacgtactactatccaccggattgagaacaaaaaaaatatcctgggcatgtacatactacgcaccgtcaacccgtccctaataaagttatcaataatgttggatattttcttgagaaacaaagtacaaatgtgggcgctcacaacgcacgtacacttacccctacgaacacacacacgcacactctacccctatgagtacctctgagagattgggccgatatattttgagatcgacaaagtcaccataaatgcctcgctgtcgatggatacgtcgtctgaaagaatttgtcaagtccgggacttgaatatgagtaggaaatttccaccacaaggaacctaaccagttgaactatgttcaattcaaaataatgttggatattaaaacaaccatttaaaccagtgaaaccattatttttaatcgttagatctatcttatataagaaaaacaatcgtttattcatggtacatcacatttcaaaaatattattgtgcaattatattcacgttaggttgcgtagaacctcttacccactctacatgaaatgtttatagatggattgtctctcaaactatatcaatcatattatgctatataaaatttagtggagtttcatgtgccaccaaattcatcctctaataaaccatgataatatatatgcaataaaagaatgaaaaacacactacttttgctttacacttacttttactttcgttgaaatattttctaaagaaaataagtctacctttttttcaaatgacgaagaagattagaaataattgcttatagatattacttaaatatgatataatataaagctaataggttaaaaattataaaaccaactaatgttaaaaaaaattacggagaaatcggggtagatgttctctggttaatatatcgcttttagtgtctcaaacttagtgtacgacacatgcccgcgcatagtttctcaaaaatgtcaaaaaaaaaaaaagaagaaaaagacgattgactgaccagtgcctgactgcctgtagtttgtatttaagtgatcttattttattattactctctcagtccctaaatatttgatgtcgttgacttttttaagcatgcttgaccgttcgtcttattcaaaaacttttatgaaatatataaaactatatgcatacataaaagtatatttaacaatgaatcaaatgatatgaaaaaaattaataattatttaaattttttgaataagacaaacggtcaaacatgtttgaaaaagttaacggcgtcaaatatttaagtacggaaaaagtatatcacattatcacatatcatcgtcggtaagggactgtttagatccatttggaatggcaaatggcaaatggtaaaagttttggtggcaaaagttttgacattgcaaaagtactagttggtgtttagatgcatgttaaatttttgtcattctaacactaaagtgtgagagagaaagagagatggagtggtcccaaagcactttttggcacaatttgctactatggcgtagcaaatgccaaatgccaaattgtcaacttttgctactagtgtttagatccaaaatgacaaaaagtgctacaaaatggtaaaacttttaccattttggaggatctaaacagggcctaatataattgtacaaaatgaaaatctcatccgtgacggagaggaaattggaccaagcagacgcggcaggggcgcaagacagaatacgagtcaagcaggcaggagccatatatcatttggtgcacccaaacgagagcccgtggtcgtctactcgtccatgagattgcgtcaaaccgacctattcggtggttgcgtcacccgttcgatgacttcaatctacccgtatccgatgggctacgcaattagccgatctgatacggccgatttttgttgataaaattttggactttgttagggattcctgtgcccgataattttctctatgtacaattgcttatttgatgaagcataactatcaattttattttcatttttagtttgtttatttgaccctatattttaaaatcgaagttttcgtctgaccctgttttcactccactattagatcctccattagatcgtctgaccctaagacatcatttagaaaaagtaaaaaaaaatcactaccctgatgtgactaaaatactccattactagtcaaccctatccccgtcccaacccccacggcccacctcatacattcccgactcccatcgctggcggcggaggttagccagggtcgagggagtggtggcagtggccgtgtgccgagggagggagaggtggtggcgacgacggtgtgtggaggaagggagtggtggcatcggcgcgcatagggacggagcggcgacggcggttgctgcgttcggagaggaggaagggagcggcgtcagctgctatcgtgctcagagcggatggagggagcgacggctgctgctgcgctcggagcagaggaagggagcggcatcggcggctgttgctgcgcttgactgcatcacggcggcgctgggtcgcatcctgacccatcattgatatcatctctttgaccgctaccgtgtttttgtttcattgtatgtaatttgggatggacaaaataggacaaacgctatgtcaattctttaaaaattaagtcaaatttgtcaaaatgaagctaattaaattatgaaaatgaagccaaatctataaaatctatatcaaattctttacaaatattttaaaggtccaaacaaacaaaatgttttcatacaatagggtgaaataagcaaggacagaaaaaacaaatcattactcagttaacatcgttatcttacctagacggaataaagtcaacctttatcttcaattttaaaaaacagggttaaatgagtaaacctgaaaaaaatgatcacattagtagttaaattttagaacatgatcaaataagcatgcaattaccccttttctctatgtatagttcgaatttagatttgcatttgttttgaagagatttatatcactataaactatcttctcaggtttttataaattatttggagaacaatcatgaacgtgtaaaaaatgctttatgctggaggtctagttttgtccacatatatgcgactatgcaagaggattgaccggttgagaagagtaacaacaaaataaggttcagagatggagggggataatatatgtaggtatctgaaggatgttattatctagctgatcagctcagtgattactcagtagcagcgaggcagtgacttgacagagttctgaaagtaggtctataggtgtaacagagagtatacaaatatacaatacgccaagctagctagagatgatggcatgatgcagctactcttcttctccttcctctttttgctgctagctcgtgaaacctccgccgtcgccgccgatgggtgtagccgccggtgcggcggcttggtcgtcccctaccctttcggcttctccggcagctgccccatcatgctgtcctgcaacgtcgacggcggcagcaactccaccgcggcgctgatcctccaaggcaacgacgctacgacgacggatcgatcgtacaccgtcgtcgacggctcgttcaactcgaccgcctccaccttcaccgtctccgtcccgccgtcgtgcaaccgcaccgtctccgacgccaggcggtggctctccggcgccaactacggcgtgtcgtcgcgcaccggcctgttcctccgcggctgccggaacgcgacgagcagcgactgcagcgtccccgtcgaaaccatgcttcgcacgacgaggtgcagcggtggaggaggcaacgaaaccgcgtcctcctccctgacgtgcatcgcctcgctctcgccggcgacgccggcggagaggggtttgggcggcctgttcgcgcagtgggagaaggtggaggagcctaggtgcgagaacctgctcacatccgtgtatggcgatacacgggaaggggtgttctcgctggagttcgcggcggcggagatggggtggtgggtcaacgggagctgcggcggcggcgtcgacgacctcgggcggtgcgcggcgaacgccacgtgcatccctatgcagaccccgagcggcaactggggccaccggtgcgagtgcctgccatggatggccggcgacgggttcgccgccggcgagggatgctatgctggtatcaattgtgaatttttaatctctccaattcttttattttccctttaaaatgttcgatacaaaaaggtcaagattgagacatcaaggtgcgtacgaccacgtagactagcatagtcacccaacttccatttagtgaataagaactttgattgaaattgcgctgcaaaacttgcttgaatttactagtttgttaggaatcagttcatgataaaaagttactttacatttaggagaaaattctttttcaacttcagtccaccatgtgcagttatcccttgcatattatgtaaaggggctagctatatttaagacaccatattccatgtattctaataaaaactagtgaaaatgtcttcacattataaattaaactatgtttataatatagctatctataaatttttaaacttataatataattatgctgtaaatttcaataattacactataatgtttctcctttttcgagaaacacggtacaaaagcgggcgttcacaaacgcgcgcacactcatccctatgaatacacacatacctacactaaaagaaaatagccgtaaatacgagcaactgtgctaagtctagaacttgatttcaggtgagttggttccaccacaagaaacctaaccaatttagctatactcacttcacacattataatatttatatatacaccttgtaagaaaaatataataaagagtaaattacactagcggtccttaaacttgtaacgaggtttcatttaggtccatgaacttgcaaaacgcacatcgagatccttaaacttggtttaatacatcatcccggtctaaagtctcgttttaccgtggttttgcttacgtggcatgcactggatgatggcacgtatcatcccggtctgacgaggcaatcggtgagcttcttggcgccgtcgacctccacggcgaggagaccctgcaggaagccgcacgcgccgacggccaccatctgcttccggcaccgccgagacggcgagcagcacgaacactgggaaccgctcgtcgacgctgccgcggagggtgctcgggttcgcctggctgaactgcacggcgtggcgcggcgacggcgatgggaaatggtgcggcgccgcgacgccgtaggagtccacgccctgctcacggtggccgtgctgctcggcggctgcgtactgctgccggccgtcgaatccaaactgccgctgcagacatctcagaccattagcatctagcatctcgacgggaagaacacgatggcagggacggggaggtcggaagcgaggcgaacctgcttcatggtggaggcggcggcggcgccgtcgaaggcgtcaccgggcgagacaggcgcggcggtgggcggaaccccaagagggagaagcggtcgaacaccgccgcctccttggaatcctcctccctcgccgccgccaacgacgacgatgacctgaaggacatgaacgcttaccttggacgccggaaactgccactgcatcgctgccgacgggcctcctcctcctccgaggtaatctgcatcacgagaaactacgaattcactcacaaatcacgacgcacagaaaaaaaaaacaatctgaaatcgatatcatcccaaatccatagctgcacgcatccatctctgctctggcagataacatgcccaaaatccgagctcgcacacacccccgcatgagagagagagagattaaaaacaccggtaggatctcgcccgagtcgagcatcacggccacggcggacaccgccgccgccgacagcggcgacccgacggagtcaacgagcgcgtccagcgccgtggcgcgggaatccgccgaccaaggcagagtcgcgggatcagcacatccgcccccgccacaaccccttcacccccaccgttccggggcgatacgagcagccgcgcgtcggcggcgagctaggacagctcggcagccgaggacgacaacagcgacacggtgtggagattcccggcgatggacatgagcgcggaggcgagggggcggaggaggagcagcgcggagtggtgggagagcgactgcgagagcaaggtgagcgacgccacgccaggtgaggaaggagagaaaagatggggagaaaaaaaaaagagaaaaagaaaatttagctatattatcgtccacgtagccaaaaccacggtaaaacgagactttggaccggaatgatacattaaaccaagtttaaggatcttgatacacgttttacaagtttatgaacttaagtgaaacctcgttataagtttaaagaccgctagtgtaaattactctataataaatggccagctgtgaaggatgttgactagttagtactccggcctgatatggttagagcaatgacttggactagtgagtcttccatgtgccgagtactacaacaagtttggtgttatagaaatcgctaaaaaattttctataaatctagtttaatttttttttctataaatctagttaaacttaaaagaagtttgacttaaaaaattcaaaactgacttataatatgaaacacaggggtagtgtattatcaattaatacatcagttttgataaccattcagattttcaatcgctcgaattatttaatatatcattgaaaaaaataaatctgttcaatgcaaaaagggacaagactgagacattgctaacgactacgtagtcttttccacagccgcctaccttgctccaatatataagaacttgaaatataaaagcaagatttgtatgtgaaatatgattgtttgtactttcagataagagaattgctctggtccttctttttgtaccgcaaggtactagtaccgcgaggtactgaaatcccaaccgttgatgatgacagatcgaatggtcaggattagttggtacctcggggtaccgacttggtcgtggtgtggcctgcgcgattgagcaagggtggaagggtagaatcgtagtttcgcgtttggaatgaagtttggatcggtggatggtttggggaagtgcggcatatccttccagactagcatatccttcctgactagcaaaaccctaccctttcacccgatctgaacggcgcggcggcggcggccacgctgaaggcacggcggcgacggccacgctgaaggcacgacggcgacggtggcccctgcacgccggcggtgccggcggcgacggcggcccctgcacggcggcgacgacggcggcccctgcgcggcattcgagaagctttggcttgcgctggaccatgctagcacaacaaatccaaccaggcggcagtacgaatggtccagatagagcgaaagttgaggaagacaaaatgaaacttgaatttgaaatggccgccaagattttggcttgtaaagcaacatataagaaaaaaattacaaagctaaacaaagaggcagaccatgttaaaagttggttcatgggttccctacttgttattgcaattcttatgtacaagatcttggagtatatgtacgaactgtattgttatgaatgcaattttttttttctgaaatctcaaataaattagaaccatccggctgtcagtctcaagcatatcaagcaatattggctcaatgttaccaaatttgctagcacaacttcatactcacatacagtaaacaattcagcgcaccaaattgcaatacatcaaacatatcttcatttccagaacgcaccagcaccaaaacacataattttcagattcgcatacaccatgttcacatacagttaaacacatcaaaattcaaccatgcgagcacaactcaaaatagcagtacatccatcatactacaggaaagcacatcaaagattcattacagtccaatgtattcattacgaccaagagaatgacaaaactatgtaaagtgcatagcaaagggctgcttctacttcttatccatctcacacatcttcttctactttcctgaaattgtaggaatgacaaaacaactttgagacatgattgcaaaatgtaatagcctataacttgaagccgtcatcctcagtcttgaatctcatagcagtaatcgtacgatactcctcttcctcctcaagggtcctgaaattgtcagccatatcttcactcataaagagtttgcctataaagaaaatttcacaattcattctcagtactcaaatctggtcaaacaaaaatcggcacaattaaatcacaaccgtctacctctacgacagcgatgaaatcacaggagtcggcggcaggggcaacaagcacctgcaacggcggcgacgactccagcagcggccgcgacgggcgcggggggcggcgttggtgacgtgtccccacggcggcaggggcgacgtgctcctgcggcagcggttgactcctgcggcggcggcgacgactccagcggcggccgcggagggcggcgttggcgacgtgcccctactacggcggcggcgacgtccaccggcagtagcccgtgcacctgccgcggcggcacttccggtcaagcgggtgggtagcccttgctgcctgcttggtcgtggcctcgtgggatgggatggctatggcgcttcaggatgaggtcgcccaaaacctgagatggatagcgcacgcgatacagcctcatgcccatcgtacccctttagcaatggacggccggataaaaactggtacctcatggtaccagtaccgtgtggtaccgaaaggaggacgggagaaaatctcttcagataaacttgcgggggagatttatttttacaactggagtgcccatttccttctcatttctcaaacagtcaaatatcaatcaaatagttatatttttttttaaaaatgataatattgatacaacatgtatgcacaatcttgcacaattatatttcaggtcgacataagagatctacaaagcaaaaaaaattaaattcgatcattaatactattctctctatttcaaattacttgttgttctatatggtccaaagtcaaatattttaatctcaatcatcaacttttataaactcatagtaatatcataagatctatttttttagttatatcatgataaatactttcataatatataatattcacatgttattaaaccatacgattttttagaaattaatagttgagatagacatatttgacttaaaataaatataaaacaacaaataatttgaaatggaggaaatactaatattgtttaaagccaaatttgttttttttgaaatgaactgtacgatacagtgcgaggttgcacgtactatatgagtttagttcggtatgttcatgtagcgatatataggaaactattctaactatttagataacatgtaaggatgaacgccttcatatttaagttgtaaatagactaattcgtgcgcctttttgtttttttattgcaaaagtgtactattttctagaagtggattttttcccttgaggggacatcccctcgttttatacgtgtcgttcaaaaagttataaaaaattaaaaaaaattatcaagatagatcaatatatcttttctcaaacatgcgagctaaaaatcgatttatacaattcaaaacaaaaataaaaaatttgtcattttttttctacttgtataagttgaatttgaatttgtgtatttgtgaagtgacatatcacatatttatctgtcctacttttttttttcaattttttgatgattttttaagtaacatgtaaaaataaaggaatatcccttatgatttgagttttccctctcttctctcacgatcgactgtctcttcttcctcaatttccaatgcaggaaaacgtcgtcgaatgcgggtagtagagtttgccaccgccggttcggtggcgttcttgctctgcctcgctctctctgtttggtgcctcttacgccgccgacaatggcggcggaataatgccaagctcacggtgaagatggcgcggaaacatct

SEQ ID NO: 62329 - DNA, 4630 bp, Oryza sativa
ttctgtcatcaagtgccgcgcctaggatccttttacttgcagttgagtcactgatatatgggtcatagtaaagtgaaaccaacatgtcagtgactcagctacacgtacagttaagtcagaggatccgcttccaccgcgcctatatgcgcggcaaggccagctagattcgcatcttttcccgctcgccttcatcgaaccacccttcgtcgagcaccttgcgtgcatgcccatcgagctcgccatcgccatctgcctcgcccttcacctcgttcgccgacgagcacctcccgcctgtgcatgccatccccttgccgtgctcgccttcctctcgccctggagacctagcgcctagagtgccgagaccgccggccgaacacttggcgtgcgtacgcggcaactcatccagctgctgggcatggatcagccgctgactgggttcctatgccacgcgcgcgcgtcaaagccattgcttgcaagcaggcaacaacctcatctagttcgtcacatgctgagtcacgcacgcacgcacgctacactacgacagatccgggcgccactcgtggtgtattacctacgtgttcaggtattattcatacttcaatgcatcgagagaagcacaagaaccagaaggtcgtccaagtgcacgaggaaacacagagaagaaatcatgcatgtatgaccagagaaagtattctaaactattaaaagacctcgttcggttaatctctcccataaagaaatcgcggtggattcagagaagatttattctacatctattgtagtactgtgtaatataattattctctctcaatcccttccaatctctctctttgggattaaattaacatgctttaaaagggaatgtcctctcgtgtgctgcatattaccttaaaaaatgtttgtaagatagattaatatgtgatatatcattttataagcatacaagtttaaatatgtcttctacaagttataataaaaaaaatataactgtatatacgcatacaagtcaaaatttaatttaattttttacaacttgtagaagttgtatttgaatatgtttgtggagcgatataccatattttaaaatatatcttgctattttttcagttcttttacatctatttaaatggtaaaagggggcattcctattagaatcttttctgttcattagctggtcgatcgtagtgataatagagaggggggggggaactattttttgtccattaggggatattcttttgcatgccacttaagtatctattaaaaagtttgaaaaatatgggtatgataaatcaatataaaacatgtcatttcacaaacataaaacatactattcgctgtgaaatttgttatgttttctattcgtataaagtttaaatttgtatatttgtgaaataatatatcctactttgcataggttcaatacgtaagaattcacatttggccagtaaacccaagcatgtgcatgcatgcatgtccaagagggaaaaaaaattggtccaacacatgtgagtagctagaaacggcccaagtacgcgtaagagtagaattgtccccgcttaaaagagacgaactgcatatgcgtacgtccagtcatccacacaaactcaaatttgccatcaattctttcataagtctctgttataaaaccagccctaaaatcgacatcggtagctaaacgcgaagaaaacatcacaggagatccacacaaactctaacagtctccatccctaattcgtcatcgaaaaagccttcctgttcctaggaactagtggcgtcgctggctggccatggcctcggaccttgtcatcttcctcctcttcctcgccgtcgtcgtcggctcgctatgcgagacggcaatcggtcatcacaacctgaacctcccgtatcagccgtcgtgctcgaccaccggcaactacaccggcgacagccagtacaagaagaacctcgaccagctgttcaccagcctctccggcggcgccatcgccggggactggttcaacaccagctcggtcgggacgggcgccgaccaggtgttcggcctcatcatgtgctacgccgacagcaacgcgacggagtgccagaaatgcctcgccatggcgcccgctgtggtccagcatccgtgccgcggaagccggtcggtgaacgccaactacgacgcctgcctcctccgctactccgacgagcccttcttctccgagctcaccacctatggcggcaacaccaacgtttccttggacgtcgacgacacgaacctctacgtcgagaatatgaccgccatgaacgacacgcggtggcagctgatgagccagctcgccgagagggccggcgacaccaagctcaggctggacaacggcagcttgccgtacgtcgactcgaagctcggcacgtcggcgttgtacgggctggcgcagtgcacgagggacctggcggcgagcgagtgccggaggtgcctgagcggctatgtcaatgacctcagcaacaccttccccaacaacagcggcggcgccattaaggggtacagctgctacctcaggtaccagctttggccgatagacatcacgctgcccccgccgccgtcgccgcctccggcaccgcctgcacctcctcctccctcggtgtcgataggactcgtggccggattgaccgtcggcgccgtctcgttcgtggtggttcttggtgtctcaatctggctcctcttgcaccgccggcggaagcacgccggcctaacgatggagcaggagatggacgagggtgacttcttcgacgatgaggccggtgactttgagaaggggactggacccaaacggttccgctacggcgagctcgccatcgccaccgacgacttctccgacgagcacaagctcggggaaggcgggttcgggtcagtttacagagggttcttgaaagaattgaaccttgacgtcgccattaaaagagtgtccaagagctcgaagcaggggaggaaggagtacgcgtcggaggtgcggatcatcagccgcctccgccaccgcaacctggtgcagctcatcggctggtgccacggcggcggcgagctcctcctcgtctacgagctcatgcccaacgccagcctcgacacccacctatacagcgccaacgccggcgcgctcccatggccactcaggcacgagatcgtgctcgggatcggctcggcgctgctgtacctgcacgaggggtgggagcagtgtgtggtgcaccgcgacatcaagccgagcaacatcatgcttgacgccgccttcaacgccaagcttggcgacttcggcctcgcgaggctcgtcgaccatggccggggctcccacaccacggtgatcgccggcacgatggggtacatggatccggagtgcatgatcaccggtagggccaacactgagtccgacatatacagcttcggtatcgtcctcctcgagattgcctgcggccgaccgccggtaatggcaccggaacaccaagctgagaaaggacaagacatgatccaccttgttcaatgggtctgggatctgtacggcaaggggagaattcttgacgccgccgatcaccggctcgatggcgagttcaacggcgggagatggagcgtgtcatgatcgtcgggctctggtgcgcgcaccctgacaggagcgtgaggccggtgatcaggcaggccgtcagcgtactgcgaggtgaggcgccgccgcgagccctcccggcgagaatgccggtggcgacgttcctgccaccgattgatgctttcggctacacatcttcggttgtaacagggagcagcaccagcagcggcaacataggcgttcctaacactcagacatcgtccttgctaagatgacatatttgacatctcagcaatgcattttgtgtataagatcaactgcacattggattaatttttttattaatttttttagtgtatctttggttgaatgtggcccgttgaagatatgggatctaagggtgaaaattcgttgctactacacctctatactaggtgtagtagctagtgtagtagaagggtagttatgaaaagaattaatatttcttgtataattattaattttttttcctatcatttgattcagtgttaaatatacctactatattattaaaggaatagaaaaaggagcctccacgttcgctctcatggcctagaaattctcacattaatcggagaaaaagaaaaagcagagtccatatagaaatacaatttagaaatagctgaaattcgaaattaaaaaaataaggaatattagaagaggagactagagtccatatagaaatacaatttagaaatagttgaaattcggaattaaaaataaagaatattagaagaggatactggagtccatatagaaatacaattaggaaataactgaaattcggaattaaaaataaggaatattagaagtagagtatagggtccatatagaaatacaattaggaaacaactgaaattcggaattaaaaataagaaatattagaagtagagtatagagtccatatagaaataaaattaggaaacaactgaaattcagaattaaaaataaggaatattagaagtagagtatagagtccatatagaaatacatgaaataatataaatttggaattaaaaataagaaat

SEQ ID NO: 62330 - DNA, 8748 bp, Oryza sativa
  unsure (1)..(8748): unsure at all n locations
caaatccgcccgttgaacgcgagaaaaaaagggaaaaatgggggaaagggagagggaatcacggggagtgatttccctcctcttactgcacgcgggggcggcgggatgcggcggaatccgcggcggcggcggcgctagggcacgggcgaggcggcgggagcggcgcgaggtaggggatgacgggtgggccccacccgtcagcgagggtggcgggcgggcccgcccgtcagcggcgcgcgcgcgggggaaggccggatgggccgcgggggagaggagagagagggagagggagggggggaaaaagggactttttagggtttttctttttataaactcattttaactttgtttatttcttcttaattattatttgtgctctgaaaattccactaaaatttatttacgcattttaggcttttaggaaatatacaaaaatcctccaagccttattcgacttttaactttgcacattttaattgttggaggctttcacatggatttttacttattctatgcataatttcgaggatgtattttagagtcgttttgggacgcgacaaacctaccccccttaaacggaatctcgaccccgagattcggaagaactggcgaagagatcgggatgggccgccttcagctcgtcttcacgctcccaggtagcttcttcctcggcgtggttgctccattggaccttgcaaaaacggattacccggttcctggtcctgcgctccatggtgtccaggattttcactggcctctccacgtaggtcaagtcttcgcgaacttcaatttgcgctgagtcggcctgctcggatggcactcggagacatttcttgagttgcgacacatggaacacatcatgcacgttgcccaaggaggcgggcagctccaactggtaagcgacttctccgcgccgagcaatgatacggaaaggacccacataccgaggtgcgagcttcccttttgtctgaaacctgtgtacacctcgcaatggcgtgacccgaagatacacaaagtcacccactgcgaattccaggtcacggcgacggttatctgcataacttttctgccgggactgtgccacttttagattatcccgaatggttctgactttagcttcagcttccctcaggatatcagtcccgaacacttggctttccccaacttggtcccacaatagcggtgtccggcatttgcgcccgtacaacgcttcataaggtgccatttgtatactggcctggtagctgttattgtaggagaactcggcataggggagactcttatcccaggtcttcccaaaatctaggacacatgcgcgaagcatatcttctaggatctgatttacccagctcttcttggagcttcttccaaaagtgagaggtgaattggcttcccctatcagatacgattttcttgggaacgccatgaagactcacgatcctagcgaagtagagttcggctagtttgttccctccataggtggtcttcacaggaataaatcgagctaccttggttaatcgatccacaactacccatatagaatcatatccaccttgggtttttggaagtccggtgatgaaatccatcccaatttcatcccatttccattctggtacttggagaggttggagaagtccggccggtcgctggtgctctgccttgacacgctggcacacatcacaaagggccacgaactctgcaatttcccgcttcatactaacccaccagtatttctccttcaagtctaagtacatcttcgtactgccagggtggatggaataaggactttcgtgagcttcctgaagtatcagctgtttaagttctctgttatttggaacgcatacccgatttccattccatagggtcccgtgttcatcctctgtgaaaccagcggctttaccctgtttcatattcttgaggagtccatgcatgtccgggtcgttcttctgagcctcgcggatttgatcgagcaaggtaggtttggcttccaacgcagccaagaatccacgactaactatgccaaggttcagggcttccatctgttgattaagttcgggtggaatgccacggacgttaagagtgttgcaatggctttttcgactcagagcgtcggcgaccacgttggccttaccaggatgatagtgaattcccacatcataatccttgatgagttctaaccatctcctctgccgaagattcagatccgactgggtgaagatgtatttcaaactcttatgatcggtatatatttcacagcgattcccaataagatagtgccgccagatttttagagcatgaaccaccgcggctaactccaaatcatgggtagggtagttgccttcatgaggtcgtagctggcgtgaggcataggccaccacatgaccgtcctgcatgagcacgcaccccaatccttggcgcgaagcgtcacaatacaccatgaaatccttgcgagtatctggcaagactaacactggcgaggaaaccagcttttctttgagagtttgaaacgccttctcgcattgcgggctccacacaaatttctcttctttcttcaacaactgtgtcatgggtcgagcgattttggagaagttctcgatgaacctccggtagtatcctgccaaacctaagaaactgcggacttgagtgacggtcttgggttgcttccaatcagtgacggcggtcactgtttcggggtccacagcaactcctttagcagatatcacgtgccctaagaatttgacttcggacaaccagaactcacacttgctaagtttggcatacaattgatgttcccgcaactttcccaacaccagacggagatggtgctgatggtcttcctctgattgtgagtatatcagaatgtcgtcaatgaaaaccacaacaaacttatccaagtattccatgaacactttgttcattaagttcatgaagaaggcaggtgcattggttaaaccgaacgacatcaccgtgaattcatacagtccgtatcgcgtggtgaatgcggtcttcggaatatcttcttcgcggatgcgcaactggtgatatccggaacgaagatcaatcttggagaataccgtggcacctttaagctgatcgaacaggtcatcgatccggggaagagggtacttgtttttgatggtgacttcattgagggctctgtagtcgacgcacctcctcttcgtcttgtccttcttctccacaaaaatcacaggagcgccccagggggaagtactcggacgtatataccccttctctttcaactcttccaactgtttcttaacttcggccagttcatttgctgccatacggtagggtcgcttgtacagaggagtggttcctggagcaagatctatccggaactcaatctctcgcttgggcggcataccgggtagttcttccggaaacacatctccgaactctctgacgatggggatttctgacagtcctatctgatgaagttctgaactactgacagaggttgggggtgcaaagaaaacaaccggttgttccggtcctcggtacagagtaacagtgcgtctcgcgcaatccactactccttgaaattgagccaaccaattcattccaaggatcacatccaagttcttggtgtctagcagaatcaggtccgagggaaaaggaatcccctgaatttctatagggacggcaggactataatactttgctgtcataacccctccaggggtggtgatgagcagagggtttctaagcctttctacccccaactgatttctccccacgaatggcacagatataaacgagtgggaagctccagagtcgaacaaaatggtagcagggatggaatgaatgaggaacgtaccaacgatgacgtctggagttgtcagcacgtcctcggccgtcacgtggttcacacgaccctgaatgacatccttcccaccgttgttggagcggggaggcgcttggccttgctggcgcctcggtttcgggcatttatccgcaaagtgcccgggctcgaagcagttgaagcacagacgctgctgaccttgagcgtccctgcagccttgaccagactgcacggctggcgtaggaggacggggcgcacgagtcccttgctgactctgctgctgctgcggctgtgggacgcgcaccacgtattgaggtcgaggcacggagcgaggttgctgctgctgttgttgctgctgcgaggaggatccccctggatagggattggtgtagcggaccctttggttagcaccctgttgattgcggaaattcgccaagcggcgcttgtgcgactccagttccttgtgcttggcttccaagcggatgctcttgtccaccagacgttggaaatccggatagtccccggagactagacggacggacagctcagggtccattcctgccaagaacttctcttgcttctcctcatcttcccgcacatcctccggggcgtaacgggccaggttgttgaactcatgcaaatactccatcacggagcggttgccttgcttcaactctcagaattccctttttttaagagccacgactccggcgggcacatgggttctccggaaagcggcggtgaaacgggcccaagtaataggctgcccctctggctgcgtagcctggaaatggtcccaccatagagatgcgggcccctgcagttggtgggcggcgaagatgactttctcctcatcgctgcactgcacagtgtctagctttttccccacggcatgcaaccaatccaacgcatccacggggttgttggagctagagaaggtgggtgggcggatgcggaggaactcggcgagtttagagtgttgcgggggtggtggtggagcattctgttgtggcggattttggaggtggtggaggaaagcagtcatcatgttggcctgctgggcgaggatttgggtgagaatggcgttggtatctggtggtggtggtggaggcggaggaggaggtggaggtgggctgccatggtggttgcggttgctgccttcaggttggttgccatcaccggcattagcacttctcctggtcgtcaccatctgaaaaccccacacagaaccagcaaacagagagagctgacaattaaggctaaccatccacgactaccataattcttaaatttattactgctattaaattggttcattaaagttcaagttgcttaggcaaataaaataaagacaggctccgacacagttatgccacacaccggcctaaccatgccccacacaactccaacaagaagacaaacgaggaagaacacacgcgcaagcctactaactgctcgtctaccactgcgacgggccagggcggaaggtgagcaacagcgcatcctccgtgctaccaacgccggaggcttccccctcctggggaaccacaggcgcgggctcggcacgaggggtctccacgaagcaggtccacgccagggactgacgaacaagctcgggcctggaggtgctcttgcgggcggtgatcttctggctgcggcagacacggcgacgcttggggcggcagacctctccctgggcgatcttgagctgatgcagctgcgcctccaccgcgtctaggtccttcttgagctgcaggttctcctgacgcagctccaggatcttcaggttgttctcgaccatcccacggcgcaccatctgatggaagtcgatacgagccgcgtcgtacgcctccaccatgcgcgccaggtgcacgatggtagcgtcgtcctccgagctagcatcccggaaggtggcgtagtcgcgggctcctccgcggtgagggtggtagcggtagggcgagtgctgcaactcgtccgggtagcgctggtgaagagtgccgatggcgaggagagcggcgttctggcaagcggcggggaaagaatctccacccgcggtgactgccagcgaagtccgctcgggagagccagcgaggatcactgcagtgacctcccaagcagcgtggggctctgcatcgtcaccctcctgcttcggaagcggcctggcctggtagtccactccatgcggataccccaggaccacgcacatgccccgcagctccaagacgaagccagtcatgtccaaaccacgacgggtgacgctgccggccatctacaaacaaaaacaaaaagaaaaacaacattttaaagatcatattttggcgataaatgaagcagcaagacagagagagactagacagttttcacaaataacaaaggatttttatttcgaaaatactgctaaggcttgggatctaaggctcgtcctagggtcaagggggctctgataccaacttgtcacgaccggaaataacccaacgggcgttccttacgtgcgtgcattaatccttgtcccaggaggcaaggtacaccaacagttgatacaaatcagagtttaacaagcggaagcgtaaatagttaattattacatgggcagcgacggcccagcacactcaaagacaacgaaaaacagcggaagactagggcgacgaccacaggcgcttgacggcaggcacgagctagacaccaaaacctccatcttccaggaactcttcttctgggcttgggaaaaaattgagcaagactgagtacaaccaccgtactcaacaagacacacccacaaatgcagaataaatgcaagggagtacaaaggagttatactataaagggttagggtttgcagtaaacagcatttaaagatatttagttgctcagagctattttgtaaacacgattctagaactgtacaatattatttatcaaggccgtgaacccacacgaacctgccttaacccaaggcctacgatgattcagaccgaactggcaacccgaccctgggtcccagctcgtcccaagccaacccaggccaaccaatccacattttagctgttaagcaggttttaagaattaaaacactaacttgggtacattgctcggctcgcccataaccgagggcgcggctattcgaatagattatactctgatcagaggtgtacaactttacccacaagacacatcttcctcacgtgcaaccacgtgccacatacaaccacggtatacagacggaagacatgacatagtttccaacccatcctagccatagacaagagtaccgacccaatccctcctacggccggaacccccgggacaggtaggcaggactgagcccctagcagcaggacaccggccctgtgccatgacatctcgactaccgggccgcagctcgtgtagccttcatttgccctggagatgtccatcgacccccgacttcgtccatctccatccgtgtacttttgtttataaccagactgagccacaaactaagccttacccactagacatgtggaagtacggtagtgctttgcaacagaggcccgaagaccggtccttatatggccgaggtgctactatcaaaaccatgcaccccgagcccagcctaaaaccattttggggattttgaatagaaggagcggtgtgaagccaattccacaataatccaacaaattccatagtgtccgggtgatatgaagattcccacagtctagagttggaaaaccacctaatgttacctaattaaatagcgaagcatctacctaaaattatactagtggtactatgagtagagtgtccactagttggggttttgtttattctagggtgaacaaggtaataataacaataacaataataataaggtcataacaaaggtaaataggcgtggctaaataaaacagtgataacgcgggaatttaaataaagcgataatgcagtaatttaaatcaacataattttacaaactgggattcaatatattcaaagatgatgtgacttgccttgctcgctttcccaaacgtcggcttcaacttccacgaagagcggatcttccgaagctgcagcgtctacacgaccaacgaaaaagaaaaggcttttactctaataaactccatataacaagcagaagcaaagcacaaaaatgggttcttgacttcttaaggaaaaattagagacttgaacggtccaattccgagttcaaatggccaagttatggccatttgaagtttatatgctctttaattgaatatttgcgaatttcttcatttaaattttaatttaaaatcggatttattgcgtcagccgaggggaggggcgcgcggaccgggtccacgggagtggggcccacgcggcagcctcacggtccacggtggaacgggtgcacgcggcttacgccggccggcgccgtgggtcccacgcgtcagccgtacccgaggcgcgggcggctgacggccgggccccacatggcagccgcggggcgcgcccgaaggcggcctcgccggcacagccgacgggaggcggcgcgcccgcgcccctttggtcgccggcggcggccataggcacggcggagcggcggccgagagaggggagggaagggggaaacgaaatgggcggtccacggctcaccccgggtcgacggcgacgacgggaacggcgaccggagcggaaaaaggcggcggcgcggctcgggtcgacgaggacggcggcgttccggcggtcggcgggcgaaacggaggggtggacgaggtcggcgatgttgcggcgaacccgaagaggcgacgccgaaacgggagaaggtccggggcgacgacggcggcagaccggatctcggcggcggcggcggaaagagagggcgacngcgcaagctctattccgaccgggagagagagcggcgagcggcggaaaccgaagaaggaggcacggggatggtttatata

SEQ ID NO: 62331 - DNA, 5938 bp, Oryza sativa
  unsure (1)..(5938): unsure at all n locations
taataatttgtgttcagaaaataccactaaaatttattaacgcattttagacttataggaaatatacataaatcctccaagccaaattcgacttttaactttgcacattttaatggttggaggctttcacatggatttttacttattctatgcataatttcgaggatgtattttagagttgttttgggacgcgacaggagagccgccgccgccgtcgaccgaactgtgccgccgctcaagctcgccgccggccgccatccgtcgtcatccgtcgcgtttgttagtaccggtgagttcgcaatgttgtcctctacgcgtaggtgccctccaatagtccggccgagcctccaagcgccggcgaggtcatcgcccgtgtcaagccggcgaggattacgtcagcatgacgtcataatcttttccttttagtttttctttattagatgcaaatcaattaaacttcggaaattcataactaattcatcgtaactccgattcgagtggttcaagttgctaaatttttctaaaactgagatctacatgttaaaaatatccacatgtactgtttatgctagtttttgtactgttttgttgattttgttagtttgctttagtttccgacgttccggaggagagcgctttcgttgaagaaggttcggaagtgtttgtggaagctcaaggcaagtcacacagatcccaaacaaccctttgagcatgttgaacccgtttaaagctaatgttttatttcaacttatgcattattttcgaatgtcatcgagtggtgagcctttcctagataattaatggccgaagatgactttattttcctataggttataatttgattagcttggaccttatatattggattggttcagctaaatgctataagtatagttgcttagccatgcttagaaacattagctaattaatgggatggatcatatatactacataattatttatgcttatatttaatggtagctcacgatggttaatcatgtaaagttaattaattgataataaaaacctggttaaaggtgggttgtgagcatatgattttgatggttgtgctcatgacaattaaggaccggttcgcgagctactgttgtgaaacatttaccgtgccaatcacaagccagcgtgggcaatggctttatcttttgtatagcatgattcattatggtgtgccagactgtgaagcggcgagaagtccgtgggggtcgctggggagtccattgcctctggttttgagggggagattatgatccaggaacggtgcactgtggtgagttgtgttgtgcgaggggtaatgtcacagttcctttctgaggtaccgtggtggtgctgaggcgcatggtgacatgtgggattgtgtcttgtgggtacagtggtacacctctgatcagagtaaaactattcgaatagccgcgcccgcggttatgggcgagttgggcaatgtttttcgtgattactctcatgctactcattaatggtaattgtgctaattaatgtgactcctggtttggaatggtatattcctggtatggaggtttgatttgtacaaccggggttggttgttcagatgaggttgggcctatgcaacacgggtgttttgtatggtgtttatttaatactgcttaattattcaactgttttactattctcttaaatatttattaaatgttgtttatgcaaatgagctttattatgacatcctttgttatcctgtgcacttccatgtttgctgtgtggcttgttgagtatgtcatatgcttattcttgtaatattcattcatcagaggaggagtacttcagtgaaggtgatgatctggaggactaggcttgatccgggttaagttgcctgtggagtggagtcgccatagctattccgtagtttgctgttatttttccgctgcgtagaatgttattctttgagaggaactatccacctctgtaataaattattatttgcgaatattaaatagctgtgtgttcgtactctattatcaatttgttattgtgtgcctcggctgattcctggacgagggtttaacacacatgtaagcgtttggaattttggatagaaattccgggcgtgacaccgattgagatggattctataaatattggaaaacatcatatcttcaatcatcaactgttatcgtagcaacttctactttgacatcctttatcatcggcttgtactccgatgctccttgagccgattcattagcttcaacattttgctctcgagacacatgcgtcaaagttaccggccgaaatccatccatcaattctcggcacttctcattgtaaaccattaatgtatcattcttgcactcatattctcctgccaattgactgatcaccagcaaggaatcacccataatttcaacagcatcggcttcaacctctttaagcaattgcaatcctttgagaaccgcttcatactcagcctgattgttggtcgcatagggcttaataacgtaggcaaactcgaaacttgccccccgaggagaaattataaccaagccgataccacaaccatgagtgcatactgatccatcaaaaaacaatgtccaaggcataatttcaactgagccgattgagtcatcacgatgatccacaataaaatcggctatagcctgtcccttaatcgcctttggtgattcataccgaagatcaaattcggttaaagcaaatattcactcaaaccgaaagtcattacaacctactcaaacaagccgattgcacaaggacatctgaaagccgtcttatgaatgtcttcttctgccataaagatctgattgttacctgcattgacatccataaaacataatatcttatgccctgaagcagcatcaaccaattgattggcaaccggcattgggtactcgtcctttggggtagctttgtttagatcccgaaaatcaatgcacaccctgactttgccatttttcttgataactggaactatgttggaaacccactcagcatatcggcatggacgaataaaaccggcatcatacaaacgtttaacctcagccttgacagcttcaagcatatcggatttgcatctcctcggcggttgctagtatggtctaacccccggtttgatagggagccgatgttcaacgattgatcggctgagtcctggcatctcataatattcccaagcaaagcaatctctatattcctttaaaagctctatcaacttggttctaaattccggagataaattcttactgatgaacgtcggccttggtctgtcacctggacctatatcaatttcttccaaatcatcagccgacatgaaaccctgtccttgcttgtcatcgagattatctactgtgtccttggtatagacgtttgatgccctcaaaataataatttgggctctccatcttcaattggttgtatatcacaatcggacacttttagaaaatctccatcccaaacttttccagacaggcaatcaataccatccatctcccaaagagctaaatcggcactggcaacgtgccaaaagcgtgttgatgcaaaaacacgaggcctggaagatctacttaacttcagtgcaggtccaaaaatcttgcctttaggttcgtgagcacaccagttgatttgatcctgcaatcaacaagaaataaagacaaagaaaccacggttaaatccataaatgatagccgatcggccagcagccgatgacatatcatttatctttgagccgatgtcatatgtgaatcgatccgcaatcatgaataaataagaaagacttaaatctactcgatcggctgtagatattaacaatatataatctttatgtcgatatatacttaaatcaagtgattgggatagatcggtcgccatgccgaaacagtataaatcacttagatcgaaatatatactaacaatgagattatagatgctcatagcatagccgatcagatagatctagcatgtatcggctaatactccgataccactctatattaagcaagtaaaatatatcaaacagaagcctaatatacctaaatgcaacaagatcttaacataaagggcagatttagcatatcaatcaagcacatgaaatataaggctaaatcaggtaagatcggctgaaaccccgatgctaccctaatcggcaaccaaaagcaagctagaaattgagattctaatcacgacttataaaatcaaactcaactgatgcagctataagtataaaaagaagaacaatattgccagggattatatagaatatatgataactcaacgaattacataaacaagattagggtatcataaaaatagaagcactaatcccgagaatgcaagccgccataacatgttttacctctagttgaagatcgaaaccgatgcagctcaacccgaaagcaagaactcgtcgaaacaaaaacgaaagtaaaagggtggcgatgacccgagattgtattaaacgtgtgttgttgtattacatgagactcggggtctatttatacccgagattgcaaaatatgtctgtgtcagacacgactcttatctctaataaactctaagataccataagtctttatggcagacttttgcccaaacatatctctaaggaaattacatgaaatatcctaattaatagatacaattgccttctcaggactcaatccatgcgtggcaatcctcatgaagcacattaactcaacccgacaacgtgtaccgcgtcacattgtcgacatcggctcaatcggccaacctagtctgactcaaactctgtcgatcctgatcatagccgattcggacttttagccgattctcgctctgtttccgaaacgatgtttatcttggattccgctttgttttatctccatctccgatacttggattactaaatttggttattaataaccgtaaaaccagcggcgtccttctacgtagctattccatcacctatcaaggtacggtaacgtccacgtcgcagtatgttgctagccacccacgcgtcggtctagggcttttgtctcggggtaggggcagtgtacagtctagtggtttcgtcaccgtgcatgncaactctacccctgccgtctggntacagctatctcctgcatgcaaatatactagaaatgctagtcagctgcgggctcctcgggcctccaagacccgtaggactcccactcggatccctatccgaattaagctcatattggatctccatccaatccccttattctggcccattgagcgtgcgaccctgtaggttcacgtacactcggctgtaaccagaaaactcctttacggtccaaatgtcaacagctgccgcgaccgagaaaattgccttttcccgaatgctagtgtattaatccccgtcccaggaaaagccggggtacaccaaacaaacatgatataaaaggcacatctttattatatcgataatatttacattattacaaaggcacttcaggcctgacaatcaaaaataaacagcagcggactagcgggcctacggctccatcttcacaggcgctcaactggggtataagccaagactccacctaagacatcttctccgaagcttctcttactgaaggggggagaaagatagagcaagaataagtacaaccacagtactcagcaagccacactggcaaatgcatgattaatgcaagggggtacaaggggtaataatatcggggttaagttttgcagtaaacagcatttaaaagtcacttagttgcccaaagccattttataaagacgatcctagagctacacagtattagtaatcaaggccgtgaacccacacgaacctgccttaacccaaggcctacgatgattcagaccgaactggcaacccgaccctgggtcccagctcgtcccaagccaacccaggccaaccattccacattttagttattaagcaggttttaagaatttaaaacactaa

SEQ ID NO: 62332 - DNA, 9417 bp, Oryza sativa
ggtgaagggttatgtcacatgtttacgacgggttccaaggccatggaatgcggagtaaagatgtgtcttgtgggtaaagatgtacacctttgatcagagtaaatctattcgaattgctgagccctcggatatgggcaagcctagcaatgtacccaagttagtggtttaattcttaaaatttgcttaacaactaaaatgtggaaaggttggcctgggttggcttgggacaagctgggacccaggtcgggttgccagttcggtctgaatcatcgtaggccttgggttaaggcaggttcgtgtgggttcacggccttgattaataatattgtgtagctcttggatcgtgtttacaaaatagctttgggcaactaagtgacttttaaatgctgtttactgcaaaacctaacccctattattatccccttgtaccccccttgtattagtcatgcatctgccggtgtggcttgctgagtacggtggttgtactcattcttgctcaatctcccccccccttcagtaagagaagctttggagaagaagtcttaggtggagtcctggcttataccccagttgagcgcctgtgaagatggagccgtaggcccgctagtccgctgctgtttatttttgtttgtcaggcctgaagtgcctttgtaattatatcatgtttgtgtggtgtaccccgtcttttcctcggacggggattaatacactagcgttcgggaaaatgcaaattttctcggttgcgacactccagcaccgaaggctcgtgttaatcatgttgcagcttcagaagcccagaatgcacccgatgtggtcttgggtacgtttcctgttaactctatacccgcatctgtgctttttgattccgatgctacacattcctttttgtctaaaagttttgcaagcaatcatgggatggaagttattagtcttgggagacctttactagttaataccccaggcaaccaagtatcttcaatgcagtactgtccttccgttactatagaaatagaagaaataactttcccatcctcactcatcttgctagaatccaaagatctagatgttatcttagggatggattggttatctcgtcacagaggagttatagattgtgccaaccgtaaggtgactttaaccagtagcaatggggaaacagtgtctttcgttgcgtcatcccctaaatctcatggtttgacattaaatcaagttgctttgcaagagatcccaatagtacaagattatccagatgtgttccctgaggatttgccaggtatgccacctgagagagacagagttccggatagacctagtacctggaaccaaaccctatccataagagaccatacagaatggcagctaatgagttagtagaggtaaagagacaggtggatgatttgcttcagaaaggatacattagacccagtacttcgccgtggggagcaccagtcatctttgtggagaagaaagatcatactcagagaatgtgtgtggattatcgagcgttgaatgaggtcactatcaagaataagtatccgctacccaggattgatgacttgttgtcacgcccagaaattcccaaatagaattccaagcagaatgtgcattaaaatccccgtccaggaacggctggggtacacaaacgacaaagttgacatacagatccacatcttacaaacattataaaaagtcttacataaatgcagcggaaaacttaaaggataactggagctaagccttgacttggtctacagcgggaacaccactccacaggcatcctcgacggcatggacgaagcctactcctcggagaaaccactatctgacgcatactcgaattctggggtttgggggaaaatagagcaagactgagtactacccacagtactcagcaagtcataccggaatatgggtatgatgtagggaaatatcaagggatagctataatggttcatttgcataaagcgagcatttataaacataagttgaaagcagttaaacagttgtaataattaattaatattagctatccactgtccaacgctatcccacgttgcaacaggcccaaccatccacctaaactatccaaattcaaaagattacactagggtgagactaatcacggtgaatctggttgaccgcccataaccgcgggctcggctattcgaatagttttactctgatcagaggtgtacaactgtacccacaagacacagccccacgacacgtttccgtgcgccgacatgccaccacgacataccagaaagagtccgtgacaggacccttcgcataaccccctctagccaagcacaccacacctcaggtttcacccccatccccagcgggcaacgggcagtcccctctcgtgcctaggtgaatccggaagcgacagaggccgtcgcagggcccgccccgctccatcacgcccacccttgcctggatgcgtcgactagaggaaagctacactacaagcccagccgctgcccacgctggcttgtggtaagtacgataagttcttccagggcatcccgtgaaccggtccttaactgccatgggtgcgaccagcaaaaccatgcacccacagcccaccatgtgatttattttaattagccaacaccaaagcggtggaacgaaaccaacaaaaccattagaaccaacagtctaaacattaattggattttccccgctgtgcactagttgaactaagcatggctaagcaacccctagtccaatctctagtcatgttataaccccaagctgacaaagggacatggtataacaatagcatggctatgacaataggtaaacaccccatagtaacattataaatcaatgcgatatttgaagaaaaacaatagagcatttgcaatataggatcaacatgttcaagtgacaagcatgacttgccttgctctgctgctggaggaacctcggcgactatttcgaagtacaccggagcgtcggaagaaccggaatctagcgacatacaaggctaacattgcaaacaggctataagactactgaaacagggaacaaaaccatttttaatggattctacacatttttcttgattcactgagacttgaaagggcttaaacggagcacggatgaattagttatgaattttagaagattcgctgtgtttattactataacaaaaagtccttaaatcatttattgcgcaataaaccccagggctgtcgtcatcaagggggggcgggcgcggcgctggcaagcggggcccacacggcagcggcgcacgggtggtcggtctaccgtggaccgggaccacgcgggtggtccaccgccggtccacgggatcgacggcccggatcggcccggggccgattggacggtgcggcggcggcctggctcggctcggctcggcacaaagccggccggccggccatggcaagggtggcggcacgcgcacgtccaccggcgacggcaagcggcggcgcgggcggcggcagaggacggcgccctggcggcgacggcgaccgaaggcgacggcgagcgcgggtggcggcggcgcacggggaatcggggaaggaaaggaaaggggacggagtcctcaccggaggggacggcgacgaccggcgacgaggagcgacggaggaaggtcgacacgcggcggacggggaccgggacgacctaaggaacgaaaaggaaaagattagagagggagagaggggccatagaaggcgggaacgccggccgaaggcggcggacatggcgactctcaccgtcgcacagtgggaatggggctccggcggctaacctcgacgaaggaggggtggacgaggtggacctcggccacgcaaacccaacggcggtgacggcgcggtgcggcggcgaccctagcggcggctagaggcggccggagtagcgggagaggtggcggcgggtgggtgcacggtgcgggagcgatggagagctcgggagagaccggcggaaaaaggaaaagtgaagaggaggatgcggggatggattttataggggcggagaggtcgggaactgtcacaccctgaagttctcctcctaagcataaaattgaatttataaatcaccctaagaaaataccggtgcaaatcaagagaaaaccttaataaattaatgcaaataataatcggaattggcatgtggaatttttcttgagttctacatgtcgaaataccctaacaagatttttagtggaattttcagagctctcgaaataattttaaccaattaaaattgagcacatgcaattttaaatcccagggaaaatcttttcctccttttctttttcttttccctccttttcctcttcttgggccgtcggcccagtccaccccgccgccgcgcgcgccctcctccttgtgggccggcccaagccgcccctccctctctccccgggacaccgacaggtgggccccacctgtcggggtcgtccccttcctccggccgcccgccccacgtcgccgacaccgccgaaaccgccgccgcgccaacgtccccgcctcctccgggccacgtcggccacgcccgcgcatgcgccgcgcctcccgcacccactcctcctctctcccgctcgcgcccgcgcccgagatggccaggattcgaattccgaatcctgcctctctctccacctccacctccccgcgttggccggcggaatcccgcccctacccgccacgtccgggattcccctcccctatttaagctccaccgccactccctctctctttttccccatctcgccgaactccctcgtgccccccatcgctcctgcgccgtgcttccatccgccgccgccgctcccgctactccggccgccgctagccgccgctagccgccgataggctcgccgccacaccgcgccgtcgccaccgttgggttcgcgtggccaaggtccaccccgtccgcccctcctccatcgaggtccgtcgctgaagcccacatcccctcgcactccggtgagcaccacctctaccgccgccttcggccatggtttccgttcgccgtggtccacccctctccctctaatctctctctttgcctctcttagggcatctcggagctcgtgcgcccaccgccgttgtcctcccgtggctcgccgtcgccgttcgccgtcatcctcctccacgccggccactctcggtgaggcattccccctcctctattcccctccctctccctcctagccgcgccgggtcgagcccccgccccggtcgtgcgccgccgcctctgcgccgccgcctttgcgccgtcggttgccgtggatcccgtggaccggtgttggaccatccgcgtggtcccggtccacggtagaccgaccacccgtgcgtcgctgacatgcgggccccgcctgtcggcgccacccccccccttttgatgacgtcagccccgggacatattgcgcaataaatgatttaaggactttttgttatagtaataaacacagtgaatcttctaaaattcataactaattcatttgtgctccgtttaagcccattcaagtctcagtaaatcaagaaaaatgtgtagaatccattaaaaatggttttgttctctgtttcagtagtcttatagcctgtttgcattgtttgctttgtatgtcgcttagattccggttcttccgacgctctagtgtacttcgagatagtcgccgaggttcctccagctgcagagcaaggcaagtcatgcctgtcacttgaacatgttgatcctatattgcaaatgctctattgtttttcttcaaatactgcattgttttataatgttactttgggatgtttacctattgttacagccatgctattttgataccatgctcctttgttagcttgggttataacatgaatagactttggactaggaattgcttagccatgcttagttcaactagcacacattggggaaaaatcctattaatgtttagactataggttctaatggcaatgttggattagtgacaccgcttcggtgttggttaattaaaataaatcacatggtgggctgtgggtgcatggttttgttggtcgcacccatggcagttaaggaccggttcgcgggatgccctagaagatcttatcgtacttaccacaagccagcgtgggaaacggctgggcttgtactgtagcttttctctagccgacgcatccaggcaagggtgggcgtgatggagtttggatgggccctgcgacggcctatgcggcttccggattcacctaggcacgagaggggactgcccgctgccttgcgaggagtgggagtgaaacctaaggtgtggtgtgcttggttagagggggttatgcgaagggtcctgtcacggcctctttccggtatgtcgtggtggcatgtcagcacacggaaacgtgtcgtggggctgtgtcttgtgggtacagttgtacacctctaatcagagtaaaactattcgaatagccgtgcccgcggttatgggcggtcaaccagattcaccgtgattagtctcaccctagtttagtctaatgaaattagatagtataggtggatggttgggcctgtcgcaacgtggtatagcgttggacagtggatgaataatatgattaattattacaactgtttaaatctttcaacttctgtttataaatgctcgctttatgcaaatgaaccactctagctctcctttgataattccctgcatcatacccctattccggtatgacttgctgagtacagtgggtagtactcagtcttgctctatttttcccaaccccagagtatgagtatgtgtcaaatggaggtttctccgaggagtaggcttcgtccgtgccgtcgaggatgcctgtggagtggtgttcccgctgcagttctagtcaaggcttagctcctgttgtctttcgtttttccgctgcatttttgtaagacttttatgatgtttgtaagacgtggatctgaatgtcaacattgtcgtttgtgtaccccggccggtcctggacggggattttaatgcacattctgcttggaattatattcgggaatttctgggcgtgacaatgttgatcaggcggtatccgaattgagtgatgccggagaaaaaacaccattggctttacccaagcaaactcctccaactcttgctgcccctgctcacttttcaagggtaaaccactcaccttgattccctcttacaatcatttattcatagccgatcacttataaatcttgcatttgcagaaaaagaagactgctgtgaagaagaaatcggcagcagcaccatccaagccagctccaccagtaatattttcttcatgaaattttcaagtctaatcataacccatgtggactaacacttgtcttttcagcctcctcctcctccttcacctcctatacagcaaatgtcaagtgaccgaactccatcggctataggaagtcataatattgaggaagaggaacaatcagccgctcctgccatcccagtaagtctttcattgtcttaacatcttatatcggctgaatctgtttgatcttcaactgtcttcaaatctctcctttgcatgtattaaccgatctattctcctttgacatcaaggattactttgatgaagaagcagaagaagaaaccacaagtaaggctctagcccctctcgatgaaactgtcaagaaaacacttgaagatatatcccttcggctagagtcatcattagataacctggtggccgactgtagttcgatccgggcacgatttatagaaatccaaccctaatcccacattatctagtgaacaccatcactccagcgatgtacgttgagcaacatcaattcaagctggaaaggcctaagcaacggatagccgatcggcgggagcggaaggacattgaagcaactatccaagccaatcggcagcttgtgcaagaagagtgtcacgtcctgataaattcatcccgaaataaaaatcattctctaaaaggaacaatagaattaattaaaattcgaaaagaaattgtcaaaccttaaaatgcgtacaagaaaaatttgaatgtggcccggagaattttcgttaaattctccttggtctaaaatgagccctcaaattttagttgaattttcagaacaccggaaataattattaagcaacaacaacaattatcaaagtttactaaaaagaaaaactaaaaataatccttcttcctcctttgggccaagtctggcccaaagtctccctctctccctcggcacgctgtcgaagtctctcttccctccctctcgttttcctttcccatctcactctcgggccgcccctccctcctctcctccccggcccactccctcctatcctcctcccgcctgggcctgccctggcccaacccgagccgcagccctcccgcgcacgcgcgccgcacgcgcgctgatcgcgtggaccggtgggtgccacccacccggtcgtcgtcctcctcccgcccgactcctccctctcccatgaaaccctatgcgtttcgtccttcaaatctgcgcgaatcaattcccttctttccaaattgattagggggaatgacccctttccttcctcttcaattccccctaatttcccccttgaatggcgccattagtcacccggaacggccgcgtgtcgcgaccgagaaaattgccttttcccgaacgctagtgtattaatccccgtcccaggaaaagccggggtacaccacacaaacatgatataaaagacacatctttattatatcgataatatttacattattacaaaggcgcttcaggcctgacaataaaaataaacagcagcggactagcgggcctacggctccatcttcacaggcgctcaactggggtataagccaggactccacctaagacttcttctccaaagcttctcttactgaagggggaaaagattgagcaagaatgagtacaaccacagtactcagcaagtcacaccggagatgcataattaatgcaagggggtacaaggggataataatatcggggttaagttttgcagtaaacagcatttaaaagtcacttagttgcccaaagccattttataaagacgatcctagagctacacagtattattaatcaaggccgtgaacccacacgaacctgccttaacccaaggcctacgatgattcagaccgaactggcaacccgaccctgggtcccaggtcgtcccaagccaacccaggccaaccattccacattttagttattaagcaggttttaagaatttaaaacactaacttgggtacattgctaggcttgcccataaccgagggcgcggctattcgaataggttttactctgatcagaggtgtacatctttacccacaagacacatcttcctcacgtgcaaccacgtgccacataccaccacggtatacagaccgaagacgtgacatagtttccaacccatcctaaccatagacaagaataccgaccc

SEQ ID NO: 62333 - DNA, 1081 bp, Oryza sativa
cccgctgcgaatgccgacgacggaggcggcgccgcgagacgacgagccggcgaggatgaacggtgaagacgacgacggacaccggcggtgttcggccgaaggggaagcgatgccaaggacgacgtcgcggctgcgatgccgaaggtggtggaggtgcggccgaccggtgcacgggcgaggagggacgggcggccgaacaactccggtgaggcggatcgaggggttggtggcgacacggcggtgttccggcgaaaccgagttgtggccggggaaggagacgatgccacggcgtcgacgaaggagacggcgacgtcggccgacgctccgacgagggacagcagccggctggagggagtacagtggcaccaatgccactggttgccggcggggacgcgtctccggtggtctccgcgtgaaacggaggcgacgccggtggaggggaagcagctgcgacgctgctggcggcgacggcgcgaccggatgacgctccggcgaggagggagaagcggctggaggcagccggcgcgaaggaaagagaagggcgacggcgggaacgtagctccgggggtctccgcgggaaacggagggcaagccggcgaagaggaggcggctgcgatgctggaggaggcgacggcacggccggccggcgtgctaacgcggcggcaggggcggctgaagacggccggcggcacgggagagaggggacgacggcggggaggtggctagggaccacgggagagctcgggaggagactaaaacggtagaacgcaaagagggggttctattttataggatgggggagggagccgggcatgggagagggcggaacggcgacgagaagcacggccggcggccatggttggtggccgggaaaagcgcggccgttcctgacaattgggggcgccattcaagggggaaattggggggaattgaagaggaatcaatggggattaaaaccccctaatcaattttggaattggccaattgaatcaagcggatttggaggagggagcgagctagggttcgcacgggagagagagaaaccgggcgggaggaaggagacgaccggggggctgcagga

SEQ ID NO: 62334 - DNA, 701 bp, Oryza sativa
agagtatatttatctataaatgtagttaaatttaaaacaatttgtctttttaccaaaatccaaacatgttataacttgaaatggagtaagtagtaaatatggagaagcgaaggaattgatgtgaaaaaaaggtgaaaatgagatgggagatgggagaggaggaggaggaaggagatgatgagtgctcacgaactcgagcccgatgccgcgggacgcgccctgcaccatggacacgccgccgccggatgtcgccgtcaacgagaacgccctcgccgccgccgccgcagccgccagcgtcctcgccgtcgccattgctcctcctctcgcctcgattcgattctcttcctccgggtgctcgcggcggttcggtggcgaggcgaggcgcacaggggcagtaatggcgggtcgttgttgtgggggaaattttgggggagaattgcgtggctagatgaaggcacacgtatgccgcgcgctggccgggaacggcctctttaattcctctctcgttttttctctctcttttcgtttacgtacttttccccttcttctttgcaaaggcgctgtttagttatcacctaaaattttttaccatgtcacatcaaacgtttgaaccaccgaatgaagtattaaatatagactaaaaaataactaattgtacaaattatgactaatttataagaggaatcttttaagcctaattg

SEQ ID NO: 62335 - DNA, 2866 bp, Oryza sativa
tctgggctgcctactcaaaggcagaatttttccaagccaatctcattgtcatccaaagtactactgccaatgaactgacaaaagaattgatgaaccaaagcagtgacatacttctagacaaacaacttaggcgaactgagagagctcccatggttatagcatatggaaactgatcctacaataaataaaataatttacattgtaatataagaaaccaacttttctgctacttgaggtttagaaactgaccttgaaaccacggttctggtttgatccacctgaacatctcacggttatccataagtacaaggcaaatatgagtagatggctaattcgctatggagcaaaataatactggaagactggaggttaccttttgttgtttgcatgtaatgatatatgtgacacagaagacctcaagaaaagtttctatgtacggataagggctatggcttataaacatgttcatgttttttttccggtttgcaaattggtattctaacctggaccaggaacctaccatgagttttaatattaacataattgttttgcattggaataatgaatgttatgcaaacattatgcagtctcctgaaatgaatcatccgataataccaaagtaaatgaagcagcaccgcatttatagagaaaaaaatgttttccctaagtaggcctacacttccagttgtaagaaggattcaaactaaagaaaaaccacccttccatttgtattcatgctttaaaattgtaaaatttatcttatattcttttctttttaccaatgctttcatacagtttggggatagacggtggagatgagacgaacatgggttgggagacgccgcagcaatgtggtggtggcggtgcgtgtggcagcgccggtgggtagtggccacggaggagatcggcgtggtgtcactggtgttgtcctcgacggtcggtggcggcacggagatgtcgagggtgggcttcggcggcgccggtgtggccccccgaggtggaggttgccggatgttgtatcaataatccctaatcctatacagcaaaataagaaaatcatgaggaagattacggtggtgcaatgtttcatgaagcttattgcactttgcttaaaaatgaaccattcttggggtttaaacccaaagggaaaaattttaggttccaaaaaaaggaccctttttttaaacccttgggaaaaaaaggtttcataatcatcttgaccaaatctgtcaagaatccagaaacaattggattgtcctaacatatgcatggtgatggtgatttcattaatcaaggaatgaatctctactatactgataattgacatagatggtgcatcatcttaaatattctgtcattgccagtgaaaatcgaattttaaggtttgacttctgaaatgtgtaaaatcttaaataaccagatactattgttctttggagatgtttagacatgtgcagacagttatgcgttgttcatagacatagatactttagttatcattatctaaaaacatgaattctttagataccaaaacgatgctttcggtttttttttcttttgattgattctggattatattaagaatcgtatgatcaaatcagcggcgactgatggggggagaggaaatatatatagtactggattgtggattaaaaaaaaggagggaggatgatttctgtaccttaatttcggcgaatcagatcgaggatggggcgacactgttctgaaagcagagattggtggttgcacggagacagtcgacgagccggagattgggggcggcacggaggagaccgacgaggcggagttcctggtgaagatcgggggcggtgcggaggagaccagcgagaagggcgatgaacggcggagtggtgagtggaggggacaactggcggggtgggagggcgggtgtggtgtgcggcgtgcgacggcggagtgggcgatgcggtctggacggcgggtgggggcgcgagcgccgggagacgacgggggcggcgacgtgcataggcgcgatgggcgagagaactggcggaggagatggatttcgcgattggaaggaaagtgcgacgatttcgggggcgtaggggtgagggaaggcggatgctatcccggacgttagatctcttggggataatctggacgttgagtgatgaatgaaagaatgagtgaaagtatttgtttaactatagggtagattgaagatcgctgaacagcaccatcttcattgtgttcttcgggggtcataatagttgactgcattggcgtgccagaagatacagtattgcatccatctgttgatttggccttctttcttgcacgccattcacgaagatacttgtttgtatcctctctctttttctttgcagaaagttcacttgtccctaccacacccccttcactctggtttatttcagatgtagttgttgcttgagttggattgacggatgttacagtgctattaacaacactcgactttgctctatttcttgcacgccactcacgtagatagctgttatttttttccctctttgttgaggtggcaatttcagcaacattgacctcggcactatcacattcttcatactctgacacatgcgttgtttgcataggacttgtactacatttcttcttagcctccagatttgcacgatatatacgttgtttgaagtttctttcctttttacgctgagactcattggatagcccaaattgatccacatgacctgcatttttttattaacactatagtcatactgaaaaggacaagacctgcgttgtacacaacgaactatccattatatgtacaccttgacggtggtttgttatatctccgagggatttgcgagctccaccgtcgggcgcagga

SEQ ID NO: 62336 - DNA, 676 bp, Oryza sativa
aaaaattgccaacgccaatcgcggagtttcacatggaggagggaagaatggaatgagcgccaggcgtcgcgtcggcgcgcgcgtgagtgcgtgatttgtgttggttgtcttcctcttggcttcgcttcgctgctttgccgcgccttcgccgagggaggccgaccaacgcatcaatcaaacacacaagcacaccacgcggacgcagcagcaggggaggagacaatttcctattcttcctcgccccgcgtcgcctcgcctgagtctgactctccaaacgccgaccagtgacgccgcgagccttgccccttgcccgcgcagatctcaccaaaccctaccagatctgcgccccgccatggactccgccgccggcggtggcggcctcacggccatccgcctgccctaccgccacctccgcgacgccgagatggagctcgtcagcctcaacggcggcaccccccgcggaggctcccccaaggaccccgacgccacgcaccagcaggggccccccgccgcccgtaccaccaccaccaggaagctcgtcctcgcctgcatggtcgccgccggcgtgcagttcggctgggcgcttcagctctcgctcctcacgccctacatccaggtatacccactaccctttgctctcccttctgcttcagaatggagagtgggctgcaggaat

SEQ ID NO: 62337 - DNA, 675 bp, Oryza sativa
ttctgggtgagtctaatatgcaagtaaacaattacagaacattatttcatttccttttataaaatatttggccgtatcatgtttgtttagctgttcttgctctttttgcttcttagtggcttggtgccacattgcctctcaggcgctttctttggcctctgtatacttgattggccatgtgttccatatttagcgcgctggatttaatgctcaataatagttaaagtaaaactagttgtccatatgaagacatctagatggatattccatctttaaattacgaaactggatgcacgtatgttacagtatttcattagttagttaaggtatatcagaaagtacttacaaaccatttcccctgggtttctttatggttgatattgtacataatatgagtcagtatataacaagtgacgttattccaatattccagtaacactactgcaataactattatgtccagttcttgctttatgccatttctagtggggataaaaaaaatcaaaccgtgaagggaatggttagcattcgcaccatgcccactgggggactcggaccatggtagtggaagaaaaggcgaaactaagtgttcgtttgaacaaacccaaattcaggacatggtaatgggaccagcttctttgatctgcacacaagggaaatgattcatgtattcaa

SEQ ID NO: 62338 - DNA, 3876 bp, Oryza sativa
ttgatgacaattagttgctctattcctcttcctattcgattggtaacttacatcaattactcttaattgattgttggttgatggttgtgtagtagaggatggttcatggctagttgatgacaattagttgctccattcctcttcctattccatgactcttactcttcatcttccattcctcttataaaatgggaatggatttgatctcccgcgagaagaagaagacacactttcatccattttcaaaagctgttgctgctacggtaatcccatcccgaccagtgtgtgcacacgcgttgggagagtaggcctccgaaaccacgcgttgctgcgacgtttgcacagacgggcgggcgatcaggtttttggggagcgcaaggcgcgactactcactgttcgtcaacatctacttcatcttcaccaacatgtcgaacactggagacaaggagaaggagactcccgtcaacaccaacggaggcaatactgcctcaaactccagcggaggaccattcttggggtataaccttattatattatttcaattagaagttttactgttaatgttcatcgcaatgtcaacattgtgtcattatgtgattgttgatgcttattcaacgttaagcatgctcatgttgattacattcaccactatcactggatcaaatcctattgtaaatatcatgtttattatcttgttattttggaataaaatatgccgaattatgaccaaatttccaacactagttacattatttttctcaaaaacactccgtttcatgttcttttcttattaatgttgattagagggaaacaagactttatcattttttcacttgcgcttttagtgctagatgttgacagtatttgggaattcattggaaccaaaacctgaaatttttttcagatggttgtcctggcaaggctcaggtttagtcaaagaggttttcttgagattttctttatggcgtcatggcacatttagaagcatagcaatggacttatctttcaaaatattaaccttcatttcaatcctggaaatccctttttgtgaaataaactcttctgcatctgtgcacagaatgaaggattccctgaaacaatatgtttctaattggttgcacactttatagctttgttgccttttcttctcttttgtgtattatctgtaactttgtaaatattttatttttctataaaatttaaactgctaggcaaagccttgacagtattcccagtcaaaaagacttagtttttaactcgattttcatagtacgtttttcaaactattaaacggtgcatttcatacggaaactttctatgtagaagttgttttaaaatatcaaatatggatgaatatatttgtcaactttgtaataaatctatactattataaaaattgaagatgtttttaccggtatttttgtacatcatccgtatttgagtctgtttttaagttcattcgcttttggaaatagaaatccatgtatgagtcggattttaagtttgtttgcttttgaaaatacaaaagaagtcgtataagaagtttctttaaaaaaaccttacatgctaacttgagatgaaagtcggacttctaattgaagctcatgattttctaaaaaaaatccaagtaaattcccacagtgaatttcatcttatttaaaccgtataatattaagatagcatttgcctgttgcaacgcacatatatttttctaagtaaaacctaattaacacataataaatatatatatttgatattttaaaacaacttctctatagaaagttttttatgaaaccgtttagtattttgaaacaatatcttctaacttaacctgttgcggcttgtttgttaactcgagggaaggggattgggagtttacatgagggaattgatgatgagattaatatgggaatttgatttttaatcccaatatcttgtttggtagaggtaatggaaattgatagggagtttagttggagattaggtcattaataaaaacggatggctgagatttgcttagacaaattaaaggaggaattccctcccaattacctacccctatccagatattgaaaaggagggagttccttcctcaattcctcatcctcatcccacaaaaattcccatgtctcccaaccaaacaaaacacttaataggcttatccctctaaactcccaatatctcctaaaaactccctacaaccaaaagcaccgttggtgttggaaagccatccaccgtaatataatcagagttggggtccaggccgaaggctcgaggaaattaccatatcgcccaccaccccgggccacgttcgggacgcggttgcctaaaaagcgaaaatatattcccggaacaaagcaataataacccgtcacgattcgcccacacggcctatctataaagccgcccccgtctccgcaaggtgatcgtattcaatcagtttattcgatcgccggatacccgaggaagaagaagaagaagaaaagatgagctactacggccagcaacctcccgtcggcgtcccgccgcagcaaggttcgaaatctccggctccccgtgttcttcttcttcttcctcctcggcttttttttaaaaaaaattatgtgtgtgcttgtgtggtttcttgtggatggtttgactgaatcttggccgtgtctggatcttgtgtttgttcaggttacccggggaaggacggctacccgccgccggggtacccaccggccggctacccgccggcgcagggctacccaccggctgggtaccccccgcagcagggctaccctccgccgtacgcgcagccgccgccccagcagcagcagcacagcagcggcccttccttcatggagggatggtgagcacttcgtctcgtctcgcctctttttttttaatcaacaattcagcatcttcttcgttgctcttgtgcactactagtagattttgaatttgaagtagtactagattgtttgattagatcaaaattttagtgctatttaggcggttagggagtagtagtagtaattaccggacgctggtctcagatctgtccacgccgacgggtgcggtggccggcgcgtccgccgcggcggcggcggcggcggcggcgcacgttcgctgtggtggggccctgaatagacgcgtgaactaccaccccttgaaacgtgggtttcgttgacgtgtcggtccttccaagcaaggcgacgacgaggttgcacttgcatgccacgagggggtctggctgtcttctccttgcaccagtgatggccgtctgatcttggatggacggctgtgatgcagtcacattcccttggtgcttaccatttgttgtttccttgtgaattttggttggttgctggagttttggctagaggaaagataagttcaaaagcctgtaggagaataaaaatgtgcttttcacagattcctttggggagaggtcacctaggataatactactatactccgtagtaagtatatctttcttggttttttatagagagatattatattttcgttgacgcgctaataccaaagaacggttctcttcttccccccgagatgattatgattagtcttggcgggtgttccatcactaattgtgttgctaacctagttgcaatttgaataatgcagtttgtcaatggacggctggacatatttagggacttattttagattgagcatatgcctttgttcaaatggcaatactatacttacctgctgcctttatcagtttcaattttggtgtcatgattctaatgatgtgttgtaacagcttggctgccctctgctgctgctgtctcctggacgcctgcttctgaggatagaggcgacgggtgcaacagagctgaagagatttgtttcatggagctgatcaaa

SEQ ID NO: 62339 - DNA, 666 bp, Oryza sativa
  unsure (1)..(666): unsure at all n locations
ttatgcgggtttgtttgcaggctgattaatgatagttatttatgtcaaacaaattgacgaagttaggctggtcaccaattgatatatagtagtacttgtgattgcgccctgacacgacacgacgntagtatgggagacagggtagctgtttaattagctgtccgcctatgcaaaattcatttttagataatatctacaaaattcatgaatttgccaggacagttgacgtggcctgggggcttgattgtgaatttgtgatgagtagggccgtaggggaactaatcgtgacccatgaggacaaccaaagccagaacaagggttggtcggggattaagccaggtttaaaaatttgaccggaaacgcaggtctttcagtttaaaaaaggagaggtctcgaagaaatgtttaaaatgctcagcaagagcttgggtcttggtcagaggttgagagccagagagagcctgcctcagttcaaccataccgggttggcctaccccgcgcttattatggccatgttgccgaagcgcgtattttctgctctgttccttagccgcgtcgcctttcgatcttcgtctgctaataacgtctcaactaccagccgcagcggcacagcacaactgcaggtcagttggacgtccgtcatcgacccgtgcagcgcacgtacctg

SEQ ID NO: 62340 - DNA, 3374 bp, Oryza sativa
  unsure (1)..(3374): unsure at all n locations
gattgctagtagtcatcctcgtcgtcgtcctcctcaacctcccgcccgccaccgcgttctccccggcgctccggcaccgttaccgcccgccgccacgttctcccggcgctccgccaccacccgcacgccgccgacgcgttctcccccgcacaccgcgccggaaccgtttgagagagagaggaagagtgagagggagaagagagaggaagagaggatggggagatgataggtaggtcccacaatttttttttataaatagagtgctgactgccatgcgtacgccacgtggatcaaaaccactgcgaattgggtcgagggggtaatttgtccgggttgcatggctgggggtgaaaaatacccggctttggggtttaggggggtaattcagacgaccgcgatagttcgagagggtaattcgnactctttcctttattatttattaaattacttaacgttgacactaatacgatgtaaaaaaaattagaaaaaataaaatttataaatagtgagaaaggtacgggtggaaacgatacctcttatacagaaacggagcttgatcgattgggaatttctgtgaccgttttcacccatatacggcccaataaccatttattggttattgggtctgcgggctgcaggcccaattaaatctcgatctcttcgcttaaaccaggttaattagcaggggattaggattgacacgagcgcagcgtggcctaactaaaccgaaccatcaactaaaccacccctggccttttctggtcaacggtcaacgctcagcatgcaaaccccgacctaaacctcgccatggattcgcctacaaaagcttcgcgcggcgcagccaccgagctgcacgacggcggccggcggcgaggagagagaaaccagcagcagttgcgacggcgatgggctgccaccaccaccaccaccagctgcgacgcctcgccgtgctcgccgcggcgctctgcgtcgtcgtcgtcgcgacggcggcgaggccgctgcaggcgaggagacacggcgaggcggtggagatggacgtgtcggcggcggcgccctccggcgatggggcggttcgagaggggaagtggctgccgctgctgccggcgggtggggggctgatgcacttcccggtggtcggcggcgtgtcgatgccgtggatggccggggcgcccgccggcgatggccgggccgggggtgcagctggtgcccccgtacgtcggcgcgacgcggcaggagcagctaagcctgtgggcgtcgctgttcaacccgttccaggtcaggcccaggctgcccgccgccgccgcagagacgacgtcgccggcggtgcccgtggacatcccggccattgccggcgtgtcgccagagaagacgacggtggacgagccggccgccggcgagcccaagtggggcgtcttcttcggcaacaacaactagcctatgatgaatattatgatccattagcttttaagtatagaaatgaattaatcgaccttctttttggattaaagtttagtgagtataattcaagtaatacatatgtaagtctgcatgtttaggtgtcaaacttattacaaaagaaaatatggagagttgtaatatttgtagtgatgaaaacacatgaaaattcttcacttatatcctgtcccaccgtttaaaatatatatatagtcacttgaatatttttgtttttttctcaacactgacaaagatagttggatatatattaatttaacaatgcctagctggataaaaatgatcatcctgaagggatggatgatcattttagttgtccaatgcctttttttttggaggtttcttaagtcataaattttcaggcccatttgtgctatatgggccgggaattccagcccaatttgcttgagatgcacttgattttgtatagccaacctctggccggcctatttagaatttggtagataaatgtaatttagcatttgatactttcgcaagaggaagattaaacattagcctctagtgaaaattgcctaactccatctctgcattaaaccatacaacatactaattatttgctcaatttgtcctccctttcttatccacacaaattgggtactgagactaatctgatagaaaatgaaattgcataattgccaatcatgtgatagctaaaagaaacataagacttgaaccaagtgctcacatgctctaatattgcacagcaataaatgggtagagactcctagatttcagggaaaatgttccaaatttgttaatctccaatgtcttgagtttaatgcagcagcctccaagcttgtcataaacctgatggaaaaggctagctgttggcacctgtatttatgtacgagttaatcaagctaatgatgatgatagaaaaaaatggtggttagctatggatggatgtgagccacaagctcagccatggctgctctctccttacatctgaatgacttctctgcctcacaatctcatggggcagaggagaatggacgatgcaatgcaaaatgcaaggccccagaaggagaataaaatatgtggctagggttccaaggatctgttttgaggccacaagtccaccaaagttttatagtgatgtggatcaaattcaaagcaggttggaggatgagaaattcatagaacccttttttttctctctttggttttggtctttggaatattttttttcttttctttttccaaggagtgtgatggtgactatcaattatccatggctttttggcaaggaaggttcacctttttttcctataaagaggctgtgagaatatgattggatcactgtgtgtattatcatgtgaaagataactggttatagatgtataggtacttgtccaattggaatatgagtgacacttatgggttgtttggagggtttttttttactccttttcctctaagaatttaacctttttatcccatttttgccactaagctgaaaaccaatttcacttttgttagtcagctgtaccagccccagtggcaaaaatagcaacagtgagatatgatcattgcttagtgacaaaaaacataaagccatcccataatgtattattccgattaccccctccgtctcagaatatagcaacctagaaccggatgggatgtatcctagtactacgaatatgggcatgccccctgtctagattcgtagtactatcatatgtcacatccgatcctaaggttgctatattctaggatggaggaagtactaaattttcataattcgattccatgccctctagtatgaaatccgtaaatacatcgaaccggagggtttcattaccaaaagtaaaagggtagcaacttttttattatgaaaagaaaaacagtaacaaagtaacaaaaagggtaccgagctc

SEQ ID NO: 62341 - DNA, 2003 bp, Oryza sativa
agtgagatggacgtgacactaatctggtgctggatttgggcgccatactgactgacagacaggatcgcttggagctcagatctcccaaatcttccgtaaccacgaccctgcacgatgacaagttttcatattcaagtcgatgacttaactctgtgttagagaatatggtagttagagttatattagaataggattgatttatgtggactccttccatatctgtaatcctttcttatctccttctcgtgtactcctatatataccgctccccctgagactcaatacaagtcatcccacattacacagtatatctctcttcatatactatccaacactctgaatttaaattgaatcaaccggtgttataattagtagtcaaacgtgggagagtgtttttattcctcaaggggatatctcattgtttcttacatgtcctgtacatagttagtataaaatattttcaaattttgataagatagattaatacaagatatatcacttcacaaacatagaaattcaaatttaacttctacatgtagtaacaaaaataacaaatataaatacgaatgtacattaattagtttcagtttaattggtttttttacaacttggagcagtcaagtttgaacttgcagatttgtatataatatatctcatattaatatatcttatcattttttaagtgttttatgactatcttaggtgttatggtgttatgtaagaaacgagggatgtccttcgagggatgaaaaatctatctccgtcaaaggtggtaattattcagaatgctttcgtaagttcagagtttttgcagttaatttaaatcttgtgtgagatgaaccggaggagattaattgtgatgctatgttggcaaggcaagttggggggtgtataatgctatgttgataaccattccctgtcggtctccggcgagtcctcttcttgcctggccatgccctgccctgcattctttctttctccaccaggggaatccagttcacccccagtgctgcttctgctgctgcttctgcatcatcttgccctgttaaaaagacacagtgcctttgttctttcgcagttgcaactagcatctcctcctctacttgtactcacttcacacctcagctcagctcagctcatctcctgtcatctcagctcaaagagaaagagctgaaggtgtaagctgatcaccaggaagcagaggctttttttcagattacagttatctgaaacaaccaacttcagaatcaatcagcaaaggtagagggagtttcttgtttcttttgtgtactactacatgactatatccatatctcctttttcttctacttctttttcttttgtttggttgtgagtgttgttgctgtgtgtttcaacaagtcaactggatagatagattcatagatatgatagtttttatctgaggttggaggtttcccctctcatccaccacacacattttggcaccccaatcctgaatttactgttcaattctcttctttttattcttcctctgttgattgatcatccatgcatgcatactggtatatagtactagtgctcaagtgctcatccttcctgatggtgaatctcttttgagaaaagaaaagaaaaagatctctctcatcttggctttttttcctgttgatctgagcactgctcttctccaggttgtttcattctgcaggtctacagcttttgtcatcaaagtggtagggtttgtactttgtagtagattgcagtgatggcccttctctgcttttttttcattctctgtttgttcttgttgctcttattctgtttcattctactttttttaaacaaatccatccttagagttcagttttcccttaaaatttttccaaacctacaaattttgttctctgtgaattcatttttgcatgattcttgcagaatctgaaatgatcattggctttgcaggtagaaacaagacagagctgctgtgcttctgtgattaattagggttgttaatgccatgaacc

SEQ ID NO: 62342 - DNA, 2064 bp, Oryza sativa
gccctccgtcgccgtcgccagccaacgccgccaccgcgacagcctcgtcgccgtcaccagccgccgtgaccgccagcagccaccggacgccaagcactaggagctcccgctccagatccgcccacgggggggctggatccgcctccggcgtgcctggatccgcccacgagggggcccgacctacctccggcgcgcctggatccagtccgccgtcgccagcctcgccgccatctccatccccgccgccatcttcatccccgtcgccgacggcccatctccgacgccgtcgtcacccccgccgccgtcaccttccccgccgccagccgccaccccgccagatccggccggagcggcgtggatctggcgggctccaccgccgccgccttcagtcgctcgagaaccgccggtgccccagcgtgctccttgagagaggaaaaggaggccccgccgccaccgtccttgccgccgcgcggctttgccggcggctgctctggcggcggcgaggcgggagggaggaggaggaagctggctcgcggcacgtggtgtcgccgcccgtgtcgcctggggcgagcgacgcgggcggagttgtctcaacttatggaccaaggaattaattgtagggatcgaaatattaagtgatgtcctaatcgagtttgatatgaggataaagacaggagcagaccaagaagatgatcgacagctgattgatggtgtattagtcattggttgtgagacaccaacagatgtaacattgagaaaacgcatccatggcgattgcggtgcggtcgagataaaattttcacatctgcatcatgcagtggaggcgacggtacaggttgccgtattgaaagtgcagagtcatttcaatctgtctatctgttcttatgtgggttcgttacctgacgaaatgcagctattttgtggccacatagccgagccatgtggcctaaagaagtttgttcttgctgcaatgatgcgtaatttgctgcgattgaagttgaaggtaagccaagaagggtcttacgctgaacatttttgctcgttcgaaccaaatcaccatgggcattcatgtcagcagataaatactgagtttgcatccttcctggtgaagattacttggtcgactttggactttggaaatccacagaattatctgtaattcacaaccgaggctacggtaataagttagtgtattcaattatttttctcattgagttaattaagatgaggcctttctgagtatgactcaaatttaaaaaggatcctaatgtcactaattctttctaattcttcctaaacatgaggcatttttttagcctgcgagaaggtcaatataataatatgtttcgcatgtcacgagtcccttcttgttttttatatagttggaacccactgcaagcatgacatcactcgcctgttagctcgtgacatcactgagccaaccgtgaaataaagatggtaacatgaagaatttttaaaaaaggaatgtgaacgaggcctaagatgtaagatagcccacctccttacgggctcccagcctcctgcagtcctgcttctctcctggcccagtcctgcttctctcctggccctcctctatgaagtaagaagtaataagttcactttacatttctcaactatgagtcaaattctatttgcatcccttacccatgaaatcgggtataaaacgtcatctaattatcaaaaccagtgcaaatagagtcccttagcggtttagatggcaattttatcctacagttacccacgtggcatgttggcatgatctttattcctatgtggcgcttgcgcttatttgggattagaaaaaaaatagaaaaataaaaaaaaactcaatggacccatatgtcattaggaaaacaaagactcaaatgtggccccacctctccctctcctctgttcctctctctctctcacttagcgctggggtgcggttcaactgaggacggcatggcgccgacacagctcgtcgcacaacctcgcgcgcagaagccgatggcccgaacggcgattgggaggcccgcggtggccgatgctgcctccttcccg

SEQ ID NO: 62343 - DNA, 2363 bp, Oryza sativa
ttaacttgttcacgtacaggatcctagcatgtccctaattatatgggtttaacttattaacgtacgaactctcaatatataatagtgaacgagtgataggaagttaggaacacatatatcatttgcattacttttgacatgatccgaaatctaaggccaacaaattatggcacgcataattttctaaatcactattgtcggagaaaactgcaactttacaagttaaactgtcttccaatactcttcatcatgcatgatctcatcatgcactggaaaatactcaatttttcaccaaatattcagtgctgactggagtactggacacgcatatatagacctctgaattgtatcctggaccttgaatgaccatcagactttactagtactcgataggaacatcagaactaatatttcagcagtaatcaactgactctgtccaggctggtaacatcagaactaataattcagcagtaagcaattgactctatccaagctgatagtacatcatactcctatctaactaaacagcagacagaatctaggtacaacacttgtatggagtggagatctaatctttttataaaaaaaatgaggagaattttttttaaaaaaaaaatgtgcttctagcttccaacatgctgagttgctgactctgtgacgccaatattttttttgagaacaatgtgacgccaattcagagaggccatgttcagtccttgtcacaaaacatatggtcaactcaggcaaaacgcggcagagaccttttgtcacagtaattcgcacataaaaaatgaaagtatacaagataaatgcagagttgacagagtcacaggccacactcctacaccacaaaggcttccagaccaagaaaccttcctctcaatttactgaaaaaaatcaggggcaatttgtgcttctgatactcacgtatatttcatacacacgtgaatgcttttaatagaattcagagaattagagaatagaaagttgtcgttgactccatctctttaacatattttaggagcatgcttatagattcacacaagtatgaacacatatagtgatttgtatatgcgttctccacatgattcagaaaaaaaaaagaacaatgacaacttgatttcattgaatttattgtggcgcatttacagatatatagtgatggaagcagtttggtgcaagacaaaagtaggcaggcgaagttacatcatgtacacttttgacttggtcaaacgcaaattatatactgacagtgacaggacctaattacagcagtatagtattaattaattgttaaaagagagtttctaatcaattctacttgcaattctccaagaagatagcctttgccatcatctattgctctgatttagaattatatgtgaaaagagtctctctctattaggggagcgagaggagatgtctactcatatatttttcttccaaattcgattcaaatagttgtaaaaaattatagaaaaaaattgataatattgagtattgttatacctatctgtgcaaaaaaaaaatcaagttcaatgctgtatcagcgttgtcaattttttttagaatttttcataatcgtttcaatgctttttaaataaacaaggaaatatcatctcttgaggataacacacaattagattagacatgcttggactgatgacttagtcaaaagagaagtccgatcacttattaatttcttgtgcatgtgcatccaacaaccttcgtcagctagccaagaacaataagcaacttcatagtgtcctagcaacggcgtcaccggccatggcttccggccatctcgtcgccgtcgccgtcgtcatcggctcgctctgcgtcgcggcagtcggtcaggggaacaatatcgtgctcccgttcgcgccgtcgtgctcgaccgccggcaactacaccggcgacagccagtacaagaagaacctcgaccagctattcaccaccctctccgccggcgccatcgccggcgactggttcaacaccagctcggtcgggacgggcgccgaccaggtgttcggcctcatcatgtgctacgccgaccgcaactcgacgcagtgccaggaatgcctcgccggcgctccggccgggatcgtgcaggtgtgcccgggaagccgaacggcggacgccaactacgacgcctgcctcctccgctactccgacaagtccttcttctccgagctcacctacggcgccgaccccaccatcgcctggaacgtctacttcacccccttcgtcgacaacatgaccaccatgaacgacacgcggcggcggctgatgagccagctcgccgagagggccggcgacaccaagctcaggctggacaacggcagcttgccgtacgccgactc

SEQ ID NO: 62344 - DNA, 6986 bp, Oryza sativa
tatagggcgaattcgagctcggtacccgagatcgcctgcggccggcgaccgataatggcggaccaccaatccgaggtagacgaagaccggatccacattgctcagtgggtctgggatttatacggcaatgggaggattcttgacgccactgaccggcggctcaacggcgagttcgacggcggggagatggaggctgtcatggtcgtcgggctctggtgcgcgcaccctgaccggagcctgcggccaacgatcaggcaggccgtcggcgtgctgaggggcgaggcgccgccgccgagcctcccggcgaggatgccggtggcgacgttcctgccgccggttgatgctttcaaccacacatcatcttcagttgcgacaggaagcagcagcgccagcacagacactactcggtcgtccaggacgaccgagacatcttccttgctgaaatgacacttgagcaatgacgttttttatcagattaattaactgcaaaaatgaattgattttgacaggagcatcatacctgtttttgactagagtatgcagctgattttggactggtaatatgatgaacattagttacataacacaagaacacaatggcacaaacataaaagggatacagctattgacactttcagcataataattagtgttctcatttattattgccccaagccatcatataaaagggacttcagaaaggtagatcaacagctcataataattcacagtgtatgtctattttcaaaaccatttacaacgaaaaggccggtctaatggcgtcccttccccccaacctacgcccagccgacctctccaatctcctttgctttcttccttccattggaccattcacggtacaggggaagtataatcaagagttctccaatagattgtaactggtactaattaagcagcagtggcaactggagtgtcaggatgggctccccattcagtccatgatccatcatatacaggaacgtcggttttgccaaggcggtggaggccctaagaagaaagcataggttatgcgacgtaatgtaacaattgcaaagtaaatcttgtgaacttccaagtcacaggtagtcttaccagagctaatatacatgctgtcacaccagtaccacatgaggacaccaggggttgatcaagcgatatacctgacgaatatcacaacaaagtagtaaagttattgccaatattaccaaagatgttgccataattttatatttcataattcatacttgctaccacagatctacatcaaaataccacagaaaaatgatgctagtaacaaccactaccaataaacaaagcactgcaagaagtcatgcctggtcattacaatcatataagcgacaacacctggcactagttggttaattaactcaaccatcaacttatacaaaaatataaataagaggctcttaatgtttcaaaagacccagaaggccaaaacattaggttcatggttaagatataggcatgtttcagaatggggaataggattgcaaacatggctaagcagggcattgtcagcagacagaaagaatttgaaactttatctggataaaaatattaccttcttgttcaaatcgtttacggagctcttctggaggtaatagcttttgcgaactgtcaagcaactgcagaagaacaaacaaagattcagcaaaaagaattggtaatacacaaagattaaaaatacaaaaatatggtcacaaatgaacccgaataaataattaatccaatgagaccaaagacaaccaaagatcaggtaaaagtaattatccaaaatttatgtccaaaagagtacaagttgattggataattgcaagtctccacctgagggaaaggaacacatttgctcccaggcacatgcccacttcttattcctttccgtggctctggaactgcaccatcaaatctgaagtgaaagcttcatgttagtattcaagaccaatgaccaacattacaaagacacaacccaatgaagcttgaagcattcacatttttatgaggtaatatggcaaatctaccgcaattactgacacaaaaaaaaacaagtcagaagagtcgaaaagataaaacaccataagagtctggaatgcctactatgttggtgaggtgttacatggaatcatggttgaactggaaaaagattacttaaaaaggcaaaagccaaacagccgactttattggcaatgaagatcttgacagatactagtgagtctatggatatattatccaaatcaatgtactaggcctagggaggaacatggtctgtagccagtgacgacagggtctgctgccgtgtagaatttagttcattacttgaatatcgaatgattcctgcaaaattttgccattgtctccaaaattggaagtgccttttataaaatccaccataacccaatggatccttaagcataaaggtaaaggctttatatacatgtaatcgtgtatggtatataatctggacttttccagaattaaaatagcagatttacctaggctttcctcgagcatctataagttgatgtgtcttggcatcaatgttctcttttacctgagaaaaaaaatcatgaactagttataccaaacatgcgactgagtttaataaatggtgaagaaatgtatgggcaagattttcagcctgaagacctctaacctggtcaagattccaaataagatgaggctgcaactttgcttcaaatgtggagggaccaacctacaaagataataaaaagttatgtgtgactgaaggtcaagctaagcaccattcacagcagctactagcatgagtatcacgattcaggggttgacaagtacataacaggagtaaggtccaaatgttagaacaaacaaaatagaggtttaattcaacttaccaactgcccctgataaactttctcaattgcttcacgagcagcactggcttttaagatggcatcactagaggcacttgattcaacatcatacccagaagcacgccattggggcaaaccaccatccaacacccaaactttatcatgtccgaaaacacgaaacatcctgatatcaaggaagcaggcatcgcacatgaaatttaattcaattatcaaaattaacaacaaaggaacatattgcaaatgcactagtaagaacggcttatgatcatttaaggggaaaaaagattgtctgtcgtttctgcctgaattctactcttgatgtttactttggtttcaagaagaagcagcttaccaccaaacacgagcagcgctaaatagtccctttccatcataaactactatcccatctttgttgtatattccaagcgaagatacagcagcagaaaatgccttttcagatggcagcatgtgcggcaactgactcaaaagataatacattcaatgatatcaagcatgccgaaaaacaattaatcagctcaacaataaccaacacaaagaaatcaagaatgatgccatgttttgcaattcatattcctatcataataagggcattatgttgaattgttgatctacttaaccaaacaggattaaaaaaacatgttaatttattagtgttacttttttatcatgaagattgacagtagtagatgaaaaatacagtcaaggagaaagggaaagaaaatttaagtgccattacaccagctagtacaatataaaagcttgacgtgatctgaaagaaatcaaacttgagtaacttattatcactttttttacaccaatcaggggattgggacagaccaccagatcacaacacacacaaatgttatcaaccgtgttgtgatctgtcagtccctgttttacttcaccagcttcaaccttttaccttctggtgttgcctaaagctatttttgttgacctgtatgagtggaacttaaatgtattgacatactgaactaaatgctttcgcttcatgtatttaaggaattgggtttaccagcccctaaatttgcatagcacaagcccatattctggcaatttataatgttatattaataaaaaataacatcagaaaagcaggatgatgtggcacataaagaaagttcatatgattagctagtagtaaatgaaaaaacaagctagtgagttgaacttacgcttgatgttctgtctgatattccatcaacatcaaagaatagcgccccaggaatatgagccacctggaaacaagattaaaatgcatatgaaagcatcagaacttctgctactataatttcaaatgaactgataaaaacagaaaattaaggtaacaaggaaccagtgaaaataagagcatataaacaatcagataagaaaaatggcgtcacagcaggtggtaagaattccaaaactgcaaaacctcagtatggcatgtaatcgctacctggtactcctgaagaggattcctttgttcggcaggcatataccaagaggcatcaagtaccttgacagaaacaagaggatgattcaatgagatatagtggattcaaggaagacaaacatttttaacagggaaaagaaaactatccagtgactactgttatagtgttattattatactagactcatttatcctactgagagtatatcataatgcatatgaaaaagaactttaatacaaatgcagcttctgttgtaaaagcgaaagtagccaatggaaagccagtgccatcctgaatgtgctgtagtctgtagtacaaagacctcatgcttttcctcaaccatcaatccgcacagctaacgcgacaaactcagcaataataagtcactagccatcctcctacgatttatatctctcttccatcatcaatcaaactgccagcatggtagaacgccagcaactagcaattcactatcagtttattagctgtagcacggtatatgcaacaattcacaaaaattatcttccagtttattagttgtagcacagtatatgcaacaatttcacaggtcaaccgcagatcgctacagtcccatcactgcgcacactaccttacatcggggtccttgaggttggcgtgcagccactcggccgaaaccacgggctccgtcctcggcagcgcgttggtagcctccgaaacggccgacgacgaggtggcgttgcagcgcgccgcgatcccgaacgaaccgacgccccccagcgccgccggcaccgacgccctgcacccgaacccggcgccctcctcggcggcgcgcgcccatccgactcttcccccctgcacccgcacaaaacacacaaaccaccgtcaggccggagagatcagggagaaggcggagcggcgtcggagtacgaccgcgaggagcgaggcgatggtggtggcgaggaggatgaggaggggaggaggaaggagggtttccttggggagggaggaggacagtatgtggtgcgagcgggcgccgcggagggagacggcggcggcggcagcggcccgggagaggagggtggccgccatggatagggttttggggggttctagaaggttcgcgaaggggttggtggcggaagcgagaggaagaaggggaagaggtggatgggttggtactacttcgttgctcgacgagtgtttattaatccgcggggaaaggaaccaactggtttcgcgggaatccgcggcgcctacggttgggcagaagagccagtgtagcttcgcaggcctctcctgaaacgcacaaagtttatctagaaaatcagcagtgagtattcctgtaaaggctttttttttttcgagatgtaaaggtagaaaagtgtaaaaactaaattttttatcgtatcaaatctcgttgagattcatagcaaattattttttaatgatactagcaaaataaactaaaaatatttgtttttaaccgaagttattttcacactacttttgctcgctagaaaaagtcttaaatgatagagagaaatgtagtagctcataataaattattattcaagaataatttcaaaaaaaggagataaaaaagacaaagccggtttgatttccaactttacacggtgcgagtcaatatggactctgaagatataggcagatctacgaggtggcttagcaacacgatcgacctgtgaatcagcaagcaacctcagaccaatcgatggtcgattgacgaccgcagctgcgtctggccgtccgtttcccttccgcgacagtggtgaccatgactatgtgatgttattattttagtatttcttacttttaattctggatttttgttatttctaattatatttttatgtgaactctaaacttatttttcaatattctttattttttaattcagaattttagttatgtataagttataattctatatggattctagactcttttttcaatatattttttaaaattttaaaatttatttatttataaattgtatttctatatggactctaatctctacctttaatttttcttattttttaattctggattttaattagctctaaattgtatacctctagtttcatgcttgttaatgaaccatcaatttatagcatgtggattttgagcgacaactatactatatgttggtttttaagaaaccggtacctataatatagtgtcggttcttataaaaaaacaacaaaaaaaaccgtgctgagccaagccgaggcaacatccttatccagtccccctcccactctctctcgctctcctctagtcctctcactctctcactctcactctctctttcttggtcctcgatccgcggcggcggcggctccatccgccgcctctcttttccctcccgcggcggtggtggcgtcaacggcaggcggatctggcggcaggtgttcttggatgtgatgtgatgtatgttgttgttcttggatgattattttatgattttgtgatgattgtggttgatttttgggggtaaagagtggttgaattttattttttttatccgattctaagagcgattgggattcgggggagctgcaaaggtggccttcgtccatcttgtgacgaatggaaaattaccaatctttta

SEQ ID NO: 62345 - DNA, 2831 bp, Oryza sativa
ctatgggcgaattcgagctcggtaccctattttttttgtgaaaaatatggcgctataaatatagctgcacccgaaagaaaatgtctacgaaaatcatgattttcacgtgcggctagcgcaaccgttgtgaaaacgaaaaatcacgaaaaaagataaaaattccaaaaatcaaaaaataaactgccgccacgtacggctcgctacggttgtctatcctcagcgtgttgtcaccggccctctccgctagcttgttcagaaactgccatcgcgtgttgttcatggtggtcacgttctggacgacgatttggtcaccggctaattttgtgtagctgatgttggtgctggcgtcgtaggcggagaaaaaaggcttgtcggagtagcggaggaggcaggcgtcgttgctggcggtcaccgcccggcttccggggcactcctgtctgaccccagcgggcgcccgggcaaggcattccttacacctcgtcgcatcgccggcgtcggcgtagcacatgatgaggccgaacgcctggtcgggacccgtcccgaccgagctggtgttgaaccagtcgccggcgatggcgccggcagagaggctggagaggagctggttgaggttcttctcgaactggctgcccctggtatagttaccggtggtcgagcagtctgtcctgaaccactgatctactatctcgttgctctgagcaactgccgccgaggcaaccatggcgaggaggaggaggatgacaagccgcgatcagaaagtattttctacacctaggtaccatggcacctaggtgtatgcatataatttaaataattatataaaaaatacataaaatttaataagatagtccatgataatataagacactatgcaaatatgtaagtctaaattcgatcgatatatgaagaaacaaaaataacaaattttatcggcactgtacgggtactattgactgtctgattttattatttttgtttctctagttgtagattaaatttagtcatgcatgtttgtatatagacttgtatcatcacaaacgatgttactaattttttttaattttttctataactatttgagtcgtatgcaaatgatacaagtcacgatgccatgcccatgaccggctagctggcgacgctcttgatttgctatgaacatgaaggggttgatcccaattagtcgtggattacaattgaagggatggagtgcatatgtatgcatgtttttttttaagacaactagtagcggtcaagcaccagttctcgatgatacgcgctggaccatgtctagttggacacttggcaagatactcctaattatttggtgtgtgtatcgtaccgtaccgtgaccgagtgggtgtgttcggatgccccttttctcatcccctcatcatcgctttccacgtgcacgctttttaaactgttaaatggtatgttttttaaaaaagtttttatacgaaagttgcttaaaaaaatcaaattaatctattttttaaaaaaattagctaatatttaattaatcacgcgctaatggactactctgtttgccgtgcgttaccgttccagctgggatatggagatcacctgtgttcgttacttctggataggagcgaatccctccagcacgaaaaatggggtgatccattaacacgtgattaattaagtattagcaaattattttttaaaaaatggatcaatataattttttaagcaattttcgtatagaaactttttataaaaaacacaccgtttagtagtttaaaaagcgtgcttatgaaatacaagagagagaggttaggaacctgggttgccgaacacatgaggtcgttacgtgattggaatgaatgggtctctctctctctggtggtaatttttttggacgccattggtaatattgcataggaaccagccagcttgcaattgcacgcctggctggatgagtcagtacttgaggattattgggctgtcccatcctatagatcgaataaagtgggtgaagtacggatattttgctgttttcgcatgccacggccttcctcattctctctcaactcactgtagtcaccgccctaagggcatccataatatacatctaaagtggatagtaaggaataaaataccactactacccggttgtatacattgtgagagcagtaagtagctaatactaagtaatatgcttactacctagtaataaggaataaacaaatgatttctctcatttttctctcatggctaatgattgtggggtccagcttactacccatttttgttctttcaccattgtggctacaacaacaactaatacccactgacacagggctcacccttattcacaaagtagggagtaaacattggtgatgccttaaccaacgagaccgtaacagtgagcatattggacttggaccaagatcagccccaaataattttaggccttcttcttttctagacacttttctaataagttatcgtgatatgctttttttttttaggaaaggcattgcgcccagctttcactagaaagcgtaagagttcattacaaaagctaaaagaaaacgaaagcaatatcatgctggggattccagctgactatgaaaggtcctgagcacgcaggggcattcaaaagccgctggcacaggcacaaccagccagagagaaaacactactgcaaacagagaactaatcagtgatcgaaggactgcagcgaagatctcctgtctcgtggaagctggcaagcaacaagccccttagcgtatccaagtctcccctcattttcaccggcgccaaacgtctccactgtaccagaaaagacacaatcttataagataata

SEQ ID NO: 62346 - DNA, 671 bp, Oryza sativa
ctgcagaagttatcgagatgctaagctaaagcgttctggatgccttgctgtattgtctgtgaactctgtggctttagacctccaccaaactaggcacaactcactgaagaactctcaggaggtatgtttatgaatgatgctctatcttttgctgcagcaaaacaacggtctatgtggcctcttcctttctttcttggttctacttatctgcagtgtttaaacttagctttatgtttcaataacattgcaagattgtaagctggaatgttagaggtctgaatgcaccagcaaaaagggaggcggtcagaaatctccttcaacagcagaatgcaactctggtttgcctgcaagagacaaagctgcaagatgtaaataaggcctgcataattgaaacaaatggagtaaattttcagaacaatttctttttcctgcctgcagagggatctaggggtggtataatcctggcagctgatgagaactattttaccttgtcacattgtgatctccgtatgttttccctaacagccaaggtgactatgaaagaaacaaatgcctactggacaataacaggggcttatggtccatagaaagatgctgccaaacttctcttccttcaagaattacaggatgtggctccaacaaccctaccttcatggttaatcttggagatt

SEQ ID NO: 62347 - DNA, 4564 bp, Oryza sativa
gtggagatgatcaatcaagtgccacactagctctacaaatggaagcaatgcacttgaatcttggctaattaaccctctaacacactagatggatgaacacaaagctcaagtggatgtgaggcaggtgcaagaggtgtatgcaattgaattgggtgccaagagagtccccttgctgctggcgggggagtatttatactcccacccaccaaaactagccgttgggggcgaaatcccccaatcattgtgctctgccggtcagaccggaggtatgaggccggtcagaccgtgctactctgcaacggctagaaaactagccgttgtagtgctgtcagagggccccatcggctcggccggtcagaccggcgttgagtgggcggttagactggcctcggctcggtttgaccgaatacggctccgtcggctctgtatcgaccaccccgagtagcaccatcccggcctccagggggccggtctgaccgcgcatgagccgccggtcagaccggccttatgggccagtcagaccgccgttgtgaggacggtcataccggccagggcacgccggtcagaccggccacatagtggccggtctgaccgcccctggtcaggccgagctcagtgaaagcaaaggtgagtgtgtgtgtgatgaaaaagtgagcacaagtgaaaatgcaatgacctaatgtggcaatttaatcatctctttgctaggtcataacccctcttaatagtacggcgaaactagaaaataaagtagcaaatttgatcgccctacacctcgatcaattctaaattaaagcactagttttaccgtcttctttctctttgctttgcaccgtcaattttaatccatcgatagtcattgtcacgcccagaaattcactagtaatttccgaacttatttgtgcataaaatcctcgtccaggaatcagccgaggtacacaaactgacaatttaatatacaaatccattataataataacgttacacacttacaaaagaaaagaaaacaacagcgaaataacggtctagcgatggcttcagctccactcccacaggcagctcaactggggtataagccaaacgtcttctacttctggatcctttttcttcaactgaggttgattgattattgcaagaatgagcatatgacatactcaacaagccatacagcaaatatgcaagtgcacaaggataccaaaggatggcataatataggctcatttgcaaaagcagcatttagcaaaacatttaagagaagtaaaacagtggagtaattaatcagaaattttaatcaacactgaacaacacacccatgctgcacaggcctaaccatcctgaacaaccatactcggctgtacagatctaactccaaaccaggagctaaacaaattattaccagttatagcatcaataattattgtgagaggtgtgagactaatcacgaaaaacattgctcaacccgcccataaccgcgggcacggttattcgaatagttttactctggccagaggtgttccactgtacccacaagacacagcctcaacatcatgtctaccatgcgtcgcgatactggaaagtacccgaatagaggctgtgacaataccctctgcacaacacaactcaccacagtgcaccattcctggatcataatcacccccttataaaacaaggcatggactcccaagcgacccccgtgggcttatctccgccacttctcagtctggtgctccgcaatgaatcatgttatacaaaaggtaaagccgttgcccacgctggcttgtggttggcacggttaatgtttcacaacagtagctcgcgaaccggtccttaattgccatgagcacgactctcaaaaccatgtgctcacaacccaccattatcaagttttagttggcaagtaattaattagccaatcacgattgaccatcgtgaactatcattaagccatcattaaataatagtgagtcataagttatcccaatagagtgctaatgtttctaagcatggctaagcaatcatatctaatatctagctgaaccaatatataaaactcaactagtcaagttataataacccaaggtatcaaggaataaagtaatcaatgcaaacaggccataacaaaggaatagattcacaccacccagtgacattcgaaaataaatgcacagttaaaataaatagagaatttaaatataggatcaacatactcaaaggattgtgtttaggatctgtgtgacttgccttgcaataatcggtcttcaattaatcttcttgaatacttccggcgcactcacgaaccttcgcaacgacggaaacgacaagctaacacgcaaaacgaagaaaaagactaataaaaaccaaataaacagtacaaaaacaagcataaacagtacataaggatatttttaacatgtagatctcgattttagatgaatttagcaacttgaaccagtcgaaaccgagttacgatgatttagttatgaatttccgaagattgaatctattagaaaaacaggaaaaagaaaaacgatgatgacgtcatgatgacctcatcaatggccggaccaagatggcgacctcgccggagattggatggtcggttgcgactttggaggacatgtacacgtagaggacgacgagatgaacccaacggtactcaccctcgaaccaaacgacgaacgacgacggccggcgacgaggtctagcggcggcgcggcttcggtcgacggcggcgacggggctctggtgaccggcgacagcggggagagagcggccgggcttctccaccctcccgcgcacctaacggtggtgacggcgaccggcggcgacgacggaggcggcggcgcgacgcggatggagctcggccggcggcggcggcgaacttggcggcggtggcggagaggctacggggcacgggagaggggcaaacgaaagaggaggactagggggtcctatttatagccatggaaggccgggatcgagcccacaacgacgggaaaaactcgggaaagtttagatcttcgccggaaaaaggaaaggttgaaccgtgaaattggaaaggatttccatataaacttttggggatttcttggggaaaaggaagaggagattgagaggattccattcccacaactaatttggagaaaggagcacgatgtggctggattggtgggaggaggcggcggcactgtgcacgggctggagagctcgggctctgcctgagctggaaaatgaacagtagctcagggaggaaaagtagacttttccggctgggctgagaggagaggaggcagctcaggttgggccggcggaagagagaggaaggaaaggaaggaatgggccgaaaatggcccaagctgaggaggaggatttttatttacttttccaaataaattaaccaatgagatgatctttcaattgttaaaaatacttccaatgctcaaataattccaagaaaaatcttgaacatacttggacactcaaagtatttaatataataatatccagatcatttaatgattaatttattatgtgggtaattactgaaatgctctttgtaagattaaaattaggaattgagctccgaaaaatccgagaatattccagagagtataattaaccatggagaatttaataaaaattaaatccatccatgctttatatttaggaaattttatttcccacatttaacttcacttgaaaattaatgaacatttaatataaattctaataataatttattaaataatttataaatcctgaaacaaaaatcaggatgtgacagtcatccatgcgcacacatgacgtggacctaacttaaaatattatctcaatagcaacggttagtccacaattagcacttgtcattaattaccaaaattaacaacgggggcctagatgcttcaatctcccccttttttttaattgatgacaaacaccacaaatatatatataatcaaacatagaacacatggacatatattgcaatgacaaccaaaagctcccccctaaacatgtgcatatcaatcatagacaataaatatggagccaatgcacatttcaatatcacattccaaaaagcacaaaacacattagcaatatatcaatgtgaacttcaatccataggaataagatggtcacatatatcaatatcacatacaccatccatcatcacacaagttcacatcttaaccatccaaaacacataactcacaaatcatcctaaaagggttcacaaataaacataggctattacaagactacgaggggtccaaatgacatagagtttaataaaacgacaaagaacacacaatatagagaaatagctcatacccatacaaaatatagcccaaactaccttaacctattagatatgagggcactatcctcactactactagtcccaacccacaaaagatagatgtcacgaccggaaatcacccaacaggcgttcccgacgtgcgtgtattattccttgtcccaggaggcaaggtacaccaaaagttgatacaatacagagtttaacaagcggaagcgtatatagaattattacatgggcaacgaa

SEQ ID NO: 62348 - DNA, 1475 bp, Oryza sativa
  unsure (1)..(1475): unsure at all n locations
actcacacaccacaanaccaaacatttatgttgaaccataagcgtctcatactctccacatcacacaacaancctcnntaaatacactcaaacctctcacataccacccncccccccagaaatgataatcntgaacancccnnnnntnggaaccccccaaaaacaaaacccgcccaaaaaaaaaaaacanctttttttttcccccaaaaaaacaacggaggggacaaaaaaaaaaagggaacctccaaaaaaaaaaaaaaaaaagaaaaaaaaaaaaaaaaaaaaaaaaaaaaaaaagaaagaaaaaaaaaaaaaaataaaagaaaaaaaaataaaaaaaagtaccaaaagaacaaaaaaaaagtgaaaaaaaaaaaagaaaaaaaaacccagaaaaaaaaaaaagaaaagcgaaacaaaaaaaaaaacgacaggaaaaaaaaaaaaaaaaaaaaaaaaaaaaaaaaaaaaaacaaaaaaaaaataaaataaaaaaaaacaaaaaaaaaataaaaaaaaaaaaaaaaaaaaaaaaaaaaaaaaaaaaaaaaaaaaaaaaaaaaaaaaaaaaaaaaagaaaaaaaaaaaaaaaaaaaaaaaagacacacaaaaaaaatagacacaaaaaaaaggaaacaaaaaaacaaaaaaaaataaacagaaacaaataaaaaaacaaatcaccagaaaaaacaaacaaaaaaaagaagcgcaagaaaaaaacaagacaaaaacaacacagacgaaaagcaagaacaaaaaaaacataactgcaacacacacaaaaaaaaaacaaacaagacaaaaaaggaacacgaagaaaaataaaaagaagaaaataaacgtcaaaacaaaaaaaaaccaaaacaacaaaagcgagagaagacaaaaaacagaaacaacaacgaaagcatgggaccaagaatacaagaaaatataaaaaaaacaatagatgacgaggaaacaaaaaccgtcgaggacgcagaaaaaaaaaaataacaataaagcaaacacatgatagacggaaacgagacaaaaaaataacaaaaagaacgcatacacaactgacgagaacaaaacagacaaacaacacaataccgtgacacaccctgccacgaacaagacactaaaaaaatacagacaataaccgagtagagaggagagcaacacaacacaatcatcaacaaagacatagaacgatacgccgccgagaatacaacgcaaaaagacacacgaatacacaaataaagaacaacaagctgacacgaacaacgaaaccatccacaacatatacacaagaccacatacgatagacgaccaacataagcgacacagagaaaaaaaaaaaataaacaaaaaaataccacaaggagcgcagcacacgtcccgactcgcacaatgatagaactagaatcgataccctaagtaaaaaacacgcacgctgtcgcaacgagaacaggaaacaacaaaaaaaa

SEQ ID NO: 62349 - DNA, 670 bp, Oryza sativa
agagaaatagtcacccctcctataaggggtaaccttcacataaattataataaaaaagggaaaaaaaaggaagagaagattgatcaaacaaataaaataaaactattagggttagtgcactacaataatatatgtgtgatttattgtatatgctatcttttaattgatgaatagtctacatgaataaaattaggggtgaaatctaccttttccataagacttgctcttgtgccaagcgcagctaccagtctatttcaaccaatgatttgtatggatcttagtccagacaattatcaaaattttggtaacttccaaacattgcccctgcgtaagttttttgtgaggataggtattggcattgatccaaacaagcctcgattgctttgaggtactgttccttgtctacataggaagccatatccgtttgatcacaatagaccaaacatacgagaaactggactgaaattgcacatacacataataacagatgcagattattatactttaaaaaataatcaggattgttagaatacggctgtgtttagttcacattaaaattggaagtttggttaaaattagaaggatgtgatagaaaagttggaagtttgaagaaaaactttgaagctaaacacggcgtacattgaaaagtagaaggtgacgtgccatccat

SEQ ID NO: 62350 - DNA, 2578 bp, Oryza sativa
aaaaagtgctgaccaggccacctgacagtaactacaaactactcttcaattcttcagcattgccagcaacagcaatatgtacagactacatagtaccctgctcacatactactaccacactactactcgtagccaaggttcacagttcatcaaacctttggtatgggttaccgtcacccgcagtttgacggttaccatggtaaccacgtggttatcgtgaaaaccacatggtcacgtgataacccagtaaccgtacggttttgtaaacatagcagggtttacagtatgatctgcaatttcttttccacgtgtgtagtaaaaatgtctcgtcatttttttacctctcgctcagtccctcgctgcgtgcttcgttctacaggccactgagctgagctgctctgcacttgccctgcacttgctctgcttccccctcgacgtcgacgacgacgacgacgacctgctccctctcccgaacacggccagcctcgcgaagatgcgcaggatcctactcgcgcaccgccgctgcgatccccaccgcatggagccaatgcagctgctggaggacaccggcgctcgccgcctgaccgccgccgccgccgccggcgtggccgccgtgtccatcctgaagctcgcctccttccgggacgagctcttcttcacggtgttgtgccgctgcagcgtctgcttcagggagaggatctcctgctccagcgcctggatcctaaagctcgccgtctcgtagcccgacgccgcgtcgtcgtcgtcgtcgccggcgcgggcgcggaccagcttcctgccgtcccgcgtggcgtgggcggtgtccgtgtacgggctgctggtgctgagcggctggctggtggggacggcggtggtgcacccggggctcggggtgtacgcggtggcggcggcggcgccgccggagacggggacgaggagctcccccgagtgcatgcaccggaacgagtcggagcactcggtgaaggcgcggtgcgtgtgcagctgctgcacgaacagcgcctgcacgatcagccggagcggcatccggtcgttctgcaccgcctggatgcacgcctcgtgcgacagcttccggcattcgaggtggccgcacagcgacgccttctcgtcgccggacaagccgggatgctcctgcaatggcagaatcaaacagcttcacaacgttagcgcgacagcttaacggactaaataatctcgtgcacgcacgagtgctctgctcgatcgtctttaccacgatgtatgtgtcgattgcttcgtagagatggtcgtgggatttccggtcgccggccggaacgacgccgatgagctcggccagccggtccggccggagcttcgggtcaccgacgatctgggcgatgtaccgatcccagagctccgcgacggcctccgcgcctcttctttgcattgagacatggctcgcgacgatgctctccatcgccctcacctccgggctgccggcgatggattggccgccggcgtcttgctctggctccggcagcgggaggtcgtccacgcgggcgaattgcaggttggacgcgaccagttcgcgcagcctcgtctggctctcgtcgctgagctcgagggtgatcgaccgcgccagcagcgcgaagtagaacgacaccgggatggcgccgccggtcgccgccgacgactcgagtgggaggaggtcgatcacgccctgcaggatcgcggtggccctcctgttggcgtcggtctcgccgtcgccggtgtccgtgctcgccatgaacttgtgcgtcttcttggagagcacccacttgttggcgtagaagagcacgacggggctgacgtacttctccttcatgccctgacgccgcagcgccagcacgatccgcctgaagaactcgaaggggagggcgacgaggtccttgatccagaggtcgcgcgcggcgagctccttgacgagctcggcgtcccaccggcgcccggcgaggccgcgcgccgcggcggcggcgaggaggcccggctggtcgcgctcgcgccgctgctcgtcgccgtcggggtcgaggatctccatgcacgccatgaacgccagcgactcgacgcagcggctgacgacgaggagctcctcggcgacggggagcagcggctggcatcgctgcaggacgatgagggcgtcgtcccagctctgcagcaccacctggttgatgtacaggtcgcagcgcgcgccgaggccggacacgtcgaggaactccgccgcgcaccgcaccgccgccacgttgaacgggtcgagcgccaccgcgtcgccgtagcagtacagcccgatcacctcgaacgcctcgctgccgccggggaagctcgccggcagctcgacgacctcgccgtcgccgtcgccgcaccggagaatcgcctgcctcaagtacccgcacctggacaccagaggatcctgcaacgacaagatcacacacactcatcaccatcttcttcctcctcatcccaaccaagaatccctaattaatcttcacacaatctctcctaaccttgtgcaggttgaagctcctgtcgccgacgtggacgctcaccgtcgccggcggggctgcaggaa

SEQ ID NO: 62351 - DNA, 526 bp, Oryza sativa
gaaccggtctccttggccctgcaatccaatccaatccagatcaacaaccaacccaaccatcagaacccccaagggctccaaaattccaagctctaacactctgtaccatgaaacgaccctcctctgcaggagcaacgccgtgctcgggctcgagtaagggctaaacacggcggccttcgccgccgccggcgacatctccacctccacctccacctccatctccggctccatccctcgcagattaccagtactagtagcagtagagactagagactagagagataggaggagtataaaaccggagtggtggagtgagggaggaaggaacatcgggaggagtggaaaaggggtacaatggctgagggcgcacgaatgggggacgttggagttgaaccccagttttaaggctgggaaatcggatcgccctccaccccctcgtgcaagtttccttattccctgggcgcgcgtgcgttctcctctgcactgcactgctctctcctcgccaccacagggcacaggggggctg

SEQ ID NO: 62352 - DNA, 6583 bp, Oryza sativa
taaatggtttgaaatttatagtgtggtaggaagtggagaaagggggagatgtgtgcgtgttaggggagggacgggcgtgctaatcgcccaaggcgatcacccgtccattaggcttacccgttcccagttcctactcagaccttttctaaaatataaaaatagtttttttggactacaaaagttctttttttctttacaagtatggtaaatgcaaatgctaacaacttgcgcacactgttatagaaccggcctagaaatcacatcgataaccgaacatgtaaaaaacatcataggagatccaaacacgataatgacactgaggtacgatatttgttaacgagatttaatcgaagcctacaacctaagggcgttgattacgaatgctcctcccagatcaaacataattataacatattagagttataaggacccttgatttgatgtcatcggcagccgctccctctcacatatactaagttgtaatgcggtttataacagatgtatctctctatttaaaagagagcttaggatagagtccaactctaactttacctacacctattacaaactcctagtcctacattgtaatcgactacgtacacatattcgatacaaactctaacatacacacacctccctataaatatacgcgtacaccctatcactatgaacacctcaaaaagactgaattgtcacatctcaagatcggcaaagtcatcaatgatgtttcggtgttgatgagtgtgccgtctattactgaaagaataattagccgtaaatgcgagcacctcaagtctataacttgaaccgaatatattgattcccccacaagttatttaaccagttgctacgctcacttcaaaataaacttttgattacatggcaaagacatagcacaccactacacacgctgaaaagcagaataattatacggagtactacgaccttttattttgactacaaaaaatacccatacgttacaacgtgtgaagattattttaatcttattattgttatataatttagttaaggtgaaattcaccgtgagaattcacttggatatatatatatatatgtatgtatatatatatatgtatatatgtatatatgtatatgtgtatatatgtatatatatatatatatatgtatatatgtatatatgtatatgtgtatatatgtatatatatatatatgtatatatgtatatgtgtgtatatatgtacatgtgtgtatatatatacatatatatatatatatatataagaaaatcatgagctacagttaggaatctgatcgtctcaagttagcatgtggtatttttaaagagattttttatatgactcttttgtattttccaaaagtgaacaaacttacaaaccatctcaaatacgaatatgattttcaaaagtgaacgaacttaaaaaccgactcatacacggatgacgtaccaaaataccgataaaaacatctttaattttaatttttataatagtagagagcagacgcaccattacacccactcacacgctcaccaccctaacatctgtgtgtttccttactaagccatttattttacataaattttataataagctttataaagagatgaaagttattatattccccgtaaaaatgctgactcactaatgtgtcttgaaaatgaccattgtatacaaaagttgtgcatgaaaaagaggggaccacctacaaatcgggtgtccgacgctattccaccgagtagatcaaaattgtttcactaagtagatcaaaaatgtttcaatcgtttaaaaagctgaaacacaaccaaatcacctcatgaaacattttgcgacaacgtatgacacaacggtttttgaaactgtttcaccatataaaaaaacaatgtttcagcaaaataatggaatgatgtttcaattcactgcaacatttaatctatacatagtgaaacaacacgagtgtacttcctgaaacagtgtttgatggaacacaaaatgaaacggattctcttaatagaacattttcattcaaacacaaaatgaaacggattctcttaatagaacattttcatattgttagagtgcgcagcccgggccaccaatcatgggccacccagggtcacattgggcctactccaacacaggcccaaccggagtcacaactttaggtcctaggcctatacaacccaaaagattagtctgatgggtgaggaccaccccaccttttaagttgtgctcccccatcatcaattaccgatgtgggactaaacccaacaatctcccccgtcgttgatcacccaagacacgccagatgacgacacaggaacacacgatatttgttaacgaggttcagccgaagctacatccccggggctctggttatgggcgctcctccccaatcaatatagctcatagcccctacgagtccatggccacactgccatcatctccctgcgtgtctacgctacattgtagtcgccatggttacattgtggtgctcccctctctatttaagagagatgtcgggttatagagtctgactgtaactctacccctaacacctatttacaactccaagtctaactataaccaaataagactggtatattcgacacctattctaaaacgtgagttattattgcaacggcacatgtggtggggcgcgtggtaaggacggcacggaggcgcgggtagcgcccgacgcggggcattttccaaaaaagatgtctaaggattacgcgagaccgtgagagtgcgtacgtgcaaaatcagggcggaatttctctcccgtgtctgccacggccaccggtgcattgcatatgcgcacacgaggagcaaagctcgcgacctcgcgcgttgcactgccgcactgaacgatcgacggacgacggcagcgcgcggccgggcgtcgcgcgctgtaccgcagcgcgcaccgcaccaactgaactctgcaaggtgcaagcaactagcgtacggcgtagcgtcgcgctcgcgcggccgcgcctcgcctcgcgacgtacgcgcttgcgaattgaaagccttccttttcgtccgttccctgagaccctgacccgcgcccacccactcgccaagcgggagcgagacggagcggcgcctgcacccgcgcgcccgccaatggcagggcggccactcgtcgcgcggcgttgctacccgctcgccacggcacgcagcacatgccgtgcatgcaaaagggtgggttcttataaaaaaaaagagagagtaagaaacggagctgtagcgtcggtccaaaagtttgtttctcgagcagggagatcgaagagagaagcatttgccctgctgctgctccggctggccggtttaaattcgtgctgctgcattcggccgggtagctagccggcccgtggttgggctccagtaggacacgcgacatgcatgctccacgtgtgacgctttgcctgctgtttcgtgtaccgcagctgcatgtatgcgtaaagtttttctactactagtttattttttattgggcggacaggtcgtcacagtagagcatttaccgtcgagccgcgtactttttggaacagaagagttagatccacagtgttttacatatccagtcgatttatgtttgggtttgggaaatttcaccggtgtaaaaagcttctcacttcatcgggcaccgtcttctgtaaatttttttcgatatgaactttgataaattttgctcctcgtccaggcgaagaaactccggctttggctataggaaacggatggtgcatgcatctagtcccgacgagcgacgtaagcaagcgttcgcccggtcttgatgtgtgccacgtgctggagaccgtcgtcaccagcttttaattcatcggaaagatagcaaagcgtttgtcgtcgtggtttacattgcatcgtctggtttccctccgagattttgtatgtacatgcatgtatagtctcgtagaccatacatgaccagcaaaaccacgtgcggatatatcaacttttaggcggttttgtgctggctgaaacaatatgtacctcagctgagaagtaatctcgaaagcatgagtacaccaccggagtcggagtgtacatgcatgcatgcacggcaaggtatgaccaaaaagcagttttgacgcagattgatcattcgatctggtagtgaaaaacaaaaaaaaaaaaaggtaaagtggtgtgtcccggtgtccgcctatacgctaaacttaccgtggtgctagagtacaagcgagccggttggtggaggcgagcgcaaaagcgccacacggccttctgccaatgaggcctcacgccgtcacgcggggcacgccagccagccagtgaccgcggcggaacgcgccacgggggacgatgcgcccgaggggggcggacgccgcatgcagcgcaacgcgagtacgcgacctcgcctcacctcaccccaccatacgcctcgcgctgctggctggaatccaccggagcgcgcggcccgcgactccgctccgcctacgtgtcggccgcgtccccgcgcggtcgcccacgtaccccgccccgccctcccacgtgcccctcccccctgcgcgcatccgattggccgcccacgccttcttaaccccaccaccccaccactcgggccccaacgcatccgttcaccacctgcgagagcgagcgtaccgttcgttcgttcgtccggtgtacgtctcgccatggccatggtgcagccggtggacatggccgtgaaggccaacgagatcatggcgaggttcaggcccatcgcgcccaagcccgtgctgccggcggcggcggcgggggtgacgggtggtggtgacggtgctgcggcggtggcggcgacgaaccgcgtgctctgccagctgcagagcaggccgtgccgggcgcggaagcgggggcggcccagcgtagtgccgccggtgtccccgccggcgggggccaagaggaagagggcgccggcgtacccggtccccgtggcgccgctccggtgcgcggcggtggccacggcgacgagggcgcgcgtgtcggtggtggtcgtcccggccccggagagtgcgggcggggttagtgcgctggcgccggtgtcgccgagtgccggggactcgacgaggctctcgccgacggtggtggaggtggaggacgaggacgaggagaggggcgtggtgctcgtggagcgcgacctgctgcggaagctgctggagccgcggaagctgctggagccgcgcgcggtgcgccccgtgggctccaccatccacgtcgagtcagtccacatcgacgtcggccgcaccaccgccgccgccgccgcagccgccccgaagacggcggaggaggtggaggcggagctggagtcggactccctcccggcggtggtctcggactccagcaaccgcgtccggctggtgaacgacgcgtacaagcgaatggtggggcagcccgagtgcccgtggctcgacgccgtggccaccgccgcgtccaggaggatcagcggcgaggtggcgctggtagtgtccgagccggcggcggcggcggcggcgctgccggagacatgcaaggggttctcgtgctcggccaagatcgcgtgggagcgcgacggcaagtggtcatccgtccatgcaccgtgcgacgtcacccggctgcagtgcgagtcgagggactacgtcttcgcctggaggttccgcgccgccggcgacgaatgcaacacccaccgccgcgccgccggcgacgcgtgacgacgtgatgcatcaagccggagcaaactttagtagtgcatagatgtaatcgtgttaaggtgcaatgttactagtagtagcaaactagatcggctgcttcctcttttgcgaagcttataggatgcaaggccaggttctaaagtatatatgatgttgaccggagaatgcaagggaaaattgtaacttttgctttagtgagatttgtttgttctcatgtagtttagcactaatgatccatttgacagcgacaagtgattgcgtctgcatgcatggacatcccaggatagatgcatgcatggacaacccaggttagacaaatgcgtggtcgcaatcacattatccgtgtcgcgttatcaaacaaaataaagaaaaacgtcttcactgtcgtgttccaagagttgagagcaaaccagggcagaacaacacttaagttttgctttaacaacctaagcaaacaggtaaaggatctttatgaaatgatgtggaaggataatggtaaacaattttagtacacaggaaatcattctatttgatcacagtgcacgcttattataattgagagttggttgaggaacggtctaagcccacactcgcacaacagattggagaaaccaaaaacaacacatatgggggtaaacaccatcttgtgcatgtcctgctagcaatgtagcatgcaagattagtgctcaggcttgctctgccttcgggggacccctccacttgaagttctctgcataagatttggcctgcatgacagaaaaacaattggttaattacagggaagctactaacttaatgcacaacaacctggacggtatgtattaaattggtcaaaaaatctgggagaagagtgatatccccttcgtcccg

SEQ ID NO: 62353 - DNA, 730 bp, Oryza sativa
  unsure (1)..(730): unsure at all n locations
ccataagtgccgaaaatacacctccagggttgataatacttatcatttggaccaagagcacagtctccaaaaattaaccattatttttcattataatatgtataaaagtgttaccaaatatatgattttattaaagtactttttaaagaaaattccctacatacccctgaaaagtttcgcgatctcttctatacccttgagttttgcctcatcccctacatgcccttgagttttcattttgatctcctctatccctattccgttagttgaccgtgagttgactgttaaatttttctaaaatgaccatatcgcccatttcccattcttacagtacatgttatatactctacttcataattcacaatgtgaaaaattgtaactcatgataaaatcaaataggacataattatttattgaaaagaaaatttaaactattgaacaaatttattttttttgacaaaatccatataagagctttagctagaaattgtgaaccaaaattatttatttgttgggttcaaattttgatgaaaacaatgtacggatatcataaaagttaatttaaaatttatttttttttaaaaaatgttcccgggggtggcgaggccgaggagttgcaagagcctctctgcggaggccctgtgcaacctgaggagctggctggagannnnnnnnnnnnnnnnnnnnnnnnnnnnnnnnnnnnnnaggcgagtgacaatcagngcacgcg

SEQ ID NO: 62354 - DNA, 3840 bp, Oryza sativa
accggcttggcgcagagaagcgcagccgatggcaacggaggccggctcggcgcgagagacgcgggcggcagagatggaggccggcttggcgcgggaggcgcggccgatggagggaggccggattggcgcgagagacgcgtccggtagaggaggccggcttggcgcagagtggcgcggccggcagtggaggaggcgacctaggtgtgaggaggagctgctggtgggtgtggcgcggtcttcggcgcgcgaaggctggccggcgggggacgccggtgtaggggtcccacatgtcggcaaagcttgtgtggtggtggagcatcggtgcgtcagccgtggattcgcaggtggtgagtggcgggtgaaaacccagttcgaccttggtcggaccgacaacgatggttatcccccctcctgagggcgttgttgtgctgtctcacccctcaggcgatctcgtctgtgtccctttgttggtctagtggcggtcggtcacgcttagcggcggccggtccggtgttagccttctcctgggctagtgtgttggcgatgtcgccgtgtgggtggtggtattttttttcctttttcctggttataaccctccagggttgtaatcttgtaattttttcctgctctatcaatagaagttcgcaccgtctcgtgcgagtcgttaaaaaaaatatttcgatccctcgtttaggaccagatatttcgatgagggaaccctacagaaatattattatttattagctcatcaaagaaaataggacaacgaaatgggtcgttatgttatttttactatatatatatatatatatatattatataaagctgagtgaaaagtgaaacgaacattacacaaataataaagaacctagtatattaaacacatcaaacattgaatggctgccaagtgtataagattgacagagatagcaaaactaccagatagaataattcaattttatctagagttgtcaaatattaaattatggatgtttgtggacttattatgagtgaaaaaaatgatagtttgtgttgtgtatcttctattcctacaaattaatgaaaaaaatgtattatctgatagctactaaaggtccaaactattctgtttgattttctttgtaacacataaaacgtcatgcttaatttaattatataggtttatttgatagtataattaccacaaccaaaatcttggttagcattgtaatggcttacacaatcaactgtttctattctgctacttttgggtacgttgaccactttgaagcatgtttttgcagccataacaccgaaatattactataatagaaatattcacaaaaagtaaatatctaagcatttgtttctagccgaatgaggccacggacatttacctaattagaaaaatatagagttatgaaataggggataactggagatagcttttcatggccgtgctcccaaaaccacaataagttgtgctatgaagtaaaacactttataaatgtcacagcaacataaactaaccatatgtcttaaaatcaagaaaattgtgagtgcaaattgagcctatgtctaaacatcatgagcacagttattacaacatttccgttgattggatgatgtagaacagattaacttgcttttagaataccatcaaaattatctcctcttgttgtatgcatgtgatgatgacttcatattatgaaataaaacaaagtaatttaaaaaaaatgcagagtagggatgtgcaccttctccactatgatgggatcatccctgctagtatggaatatatagttgcgcaatggatccaaaaggtcccgtgctgctaagtatccatacagctctactgggccaccggtgacagcaatttcagccagttttagtgagaaaaagtgcaacataggacatggtccatgccttatacatgtttcaccatgcataacgcaatatttaggacctgataatatcatcgcctccaatcgagcttccccaatgatcacatgtcatattacaatcaatgcaacaattaatacggtcagcaaatacttggtacaaagaaagaaaactatacttttgcacatcaattgggttgcagaaaatcctgggtcaaaccgctttatattttttgagtaattctataaaaagaactacacatatttttgtcaaaattatcagtttgttgcaattttagttaggggtttcagaatactgcaacttgagcccaaacctgtaggtatttacagtagcaaatataatgattgatttatagcttgataaaatttgtaagaccaaaatagattttttttaaagaaaaacagtaaggatatctggatcacttactctcctcaagatctgcaatacgataagtccttttccactcgctattgcccttgtatatagaaccatcacggtgactgctatcttccaatataaacgcagtatttgcaattttagggggattgtaagaggagtcatcttcgctatcagatgacatccctgcctcttcttcactatccgatgcatcttcatcgctactggttgccatctcgggatattctatggtcttgtcgtgttcttcgctatctgttgtggtccttacattttctttacaatcacccaaatggtctttagttgccccatcatttttttcatcatctgtgggacgatcaacaccataacgatcatgatgactgctaatgcccatcttctgagatccaaaaaaaaaatctatcatcaaagggcatatttaaaagggctcgtcttagcatccatccatcacggttgaatcgtaattgtaatattgtccagtgactccagtctgaaatctatttttatatttcgttccaaaaaaaaagatgatcagaagaacttcaatttcaacaaacatcttaccttgttacacctccaaaaatcgatagaactgccagtcttctccaccatatagagaattaaaaagaaaagagaattggttacaatccagaactctaagactgtagctaaaggatatgctccctctgtaacaagtcaaacatttttaactttgactattaatagcaaaaaaaagatcaatcacgtaaaattgatgttactagatttatcgctgaacaaactatcataatatacaatttttttatttaaactattttaattttatagatattattggtcaaagtaacatctcgaagaccgtgtcggagtccaaaaatgtttatattttggaacggaggtagtattaactaacatgagaaggagaaaacacacacctgaggataggatggacaaatcgatcttgatcgggatcggtagaggacaatgctgctgccgtcagaagaatcgagcaaacattcagttggagatcagtctcaccggcggcggcgacggcggcggccgggggatctgccgatcttgggctcaaaattggctgcacttgcatggatcgatccaatctgcgtgattacctagtccgagggttggaaatttcggtaattttggtgaccctgatacgatattaattcggccgaaatttttgaatttttgaattttttcacaaatttggataatatttgttcaaattcaactaaatttctttgaaattttgggatttcggtgacccctgatagaaaaccctgaaccgatatagtgaacctctccgattggtatagcacggtacagttagttactgactcggaatcatgactaaccaaccttaacctcttcatgtcatatcttacgttgccacgcactaagccgtcaagcttgctagcccaagccgcgcgcgctttgcgtgatggacctatcgaccggcgccggctggtcgccggtgagctggtcggacatggtgttcgacctcct

SEQ ID NO: 62355 - DNA, 3449 bp, Oryza sativa
atatatataggacttatgaaatgacttagttaactgatttatcattttaaaaatgattgcaagactccaattaaaatcatggaacaaactgtttaaattggcaaattatgatctataggttctcattctctcttctagctaatcgctataacatgtatgatgtcgagttagtgatcatacatcaacgctacaatgtcactgttcaccgaaccttaagtgagttaccacgtctcgtagatggcaccccccgtctctaaatcctggcttcgccactgatcggacagcggcggcggcggcggctgcatcgttgtcctgctccaccggccaaagtaccagctctcgttcgcgcgggtgggcgtcgacgagcgctgggcttgggtcaacctgcccgactcggacttctacaccgacgtcgtctacaacgacgacgacggcatgttctacgctatcacgtacctggccgccatccacgcctacgacttctccggcgggccctccgccgtgcgccagacgatcgtcctagccgaccagttacacggcgtcatcgacagcgagaccaagtacctggtccgcgcccccgacggcgacgggtggcttcaggtgtggaggatgatgaagcccgtgcgcgcggccgcggcgcacgacgccggcggcgacacgacgcggacgacggcagtgtataggaagacgacgatctggatcaaggtgttccgcgtggacctcgccgcgcagaggctggaggagacggcgacgctgggcgacggcagcgacagcctcgcgctgttcatcgggtgcaacagccgttctgggtgccggccggtggcggcgacggcgagtgcccggcgggcggtgtgctgcccaaccacatctactacacggacaacgaggaggactacgcgctgctcttcccggagtcgcccagagacatcggcgtctacagcgtcgcagacggcagcttctcgccgttccggccaactcaaccatggctgacttggccattgccgacttggcttgttcccaatttcgaatactaccatcagtgttaagttaattaacacagagcagctaatttgtttgtttgattgattgattaatgttgcgtttcattgtttaaagctaggttttcttctctgatgtttttgttgttctataattctatttattgttcaatccacaatcgggctgaacgcgtagactaaaattaacagtttttttttcataaattttgtgctgatatgattagactttttttttacctgtatggatttgaccaatttagctacattttttaaagctagaatatttcttttaagggtccatgccattgaaaatgtggctattcagaaaaatgttattacaattcgtctattcatagccgtgctactccaattttataaaattagaaccatgctactgccgtcaccttttctatatatctatcctcttcctttccgtcttcttccttccttctccatcttcttcgcggccatcgcatgccgtcggcgtcgatgctggcgtcgagcacctcctagtccctctcgggaggcacagggagcgccacccgtgccagggctgcacctgacgacgacgacgactcccacgccgccgagggaggatcgatgtcaacggactgcaggaagcggagcgcacgggggaggtccctagagaaggcggaggagggggaggcgagaggagggaagggggcggtggtcgccattggcagaggtgggagagttgccacctgtggcggatttgcgctttctcaccgacgaggtcatcgacgaggtcacgagacgacaccggcagatttgcgctttctcactgccctccctctcctccgtctcctcggcgcagcacggtcgagtcatcctcccgagacacgccagccgcagtgccagtggccgctgccgacgcccaggtgtccgccacgccttcgctcgatccgagcctcgggatgtcggccatgggggccgtggagctcgagcgcgcgaggaggcttgcggcaggggggtggtagcaaggatcgcaagcaatgaacaagaaaaatcacggtagaccttccttctacaagatacgaaggctacaatggcaacagtacttcgccagcagtgtgcacgcaccatagtaaaaagagaaattttatagtccttgaaaaaataactggaggagtacctagtacccagaggtttgctaaacggataactcattgcatggtttgacatgatcaagccctgtcttttgttcaacagatagtcagtaagagtgtaataatttacttaatcaaaatttgctgctcgataaaccagattagccagagttaacttggcggtagtaaccaaagctaggaacaagccaagttggtactggccttgtcaaccatggttgcattggccggaatgacgagaagctgcagtctgcgacgctgtagacgccaatgtctctcggtgccgcggctctctggatcaaggtgttccgcgtggatctttccgcgcagaggctagaggagatggcgacactgggcgacggcggcgacagccacgcgctgttcatcgggtgcaaccagccgttctgggtgccggccggcggcgacggcgagtgctccagcggcattctgcccaaccacatctactacacggataaggaggatggcaacacggaggcgccgagaaacattggcgtctacagcatcgcagatggcagcttctcgccgtttcaggcaactcaaccatggctgacatggccattgccgacttggcttgctcccaatttcagttactatcgtcaagactaagctaggaagaactaaatcgacacggggcagctaagtttgtttggtgattactctctgtttcatattataagtcgattgatttctctttcactcaaaattgtttaagtttgaccaaatttataaaatgatatagtaaaattttcaacacaaaacaaatattttattagaatatattcaatattagatttaataaaactaatttgatattatatatgttgctaaacttttctataaaaagacgaacgacttatagtatgaaacgaaatgagtaattttacagtagttgagtaggtaccgtattttcttgtttgatccattgattagttgttgctgctttcattatttaaaactatatcttttgttttctcttattttttattgttctaatcatcgttcaatccaaatgttatctcttatttttgaatttttctaatcatcgttcaatccaaatgcaaggctgaccgcatagattaaaatagagtttttttcttctaaattttttttatgacgataagattggattttttttaacttatatggattgaccaatttaacgacatattttaaagctagaacatttttggttgaggaccctaggctgtgaattttgaacttcatatatatatgaaacaggggaggggctctgagagtactgaaa

SEQ ID NO: 62356 - DNA, 15007 bp, Oryza sativa
cgggacttgaatatgagtaggaaatttccaccacaaggaacctaaccagttgaactatgttcaattcaaaataatgttggatattaaaacaaccatttaaaccagtgaaaccattattttaatcgttagatctatcttatataagaaaaacaatcgtttattcatggtacatcacatttcaaaaatattattgtgcaattatattcacgttaggttgcgtagaacctcttacccactctacatgaaatgtttatagatggattgtctctcaaactatatcaatcatattatgctatataaaatttagtggagtttcatgtgccaccaaattcatcctctaataaaccatgataatatatatgcaataaaagaatgaaaaacacactacttttgctttacacttacttttactttcgttgaaatattatcatgatgtgatttgatgtttcaatagctgggcaggtcatacagtgtgggttggaatcccattttttaagaaccctgtttgcattggtgttgagcctgtctcggaacgctaaccacaaaaagatcctgcaagtgttggggatagccttgttccagataagtgttgccggctgccaaaggatgccatgataagtcaacaagttgtagtttgctgatgttgtgatatctgtggaaccaagcagcagtgttcttttgtcggggacattctgttgtatgtgttggtccaacaatatatccatgagggactgtaactcggtttgagcccgggaagagagaaccgggtgtagatcaattgtccaggtaccgttagtgtgttgggaggagactgtacagttgatatttgttgcgtacgaagctagtgtcggatatatgaggttgaatcgtcctactgctgtccagtggtctcgccaaaactgcactagctggccgttcccaatcgttaccttagtggaggcaataactggctcgataacggaacagactgtcttccaaatcggtgtttctgttggttttgctttaatagggatctcatttgccatgtgttgcgtgcgcaaccattgaaaacatggttctgatgagtctgataacaacttgcctcctatcttcataagtagagccatgttgtgagctctcaagtcacggattcccaatcctccttgttccttgttgagagtgatagttggccaggccactaaacattgacctccttttactttcttatcccctttccaaaggaatgccctccttaggcgatcaactgcttcgatggttttgtctggccacttgattctggacatgaaatagtttggtattgccgacatgactgagttgatcatgatgagtctttcaccccaactgagaaggcctgggatccatcctgctagccttcgatctattttgtcaatgactggtgcaagcaacttgtgtgagattttggacgtagagagtggaagacctagatagttacaaggaagcgggctgatggggcattgcaaaagctcagcgatggcccttgcctcgggttcattcatgtgtatgggtacaaaggtactcttgctgaaattgatctgtagccctgagaatgcagcaaattcctcaagaatgccgttaattatttcagcctgctcaagcgatccttttaaaataagtagggtatcatcagcgtattgcagcgtgggaggaggagagtgagaatccagtgggtggagtaactactcggagtggaaggcttgctgtatcatttgctgtaggacgtcagcgactaggatgaagagatatggggagagagggtcaccctgacggacccctctcctgtacttaaatgactcgcctgttgatccattgatcaatatgtgtgcttgtctagtttccaaaatctgtttgatccaattgatccatgtgtcgtcgaatcctctgcggtgtaggaccaagtataagcaatcccagttaactgtgtcaaaagcttttttggaagtcaagctttagaataatcgttggttttttccttttgattgcacattgaacaatgtcagaagctagtataaaattctccgtgattgatcttcctttgatgaatgcagattgcattggatcaattaactcatgaatttccccttgaacccggtttgctagcactttgctgataagctttggcagactgtgtagcaaggatattggcctgaaatctgttatgctgagaggggttacttttttcggaattaaagtgatgtaagagatgttaacccctgaaagatcggctgcattggcatggaaggaattgaacagtgcgatcaggtcaggcttaagagtagagatgaagcatttgtagaactcatttgtgtatccatcaggacccgagcttttatttggaggcgagtgcaggatggcgcttgagattatattgagagtggaaagagaaatttaaaaaggttaacaacaaatgttcctcaaatgaggataatcagaactaatgagacatattacaaaagcacaaaacaaagcccctccctgtgtatgtattactatacgatcagatgaagttaactgaagaaacgagttccattttttttttcgcttgaagaggtggtgaactagtgatgactagagaagttcggagcatttacaaaatattctagctttaaaaaaaatatagttaaattggtcaaatccatacaggtagagaaaaaaagaagtctagtcttatcagcacaaaatttaatttagaaggaaaaaagaaaagtcacactctatgcacagcccgacatttggattgaacgatgattaaaaaaaaatcagagacaataaaacgtagatttaaataatgaaagcaacaaaaaacaaccaatcaatgaatcaaacttagctgctctgtgttaatttagttcttcctaacttaaccttgacagtagtaaccgaaattgggaacaagccagatcggcaatggccaagtcagccatggtagagatggccggaacggcgagaagctgccgtcggcgacgctgtagacgccgatgtccctgggcgcctccgggtagagcagcgcgtagtcctcatcgttgtccgtgtagtagatgtggttgggcagcacgccgcccgccgggcactcgccgtcgccgccgccggccggcacccagaacggctggttgcacccgatgaacagcgcgtggctgtcgccgccgtcgcccagcgtcgccgtctcctgcagcctctgcgcggcgaggtccacgcgggacaccttgatccagatcgtcgtcttcctatacaccgccgtcgtcggcgtcgtgtccccgtgggtgtcggcagcgcggcgcacgggcttcagcatcctccacacctgcagccactcgccgccgtcgggggcgcggacaaggtacttggtctcgaggtcgatgacgccgtgcaactggtcggctaggacgatcgtccggcgcacggcgtgttggcccgccggacaagtcgtaggcgtggatggcggcctggtgcctgacagcgtagaacatgccgtcgccgtcgttgtagacgacgtcggtgtagaagtccgagtcgggcaggttgacccaagcccagcgctcgtcgacgcccacccgcgcgaacgagagctggtactttggccggtggagcaggacaacgatgcagccgccgccgccgctgtccgacgatggatcagacgacaggaacgcgcgcatgaggaggtactcggcgagctcaccggccttcgcctgggtcggtggccggtcgtcgcgctgctccatggtccagtcgtactggacgatctcgtagtcgtagtcatcttcgtcgtcgtcgtcggcggcggcggcgctctggctgcggtgcctgacgtgctcgatggtgtcgaccggcgggagcgagtcgatctgctggccggtgacggggttgacgaggcggagctcggcggagtcggcgtcggcggtgacgatccatccatgggagctgcccaaccatgacctgtcgcggatggggggctcagccggcagcgtgacctcgaacgtcctcccgccgccggcgaggggaaagatggtggcggcgcgggtgttgtcgtcgccgtcgcccgaggcagcagccgtgtagactaggcacggcggcggcgggcggcgggagaagagcgggtggcggtcgcggacggaggcggcggcggcgtgccaggagcagcagacggcggcgcagcgaaggaggtcggcggggtcgctgaaggtgtggaagacggtggcgaggaggtcgaacaccatgtccgaccagctcgccgttgccggcgacgtgaccatcgaggacgataggtctatcatgcgaagcgcacagctagctcgacgatgggtgactgtgatttgattgcgatttgcgtgcgtatgcgttagatatgcagttcggccggtcacgcacgattccaactcgatcggtaactgagtgtacggactatgtatatgcacgggatgaaaccggtattgaaaatcccaaccgcatccccttccgttttgtaccgacgacggtttcttccatgaccattgttgcggctggtatgctgttttggtacggaattcccgaacaaattaggagaatattttgtagcaggtgcccaatgcaaacaaaaataagagttaattgcactttagtccaaccttttttctttatattgcaatgttaaaaaaaatatatgtttcaataattaaaagaattgtgtttcatatgtgagaaagggaaagtagtttcaactcaactttgttgcacatttttaggccctgtttagttttcaaaacaaaaaatttaacaatgtcacatcgaatgtttggacatatacatggagtattaaatataggaaaaaaccaattacatatattgtgtgtaaattgcgagtcgaatttttaagactaattgcgtcatgatttgacaatgtggtgctacagtaaacatttgctaattgtcacgcagtttcctggcggaatctgcaatttgttttgttattagactacgtttaatactttaaatgtgtgtccgtatatccgatatgacgaccaaaacaaaaaatcttccccaactaaacaaggtcttagttttcttgttgtaatggatatttctttagtattgcacctggtattattcgaatgtttcgacaagtaatatcgtttgcaaatgttgcatatggtattttctcatgtcaagtccatgattcatggcgaccaccgcctccttcttccctcccctcacctccccctcctccgcctcctccagggacctccccgtgcgctccgcttcccgtagttcgtcgacatcgagcctctctcggcggcgtgggagtcgtcgtcgtcgtcaggtgcagccgtggcgtgggtggcgctccccgtgcctcccgggatggaatgggaggtgctggacgcctgcatcaacgccgatgacatgcgatggccgcgaagaagatggagaaggaaggaagaagacggaaaggaagaggatggatggaaaaggtgacggcagtggcatggttttaattttgtaaaattggagtgacatggttacgaatagacgaattgtaatagcatttttctgaatagccacattttcaatggcatggacccttaaaagaaatattctagctttaaaaaatgtagctaaattggtcaaatccatacaggtaaaaaaaaagtccaatcatatcagcacaaaatttatggaaaaaaaaactgtcaattttagtctacgcgttcagcccgattgtggattgaacaataaaaaactatgcatgccgttattttttggcctattctctgtcagccttacgaagatagatataattaattgactaattgactttgagttagacaatgtaaaaggtaatcttctttttgataatgatgtaaaaagtaatctaaacgatgtacatgctcctgtcactgtcagttaatgaaatcaactgtttgttcaaaattgttatgggttttcttacacagctttcattcaactctcttataatacactattagagaaacgataaaaggactagtaccatagatgccggaaatgtaataactgacacctacagtatttttttcgttcaagcgcgcgcctgtggggaaccattttcaagaaccgacacctatgtaatgacataagtgttggtttaaaaggaaccggtacctatgagtcttgccaaacataggtgtcggttcctattaaaaatcgacacttatatctaagtcatcggtactagttttttataaaatgattgttataattgagtcatcagtactggttttataaaaggtgcctatcgttagatggatgttgatgaatattttcttggattcgatccgatgcaacgagctggattttttttcattcctgaaacctcagtcctcctcattggtgccgcttaagggatgctggccgggaaaagtccggtacgtacccatatgggtttcctggccagctagcaccaaatccctttttaagtagtagcataaagttgggtgtgaagggtaaatgctcattatattgtccttactctgcatttgctttgataattctgcagccgaaatgtttctgatgcgcatttttagcgcagatgatcatgtcttggccagtgaaaacagattctacaacttattgtcctctgattttaaggggctggtatggggacccatatcgtgggctcatatataaatgacacaagtactttaaaaggagcttctttccttggccaatcgatcatctctttgtgcgatttgccggttcagacttcaaacttcaaagtcagcatgctactccttcgtacatccaggtccatttgtttaagaagagctatttagtcagaacatcgagagcttgttcggatcgacaccaatgtaaacttttggttaaagacgagatttggctactgtcaaaattttggcaaattaatctagtcaaaaggcaagagtatgtgattttttttttgaagcaatcaagtgtatgtgctttggttttcttgccgacgtttttggcaatgccaattcttttgcaaattgcaacaaacgaaacatatgtttacttccatttgcattactatttttggtatatggttgaatacggcaatgaattaaccaaacaggcctgttatggctgacgttgcttaaatttgtgctgagattatgtctagaccgtgtcaatcgattctctgtgaagaatgtacgtcctgccgtacatcgactttttcagcggctgtgtttagttccgaaaaaaagttgaaagttcggaaaaagttggaagcttagaaaaaaaagttagaagtttacgtgtgtaggaaagttttggatgtgatgtgatatgatggaaagttggaagtttggggtagttgagggtgaactaaacacggcctaaataaagtctaaggctgtaatctgttaattgatcttattggtgcagtttcgtaaccataccctaatcagattgatcttgtcagcttcgttatgactgtaggaaaggcttgctttatttatttatttttcctcaagagcaagcgacaagacaagatgggtgtttctcccttagagttcttagttatgcaaatagttattgttttttactgaaataattattagaaattttgagaacactatataaacattttagatcaatatataatatttcattctaaaaacggataagtttaaattcacaagaaatagcatactcatatatatgattgtgaacaaaacatgtaatatatcgttgatttctataggccctaagtcataggcaattcaataaatacatgtgtaagtggtttatcacccgcctgtaaaaaatagttgtgtagcagtgtccagacaacttggggggatattggttcaagtgttcaaccaagctcacttcaaaaaggttttggttcatgccctcttcagttcccaaagcaaaattttcacgatgtcacattgaatgtttggacatatgtatgaagtattagatataagcaaaaaaacaattacacagattacgtgtaaattgcaagacgaatcttttaagactaattgcgctattatttgataatgtggtgctacagtaaatatttgctaatgacggattgattaggcttaataaatttgtctcacagtttcctgacggaatatgtaatttgttttgttattagactacgtttaatattttaaatgtgtgtccatatattcgatgtgacaaccaaacccaaaaattttccccaactaaacaaggcctcagttcaatatgctagaacgtagggtaagctcatctttccgtaacggcgtgtttagcaatttaatggaaggggacgggaagtttagagggagatttggtgatggattggtcatgggagtttggtttttaatcctagtcccttgtttagctaaaaaaatagagtaataggaagttttgggaggaatcagattttaagtaatgatggatggcttagatctaattgtttgtacttgctacttagagaaggaactccctaagccatccatcattacttaaaatctaaagtatacacttagagggtgaaggtgagggtgactctgataccaccgccaccccagccattcatgcaagtattgtctatacagggagattggatggtggtatcagaaacaagagagttcaatctccctgtcccaatccatcaaaaacccccacaccaccatccaaagttccagacaaaggaactagagaagttttatggtttttgcgaggtacgtagaggtattgaaaggtgaatcaatgtggattattgattaagagaggggtaaggtatggaataaaattattgtagcttgtctattgtcgcctaaactgttgcatcattcttctatctaatctgctgttatttttatcctccgccttgtaaattagattaaaatctcccaagattaaccatgaaggtaggcttgttggagccacatcctgtaattcttgaaggaagagaagtttggcagcatcttcctatggaccataagcccctgttattgtccagtaggcatttgtttctctcatagtcaccttggctgttagggaaaacatacggagatcacaatgtgacaaggtaaaatagttctcatcagctgccaggattataccacccctagatccctctgcaggcaggaaaaagaaattgttctgaaaatttactccatttgtttcaattatgcaggccttatctacatcttgcagctttgtctcttgcaggcaaaccagagttgcattctgctgttgaaggagatttctgaccgcctccctttttgctggtgcattcagacctctaacattccagcttacaatcttgcaatgttattgaaacataaagctaagtttaaacactgcagataagtagaaccaagaaagaaaggaagaggccacatagaccgttgttttgctgcagcaaaagatagagcatcattcataaacataacctcctgagagttcttcagtgagttgtgcctagtttggtggaggtctaaagccacagagttcacagacaatacagcaaggcatccagcccgctttagcttagcatctcgataacttctgcagggaaccggcacccattttatttatgtaggcgccctccaggactccaacttgatgtcctttaagccggggtcacagctgcctttgctttggcagctttgagcttcagcttcttgcagccgcctttctccaccaaatcagcgatcatcttgagggagcgtggagtgagtttttttttgacattctcatcaaaagaatcaccttcactcataataccaatttttttggaaataatctcttgtgctataagctcaattttgcaaccattccttcttttcttttatagtctctcactgtgtcgttgagtagcgctaagcacaacttttggtttttttagtacgaatgcgaattgggggcgacatgaggggtggtctcaccggagttgtgagggaagcaatcaggtcagcagcactgttgttgttaacgtcttcggcctgcgttacaacagtccctcctgacagagggacatacacaggggagccctgcacgccatgttcgccctctggcgagaagctgatagccgcttcaacccttaggccatttacaatgcaaagacgtagcgttcagcctccacatgccagctcggagattcctctccacctaggcacttttcactccctcaccaggaacggggagccaaagtaagctccgagttctttctcacaattgcaggtctggcccacaacatcgattcccgcgtcatcaagaaacggagagagaacaagggaagacatcacagcgagctcgtcggatagttggctgcgccggcgacgcaacaaccatggatacggacgaagagaagggggggacggaggggagaagccgatgagcccgccatcgccgtgcgcagccgacgagcacgccgtcgccgtccacgccagatccggtgagcccaagctggatctggccgccccgctgccgctccgctcggcgccttccccgctgctccgcccggcttcggtggcctccccttctggccgccgctcgcgtcgccatctctctctctcctcccacccatggccgccgccgcccatcgacgccgccgcggcgcagccgcccgacgccatcgccgcggaggccagaagaggaagggggaggcgcggaggccgaaggaggaaggtggaagccggacgctgcttgccgctcgggccaagtcgtccgcccgccgctgccgcagtcatcgacgcccgccaccgcgcagctgcccgacgctgtcgcccgccgccgcgcacccgcccaacgccgtcgctgctcgggccacggcgcggaggccggacgccgctcgccgctcgcttttggtgagaggggcgccggatgggggagatgggcgatacggatggggagaatggagagagaagagagatgaaaagggaagagagagaggacgggtgggacccactatcatgtgcttgcgaaaataaaataagccacatgcactgtgaatcaagtgtcttctgtgttccttgcctagctggtacctcaggaacggcattttgcgacgacgcactgtgagtgcccttatggggtcctcttgctgttcctggtttccctggtccccgtgatggaaggaaaacaactcagctggagaagaagacagatcaatagcgagggatcccccccccctcttgggcttttgcttctgcgcggctgaaagtgaaattggggccctaacctcagtgtcgtccctagaacggcggatgtggtttatggtgatgtatgtgtctctgttgcgctggcatcccctcgtgtcttcattgtagaatccttgaccatctcccccacgctcactgctgtgggatctccccgtgatgcggccccacagtgacctggagcggctctggtagcgcggatgaggccgaccaccatccccatctgggtcttcatttggtccccgcaccgcactcggctctagcctgcacggaataggccgagagcccgaacgggaacgagatacaatcatcatagaccccgtaggaccactcgtattgcttgtacaacattggatgaggctggaggtcctccaaggtgtccaggtgaataatcaccggggacaaacatccatccttgggccccgacggtggggggttgtgcatggggtcgatgtcgggcatggggatgtcgacagggaccagctcatcatccggatttgccaaccccagccatgccattttggggatggcgccggggtcgtttgtctagatccgaaggtcgaaggtgcggttatagttgtggcgacgtgagtactcttcgatgaagttgatggcgcacctgggcccaatcagcttgactgcagtgacctcagtgcgcgcatgcgttggaatgccctcaatgcacagacgtgcccggaactggtaatgcataccaaatttgttatatgtttatctaaaaaaatgtgtctattccaggaaacaccattcatataatcaaaatagataactttaccaccacacacattagaagacggttttaacctgcttggtaccaatgttatccagagaagcagaagcacccaaatatcggccctattttttttttacatagagaaccacccaaatattgcccctattttttaacatatacttattcttctttgttggactatttgcaatcttctcccgtggtctattcctattgacgcgaaaaacacatactggcctgggagatctgcttagctcaagtgcaggaccaaaagttgatgagatgcaggcgtgccagtcagtttgactctgcaactgacaaggtatacaaatagcatatcaatgagccgatcggctgataagccgatagattaattctagccgatgtcaataccagccgataccgatagggttttgagctatcggctataattccgatgtagattctgacgcttgatgtaaataacaatataaaggcaatcggctgatgataatgtaggaaagcaacaatataatccattagaaaccaatcggctaacaatgatatgatagaacaagtgtccgaatgttaaagcatacatcggctggagatccgatgtcataaaatccacaaattagattaaatggtgaaatctttgttatcatcgactaaatccaacttacatgcaatccttgtaagccgatgcaacgtcgagatatctcatcacctgaaaccccgatgaaacccttattggcagtcaaaaagcaagctagggattatggttctaaacacggcttagtaaatcaaacttaactaatgcagcactaagtatgaaaagaaacacaatatctagacaatcaagctgttgactgatttttagggtggtagatgccttagctaatctaatcttagtaaaacaatttagccgataccggtagaaaccctaaagcgagagacaaccgatagagctaaattgagatactaagactagattaactaaacatatgataaatagccaggcaaatatatcaaccaaactagagcaatccaagaggtcgaatgtactgatatagccttgaatagcgccggcgtggacgatacaattgcctgagccggtgaaacattggacttacccattcatcggagatcgaaaaccaatgcagccccgagtcaagtgccaagccccaccgtcctaattaatagataacttgccatgccgcattctccttgaactcggtcacttctggataagtttcatttaatagattaatttttttaaccaaatatagcagaaatcctactataggcgatgtgataattctcttaggggcttaccaaatttcactgttaataattccaaatgccatcttcatcgaagactttgattatttgctacacgggtccattggaatatttctattttaccacttttaactgtcaacccatcaaatcgggaggtaaatgactatcttgtccttgtcttctttccactttctcatccctatctatggtggccttggacattggacagctcactcatctctcctgctgagttgctggcttgctgctcgatgctgaggatgagggcgcgacacggcgcgtgaatatgaggccgacgacgccaagaggctgcacgcagccggagctcgaaggccatacactgtatggacgttgattctaatgtgctaattaagctatggatgttcttgactatctcattggggggagctcaaaattaagcaaccggcttgaatcccttcatcaatgccactaattttgtgccggcacaaaatccgacaaccgccaaccggtacttgtggctatttctatcactgcaacaaatctggacttctatgacgattacctgatgacagaacacatatctgtcataaatagaggctgtttatgacgactgttcagaggatgacaactgtttatgaccaaaccgtgtatctgtcataaccatcgtcatagtatactctgcatgggctctgtgacgatagcacgatgacaataatggatcgtcataaaacacataactattatattttttaaaaaaaacaaaaaaaatcttgttatactacattgccactagaccataaatcatttgtcctaggtggactcttgttgtctacatcaattatagtctctcattttaggattttaggattttaggattgaagtcatctctagtctcattttatgaataaaaaaatcaaaattgtggcgttttattttatgattgaatgaaaaaacttaaaaaaacaaactaaaatggctataagttggtctaaattattctttgaaattttccgtgaattttcggagctcaataactaattttaataccacaaaattcatttaacctattaaaataaatgaaaaataaattaaaattcctctctctgtccttgggcctttttcggcccaagtattactctctccctccctcagcccgcggcctctctctccctcctcctctctcttcgggccgccggcccacccttttactcatccctcgctgacaagtccatttacctccctcctctcaaatcaaataactttccgggtagtaaataatttcaaataaaacaattgttaacaacaaagttgtatatcttaacaagatctacaacttttattttggtcatttttcaatatgactttgtttcaataatttgaatttgaattttaaattatgacaacttcaaacaatattttcaaatactaaatgatttgaaatgaaaaagtcatcaacaacaaagttgtataacttatcaatatctataatttttactttggtcatttttctatatgactttgtttcaataatttgaatttgaatttcaaattatgacaacttcaaacaacattttcaaatactaaatgatttgaactgaaaaaatcaacaaaaacaaagttgtataactcatcaatatctataacttttattttggtcgtttattcatctgacaaagtgatagtaacattgttcacaaaatttacatatctctcttatagtttataaaccatatggagatatgtaaaatttatgaacaatgttaaaatcactttgtcg

SEQ ID NO: 62357 - DNA, 738 bp, Oryza sativa
  unsure (1)..(738): unsure at all n locations
atttgcgctcacattcgtgacagatccctaggttttccaaattcctcnggtttntnnttnnnnnnantccaagggggccttaggtaattccggtaggaaagtgtggggaaccccctaatattatttccaccaaggcccataatagaggtggctactaccttcaattttatccatatcactcactcataaataaattaagagacaacatatatgatgtgtcacttctaatacataaatatcgataactttaatattttcacactatttttggagtttgtgtggaggtaacatgtgtaaaagaggtatattgtaggtgtatgttaatgtgagtgtggtatgaatgggttgtacgtactccctccatcccaacgtctcgactctgaactaaaaactcaactcctcccaaaatccctcgccgccgccgccgccgccgcggacgacgacgacatgggccccaccacggccaccgacaccggcgcgaggatgaagcccacgaccgtcgcgtcggcggtgcaccgcgtccagatggcgctctacgacggcgccgcggcgtcgagggagcagttgctccgcgcggcggcctcgatgctctcggggccggcctacgccgacgtcgtcacggagcgctccatcgccgacgcctgcgggtacccggcgtgccccnnnnnnnnnnnnnnnnnnnnnnnnnnnnnnnnnnnngtnngtgcaacgctntctagtggtgtcatcaaccccact

SEQ ID NO: 62358 - DNA, 851 bp, Oryza sativa
tttacgattaacttagtactatcagtactatttcataaacttcttcggataattactcagtagcatacccttcgaatgaatcatgacaaattatcattcaaatatacaaataatgaaactaaataattcaaatattttaaccaacaaataaatactacaatttctgaccaaacattatcaaaaccctaaatcacatacatataacattacaaaaatattttcctttcttacacactaaaataaattacatattattaaaaaaaataacttattacaaataaatggagaacgcgaccctgtcgaactgcggcagttcgacagcccagcctatcgaacgggggctgttcgacagccctgcctgtcgaacgggggctgttcgagtcctgtcgaacggcagccttccgatctcctcgccagtcgcgctatggccgttcgataggtgccctatcgaactgcacccgttcgacagagacctattttcgcgattttccccggttgaccactacttttgcgattttccataaaaataatattaattctcaaaaaaattcctccccccactcccactccctcggtttttcaccgcacgcgcacctgaaagaatcaaagaaacgcctccgatgcgctgcgccatgatcaaccaccgactttttgaccacgcgcgcgcgcgcgtgcaaagcgcccacctcctcaccgtgaacaccgtcccgtccccactcctcgccgcgctgccaaatgtacgtcgctgccacctgcccaacggtgaaaaaaaaaccccaccgaaacgctcccgctgcctccacgtctccacctcgcaccgcgccaaggcggcaacacccatgcccattact

SEQ ID NO: 62359 - DNA, 3108 bp, Oryza sativa
  unsure (1)..(3108): unsure at all n locations
ttgtagcgtagcgcagcgtgggagtactacactgcactgcatcgcgcaaccaaccaaccacccaccacaacacaaccctcctctcctcatcatcactcgctcgctcgctctcgcgctttgcggcaactggcggtgtctcctagcccttgcctgccatggtgtcgctagccggctcccagatcccgtcgccggggcagagtccgtgcgcggcggcgcggtcgcagcgccgcggcgcggggtactccatgcggaccatccggtcggcgctgctgcagccggactcctgcccgggctcgccgcatgtggcggccgcgtacgacgcggcgggggcggactcggacatggagaacttgacggactccgtgattgatttccatctcagcgagctggcggccaccgcggggcccgcgcaccccgcggcggtggccaagtcgtcgtcggccaacgcggcggccacggagatgctcgagctctcgcgggacttcagtgactactcgagcttcaactcggatatctccggcgagctcgagcggctcgcggcggcggcggcggcggtggtgacgcccagatccgacgcgccgcaggtgggcgccgtggatctgaatgagcttgagtcgatggatctgtccgtcgaggcggcgccgctggagcgcgtggagccgttcgtgctggcgtgcgtgcgggcgctggggcccgacgccgcgccagacgcgcggcgcaccgcggcggcgaggataaggctgctggcgaagcacaggtcggacatccgcgagctgatcggcgtgtccggcgccatcccggcgctggtgccgctgctgcggagcaccgacccggtggcgcaggagagcgcggtgacggcgctgctcaacctctcgctcgaggagcggaaccggtcggccatcacggcggcgggggccatcaagccgctcgtgtacgcgctgcggacgggcaccgcgtcggccaagcagaacgccgcgtgcgcgctgctcagcctctcgggcatcgaggagaaccgcgccaccatcggcgcgtgcggcgccatccctcccctcgtcgcgctgctctccgcgggctccacccgcggcaagaaggacgcgctcaccacgctctaccggctctgctcggcgcgccggaacaaggagcgcgcggtcagcgccggcgccgtcgtgccgctcatccacctcgtcggcgagcgtggcagcgggacgtcggagaaggcaatggtggtcctcgccagcctcgcgggcatcgtcgagggccgcgacgccgtggtggaggctggcgggataccggcgcttgtcgagaccatcgaggacggcccggcgagggagagggagttcgccgtggtggcgctgctgcagctctgctccgagtgcccccgcaaccgcgcgcttcttgtccgtgagggcgccatcccaccgcttgtcgcgctctcgcagtccggctctgcccgtgccaagcacaaggtaaaaccttttcaactttacattcctcttgtttgctaatgtcatatcgggattggatatttgggtatgatttgcaagatttctagtatgtcgattttcaagtgtagattttgggtttgagcttttggtgtgactgaagcttttggataattgtaccgaacagtatccaacgaattcacctgttagagtttgattgaagtctgattaccattataataagtactgaaaagtacattaaacctagacggaggaaaaggttcactgtgcacgtacctgagtttaggtagatttctactacctgattattatcaaagctgtttaattcagccctggtttctattaagaaaaccatcatgctagctaacacgcaatgcagatttgcagtacactagttgttgacttgtagattcttttcacatagtgcagatatgcactttattaattatacatatcttaggtacagtcttggatttgctaaaccttcgaggtacaagaggatgcacgttcactcttctgcaagtcaaaactgcagtacctttgctgttagcttggtccttcgatttaagaaacattgcttagttcttactacctccgtcccacaatataagggattttgagtttttgcttgcaacgtttgaccactcgtcttattcaattttttttttgcaaatataaaaaacgaaaagttgtgcttaaagtactgtagataataaagtaagtcacaaataaaataaataataatttcaaaaatttttgaataagatgagtggtcaaatgtngcaagcaaaaactcaaaatcccttatattatgggacggagggagtaaacaataagtatattaattatttatatgacaattatcattttgccaccatagtctagcctgtcgtgctttatctgcctagttgtacagtcggattggaaagagcacccccgaatgtgtgcttcactagttagctatctagatttactgaatctgaaatctgcttccaaattttggagacacttatgtttagctgtgtgatttgcaggctgaaactttgcttgggtatctccgcgagcaacggcaaggaggtggtggctgcagggttgaacccgtggcagcttcgagcttggccaggtaatgctgtaatcatgtggtcgcagtatgcttcgctcttatttaacctcgtgtgctctgttcttggagaatggagtagctgtgtaaggaggggtagagatgatcatctgtaaataacggttgatggctttggtttggtaatgtgaatacaaatgtggtttgcgagtgacggatggttagttggtataactaacatcaactgagaggaggatccagccatccagggggtggggacagagggtttggattgttggtaactgctaaggtgacgttgaattttagatgtgtacaggatgctagggtggtatgcttgcttggcttggaaaggttataggagaatgatggatcatcaaccatgtcttttttccttctggtttggagtccgaattcccctgttccaatttatctagtgtgacttattttgcaaatatttcattattctctttgctccatgtggtttcctttcttttcctgttgaatcaagatattctcaattgtgatgaatatagggctgcaggaatt

SEQ ID NO: 62360 - DNA, 745 bp, Oryza sativa
tgatgttataaaagacataaatcacaagtcataaaattataacttttatggatttataatgttataaaagacattgacttgtgatttgattttcgcagcggaaacagtgccaccattggtgccatagttctacggtgcatatgctactgtcttcagtaacgcgttcggcgttcggccataccgtgcaaattactttacaattcttgtcttctgaacattcgatttcgaaattttgtttttcagactgagaccgatcgatgtaaaagcagatgggatataaagtttcatcaagattaactgctgattttcttaaaaaaaagaaagaattaattgttgattacttccttcgtctcaaatgtaagcatttttaaggtagtcacagatattaaaaaaactagttgataccccgcacgttgctgcgggatatatagatatataactttgaagaattatggctccagcaaaggttttaatattttgcaattcaagatatgagctttcttaacgaaacaggcatagctgcaggccttagcaagcatgcagatgaagttaattactttgacaaaaacgaactgcaccagaaaagtctgaacagaaacttgcaaatgtaagctaccaggggccaggcaaagtaccgattgtagctaacatattgcatttaacccacaagattagtacagtttgttgacaaaaggaaatgaaattctataagagcatttgaattgtcgtgtctgggctgcaggaa

SEQ ID NO: 62361 - DNA, 21103 bp, Oryza sativa
  unsure (1)..(21103): unsure at all n locations
tactagaaacaaaccctggaacagaatcatgcagatttttattagaaaccagcaacatgcatttagtttacagaaaagtagcatcagacagacggtcaaagagagagaaattgaatgagcacaaattgaaaaacacaagcagaagtgcaaacacaaatacaccaccataagacattcaaacagacacatgattgaactagttaatactatgtagatggacaaataacctgatgaaagtgtggagataataggaaagtgaatgaaataaattaacttcgaaaactcagggttcacacttaccttgcagagagtggaatgcatagaacatgacatatgtggaataaataaaggaggtgctaaaagatctatcagtaatttctccacaagccattttgttcccatcatttccttattctttttatgtaactttttgtgcattttctcaacccaaccaggacaatcaaatgaattatgtccacaaatgcccgatgaactacttgaaggtaccacgtatcaatgcatggtgaatggtataatggtagtgctgagctactaaaaccacatatgagttatctcatttgtctcttcttcccagtattatcggaaacggacaagcgagttggctcatgtgtgtgatttcggaaagagaaacggcatgcaagatactactcagaagacgacaaggttgctgaatccgagtacgttttagatttggggtgctcaattcggcaaaaaacaattggccacatttttcaggtaacactgcttctttcaccagacaaacttaaccactacaattcttgatcagcacggcaagttcactggaaccaaatatactgatatgctggaaacaaactaagcaaaggatgcccaggtaggattgaaatctgcctaaggccagaactaataaccaccttttcctattagagctgatgagaagacagctcattctgcagtggcatcgttaataattaccaatttcctacagggttacataccacattagccctagacaccaataatacacatcagatggaaattttattaaattattcattcagccacccttccagtggttagaacattgcattattaattggatgccatatttgtaaatcaaacatgtatcctatgaacacaagggcagaatgtgaggcaactgattaaatgtgacaagttcataaccacttcaaagtctgcactagactaaacagaatagcatggaagaacagcatgcaaaaattatttgcatgggcacactgcttcactcatgccggtagctcacgcggtcatgtcctcgcaccactccaattcaggatgcatgccaaagaagctcgaccaatcatcaatcgcatctttatccctagcactgtcctaaatccacacaactcctacagcactgaaacatcaatcttgcctatacctacaagtactacgccaatgattgaacacagtaaaacttcaattgcaatcatgacgctacaaaattggacattattcctaattgatatgctaccgcaacctcgaatacacgcagttagctaatcgcaacaagctgttaatcaactaacatgttctcctccaactaacggaaagagtaacacaccgtggtctttggcaaagctcaagaagccgcagaattcagcgagaaaaaaaaaatcagacgaacaaccgaatcaaacgaatcaggcgcagcaatcacagctaaaaacgagaggagctagttcttcttccccctcacctcacagtaaacgctactatcaaagttgaccaaccaagaaagggaacccaacccaagctccctccagattcagagccggcaacccaccaaagaaccagccaccaaacccacccaaatccccaaccctgaaccgccccccgagggcggagcaaccaccagcgaaagaagaagagatcacaccgagtccaatccatccatccacccacgagagattccgggcacagatcggagcaaaaagcagcgaactttcggggagggagggcgagagggcgccgaatccggcgtcaagatcgcaccttttcgcgtgccccggcgccggggaagaagagaaagccggcggcggcggcgaaagaaatcgcggcgaggatgggatgtaagaggaggagcagtagcactggcagcacatgcagcacagcgtgtgtgagctggtgtggtctcccgcggtgcccttaaatacaccagctttgctagttgctactgctacagaagagagccagccacatggtcgtcgatgcggcagattcctctatcgtctactctatctttatctatctccgtgtgttcgtcgtcagaacgcgcgtgttagaagaagagggggggaaaaggcgtgtgcttttctctcctggttgtagcttttccttttttaattaagttaattgattgattgacagaggagcaaatgccatgtgccaatgtatgtgtgtttgtttatcaggaggatgtagagggttgtttctataattttttttatttataaaagtattatatttattacattcgtattataaccatattataagtagcggaactcaaaactatgtatatagtttgtaaatgcgagaagtcaaggtgttgctaggagtaagggtgtgtttttttaaagttataggtagattttcggcgacacgtgaaatacaagaaaccgcatatgattaattagtattaattattgcaaatttaaaaattagatttttttgatttttttaaaaaagaacttttacataaaaaaatttatgtgctaacggagatggtttgaagttgatgaaaataacgcaggataagctagtgggctgggttcctacccgggttgctcaacagcttcaaaattaaattctggactgaattatgttgcttctttctcaatactaatatttttggtattttacattttgtctgatgtagtttatgggcgtcatcatttaaaatatttataaatatcattgcagctcgttgcgtgagtctgaaaagttggttccactctaacgtggcttatgttaaggtaaaaattaatctaacaatatgaaggtttagaaggttcaaaatttctagggtataatttgacatcagggaggtataaaattaaattatatcagttcttatggcatgatttacacacgtggcatggatagattcaatgcatttgattgattcatccgacttttgacttagcttctatcaaaacaacaatattgaattggtcaaattataggagattgggccatcaaggatccacgttgactgacaaggcttagaccgatacctcaagagaacatattggtaattaaagatcatttatgcatttctagagcctttcttgtatggataggtcaatgtcaaacatttagatgataatggtattagggtgtgcaccaccatatgatagaatgtgaaggaaaaaagtttcacaaaaacgggtcatacagattcaaagttgaaatggactcatgatgtccaaaatgctcattttaattaaattgcggtaaccgatatatataattaaatggttatggagattactgttacacattgatcatatcctctaaatgccattttaacattttcatgatatgatatttgttatatgcttagaaattacggagatttactgtaatagaacctacaaaagagttgaaggtaagatgatatgggtaacatttagacgacgccttttattttaataccaatttaatatgtacacatgtaactctaacatatatatacctgtagcgtattacaaatactatacaacatatggttgtaataataacctaaaatatttctggtgtttcgatataacgatgcaataaaatagagtgagaggggagacaggggaattaatagaagaaagaatatatggtcttgatggctgtgtaccaaaattcctgtgaaatcgtaggacagagagggagatgtaatgggttggtgtgtgagggtgaggtggcaggctgagccgttggtgagggaggaggtaaccacaccggcgctggcacccggttttaatttgactgaccaaacgcgccgtcgggtcgggtcggctttgcattgcattggttggttcacatcacatgccactgccctgctgtccctgcccctccaattcttctcctcctttttcttttcttttgtttggaacacaatcaaaacgaaaagttcctccaattctttaattttagtccatagatgtgataacacaaaaatacattatattcagcctctttaagattatggtttttatttaagggaagatattctgcgtatataagttttgggtgtacttatgaatgttattaaagttttagaaaaaaattatacatatactttcaatagtattatagcctcatcttcagtagttatagttggcttctgaactttagttatactttggcggagtatatcattgtctttctttcttcagactgaatttggtaggtttgacatttttttaacaaacaaaaactagttcttccactcttgccagcctctacattttctgtaggagaaaaaaagtacagattgtgttagtttagttagttgcatgcttggatggtagaacaaacaaacacctaataggatgaaactattctgaaatgatcatcatagggatgaaaggaatagacagccatgagttggaggagacgcgcggcacatccaatccaatcatgatttgcatgtgggttagctctcctggctctgaattttttaatctcatttaattttcactctgcaaacaagcttgaagagaatgtcttatgatcagcttagattctgtttaagctgacggagattattgtgattgaatcttttgtatgcactattattcagaaaatccaaactcctcttggttgtcagtctcttgtagattgttggaattttgggttgtgtggacgtttcctgggaacaaaatcaggtgtttgatactccaaatgaatgcgaccgacaaattgagaatgcactactccgtattatctttttgtgtagctctgaatcaattgacagagtgagaatatcttctacactctttactgacatattgttgatcagacatggtctacaatatgtgaaaagtttcttactacatcagatcatttcttgaggatatatatgatgaaaagtagaaaaccactaactgttcagttgttcctgcaaatctatgaacttgttcttgataatcttctcctcttatgtccttgcaccttttgtgtatgcaagcgtgccagttaagctctacttaatttttttcacccaatgcttgcttgcacacgcataaagttaattcttcttttgcctttttgtgttagtacactaatgctagtaagatcattgctgtcaatttcatggtatgcttgtgagaccagtaactttaaatctctcatgtcatgtcctcacatgggcatttcggaaccaggatatcactggattaattcacacaaaaggagagcccgctatgtcaaataatttgtgaatacaacatgacatgttcttcactatctaaaagtaatggctttaaaaataaacttctatgaaaaaccccccaaaatcaactctaaatttaaggttgaaaattcaaattggttgataagcataagcgaaaagatgaggttgtaatttgtttgagatccatttttttaacactattaaatggcaagttcagcttattgtgctggattgcaacctgaaatccgactgcatgttcggcccaaagacagtcttgtgctttctatggcctatggacatgaattaggctgtgcccaacatgaggagcagcagcagacgactgataaaatctttcgcaaatcatcatggttggcaactgtcatgaggcctaaggcagacttaactgtcatagatattctaagatatttgagcaaagattaggaaagacaagattaagtgacaggccaaagcaggcctaagaaggttcagatagctcagcatggttggtaaaccaaaagcatcttctttaaactccaagctagtagcatgacaagttggattgccagcgacttggacaaccgattttatgggatgcattctgagctgtcagtgaaatcgacagcttaccttggatgcactctgagctgctagtgacatctaaaccctccttatttagtttgatcaccaaccaccatcagacttctaacattcaacatgtgtacagcatcaatcaacaagtctcagttggaatagcaaaagcaagagtcctaaagggcgtggtatcatcatggaccaacaaacatgttgcatgctcaacttcaaaaggcacaaaggtcacttccagcttcagcaaacacatgaactgagcactcacagatcaccagggaaccatatagggatagaataaccaaaacataggaggtttcatttcttcttctcaaagtagtgtagcatctttccttctttcaccattacataagcttaagcaataacagataacaaatcctcctcctcctctaggtaaaatattcaaacacaatacccttataagtacttattattaggaaagtagcgtgcatgggcataaatggcagcggggggcaggttaagaatcacaatgctgagcagcgaggaaacaaaacaccataatgggacagagcaaaagcctccgaaagggagcttttaggcagaaggcttctcccacttgaggggcttcaccacctcccaggtgaagtctgggtcgtcccttccgaagtgaccgtaagccgccgtcttgaggtagcgtccgttgccgcctttcttgaggtcaaggttgatgatgatcatgccaggcctgaagtcgaagttctccttcacaatcttgaggatctccttgtcagggatcctgccagtgccgtatgtgtcgacgaatacggacagtggctctgggacaccgatggcgtatgatacttggacaatgcagcggcgagcaaggccactagcaacaatgctcttggcagcttgccttgcgacgtatgctccactgcggtcaaccttggttgggtccttgccagagaaggcaccaccaccgtgagctccccagccaccataagtgtcaatgatgatcttccggccagtgagaccagcatcaccatgaggtccgccaatgacgaagcgaccagatgggttaagatggaagattgtcttctcatcaaggtactgctcgggaatgacaggcttgatgacatgctccttcaggtcagcagcaatctaatggtggggaccgtcttataaggtgggtagagatgaggacggtgtggacacggacagggaccctggcaccgctctcattgcggtactcaacagtcacttgggtcttcccgtcaggcttgagccatgcgcaggtcccattcttgcgaacctccgtaagacgagcgcccaagtttggtagcaaaggacatggtgaggggcatcaaatcaggggtctcatcagttgcatatccaaacatgtgtccctggtcaccagcaccaatctcctcagggcgcttggtgaagtggccggtgcacaccctgtgcaatgtcaggggactgctgctcgatgttcacaagcaccttgcagtggtcagcatcgagaccgacatcagctgacacaaaaccgatgttacggcatgtctccctgacaatcttctcatagtcaacgttagccttggtggtgatctcaccaaagaccatgaccatgtttgtcttggtgcaggtctcacaagcgaccttgctgtcagggtcctcggcgaggcaggcatcaagcacagcatctgagacttggtcgcagagcttgtcagggtggccctcgttcacagactccgaggtaaagaggaaggtatcaagtgcggccatcttctcctatctgcataaaatggtatttcacatactttagacaaagaaatatcatgaataaaatggacatggtgagcctatgagaaaaaaaggggtataagtgatagctaatgtgagggaagctgatagcgacaattgatttctggaaatgcttacataacacactgagaggacaatactgatccctagaacaaatggtttatgcaacaaaatttgtcctgagtaaacaggttaaaaaaacagtagcaaggaacaaaacattccttttaatcctctatatagcttatgtacgccaagatgctgttttgttggcacctgacaagaccacaattttgggctaaaatagttgtccctacaaagagttgactaagttcctaagttccttgggcaagtgttaggtatttgtaatattctctacaagcgcaacaagcaggtatagagcacaaggaatctaacaattttctgccggaatcagcataaacgcataatcaatcgtggtgccactatgtattgtaactatcacataaatataccacttttaggggtaaacatatcatggagacctggaaaaaaagagcgaaatcgctggctagcttttaggggttctactatactctttacatgtaatctttccacaaagacaaacatcataaatcattgaacatgcgcatcaactaatcaagagcataaaacaacagcagaaacatatcaattcgtcttggcatatttaactttgaagtggcaccaatcaatttttttttccattttccgttcatttataagaattccaactcccaagaccaaggggatgactcgaatctaccgcagaacagtcaaatgagctgacagccaaagacataatactagcactaaaaccactgctctagcatgttgtttatcagcaagccgtttgataagcatcaaggtattaaacatctaaaaggaagtcatcctactgcttctctctccatctccatccataataataagcaagcatgacaaaaataaaacttacaacacctaaatccaaccaaagaaaccccatctaaatctaccataccacaagatcgaaagaaaagcaataaaccctccttataaccctcccaaaccagcacaaacaaatcaatatctaggcacgatgatacgtccgcaagacaaccaaccacgagctcagatccaacctgagagcttgatcctaccaagaacgctaaaaccctcctctcccttttcaagccgcaagaatgaagggagaagccggacagcagcagcagcagcagcagcaacacacacgcgacaacgctaccagcaacgaggacaggggaatcggcggctcacctgcggcggcggtggcggcggcggaggaggaggagccgggccgatccgatcggggggaggaggaggaggtggaggaggtaaattaattagatccgaccgggcacggcgagatgggccttggtctcgcgcggcccatttataggccccccctcaccacgggaggcgggtgggcgcggccgcacgatgggattcggtcgggatcggacggtgggcgccgcgcgacgtggggagggaggagttgggtggcggacagcgacccgcacccaccaacacacgcgcacacactgacactgacgaggtgggccccacctccgggcggccgctcgcccgccaccaaccgccggtgggccccccctgcactggccgtggtgctgtctgcggccgcctcgtccacgcgtgattcggtcagggactttcttttcatttcgcctaatttaattcgatttttatttttcatttagacactgttgaaatatattttttttcacagactattgagacggattgtttaattgattaataaaaaaatatattttagaaaataaacttcagaaataacttcatatagtagaagaaaatattttaggaagtaaatatttttataagcgtgaaactaatccatgacccaaaatttggggaaaaaaaggggggggtgctgttttggttaagcgagagtgcatctccaccggttcataataaaaaagacaagaaaagagtgcttctctaccggttcaaaaaataaaaaaacatgagaaagtgcagctctaccggaaggtttgagagctggtgataatgcagtacgatttgagtcagagctagagagtcaacttctcataaacagggggagcatgacaaggtccaagttgctccttcgcctttcttactactagtgcctcttgccttgtcgcctttcataaattatcacggctacatattttcttcatctaaaaatataagtcatattttgtatctttaaaacaaaactttgacggaggatgttgcatataacaataatgtgaaaagtaatgggaattgtactagcaacactacttgaagtcaatatgccccttattccttagcatataggccgagtttagttccaaacttttttatttaattaaatattttctacacatacaaacttccaacttttccatcacatcgtgccaatttcaaccaaacttctatttttggtgtgaactaaacacacccataagcgttcttggataaccaagtctagaagaactactacaccccatcacgacactggtacttctcatggcgtgtagtcaaccatcaatgccgaacagcgcgacaaggtcgaggtttgtcgggtttgcagaaatgtatcttatgtgaccaacacgagaaaacaatcgaccacattctaatccggtgtccaaagacgctccagctatggtggatgatggtcttgcgtggtattggccggcctcaccgctttcaggcaaacaagcaatccttcctcctctcatggtgtcatagccgggaaaaaagcgcaacggctagaagacgaggattggacactgtcgatattctaaagcctagacaatttgaaaggagcaaaataaccgagtgttcagcggtggttgcaaaaccatactgaaagtggcggagctagagggaagcaagagtgccaatctaggcccacttggtcgccaaatgaactgcaagacgtcgacctatgtgtatatagttgatttttctttttctccttttatatggttgctgcgcccgtgtgaaacatctaatttctgattttaatacgaagatacggactttgcgtattaaaaaaaaattgggcatgacaagcagcgaaaagttcctataattcacggcagatggtaatctcgcattttcaggatgagttgcataagcatttaaaacacctaagatgatcataatttagcttgggaataaggacagaggactctgtccacttgaaaatgttgatataggtctacatctccatttaaactggagacaggtgtaggcaccactaaatatcgcatctgtgaaggttgtgtcgtacatagtataaattggtgctgagatcttgcacatgcatccgatcctacattccagatgcccccttagttggtgacaagcactgcaattgccagcctacgtaccacaaatcgaattgtctctctaatatttttcaaagttattttgatgacaattcattcatatcgtgttactacatgaactaaaattatgtgttatcttgacaaattcccaactcttaatttatttgtgtttgcttgatttactcttatctgtttagctaatctagggtctgagagaagaaaatataatctgacttttctactccattcatgcatgatttgttagtcatccattcctgtcaactcatttgtcatggatcaatctacaccatcacgtgtttcacgaggcagcatgaattccactaatcccctttctgccgatcgagcttggcannnnnnnnnnnnnnnnnnnnnnnnnngaaaattccattgattgctccatcaggttactgattattttttatatatgcttatcttctgttttgacattgtctatagtttggttgctacaatttctgtaataattggccttaacttctgctgaagcaaagactgggtttactcgttatctaaaaaaataaaaataatcaggctatcgatcagcggcaaaatgcttctcacaatccgttgctagttactactgaaattcagagaaagaacagcagaacagcagtggcgatgcattcagacgccagcaggaggtccagcaactggaactgatgatgctggtgaaagatcccggaatccacctgattataatctggagttttggaatcataattatacagatgacatgacgccacgtgtgcatccaccagattatgtggagtgagtcattgtgcatctcaactaccaactctcatcaatcttggctgcaaattgaccataaacgaatgcatgattggagaagaaaaaatgttgcaggcgtcagcccaagatgacggaccggcaatattcagtttcagtttctctgaacattgttttctttcccaccttgtgcaatgatccacatgtaaactgcctcaaaaagaatcatcaaagcagctactacttgaatttctactgttctatcagagaaagattactgcatctatatatatatatatatcagctccaggctgtgcatgtaaaaatgtttgaaatcaacaattatatgctaattttggggttttattgggagagtagtgggctttgcccccttcccgctggttggagtcgtagtttctgagtctttttttcctttggtcttttgtttcccacctctcttggtataagtcggtctggcttaatgcgttatgtaacaaatatttttttattctaatatattgacgtgtaatttttttttgtgcgtttgagaaaaaaaagttcagacttgaagctggcgatgccttttctgaagtcgtctccaagctaaggtaatcagtctggtgtggtgactggtgttgcgtagctgagttaggtagcatcatagaaaagtacactgaactgattaaccaacaaacagcgagttcacctaccaaaccaaaccaaaccaattcagatattcagagaagctggcaaaaatggaccgaccttacatgaacgtccagcaagcaggcaaaaacaatctcaccttcttttcttttttaaaaaaaagaaatcaaaggctttccatgcatggatgaatcaattagaaaggcaacaagtgatgaacactaccaaagaaagcttcagcatacatcagcattcagaaaattcagagaaggagggttttgctagagttggagcaggagctccaagagatcctcctccaacccactctcacctactgcatattcattacccctgtcttattcaatatcactcaaaactaatcaagaaagctaattaagtatttctgtcttaatcatttcactcaaaactgaaccacttggtagttggtactcccatttgtcacttgcatacaagaagcccaaacagtggcatttttcctgggctgttcttggtttggggtccagtggaagaggtgtcactggatcaatcacccaccagggcccatctgaaggcccaatctctcatggccctagtagtttcccgtggatcgggccaagattccagtttgaagtggaccagataaggcctccaaatgacatgggcttcatatcggcccatttactcttatggtcggtatctgttcaatatgtgggccacaccagaaagaggtctaaaaggctcttagtatgtgggccaacccatttacgtgattgtctaggcccaaccaagttcttgctgctttttccttctttatttctttgattctctctctatgctcttctttcataaagagctgccccttttatttaaagcactgcagtagaaacaaaataccgtgcagttaaacttaaactagaaattatgataccttctaaacttacacggtacacaaatgatctcttcagaggagaggaaaaaaaattaaaagatacgcaaaacgatattagtcattacgtatgattaatatagtattaattattttaaactttaaaaataaattaataggatcatttaaaatatatttttctgtttttaaaacacacatggtttataattaaggatcaaaatatagtgttacattcttcagagaccaaaggaatttgtgtgcagatctgtagaagttcatacgtactagagataaaccaaaggaatgacaaattacagcaaaaataatctctctttaattttccaggccaaaaatctctctagctaatttgtgaaaaatacgacagcgaatgcgatgcatcgaaatatcaacggaggagtgtgtcttcagccttcacggtggtctgggcttttcaattgcgatgtatctgattttatatatgtcgggttgtgcaaaatttcaattatttcatcggtgaaagctagactgaataacaagctagcttagcatatggttggtggccaggagcttttcttcagtagtagtacgtacgtgctcaaggttcttcgttgacaggagaaaagatttttctaaatggagatcgacgctgcaagaaaaagtgacatccgacctgttattcttgattaatcacccattagatcgcatcgtcgattcttctttagtttatttaacacgtagtgcagtgatgatcatgataaatttggcacataattaagtatgtattatgtcaaatcatagctgaatgcatgtatatagctgatggggcagttcagaaatggtattgctgaagctaccaacttagtgcaattccagagaggtaacttgttgtcatgcacacaaagagtcacatctgaatggttaattatgttttctatcggtatcaaagagagagatggtagtttttgaagttcactttttatttttcttatatatccctatagataataaccatggcaaactcatgagagagtaccgtttcctttcaaatctaataactattttctaggtaaaatctgttgaagtatgtaggttgttggatcaaaatcacctcacatcctaccttttctatagtcatcggtcctactcgaagtcgaagtctgatgaccattagctggcctcacttattggtcatcgatatttatcatatttcactatcgttttaattactcccaccgttctataatataagttgttttgagttttttctagtcaaacttatttaagagtttactaaatttattaaaagaataacaatatttacaacaccaaattagtttcattaaatatgatattgtatatatttgatgatatgtttgttttgtgttgaaaatattgttatattcttttaaacttgatcaaattttaaaagtttgaaaaaaaatataagcaacttataatatgaaatggagggagtagcgggagtcatgacgtcgtgtatatataagtaggacgattatgttagctagtcctatattactttttcagataataagattaatcctttaatttatccacaggaagcaattgcacctgaattcaggctgtaattaacaagatcggtcactcattcagtaatgccagatcatgtttaaaatgtggagctgaaacagcaagcaacttataatctgtaccattttcgcaacgaaaaagaaggaagaaccaccattatattgttgatatattggggaatttggtggctagtgctttgtcaacaggtcgaatctgatggccaattaggtgaaaggcagcgtgttcgggcttccacatccaaaggatttcaaaattcaaccgatttttaaatttccaatcaaataattaatgtggtacctagctagaaatgaaagaatcaaatgaaatctttaccaaaataaaacatgaatagcacacattttactccttgaataaattcacccatatatatggtcagaagcacaatttatttttgcccaattggcacactcagcatcaaaaggtaaaaaatgaaactgaaaataaaaataaacaaaagttgttgtagtagtagtagtacattgaatcatgcacaaacatataaggaaaaataaatcaaatgagcctcatgcatgcatggcaacagggcagtagtgtttgtatatatgagaatcacaaacttcacgcgaatttaatttgagttaattagttgatcctggagcagttgagcctgatctccccctcgccgccggtgagcacgtcgagcttgctgaccttgaccagcgcggcggcgaagcgggcgagccaggctgcggggtcgccggcggcgtagagcctgacgagcgccgccgtctccggcgtgtcgaggagggccacgtcggaggcgaacgtgacgttcccggcgagcacgttcctgtagtactggttgtccatcttgaacggcgtcacgtcgtcgagctgcaccatcgtcgcgtcctgctgcgccgccgtctccggcgggcacttgctcttcatgtccgccgcgtacgccgccggcatcgacgggtccgtgccgtacgtgccgtagtacttgtacagccggtttgtgaacgatgagcagtgagacgtgccgatagagtgcgcccccgacagcgtcaccatctcctccgccgtaaaacctaagtaatcgtatatcattaatatggtattagaggatatttctttgttggttgtatgtcatctaaatagttactaaattttttaaaaaattgacaagataatttaatataaaatatagatatctaaaatatatcactctataaacataaaagtcaaattcgactctacgagttacaaccaaaagaacaaattaaattgaaaataattattgaacatttgcagttatatttaatacaacttgtaaaagttaaattttaacttgtatgtttatagagtgatatatattatattaatctatcttgttaatttttttcatacttttataactatttaagtggcaatcataaacgttgggatatcctctcgagggataaaaacactttccgtatatcagagctaaacaactctcactatcttgcattcataactcgctctatgatgatttatgggacatcggtatgagggagagcattaacaagactttagataaactggcaagtgcatatgatgaccccatgaaattgttaccgatgatatgcgtatctatgtagtacaagtatataatatgtacctttagcggtgaagtttttgaggaggtctttggcaccgaactccgggtgagggacgttggagaggacctcatcctccttagagacgaagccatcacgacgacctgttgggatctcgaagtcgagcccaccagcaaggtaggcgctatcacgagccacgagagagaggatgtcggcgcaagagacggtgtgtggacactccttctcgaggaggtccttggcatcatcgacgacgtcaaacccatccaagctagggttgttcgccttgttgtccctctccgccttgttccctggtgtcgactccagcaacaccgatgcgtcacatccctagagagtcatatatagctgcctagttagaacacatggcacgatatggtgcgtcaacataagctaagtacacgtggcacgacatggtgcgtccacgtaagcacaaagctgcctagtgagcacacgtggcacggacacgatgcatccacgtaagcggggtgctatacttacgcggacgaagcagtcgtggaagaagaggcggatgaggtcggccggcgtgccgggcgccttctcgaacgccttggtcaccgtgtcccggacgatcgcctccgccttggggcacgattcggcgtagaacccgacggacaacccgccggccgcctccaccttcatctccggcgccgacgacatcatcatcagcatccctaatagtgccgcagcggccatcggcacatgcagagacgacggcgccggcgacgagactgccattgcttatcttatcgtcgccgtgcagagatcgagatcgaaggaactctctcagctacctgctagctaagctgtctagtgaaatggctgtgagatgttggaaaggacaagaggtatatatatagacaaatggttagcttgcatttgatagttcatggtgccatggcgatggagcgccattgattggtagaaaggtagctgccacgtgaacaattcgtttccttgtgcgagatcgatcgctatatcggttgttggagaaaggaccaatgcatatgtgcatggatggtccacacacgccggatggtgtgctgggcatatctgcgaaacaaagctgccatccagagctagctagctgaactctcaagctattaattgattttaattgtaggtaacttgttctgaattctgaaactaatttattgtttcaaagggatctcgacaactgtattctatgaatattaattctctctcaagaaaaacagctctagaggagaggacactctatggtacaattagctttctatgtgttcttttttccattctaaatagttgaatgaatgaatagctgaacgatctatgataaaatttgagagtacagacgaattaattaaatattatatttttgaaagatggatttaaaataattttaaaataaattcatatatatatataaagtttttacgaaatctgcaccgtataggagttcggaatgtataccgctgaattaaatagttcaattccttttttttctttaaaaaagaacacgctagcttatcatggtttaggctctcttaatttgccacaactccagatctaaatgcacattcgatttgaagtttgtatattaaactataatgatttaaaattttatatttcatttaagatagaaggggaaaaaaaaatccaaatagcccttaattataagtcagctgtttttctactcttctcactttcgtacatataaaggccctctacaagttcagtttctctttttaattttccctcttctgctagttttcattgatttatcaccgttggttcaactcctcgactcctcatgccgcctagcttccaacatagcgagatgaggtatccccatgccgtatcaacaagggagaatacctcttgtcaactagggatatcacactgagttgtagatgttccgaatagccgtgttgtgttttctgttgaggtttattgtcgccgtcgctgcgctcgtggaaggtagaaggaaccccacccttatcaagatgacatggccagggcaactccatttctccatgttggatgcccacatggcacaagaacctgagcaaacaatgatgaattgtggaaaattagcaacatgcagaactttggaagagaaatctaatttgcagagggtcttttgtatcagagtgggttgcagggggagtgtaaaaaaatagtgacttataagggggttatttgaattttcccaaaaaaataaagaaaacaatgttccatccagaacgtaatcgcatattcatatatatccatgaattttgaagttgtaatacaccggtccaaaaaatttttagattcggagccgtgtcaaacataacattaatttctgaagttcaacttctaaatctggcaattattgaaaagtaatttttcatcaagacataattgagcagataactaaaaggtagaatattttgaaaaagtagaatctatgaactagcgcagtacagaagaatgtcagggtgacaatggatgtagtgcaaggtgtcaccaacttgtcgatcgatagagcccaacccctctgcgagaattgccccggaaatatcttgcttttccttttctttttttcgttttcgtaacaagcagagccagcacagcatgcacttgcttttacttaaatcaaattgactccttgatcaatctatatattttctggcctgctggttggtgctccatgtccgtcatatcttgctttattttatgcttccttctaaagtgcagggactgagttgaaaggcatgtagtatgcacgtagcttgcttgtagtaacctgcattgttttgtttttaaaaaaatagaaatgtgacccccttggtcttggaatattgttaatgactaacctattaaacatgaaacctgtacgttaataccataccgtctgcataaaactatctcggcatatgtattgatgtagtacatactcgtaggccatttacgtgaatggtttacagttcacatggaagtatgtaaccatcgacaccattgaagaaaccatcggcaattgattttttttgttctctacatgccgcgtaggctatttggttatttcacagctgaccttggtttgtattagtgacttgtagtccgctaactaaaatggtatagggaccttaacaattatttatttctttctttttaattataaaatgtggctctaataagcaattaagcatagtatctcagtcacacaatcgaacatacatcatagacttggattgtatgcaatactcaaggaaacagtgttgttccctgaaaaaaagaaggaacagtattgttgacgagataggttgaacttaattgtaagtaccataaaactttatgaagatccatccatgcacaaacatattgttgtgatcatctctagttggctttgacttctaagtccggatcgttacggtcttatatatatggaccgtttattacacatagacacaggcacacaatacacataaaagtcgtattcatagttgtgagatactacaaatcatccgatgatttggttgcattctataactatggtgtaaaaacatatatatactccttatctcaacatcagcgtctaataataatccactccattcctcaactacaccacgctcagatccacattgatcttgtatttgtacccatctacatctcctttctggtaccgacattgtctcatatttcttgtccatatacatgattcgtgccatcgaaacagatgcaaccaaatatccacacctttgtcatcctagtcacaaaagcctcgcccatttccgcttcccttttcacgctctgacagcaccaactcaaccatccatgacttaaaatccgatatacttttggattccactcgaattgttctccaggatttgtgcaaattgtaaggctcctcctgtagctagccctgttaagtgtgtcaccatcattggcatgctccataagcggcaaatgcgttcatctggtgatgtgttcttttcatatggaaggaaagcttggaacataatagaaccatacgaaaagacgatagatatcgagctcaaacagaggtgacacattgggtgtcaacgacactagtagctagggttaacttgcaacttgaggaagctagctagctagaaaaaaaagagagaaaaaatgtctctatatatctaaccttgtatggccgagtttagttccaaaatttttcttctaacttccaacttttccatcacatcaaagctttcttacacacaca

SEQ ID NO: 62362 - DNA, 16566 bp, Oryza sativa
catgcttaattgatcgatgccactaaatcaagatccaccataattagggagatagtataaagctaaaatgcaccaatcatatatcaccaaactgcagttgagtgcatgcatgatcgatcgagctcgtcagttacacgcacaagaaatgggtctcagttcatcatcatctccacaggaggttcggtcgatcgatcgatcaaccacgcacacgcgttatcttacatcgatctcagatcatctatatatatgtaataatcgtatgttttgtactttggtctcacatgatgtaacaggacatgcttgtagcccagacaaaccatgagagggctctcgtgggtctcagacagaaatagaagtgtgtgtattttttaaaaaaaaattagaaaaaatgcccatacgttgcagtgggtgaaggctattttaattttattatttttattattgtaattcatcgtgggaattcgcttgggtttttttcttttacaaaatcatgaattgcaattaggagtctgatcatctcaatttagcatgcgttagtattaaattgcatgcatgctgggtgtaatctaattttagggatgcaagtgggttttttagcccgcttatctcactattctagttcattttttcttctaaattttgtaccaccatgtgagaaataaactagcaagcgggtttctatgcgggtagtgggactacccacttgcatccctttaatggaactaataataatatgtgccattgtattttagccacacaatatacatatttgtgttttgaaacgcgcattttgcaggcaaagtacggttagcacaatttatttactttctattttactcaaataatggccatgcaaatctttgctaattaatcatggatgaagatttagaaatagattttttgacaggaaacagtagtagagactcctactgtgaaaatatattaaaaatacaagaggttatttacaaagggaaacaaaaaatatttacaaaagatttacaaaaatattttaaaatgatttagaaatagatgcatgcttcctgatttttattttttcaagttttcatccattttatggtttgttttgttccttcatcttttctattgttatataagagcagatagttgtcctgcaaacttggtagtactagtaattactataacttctgttgaagtaaagtctgggatttcttgttatctaaaaaaattaactcaaatatccaggattcaaactccagatatgtaaatgatatacccttcagatttacatcagttatgtcattacagttcaagattatggatgagagcccagccaattcactgaacttccatagcccagtacatagctagcccttcctgccacgttacaattcattcggcccagattgatttactcgttgttatgtgggatttatagtcataagatgggccatggtatcaaaaaaaccattctacctttacaatatagcattttcctcatttctgatgtgaactaaaatcttctgtttttttagataacagtaaactaaaatattttctccactctgatttgaaacaatataagaaaatcttctcttgtttgagttaacaatagaatcttttcttaatcacaatttgccacacaaaacaacaacaaaaaaatttccacatgatgaaatttgggcgtgtaatattactaattctacatgtataaaccagctgcagatgaaattatatatatactataatataagcttaattattgattgacaactagtagtggttgttgaccatgaagcacttctctctgatctctccctcgtcacccgtgagcacgtcgatgttgcccatcttcaccatggcggcggcgaacttgacctggaacaccttctcgacggcggagtggagcttgacgacgccggcggtccacgggctgtcgagcagcgcctggtcggagttgagcaccaccctgtgcttgagcacgttcttgtagtactggttgtcaaagctcgccggcgtcaccgggtcgagcggcacggtggtggggtccatctggtcgtcggtcgctggcgggcaccggcgcttgagctccgccgcgtacgccgggtcgatggccgggtccgtcctgccggcctcgccgctgaagttgtagaggcgggcggtgaaggaggagcagtgggagcggccgatggtgtgggcgccggagagggtgaccatgtcgtcggcggtgaggcccttgcgctcgaagctggcgacgagctgggcgaggctgaaggtcggggcggggacgttgtcggcgagcacctcgtcggagacggagacgcggccgtcgcggcggccggaggggaccgggtagtcgacggtggcgccggcgaggtgggcggagtcgcgggcggcgaaggcgaggatgtcggcgcaggagacggtgcgcgggcagtgcgcctcgacgatggccttggcgtcgtccaccacctcgaaccctcgcatgctagggttgttcgccaccgaatccttctccgccacgtgtcccggcgtcgagtttatcagtatcgacccgtcacacccctgaaataatcaattaaattcagcacaattagtttaatttcgtccctctttataatatgagtcgtttttaattttttccatagtcaaaaattaatttttaatttaatcaaatttacagaaaaatataataaaactttcaacacgacacaatgatattatcaaaaatgtattcaacgttacatatatagtgaaactaatttggtgctgtagatgttgttctatttttctataaattagtttgactaaaacagagaaagtatcatctaatcatgactaattagaggccttaattaattacacgccattgacagcttcttcaagaatggcacgtgatatatgtgtacttactctgacgaagcagtcgtggaaatgcatgcggatgaggccggcggcgaggccggggtcacgggcgacggcgcggcggacggcgttgcggacgatctcctccgcctgcgggcaactgtgctcgtagaaccccaccttcagcttcgtcggcaccggcgacgccgccgccacggccaccatcgccgccgcccatgcaaacaccatccacggcgacctcatcatgatcaatcgatcgaagctagctagcttagctattgatcactatttatctcactatctagctagctagctcaattaattacttctctcttgaggttaattaattgagagatcgatggatggatttagattgattttgagatggaagacgatgatatggagtggagtggtatatatagggaggctaccaaaagatcgtagcagttgggagttggcgcgttttgcatgcgtcctcttcatgtttgcaattaaccgagtcaacaacacgactaaatctttgtagtagctaatgatctccattaattagacaagctaacaaacttgatttgtttgttaagaaagcgtgtcagacgcgtgcatgaacctgtccatggactttgggagaaactccaaagtttcgcgaatctcgaggagcgatggacggcttgatcttgattgatgatcatatattcatattagctgaatgtccgtgctttgctatggataaaagaaaattttaacataatatttttttcacatcttttttttttctatgggaaatgttcaccttaattctattttatatgtggctatccatttagatttgtttgcttcttaatattaaagaagttcaaagagtaatttgtaaattatattaaaataggtgaggtggtagattccaataaatatttccatgcaggtctatggatcaagaaaatttccaactttgggtcggctgcactgagaaagtgagaaagggatatgggtatgaatgcaaattgcatcgtgtcatatattactatatgcttggaatcgaaggaagaactagtaatagatagctgtacatcaattaggccgacaaaataagtacaaataatattgtaattgtgtgtcaccatcacctaatgttgctcagactttgtagtaacagatcgatcgatctacacacaatcatttgcgtaagaaggaattagaaatgggcaaagatgtgtgtgtagattacttgtaaaacattcttaacccacttaaagacagaaagcttttggttgagagatcaatataataaaatttgacaaggtcgatggggtgaccgggacaaagtcgtgtgagtttggaggatgacgcatgatgtatatatacatatgtttagtaagtgtacatttcgttttcctaagtttaccttttgtccctgaagttaattacctggtcaaatgatatctcatgatcatctagcttaattagtctaccaagtagctgcagatatatatgtaataaattagatgcatggggatcatggcgtcatgcatccaagaaagtctccaaaggcaactagaaaagtattttagtagtgtgtatgcatgctctctgcaatagttagttagttcactaggtgatatacgtacagattattgtcgttgcacagtttgatgaagttggtgaattaatttgaggctcccttttgactatatcttagcacaaatatacaactccaaaagtcaaatttaaacaatacgtactagtagaaatggtctgcctctaactctaaggttagcaaacaacttgtcctataacctatgtatatcttcctttcaaaacatagatataggcaatgtattttgggtggttaccaatttaccatgcatgaacatgtcttgcaaaaagttagctgcattgctgcaggtatgaaaatacaccgatttgcaaacattaaatttcttatgtaattaagtatggtagagaaagaaattaaatgtaaggcgataagtgaatgcacaattaatttacagggacgcgtttacttttgcagctgttgcatcgatcattcgcatagaactttttggtggggtaggtgtagaagtcaaaacatacacaataaactttttggtggaatacatgcttacatggtgtagagatgaatgtttcttgtttgtgttctttgtttttttccgtgttgaactttcatctccatgtctcgcatggtcaagttgtcttaattcgattttcagaggcgcaaacaactgattagttagcgtgttgggccggagtagcatttagaagtccattagacctagctgatcagagttttgttttgaatgggctacagaattgaacgtgccagcccgtacacgtggatgggccacaattttggcctatacaaacgaggccctaacgggctgatgtttttattcgctcggcccaactaggcccaattaggttggatctgctcatacgccgaattttttgtatttttagattttttttttttaatatttacagaaatattatagcgccgaaaaaatttgcaaaactagaccctgccgcccttcgcaagggcggcaagccgacgtggcacacggcgcgctggacggcgcgggacggccgtcctcctgccccctcctgccctcttgccgccctggcaaagggcggcaggacccccttgccgcccttacagaaggcggcaggcctggccgcctataaagcccagccggctcctttgaggagcccattccctcctaacctctccacatcaaaaaaaaaaaaaaaggagaaggggaggagaagaaaagaagaggcgaagccctgccagtttcaaacttcgatttcaggtaatattcgtagattatatacgtgactaaatatatgataaatgcattgtatgaaatagagttttacctgtggtactatataaatatatattgttagatgtagccatgtaggtaacttagtagatctgtagtatttgtagttattaggtttgtagttttaaatgttgttgagtaacattgcaatagaatatataaaaatttaggtacgttgcaaagaagatattacactgtagtcgtttattatgtaaaataacggcctagtaattaactttgcagatatgtccagtaaacttatatttcaactataccatggtcaaggaaacgtccgttatgggccaactggggtagatctgtcagaatttattgtaacagcaaggggaattgataggccagccgagaggagtgtaccttctataaaaaaatggttgatgcggggcttgggagttgatccacagactagtgacattacaatctatgttgtagtaagtcgggcaacagagggtttttattgggaactaatgccggttcaaaactctgggatgtggagatggtatgtggagaatgcattgcaacgtgggtggcctctagctatggttccgtatgttcatccgaaggatccaagtgtacagatgaacatggatgatggcgaggggccaagtgcagaagtgaatgagattgaagtggatcaggtcaacgcaccagaggaagatggagtagctccagtagtagctccagtaggcatgcaacctggtggagtggctgacgagggggagactgtgggtgccattgtggacgaaatggaaaaagaggatagtgacaacgagcgtgtcgaggaagatgattcgtcagatgatgacgagaacaatattaatccagctgaatgggctagtgatgatttttctggtttggtcatctctgaaggggaaaatgtgagatgggagtacaaggaaaacgagattatcgagggagcgaggtatggtaatggagaagacatgaaggaggcggtgaagcattatgcagtgtcacttcatagggagttttgggttgccaagtctaaccggacacaatatgaagttaggtgtgttaatgaaaaagatgggtgtccgtggagagtgcacgcctataaggggaaatggaaggactactggacagtgtcggtcgttacgaaacatacttgttatctacctggtgttcaaaaataccacaggaacattacatgtgcatttgttgcatctgagatgtatgcgcatgtcgtggacaatctggcatatgaaccgaagtcaataatccgacatatcgaacagactttcaagtatacaattagctatgccaaggcgtggagggccaaacagaaaataatagagatgagatttggaacttatgaagcctcatatgacaatttgccacgtctgctatctgttatccaacaaagaaaccctgggacctcttgtgcactcaagacattcccctcaattgaacatcctggcaagactgtgctgcaaagagcgttcttagctctacatgcatgcaagatggcattcgtgcactgtcgtccagttctttgtattgatggcacatttttgaccgggaagtatcggggccagatactaacggcaattggggtagatgggaacaatcaggtattgccgttggcatttgcttttgtcgagagcgagaacaccgacagctggtactggttcctccatctggttaagacagaagttgttggtatgaggcccaatgtgtgtctaatacatgacaggcacgccggtatgcttcgagcgatagaagagttaaagtttgggactatggaaagaggataccctggccagtgggaagatgtacaaagcaggtggtgcatgcgtcatatgggagctaatttcttcaagcaatttaagaacaaggagttgatgaacatgttcaagaggctatgcaatcagaaccaggagaaaaaattcaatgagctttggaagagattagatgagttgacaggcaaatgtagtgaccagcgtgcaacaagaccagcggccgctgtacctgaccctcctcaagcactcggagctctcccaacagacagtgtaacattggttagaagaactggggagcaaattcgaaaattttctcagtggattgagaatgagccaaaagagaaatgggctaagacttatgacacaggtggtgctagatatggtataatgacaacaaatttggccgaagtttacaactgggtgatgcgcggtgtccgtggactcccactagttggtatactggatgactacggttccgatggtgttcgacatctgtgtcgagccgcacgcaccttaccgcgtgatgcggcagttcggcttccgtcagtcctttccagtcccgtttccggcgggcgtcacggctgccgttcaccggtaagccgttttactacgatttaatatgttgcattaacatcgggctgtccataataatttgctttgtttgtcgtttgccctaatacaatacattaatttgcaggtactcgcgcaagggtcagcactcagctggtcactggcctgccaagttggggccttttctcgacgactggttgcttgctaccgaggaggtcgtggaccacgcgggagagccacacacggaggaggggtatgaggcgtacctacgttggtatcagccacgcacccgtactagagtcacctacgctccgacggagcaacaggcccacgccgcgagcgccagagacctctacgccaggcaccgcgaccaggacttcgctcgtgcggtgagtaccttgcatcgcaccatcgtctcatcatcctttctgttggacaaaggctacgaatatttacgttgtaattaaccgtgcaggccgttgagtgcaacagggtcgtcgttgatgctacaacggcgatccaacggttaggcgcggggattgaggtgggggcagacgagcacctgtcgacgtacacgcggatacgggactcgatgcgctcggttctccgtgcgctgacctgtcgtgctgccgacgttgctcaggcagacgcagcaccacaggtgcgtccccgaccgactgctcctcgtccagctgcgcacgttcctacgccgacaccccctcccttcggaggtacgtatattcaaggtctatttgtacatcatcaatcaattgatactcaatttatgtgtaagcttacaagtgtcgcgtcgtcgatgtgtaggcttcgctcagcctgggacgacgccgggcgcccactcctggcaggctgcggggtcatcgtcacaggcaggtgtgtcggcctcgctgtctgcgcagttctggcaggacgccgggacttcgtcacagccgcccggcacgtcttggcagggtcctaccgggacttcgtccgagcacgggtgggcttccgccacgcacttcgacattagtgacttcgacttcccggacattatcggtccctcacagcttggaggcgcaccgccggtgcacacgcaggagcagtcgccctccaccccactcccagaccctcgcgctacccgtgctgtcccaccggatcgcttcacgtactcccaggaccacgtgcgagcacaggcccggaggaccaagcggggtcgcggcgcgagtcacggccagtagagcagacatctctttatttttctttacattcttgtactatatggttgtaaactgaatatgttgttgtttatattcgggactcgcattcctacacttcgctgttacgttttccaaaaacaggagtcctttccagccgttgtgcagagaggaagctgccgcccttgcagagggcggcaagccctcggctccccgcggcccgtgcgcgccgtcaagacgcacacggcgccgtgtgccacgtcggcttgccgcccttgcgaagggcggcagggtctagttttgcaaattttttcggcgctataatatttctgtaaatattaaaaaaaaaaatctaaaaacaaaaaaaactcctcatacgcctttgcactagggcctcctagctgggggttgctagttggcgcgcgcgctggcgcgccagctgctcccggcccatcagccctttttttcttttttttcgtaattatttttcgtttttcttttgcgatttttttcactttttttccttttttttctgattacttttttttaatctttagcacacttattttttaaaaaaatgttttgagttgaaagttttcaaatctcgatttgaaaatttataaatctgatttgaaagtttttaaatctgagttgaaagttttcaaatctcgagtcgaaagttttcgaacccgagtcgaaagttttcgaatcggagtcgaaagttttcaaatctgggatgaaagtttttaaatctgagtcgaaagttttcatatttttttcaaatcttaacttaaaaattttcaaatctgtacttgaaagttttcaaatctcgagttgaagttttcaaatccgatttgaaagttttcaaatctcgagttgaaagtttttgaatctcgagttgaaagtttttgaatctcgagttgaaattttttaaatctgagttgaaagttttcaaatatgagttgaaagttttcaagtcgaagttgaaagttttcagttgaaagttttcaagtcgaagttgaaagttttcaagtcggagttaaaagtattcaaatctgggttgaaagtttacacatgtatggaaaaatttggaaaaaagaaaaactaaccgtgtcttgccgcctattaggccgtgtgggccggcgcttacgcgccaattaggattcctgctcctagctagcgcgtgcgcgctactggcgcgcacctccccctcttaaggccttaactacctctattagttaacacttgatactaatgatagtaattaggtaagattctgaatatttttttagagattattttactaacagaattaaaattttttaagttagattaaaaaactttcgatttaagtttcatgttttaaagtcaaattttgaaaactttcaactcagatttgaaaactttcaactcgagaatcgagattcaaaaactttcaagttcagatttgaaaattttgaaaactttcaacttgagatttgaaaactttcagctcgagatttgaaaactttcaactcgagattcgaaaactttcaagtctagatttgaaaattatcaaaactttcaacttgagatttgaaaatttttaactcgagatttgaaaactttgtcctaatttaaaattttgaagttaagatttaaaaactttcaacacaaaacatttgaaaaacacgtgtcgttggaagattaaaaaagcgaaaaaaacacggaaaaaaagaaagcaaaaaaataaaataaaaagtaaccgaaaaaagtgaaaaacaaaaaggaaaaaatcacagaaaaaagaaagtgaaaaaaagagaaaaaacagcgcgaaaaaaaagaagattcgcgcgcgcgtgttgggccgtgtgggccagaatgcgcgccggcaacgtgcgcgtgcaagttaggattctcgctttgcactcttggatgggtaacactaccactaatgggcagttgactatcagagatggatttattttcagtgaaaatatataatttttttaataaatacgctctcttaactacttgtattccatttatgaacgggaagcatatagcaaatatttgctcgagggattagaattcaattccattgagtttattgtgctaattttacatagaaattttacggttttccagaggtaccaaaagaccaattttttttagcttaatatctaagatactgagagacatcaaattttacagtagaaataccttcatatcgctctttacataatgttttaaggcagctcaaacaaaggaatcccgggtagttcgatggtttggcgccaaacagaggcacacgaggatttgctagtccagtttctcactgtcattcatcatatcccaatcttcacagtgacaaactgacaattattaattagttggtactacttgttagcaaacatacaaaaaagaaaagcacacagatgagttctcttatcaagacaaagaacagccatacacagtgtaaagcatcctacattattctgaagaaagtgaatcactcaagtacagtctagagagagatacacacataaatacagttatgcagatacacaaaaatgcataaacttgcatacatgttcatgaatgattgagctgatgagatgagcgtgctatgtcgggccacaagaatccaaagtgtcattacattatttggcactcaatcgcatgcgctcctgcagcgattagtggctacaccaacacaagcatccaaagatggcaacactgctgctctgacgattcagaaagttaacaggaggagattccccagccaccatcgccagcaacttttgttttgttatctgatcatcttcttctagcccatctcgtagtaaagctactgtcagagaagcttcgcatgctgtcctttcacaagaacaataatctagtcagagtttcagaggaacaataatataagtcagagagtttgttccaatcagaacacatgcatcgagctgatcgagctaccaatattttaaaacagcaagtgatgatcactcttgtgaatttactaccatatggtctcatgttctaagttgatccagcattgatcaagttggggggtgaaaagattcgcgtagaaaaggttggcgccaatatactgcagagttgtggtcgatcggccgggtcgtcctgctttgcttcagacttcagagttgaattttttttccattggaggctacatgcgactaagtacactactagtagagtagtggagtagtagattattaatctaatcgagctggtcaattgcatccagtgacactaaaattttgtctctcttccttgctgcatgcagatcccgatgcatatgccattaactttcagtgcagactgcagactgcagtttttgttactgttcagtagaagtttccatagcaattagtcatccccgttcacaaatctaacaatttctatttatttttagaaaaaatcaatacaggaaaatttcttacttagacgtaaaaatatattaacaaggatttcaaggttatttaaccaaaatttagattgacgagaaaaaaaaatctcaatgtctctgttatgcgataggtaggtgggagccaaaggatggtagagataagatataaaaaaaataaattagaggtgatcaatgagataagtagtactctatttttcttagataaactttaaatgtttagaatgcttatatacttttagataaattttaaacgtttagaatgcttatatctgtggggagagagggcgagagtttaagacagatggttttgttctccatccaacctgtagcccaatgctgtccctgcttgctctgactctgaatgtatatggactgaactggaactgcacttgtattttaaggcagaaatgttgagcagctggtgcccatattatttgcacatgcacgcatgttagccctttggttgatcccatatgtgtaaaggagaacgaaatgtcgaaatgtagagagagagagagagagaaggaaacaaaacatgcaacacgttggtttgtgttacaacatgccacatgtgcatcaagataccatgtgtctcttccattgggcagcagctggaccagttcatcttcctcttcttctacagccaacaaacatctcagtgatcgatcgaattatatgagcaagaaatttcagcaatacacactgtaacagtaactgaaaatcaatgaactatcatgcaagaaaattcagaccaaaggtcatgaataatgaccctgttctcactttgctgtagctgaatattgaatatttgaacttgaaagtgcataattgaaacttcagaattagaagaaacaaaaagacgaagaaaaagaaaagtgaaaagctatcaacacctgaactgaacaaatgccgatgtgataattctaccctctcttatgttacaacttacaacaatgtcatcaagtacacatgatcattgtgtgaagcagcatgaaatcgaaggtgatgttgaatttttcgatgaaattttgctgatcatgtcatgtacaataatcaatcaatcaagcagtatcgaagtgcgtgcatggttggattgaatatcgatcgattttttttaaatataattagttcactttgttgcagtattgccggatctcgccgggtgggccggtgagcacgtcgaggttgcccatcttgaccatggcggcggcgaacttctgcgaccacagcttccggctgccggcgtactgcgccaccagcgccgccgtgtcggggcggtcgatcagcgactggtccgacgtgaacaccacctcgtgcgtcagcacgttctggtagtactggttgtccagctgcagcggcgtcttgaagtcgagctgcacgacgcggtcgaggcgccccggcgccgcggcgcacttggcgcgcgagcggacgccgagcgtggcgttcatggcggggtcgatctgcgggtagaggcgggaggagaaggaggagcagtgggagcggccgatggagtgggcgccggagagggtgaccatgtcgtcggcggtgaggttcttggtggcgaagcgggcgacgagctgggtgaggttgaacgacccggggggcaggttggcgagcgcctcggacgcgctcgagacgcggccgtcgaggcggccggcgggcatggcaaacttgatcccgcccatgatgcgcgacgcgtcgcgcgccgcgaacgcgacgatgtcggcgcaggagaccacgcccgggcagcgccgctccacgacgcgcttggcgcggtcgatgacgccgaagccgcgcaggctggggaagttgggcggcgccatcttctccaccgtgccgttgctcgccgggtcggcgtcgagcagcaccgacgcgtcgcacccctacgtacacattcgcattgcatcgaacacctctcgatcatcagctcaaccaaattcgaccaagtgaattcaaccaaattaaccgcaatgcgatatcagtatcactgaccctgacgaagcagtcgtggaagaagaggcggatgaggccggggccattgccggcgtcgttgcggacggcgccatggacgatcgtctgaatcaggtcctcagctccggggcatgagttgttgtagtagcccacctgcagccccgccgccgtcgccgcgtaaccaaagaagatcgccgcagcagcgacgagcacactacacgatcggcggcgagcaccgccgtctctgctaccggcggccatcgagcacacacacacacacaaactatctcttctagatagctcagctagacgaggagtctaactgatcaagtgaaggtgactaggaagaagaagagggtggccatccaatttatatgtatcagctgccatgatcgatccaagtggggattagtataatctgatagtgattcgtagctagtgacgacctgcactgggtgattaagctaagctaagctaggtagcagctgcatgcaagtgttgatcgatgctaactgggaacatggccagtgtgtcatgaggagacaagaacatggggtcacaagttgaccggcctgcctctcttgagctaagctgatgaagctgatcacactgacactgtctgttcaagtgtagtgcatggtttaggtgagtaattaattggcgacgattagtttagcagcagcttgctgcagctagcgtgcatgttagttatggacttatggtaaattgagatcttgttaatttgcaaggcgccacgggtgctgacctgcagcagtgttcgtcgtcgtcgtcggcggcgatgggatggatggatctggactgaacatgtctgaactttcttgcacatttcggataccggatgaacatatcatctctgaattgctgatgaaagaagacgcagcatctgatgaaaacgacgacgaggatgcggtcagtcaatttggcagggcgtgtgtacagatgaagaggtatctagcacgctatgcagtcaccataaattaattgaagagtgatcttggatcgatttcgtcagtttttcaacttcactgtcatggtgacttaattcagatccaatgttagcttctggtccaatttattattattgtttatatataaaaaaaaaccatgccattgcatggctgtggcacgatcgatcgagatggatccagtagtttgacagaaagtgaaaaaatgtttggattgagtctgatcagattgtgctagctctgcaattctgcagtgagcgattgaccaatattgccgcaaggcttcaagacgctgtcctgcgaattgggcgaaattgaagcctaacgggctcgagacaatactttttggcccatcacaaacttcgtttatttgaggccttaacacgataaaatcctttagcccacataaccttccttactatgggcccaaaaattgtctaatctgttcggcccataatatgaacgatcggtagcccatagtaggaaagattgtgggctaaacatctctgaaatttggaggaatacgtctatattcctccctcaagtagtgcccctggttgaatcacatccttcaaccgttaaaccgggtataacccatcccctaactcttaaaactgttgcaaattgactccctaggcggtttcgtcctatgtggtagttaactcgttgagtcatcaagtgggacctatttgtcagcggcctccacctcatcccatcttctccctcatctctcgcgccctctccccctttcatatctttatcagcgtggtggcgatggcgcttggcatacatgggaggagcttctcggccggctgcatgcgggggaggagcgcaaggagctcctcgttcactggccgtccgcgaggaggagctcgccggtcgggcgcc

SEQ ID NO: 62363 - DNA, 1819 bp, Oryza sativa
aactatacacacccaaggtatgcatagaattgcgttgaaggtactactacaaggagagaagcgaagcatatatataaatattggtcgttgtcataaactgctatagctaccggtccatcacccgttgaatttcgagaacatatttgtatggttgaattgtgatgagaaaattgacgtcgttcttatatgtgagcgagaggcgcggtcgatggcgggagactggactagcgcgagaggcgcgtctggtggtggaggaggccggcacggcgcgatgaggcgcggccggcggtaaatgaggcgaccacggtgtgagtaggagtggccggggggtgtggcgtggtcttcggcgcacgaatgctggccgacgggggcgccggtgcagtggttccacatgtcagcagaggttgagcagtggtagagcatcggtgcgtcagccatgaacttgcaggtgatgagcggcgggtgaaaacccagcccggcctggccggaccgacaacaatgttccccctccaaagggcgttgtcgtgtcgtctcatccctcaagggtgtttgccgggcgaaaacccagtcttggctcttttgagtccctgacggacggcggcggcggttttccgtcgcttctctccttggagacgtcgtttaggcatcccttgtcgaaaccactcgaacgactggtgcaagcacactctagatagagttgggctttgtgttggttgtaagggcgtcttttgggcattctcgtatgtgttcctttgtcggcctagcggcggtcagtcacgcttagtggcggccggtccggtgctagccttcttccggacctatgtgttggcgctgtcggtgtgggtggtagtattttttttcctttttcctgattacgaccttccagggttgtaatcttgtaatttttttctgctctatcaatagaacttcgcaccatctcgtgcgagtcgttcaaaaaaaatagttttgaagttacaaagtgtagtcacatacatatgtgcttgtgtcgactaggctgcattcggcagcatgacaataggagtttgtttgtttcttttttttcgcgcacgcttcccaaactactaaacggtgtgttttttgtaaaaaaaattctatagaaaagttgcttgaaaaaatcatattaatccatttttaaaatttaaaatagttaatactcaattaattatatgctaatagctcatctcgttttgcgtatcttcccaatccccttctcctcaaactcagccttaatacaagttaggtcacatcaaatctattcccacccccaatatggttatttggtctattaatatgtagtaagcttaaagtcaaccttgatgaatggtgacgaatgaaattatgttaagggaaaagccaagacaccatggggatgaacaccatgttgatgtattgatgtgatgggttcataagtcgatcataccaacaccaaaaatcgcaaagaagatatttggaaaaatagaaagaaaagagattcattttcaaaatcataagggcatgcacaattctcatgcgtggcaagtggtttcggctcaccaagtaggatccttaggcacgtgatggctcatcagggtaaacgtgtggggcgacaagggagaaaagggtgagaggaaggctgtgataactaggggagggagaggaggggcctaccatcatggatgctccgtcaccctgatttgtgccatcgttgaaaagttcattggcccgctgccgctgaagagcggagcgcctagtcgatcagattttctccatgctgccctgatctgcaccgctcttgagggtcacgccttgtcattactcg

SEQ ID NO: 62364 - DNA, 3908 bp, Oryza sativa
tgtttggctcataaaagctagtatacctaacaatttaaaatctcagataaacttgttgacaaattcaaatgaatcgaaagacatgagccgaatgagctagcaaaccacgagtttttatccaattttaaaagtcgggttacaaacgtctctcacacaacgaccagtgatgaacctagaacaaaatttcctaggatacaatatatagtaattatctaattattaatcgatatactaattaatatgatataatttagttaggatatggataatctatctggggtccttgtcaataaacccgttattcagaaaacccatatactctgtatcaatttaatcacgtaaaaaaaataagtcagatgatcctcttcccaccgatccaccaaactgaagcggagcatgatggcggccgcggaaagggccagtatccccccgttgaaaactccgcgcgagcgtgcggacgcggcggggcccctcacgccacacccaccccccgccggcaccgcgcgggcaggcgcgggcagccgcggccacgaagcggactcgagacgagacggttccgattaggaaaaccaaaaaaatacgcccgcctgctcatccaaaggctgcaggtggacgcgccccattggtgcggcccgtcacgcgctgccgccacaagcagccagagcccagaggcgagtcgatggatgcctttgcttgactttttcgggccatatcgctcaaaaccgtggaaaaaaaacgggagtaaaatatagcctagaaacagcgcacccgcctgatctgagctcactgcattgccccggactttctgcgacccctttttcccgacctttctacaggccatcctccctttttccagttccctttctacccctttttaagctacctgtacacgtactaattctataatctacacttctacagatacagtggtttgaacgaatgagtgaaggtatactcggggtaattttcttgaggctagggctgtgtggctgctaaagccaaacaaggcaataaaagcaagcttagttaggtacgggagtagaaaaaaaaaagcaaggtgagactaaaaaaaaaaaaatctgctgctactaccctaatccccctttggtgttatatcctcgagccccccagtagacgctgcctgctcctgctctctcctccgcctgattcctcattcctccaaccagtggtgtgtgcttgctgctgctgctgcttcagttctcgagtagtactccagtacagacaaggtaagaggcgaaaccgccgaatcctctcgtgctttctgctttcagatttgctttgcttccccgctctgtagcttctgtgctctcttggattccctgggatttgtgctctttcttgcgctttccctttattgggatggaaacctacgcggcatcgatcgccctctcttttccgggagtttatttatcttcagttcttgagtggttgtgtggttgaatcgagttcttggggctgtgaactggtagtgattccatctgttcgagaaacgttgacgaggaggagactctgtgtgctgcagtttctgggttttatttttcttttttgtaagcatctgccgacagttcagcgttgtgctgttcttccacctaccgtcggattttgactatgcagctgctctcccaccggtttcgatttctttagtcggggggaaattcggctcaattttgtgtggatttggtttgattcgttgttatctcttttggatgttgtttgcaggcgagtggtggtggtgtttgttgccatggagtcgcagcaggagaaggcggtttctgcgccggcggcgaacgggagcggcggcgccggcggcggcgagctgatcgggtacgtcgacgtgcacgtgcagagcgcgcgggacatccagaacatctgcatctaccacaagcaggacgtgtacgcgcggctgtcgctgccgggggagggggcgccggcggcgtcgacgcaggtcatcaacggcggggggcgcaacccggtgttcgaccagtcgctgcgcctgggcgtgcgcgccggggacgtcgacggcgcgctccggtgcgaggtgtggatgctgagccgggtcaagaactacctgcaggaccagctgctggggttcgcgctcgtgccgctcccggacgtcgtcgccgccgagggcggcacgctcgcccgcgagttcccgctctccaccaacgacatcttccactcccacgccgggttcctgcagctcgagctgtcctacatcggggtcgtgcctgaggtcgtgcccatctcgccgacgcccaagccggccctggccgacgcggaggagcaccgcgccggcggcgcggcgaacggtaaggagtacgagaagatcgagttccccgatctgaatctcgtggaggagaaccagatcatgctgtcggagtacatcgggctgccgtgctccgccgtggagccgcagagctccgagagcctcctgacctcggaggaggacggcgacggcgccaccgccgagacccacgtcgccggcgtgcgcgtcgtgcagagcttctcgacggacaacagcaccgccgactcggccggcaccttccggagcgacaccccggtcagcagcgtgtccaccacggagtcccccgccgccgccgcggtcccggccaccccgcagtccaactcctccggcaatgccgtctcgtcggcggagcagaaggagaaggccgcctccgacgccgccgacgcggaggtggagtcctcccgcaccgtgcagagcagcgccagcccggcggcgaactcccccggcgccatgtccgagagcgcggtggataagccgccggtcatccgcgtcaacctcgagcaggaggtcaaggtcgaccagaaggagatcatggacatgtacatgaagagcatgcagcagttcacggagtccctcgccaagatgaagctcccgctggacctggacaacggcagcgacaagagcgcggccgtctccggcgccggcgccgccgcttccgacgcggactccagcggcgccgactcgggcgcggcggccgcggcggcggcgaagaagccgatggccggtgggccggagaaatctcccaaagtattctacggaagccgtgctttcttctgaagcaaagagatggggcatttgcagccgtcggatctcagctgaaacttactactagttcagaggaataacacgttctcctcctcctgctcctgctgctgctgttcttgttctaggcttgtcatcagatctcgcaagacgagcaaactagctgctctgttttaatatatcagtactcttaatgaaaaaaatggtttggtttcttcgttccttttcagctatatttcgatcaaaaacggttaaattcgccaagaaggaacacggtaaaatcacccgtctttgtactaccatccaaaagcatcgaggcgtatttatctgtcgattaaacgctaaaaagtacgttcatctgtcttgggggatcatagaaacactcgcatttgatgcttgtcatcaccatctgattggaagaggcagctgcccacaccatctgattgtactacctagaagggcggtgtgggacagcgtggaaagtgcaccggtgccaattctgaagttgttcgtatgccatttgtcgatcgatcttgctcatggtttcaaggctttttaataggagtcctgaatacaatcaataagcgatattgatcttgtcggatgcatgtctgcgtatacaggtatactgatggatgtggatgtcgaaagtagcacatcaataacctatatgctgtgatcatggaatactcctacctttctttctcaatccacactcctgtttgtgtaggtctgtagattgttgggttcatcttgaaatgtacgaattttacacggttttttaaaaggaaagaagaaaatttaatcgggctgcaggaat

SEQ ID NO: 62365 - DNA, 7098 bp, Oryza sativa
taaattaagcgccagaacatagtcccacacacctctttttaatcaaaacatttacttgaggtttttataagaaaaaggtgacaatttattcaattccattgtccaacaatttaccttaacatatctcgctggtaagaatcataatcccctccgcccctccgctttctccctcccctccccatcggcggtgacatccctctcccccctccccttcctgtctcgctagcatggcgtgacagctgtacatttcgtggtacggagtgacgacggtgagggtatagcatgaaagacgtttccttggcacggcgcaacgacaacggcgatatggcgcaacgacggcgtgggcacggccgaagctgtttcgtcgaggcggtgcagcgacggcgggggtacagcgttaggacaacgatgacagcatggcaacaacccatctccctctcccactcagcctcttcattttcaccgtcaaatgcgggagatgttggcggcagggaaatgggctcgaggacgacaatggtggatccaggaggatgatggcagtggtggtgtggttggcaagttcggctcgattcgagccagctttctttttttttttctcgtgcaaagctaaaggtgtttgttctattttcctcataggtgtcggttgctggtattaataccgataaattggtgccggattttcatcctacgatacaaatcggcacatatggcatcttctatagtcgtgttaggatgttaggtgacttctaatctaatccattcatcttctttaaaatccatgcggttttttcttaagcgcatttcacatagtaaaactatttttattcggcgaatagtaggagtacacacttacacaagattttttttttggcttttttgcccagtgaacaatactatgtattatacgtacgcgggatattttttttcccagtttgttaagtgttattttcctaatagatctcatctaatggtataaaataactggtctatcgatttaagtgaaaatcaagggtcggatgttttatatttttctcagaatatttaggatctcctattataattacatattttttatactaaagtgaatgattaaatatatgctcaaatatcaatagcataaaaaatcataggtgagaccaatatattgtagggtattcaatataaaactaaataaagaaaaggttaaatggagagtaaaaaaaagtggggcacatatacgttacatgcgtacgaatgggatgagggaggcgtacgtacacgcgggtgagatgagagggaggaatagcttcttttttattctaactaatggtctaaaataatggaaccacctatttaattaaaaatcgacggctaaattttgcctccatatagcggtataggagcatttttagaaatctcacatgacggtttaatagcgtttctaggaattttagtgaatttttaagtatattatagataagtatattgaaactatggttctaacatacatatgaattgaatttataatttaaaagctacaattgttgaaagattgtctattttttttgtaaaacccataaaggtcatgcagcccttgaagtgcacaatgagctgagcttagtctaaccgagttgaaaataagttgggattatatatcattttaattaccatacataaaaagtgagagttcgttagaaatgaaaaaaaaacacacagagagagagagagagagagaaaaggaaagggaggttgggtgtagatccgtacacgtacacgcagaacaaacgattggaaattgggattcgtttttaatttacagatagatctgatggttcaggatattagacccactaatttacttaaaatcaagggagcatgttttttatttttactaatttattgaaatgtcatgtatcaatttatgagtatttgtaggaatgccacgtggcgatacgggagcgtttataggtatttcagttttttcttcacctggcaaaatatatgcaataccgatcttgatgtatttatttaattacaaataaaaatagcacaaatgaatttaatgctttatataaattgagaatcatgattatttagctatttaaaattaaaactattttataatgagtttttagaaaataggagaaaaggggagggcatgtggaatacgttgcacatatgtacgtacttacgtacggtggcaagtactgcaggggaagggaaggttacaaattctgcgagatagatctagagggatctaataggcccataggttggtttgagtatctattcctttaaatcggtctaatggttaaaaataatgggtccactgatttaagtgaaaatcaatggtgagatgtttttcttttttctaggatttttttctaatttattagagcgccacgtggcgacttaggagcgtttgtagagcgctacgtggcggcttgagagcgtttataggaagtttaatggacttttagtatataataatagatagatagatagaagatagatagatagatagatagatagatagatatttgctgttacacgacaatacaaactatctaatcaataactagatatttttggttaatgtaggagctcacttaaatgtgcctgactaactaatattgccgtcacatgccacggacaaaattagaatcttttggagatggttgtacctgagtggccacgggagcacgttggcgttggcgttgtagaggtgggtgtcgaggctggcgttgggcatgagctcgtagacgaggaggagctcgcttccgtcgtggcaccagccgatgagctgcaccagattgcggtggcggaggcgactaatgatacgcacctctgactcgtactccttcctcccctgcttcgagctctaggacacttttttaatggctacttcaagattcagatccttcaagaatcctttgtacactgacccgaacccgccttccccgagcttgcagtcgtcggagaagaagtctgtggcgacggagagctcgtcgtagcggaatcgctttggtctggtccccttttcgaagtcatcttccatctcctgatgctccctcatcagccgggcgtgcttccggcggcggcgcaagaggagccagatcgagacgccaagaatgaccatgaaagagacggcgccggcgacagacaggccggcgacgaatcctgttgaccttgtggacgacggaggaggcacccggagacgatggcggaagagtgatgccaaacggcgagaggtcgtacctgaggtagcagctgtaccccttaatggcggcccagctgttgttggggaagattttgctgagttgcacaatgtagtcagacagacaggtgctgcactcgctcaccgccaggtccctcgtgcactgagccagaccgtacatcatcgatgttgatccgagccgcgtacttccggtgtccagcctgagcttggtttggccggccgtctccgcgagctggctcatcagctgccaccgcgtctcgttcatggcggccatgttctcgacgtaggatttggcgtacacgttgaaggcaacggtcttgtcggcgacggagaagaaggagacgtcggagtagcggaggaggcaggcgtcgtagttggcgttcaccgtccgacttcccgggcacacctgcgtgatccccgcgggtgcgccggcgaggcattccttgcattgcgtcggattgcggtcggcgtagcacatgatgaggccgaacacctggtcgtcgccacccgttccgaccgagctggtgttgaaccagccatcgtcggtggcggccgtggcaagtgtggagaggagctggtcgaggttcttcttgtactggctgtcgccggagtagtttccggtggttgagcaggatgggttaaacggaacgattttgttgccctgaccgatcgccgctacgcagagcgagacgaagatcgcgaggaggaggatgagatgttgggaagccatggcaagagagtctggccagccggcgacacccgttgctaccaagtttttttttttttgagagctctccactttgagtacaagctgtagtatctgaacatacgtgcaaacgcactccaccacgcacacacactccacctatcaactatacacacacgtgctaatgagatacacaaagccacctaaggaccttgtgcgtgacgaggacgtcactctactattgtggcgctggcacgggagagctggaaatttatttgggaataaatcccggtgagacgcgcgggtgacgatcccagggatcgaacccgcgcgggctgctcgctcaccagcgatgctagccaaccgagcacgctcggttctcccgttgctaccaagttgctacggttccttgctactagtacttgctgataaatattttagcactagaatatatattgtagtagaggttaaagaaaacacgatagtatattattgaacttgataaagtgagtggtagattgtagaagctagtgcgataaactcagtggtactgagtggattctctctatttaaaatatggagggaaagtgaattcctccctcgtttcatgcatatcacataaatagtcataaaaaaatatgaaaaaaaattggcaagataaattaatatgaaatactttttctgtttcacaatgtaagtcattctagcattttccacattaatattgatgttaatgaatctagacatatatatctatctagattcattaacgtcaacatgtatgtgagaaatgctagaatgacttacattgtgaaacggagggagtatatcactccacaaacatgcaagtttaaatttaacttctataagttgtaacaaaaataacaaatatagttgtgaatgcacgataactatttttagtttaatttattatttttgttgcaacttatagaagttaaatttaattttgcatgtttgtggaataatatatttcatattaatctatgttgttatttttttaaaaaaatttgataactatttagataacatacaaacaacgaggggatgtctccttaagagatgaaaattcacataattctcactaccatatgtacaattcagaaactagagtcagcatactgcaatttgtgtgagaattattgtgtcagagggtcttttttttccacgttttggctttcgctgaggtgtgtgataaggacggaacacgggtcctctctatgttggcgtcaaaagtcagcattctggatagagaacaacgtcatctttggcccggtttagttcccaaatttttttataggttgacacatcagatatatggacacatatttgaactattaaacatagtctaataacaaaacaaattatagatttcgccagaaaactacgagacaaatttattaaacctaattaatctgtcattagcaaatatttaatgtagcaccacattatcaaatcatgacgcaattagccttaaaagatttgtctcgtaatttacacgcaaactgtgtaatttgttttattttttatccacatttaggttgtgtttagttgagggaaaagtttggattttggttgaaattgaagatgatgtgactgaaaagttgtgtgtgtatgacaggttgatgtgatggaaaaggactgaagtttggatccaaattttggatctaaacacagccttgatagttcatacacatgtctaaacattcgatgtgatgggtgaaaagattttattttgtgaactagacagggtatttgtttaatgcttaggttatatttttatttattttctacttagattttgtatactttgtgcagattgatgcagtttggacacagtcaattgtttattattgaagtacctattggaatgttcctatcgagtaataaaaatctaccgttcgaagtccatgatacaattaattaagaggaaatacacgcgttttcagtcaaccaaaatatttggtaaatattttttgtaaaatgacagatactttagggaattgactcgtattaagaattaatgactccattagtacagcacgaataagaaaatcattttttgccttaaaggataagcagacaaatctcttctttctataaagctaatgtccactaacacctaaaacttaacatgtaaaagggcatctccaagagagggctaaacaggttcctaaaagataaattttacaattttgatgaaaaacaggcctccaacagattcccaaccatggtcccaaaatttacctccgaccaaaatcatggccaatctgagccaagacttgggagcgtggacgcgctcccaatcccactaatcgtgcaacattttctctgcccgcgccatttttttgtccttccgcgcccttttttattttattagtgtcggctattttttctccgtaacttcgatggtgtaatttttataaatgatgactagaaatattcgaaacttatttaaaacatgttcatatgaagtcccataaagtttctaaagaaatatcgctagtttgaggtgtattattgctaaatgttatagttagagaaatctgaatgctttcaagttgaaaatatgtcgcaagatatataaaattaatctcagttgcagtacaacatgcttcaaaacttttacaccgttgtttgagatataaaattgagaaacatagaagaaacaacaatataaaagttttcaaataatttgaaaaggaaactcacaaatagataaggtaatatcagacatctatgcatagttcaaggataatcttatgagatataaaattaagaaatatagaagaaaaatacaaaaacaagaatagtgttatttgttaattttatttcttattaacgaagttgagtttgttcatgtaacttggtacggttgtttatttataaaatatctacaattctacatatgtaattttttaagacttttttagaacttctataaaaaaagtttccaagttttcacctaagatgtggtttccactatatatttccggcatatagaagtgaggctcatcatgaataaatcaagtggttatatctgttataggaatgaaaacggagtggatacaaacaaatatgctcttatcatatttgttttcatttttatctagatatgaaaacggatgtgaataaatcaaatacaaaatcaaatatg

SEQ ID NO: 62366 - DNA, 825 bp, Oryza sativa
agcatattgaatcccagtttataaaattattttgatttaaattaatgcattatcgctttatttaaattcccgcgttatcactgttttatttagccatgcctatttacctttgttatgaccttattattattgctattgttattattaccttgttcaccctaggataaacaaaaccccaactagtgggtactctattcatggttccactagtatgaatttaggtagatgcttcgctgattaataggacaacattaggtggtttttataacttagactttgggaattttcatatcacttggatgctatggaatggatggcttttgttggaattggacacacacctccccctctattcaaaacccccaaaaatggttttaggctgggctcgaggtgcgtggttgggtttggttagtcgtacctcgggtactataaggattaagctcgggcctctgttgcaaagcactaccgtacttccacatgtctagtgggtaaggcttagtttgtggctcagtctggttataaacaaaagtacacggatggagatggacgaagtcgggggtcgatggacatctctaggacaaatgaaggctacacgagctgcggcccggtagtcgagatgtcatggcacagggccggtgtcctgctgctgggggctcagtcctgcctacctgtcccgggggttccggccgtaggtggggttgggtcggtactcttgtttatggctaggatgggttgggaactatgtcacgtcttccgtccgtataccgtggtggtatgtggcacgtggttacacgtgaggaagatgtgtcttgtgggtaaagatgt

SEQ ID NO: 62367 - DNA, 4688 bp, Oryza sativa
tgctcaatcttttccccccttcagtaagagaagcttcggagaagatgtcttaggtggagtcctggcttatatcccagttgagcgcctgtgaagatggagccgtaggcccgcttttccgctgctgtttatttttgtttatcaggcctgaagcgcctttgtaataatgtatatattatcgatataataaagatgtgccttttgtatcatgtttgtttggtgtaccccggcttttcctgggacggggattaatacactagcgttcgggaaaaggtatttttctcggtcgcgacaagctggtatcagagccatctcgactgtaggataagccaagtggataaaacctaaggacatattttataaataaaactatttgcgaaagttccttttttctccttcccctaatgctatttgcaaaaggtttactccgttcttccttcttcggattttcaactagtactagatggtcagctttgcgaagaagaagatgtcgccaattgtttgccgaagctccggaagactgcaggatccgcttgagaagtgctggaagcagtgaagccagctgtgaaggagtgaagatcttagagaacccgtcgcagaacccaagccaccctctagggtagagtcgtttgtcgtgtgtttccttgcttgtgtgtgtagcgcgtggtttgcatcagtgggttgtgatgtaaccatgctaggttgtttgcttaatcaacttgcagaataagcaaaacaaacaacacatcaacaaaaagagttagttcctttaaggtcttgtccctagttttggtctattctttcctgacttgtttcctctctcacctcaatccctgtcacagatgtttaacagagaaaaaggaagtaactcaagttttcaactcaatccaccactggcctcaagagagttagcaagggcacacccttggtccattccaagcatgctgcttagttcacagctaccattggttggaagtcaagaccaaaatcagtatgtgtttgatcgaccatttgccacccaggtcaatgagcttccaatgccagaagagcatgtccccttttgtcatgattgtagagagcaaggacactatgccctgaattgtccatgggtatatgccaaagaagccccttcctttggtttagcagggcagtgtagacccccgattttggaaatcggaaatcttctgtgtttatccgtaccaatccctggatcagtagttggtacacacatacatagttggatcacaacatatcacgaatgaatttaggctaaaagagttaaatacttacattagggccaggtaggccaacaactatcagagaacaacagcggaagacaaaataatataagggcccggttaacatgccacaggcagtcgactggggaacgagacctagaacaagaccgcactccgatcatcttgtgggatacgcaagcgtaccgacaagggcttctcttcaacactctcctaaaagatatataaatagcaagggtgagtaccaaccgtactcagcaagccaccacaacaacaatgcatatgatagcgggtatttcaaggaatggcttcaggttcttttgcataaagctaattttacaattcttttcacaagcctaaaacctagcatagactgatcaaattttagtaccagtgttcactttaaacaacgacggttctgtccaccatccattgtgatcccaaggatagcttcccgccattgaatcgtcatggttttctgaggatgtccaccttccctcctctcgggatgtggctccatcagcataaaattcatcatgcaatatcccatcccacacaagttaagaatttagagtctagccaagtgtaatacatgtcccggtgctcaataaccgcgagcacggctattcgaatagatttggtttactcacactgcagtggatgtacactttacccgcactccgcgactacccaacacatgagcctcgtcccaacacatgagacgcgtcacggcaaagcttttcgataacctcgcattggcagtacccgctccatgaacttttcatcctcatgcactctaggcgtacacggtttctagcagtgagaggagttctggcgcacccgggaagggaagactcacacatgcattaagttatagttatgttttagattctctcatggcagtcctaccgatggcgacaccactgtagacacccgcctcgcggtcctaccaatggctgccccaccgtagagcccctgcctcacacatcaagaaaccactatgcatggatactgcctccgctcagctatctactccgctaggtctatacccatacgagaagtgcggttgtacgggggtcgtttcatgcttaacttcatggctcggtccttaattgaccagggacggcactagcattttccggacaccacccaagtcctccagccgccccagtcgaaaacagttgttttacttttttttcctttcacaaatcatgtcatcaatatcatggcaatgtggcgctcatgtctccacatgccgcatctcaattaccttcccaaaggtaattgcccaagcatatagcatttgataaatatgagtatgcatgattctagaatagcctttctaagcaattgtcatagttgactagggactcatacgtaaacatggttacaaagatttaagggtaaacaataatcaaggcatggcataatcacaagtaggatgttcatcattgcatgcaattttatttataaacaaaacaatttcgcaattgggatcaacatgctcaaggaatagtgatgacttgcctgctcaggataatccctattctcgatataatcttgatcaaccttcacctcctggaagttgcagacgttgcctcacgactaaccgatacacaaagtctataatacgcgagaaaaaccaatattcaagcaacaatcaaatatgcacaaacaaaatatatttgctgagatcgaacctagggttgctcatattattcgcgcttgctaatggactctaatcaagctaagagctaaggtttcttagtctttctgttgtcatggtggttcagtctagctaatggctaaggaaggattatggttacacatgcatctatctaaatagaacggttatacactagaggttctgttgccggatggattttggatcggtcaaataattactgtgaatcatttgtattattattttattaatggaggctttaatttaattatgtacatatttcacttgtcaaaataaattataaaaggttaacaattacccatgctgtgtatgttagaattgtttaggttaatcatattatggttacggattatcccatcacataattttacaatgaataatccaaatttacagttgatctgtaattatacgaggacaagatgtataactagtatttatctaatattcatgttcgtcacatactccctctaaattaatatatgcaacaagcaaattaatacgataccatatatctataatgggatgtacaatatatgtgtgcacaatatcttaatatattgaatcatttatttgaatagtttctatttactgcttggttaactaagggttgctcacctctcccactatatgctattatatgggatatgtcgttgattaatttcatataggtgatttaatcacactagctctgttattatttgccataaacaagcttaggaccgatctatgtgtatctatattttacttacctaataattataaggctaactctatttaaataactaataagtcgtgggttttaattatatttggacatagattaataaatggcactaatattttcctatatatccattaacttcaaacatcgattatacttaatttatgtggttgctacagtgacagaacatattaaagataattattctgctgtacaatactaagcatatttttaagttgactattatgcatcatcttgatattaattatttaatttttataaatatattttatccaatagtgaattatatatcattggaaagcttatgaaattagatgaatttaggttcaagtttcactcaaatcggagctgaaatgaataagttatgctagcgtaaagattcaaatttgaattaattctaataattgcgaaatggtactgtccctaattcatttatttataatacaaccttatccacaagctacagtgaccgacaggtggagtcaagctctttattttcttttcattaactttactatctgcgaactacggcaaacccaatttcgatttaaactattttgcgggtataattattttgttgtcataagtttttaatttactcttcccgagcattatatccatataataggttagaaatttctattacgagctaaatatcggacgaaatcctagaaatattatacaatttaatttagtctatgactaaacgatataatacacggctaagattcctagtaattaaatctgaatttctaccgtgaaccgatgacttagagagattaccaaaaataatctataataatctaaaagaattcatctaattgtttagttattaattatatctaatttactaccaattttaatctaatctgatcaagacacatattcttataattaactcggaatttcgaccgaaatactattacgctcgaggaattttcaaaaataatctatgattaaccccgaccatttttatttcctaaatcct

SEQ ID NO: 62368 - DNA, 8123 bp, Oryza sativa
ttgtaattagacttagtatataattattgactagctagggtcctaatgtacgtcacttagacttggcatagttgactattacagttttaatacaatattatttgagttttcgtataagattattatagttttaatataagattattagatttgtaattagacttagcatatacgacaattagacttagaatatatgacttagcatatatgattgttagcatataagattgttaaagcaaaaatgtctcatgacttagcaactatttcttgtatgaacagacggctgatcgcgatgaggaacagatattgtatgatacaatcgcggagggaagcagccagtactggaacgaagaagaggggaacgaggatccaaaccagtacttgaacgaggaagggaacgtggagagggatgcggaggggaaccaagaggggcacgtggagagggatgtggaggggaatcaggaggaggaggctagtggaagtcaaccctccgctggacggaagagggcacgcgggcaacgaggtgccgcgaagaagcttgagggtcggcacatcataacggaagtggacgaagacggccgacctattgccccggtggaagcagccaagaactacatacgtcacagcggttgggttgtgcgggataacgtgcctgtcagtacggtgtactggcgcagaacaagggcacgcggagatcatgagagctttgtcccagatttggagaaagagatgctgtggaccacaatgctcgagacattcacccttcccgtggatacagaggacaaagtgaaaaggtggactctaaagaaaatggcataacagtttcagagattcaagggaaatctgtaccagaaatatatcctgaaggggcagacaccgaacttcgacacattcccaaagctaagggatcactgggacgagtttgttgcatataagacaggtcaacaaggacaggcgatgatggaaagaaacaaagaaaatgcctccaagaagaagtaccatcaccacttggggtcagacggctatagcgtcgcgatgccgaagtgggaggagatggaggcaagcttgcttgagaggggtatcgaaccggccaccgctaattggccggatcgatcgaagttctggtattatgctcacggtggaacgctcaacccagctgatggctccctggtcttcagcgatcagatacgcgaggctgcacgtcgactaacggacgcagtggaagcctcttctcagggcacgttccgacccgacagagagaaggacgagctgtcactcgccctgtagactccagagcatccaggatgaacacgagggaaaggggtgattccttggaagattgggttcaagaaggacatccacacgtacaggagtcggatgaggagcaagagagataccgaggcaaagattgcagatcttgagtacagggtatcaagctacgagctcagcatgcaagaggaggtggcaaggaaggttgatgaacgcatggccgcacatcggtcccatgatccccagccgaccattcctcctgcaatggtgagcccttcaggaaatcgtagcagctgcgccttaacggggcaggtaggatcacagtgcatggacgccatgcaaacccaggacaaaaccacctgccccgttgatgacatcactcagcggacaccatgtgagctgcatattcccttcaagaacttatcaataaaggtaagcttgtagtttatagattttagatttgtccattctgtaagttgctgcttatatatgttcattacaaataaataacctctcaccacgtgaaggtggcgtcaggcatggccatcccaacagacccttcaggtacttaccactacaggtcgattctagcaggatactccaaggtcgaagttgagttggtcgaaggtgcgtacgaggacctcgagttggattaccctggaggagatggtgagacgcatctacgagacacaagccacgccattatactatggcgcaagtggtacatcatcctccctgggcgacaagcggcatctcgtgcaccatctcctccggctctgccatctcctcctcaggctcttgcaccgtctcttcctcatgctccagcaccgtctccacctcaggctcctgcactgactcctcctcaggctcctgtaccaactcctcctcaggctcctacactgactcctccgcaagctcctcgtccggcaccttccaagtcaagggccccccaagctccaccgcctgcccccacaagggcaacgaagaaggcgaaagttgacgccgccaagaacaaggacccggggtacgattgcacgcaagaggagcttgacgcttatgtggcatcagaagtcaggagacaattgaagcctcgaagcccagaaaagaagattcctatagacccgagtgtcaagaacttcttcaggggtatgtctgcacctgccaaggaggccataaagctatcggactgtgagcgaacactcaagaaaacatcttctggaaagtccaaaccagtctctcagcttggagagcaaccaaaccaggagatcaagccgttggtgaccggtgaagattttggaatacaagaatttattaatgacactggctaactacggatcaattgctacgaggcgcaccaatcgaaaaggcggaagtgaaatacatgtacgaactcggtaaaccgcttgtcaagcatgagcagctgcagtccctacctacagaaatgtacaagttccatcaactgtacatggagatgagcgccaccggtagagagatgatcggagcgaggatcagggacacggacttcttgcaaggagatgacattctctggatcaatttcaagggtatctactaactataccagctggacgagttgctggattttgtaagtatcgttcagttagatttcttattacgtttcctttaattagttaggtccttgtatataagtacactatatataatatatactcccttttatcgttatagaatggagattcaaagggctcgacggcggggggttttcgatactggattaattgaccctcggaaagtaaacgttgcaatgctcgaccagtatccgcaagccacagaggacaatctcgtccatctcctgaaggcgcagcattacaagacgttcatactgttgccgtacaacacagagttagtttaattttactgtctttctataccaaatttcattctcgtacgaacatgctaagtgtttcatatgtaatgtatcccacgcacattacagattccactgggtgcttttactcttcgacctggaggcctgcaccgtcaacgtatatgactcaatggataaaaaagacctacgtttgacaaggttttcgaacttatagataggtactgtcataagttcctatgttaattaagaatcttgttatagttaattgctactacgaatcatagctttaaactccatgtagggcttggtatcggttccgtcatttggtccgtggcaaatggagagaaagacttaggcggaagttcaattttcctgtgagtacatgtcacgaccggaaataacccaacgggcgttccttacgtgcgtgcattattccttgtcccaggagacaaggtacaccaaaagttgatacgattcagagtttaacaagcggaagcgtaattaattaatctattacatgggtggcgaagacccagcacacaagaagacaaacgaaaaacagcggaagactagggcgacgaccacaggcgcttgacggcaggcacgagctagacaccaaagccttcatcttccaggaactcctcttctgagtttgggaaaaattgagcaagactgagtacaaccaccgtactcaacaagacacacccacaagtgcagaatacatgcaagggagtacaagggggttatagtataaagggttagggtttgcagtaaacagcattaaaagacacttagttgctcaaagttattttgtaaacacgattctatagctatataatattattaatcaaggccgtgaacccacacgagcctgccttaacccaaggcatacgatgattcagaccgaactggcaacccgaccctgagtcccagctcgtcccaagccaacccaggccagccattccacattttaattgttaagtaggttttaagaattaaaaacactaacttgggtacattgctcggcttgcccataaccgagggcgcggctattcaaataggttatactctgatcagaggtgtacatctttacccacaagacacatcttcctcacgtgtaaccacgtgccacataccaccacggtatacggacggaagacgtgacatagtttccaacccatcctagccatagacaagagtaccgacccaaccccacctagggccagaacccccgggacaggtaggcaggactgaacccgtagcagtaggacaccggccctgtgccatgacatctcgactaccgggccgcagctcgtgtagccttcatttgccctagagatgtccatcgacccccgacttcgtccatctccatccgtgtacttttgtttataaccagactgagccacaaactaagccttacccactagacatgtggaagtacggtagtgctttgcaacagaggcctgaagaccggtccttatatggctgaggtgctactatcaaaaccatgcaccccgagcccagcctaaaaccattttgagagttttgaatagagggtgaggtgtgaatccaattccacaataatccatccattccatagtgtccaggtgatgagaatattcccaaagtctagagttgtaaaaccacataatgttgcctaattaaccagcgaagcatctacctaaaatcatactagtggtaccatgagtagagtgtccactagttggggttttatttattctagggtgaacaggggaataataacaataacaataataaggtcataacaaaagtaaataggcatggctagacaaaacagtgataacgtgagaatttaaataaagcgataatgcaataatttaaatcaaaataattttataaactgggattcaatgtgttcgaggatgatgtgacttgccttgctcgctttcccaaacgtcggcttcaacctccacgaagagcggatcttccgaagctgcagcgtctacacgaccaacggaaaagaaaaggcttttactctaataaactccatataacccacaagaacaaagcacaaaaatgggttcttgacttcttaaggaaaaattaaagacttgaacggtccaattccgagttcaaatggccaagttatggccatttgaagtttatatgctctttaaatgaatatttacgaatttcttcatttaaattttaatttaaaaatggtttattgcgtcagccgagggggaggggcatgcggaccgggtccacgggagtggggcccacgcggcagcctcacggtccacggtggaccgggtgcacccgggctcacaccgatcggcgccgtgggccccacacgtcagccgcacccgagggcgcgggcggctgacggccgggccccacgcggcagccactcggcgcacccaagggcggccaagccggcgcggacggcgggaggcggcgccccgcgccccgatggtcgccgccggcgaccaccggcgcggcggagcggcggccgagagaggggagggaagggggaaaggaggcgacggtccacggctcacctcggggcgacggcggcgatgagggaggcggccgaagcggagggaggcggtgtcgcggctcgggtcgacggggtcggcggcgctccggcggtcggcgaccgaaacggagaggtggacgaggtcggcgaggatgcggcgaacccgaaggaggcggcgccgaggtgggaggcggtccggggcgacgacggcggcggaccggagctcggcggcgatggcggagagagagagcgacgtcgcgagctcgaatccggcgaggaggaagggcggcgagaggcggaaacggacagaggaggtgcggggagggtttaaatagggttggaagggggagagagcggccggggaggaaggaaaccggcgcgggaggtccggccgccatcaatggcgccggcgagatttgcgggggcaaatccgcccgtttgaacgcgagagagagagggaaaaatgggaggaaaggaagaggggatcacggggagtatttccccccactttattgcacgcggggacggcgggatgcggcggatttggcggcggcggcggcgcttggcgcagggggagcggcgggagcggcgggaggtcagggatgatgggtgggccccacccgtcagcgagggtgccgggcgggcccgcccgtcagcggcgcgcgcgcggggagaggctgagtgggccgcggggagaggagagagagggggagggagatggaccgaattcggcccattagagagaaggagggattttagggtttttctttttataaaacctttttaactttgtttatttcttaacaattattatttgtgctctgaaaattcaactaaaatttatttacgtattttaggcttttaggaaatatataaaaatcctctaagccttatttgacttttaaccttgcacattttaattgttggaggctttcacatggtttttaatgattctatgcataatttagaggatgtattttagagtcgttttgggacgcgacaaacctaccccccttaaacggaatctcgaccccgagattcggaagaactggcgaagagatcaggatgggctgccttcaactcgtcttcatgctcccaagtagcttcttcctcggcgtgggtgctccattggaccttgcaaaaacggattacccggttcctggtcctgcgctccatggtgtccaggattttcactggtctctctacgtaggtcaagtcttcgcgaacttcaatctgctctgagtcggcctgctcggacggcactcgaaggcatttcttgagttgcgacacatggaacacatcatgcacgttgcccaaggatgcgggcagctccaactggtaagcgacttctccgcgtcgagcaatgatacggaaaggacccacgaaccgaggtgcgagcttccctttcgtctgaaacttgtgtacgccccgcaatggcgtgaccctaaggtacacaaagtcatccactgcaaattctaggttacggcgtcggttatctgcatagctcttctgccgagactgtgccacctttagattatcccgaatagttctgaccttcgcttcagcttctctcaggatatcagtcccgaacacttggctttccccaacttggtcccacaatagcggtgtccggcatttgcggccatacaacgcttcatagggtgccatttgtatgctggcttggtagctgttattgtaggagaactcggcgtaggggagactcttatcctaggtcttcctgaaatctagaacacaggcacggagcatatcttccaggatctgatttagacgctcggtctgtccatctgtctgcgggtgatacgcggtgctgaaatttaaccgggtacccaactcttcttggagcttcttctagaagtgagaggtgaattggcttcccctatcagatacaattttcttaggaacgccatggagactcacgatcctagcgaacaagcttgggcctagaggtactcttgtgggtggtgatcttcaggctacggcagacgcggcggcgcttggggcgacagacctctccctgggcgatcttgagctgacacagctgcgcctccactgcgtctaggtccttcttcagctgtagattctcctaacgcagctccaggatcttcatgttgttctcgaccaacccacgacacaccatatgatggaagtcgatacgggccgcgtcgtatgcctccaccatgcgtgccaggtgcatgatggtagcgtcatcctccgagctagcatccctgaaggtggcgcagtcgcgggctcctccacgacgagggtggtagcggtagggcgagtgctgcaacccgtccgggtatcactggtgaagagtgccgatggcgaggagagcggcgttctggcaagccgcggagaaagaatctccacccgcggtaactgccaacgaagtcctctcgggtgagccagtgaggaaataacccaacgggcgttccttacgtgcgt

SEQ ID NO: 62369 - DNA, 733 bp, Oryza sativa
  unsure (1)..(733): unsure at all n locations
cgctggnnattaggactacaacagatgcacccancaattcagaaccccagagtccgcacatcctcaaatacaaagcacttccctagttagatgtaggttagacttcccgttcgagaaactctaccttctacctgccctcaatttatgcacgattaatgaatgccacctgggtggaagcgagaggtggaaatggaaggtcttagttcggaggtgggatctctacctgatagttgcattgccattcatgatgatcccctggcattcgtccattcagccattcaccattcacccattcaactggaattttggttgaatgccggaattgtgtccacaaattgtggatggatagttggttggctggctggatggctggctggatggctggctggatggatggtgaatggctggcggcggttcggttgctttgaagcatttgttgctatctaaattccatttaaggtcgtaccttatcgcccagcatcatcttattctctatttgtattccctccatctttcagatacggatgtagccttggatgtgcccgtgcccaatgaagaggaagagcgcaacatgaaacgtaagtacaaaagtaccggacacccacccagatcccaatagaatccgccaaatcctgcgggaaattgtaatcccattcaccagctcctacatttaattaacaagagaactattgtatttatctaacacctggattatctccacctttcatttgat

SEQ ID NO: 62370 - DNA, 689 bp, Oryza sativa
  unsure (1)..(689): unsure at all n locations
aagattgatttgctnatcgcatttacacnagtccatcatatccaagaggttaatcctcgattcctccaataatttgtcatagtgtaaataaaggctcacacatgaacaagtgtatgtttgtgtaagtgtagccagggtctggtttagttctcaactttttctttaaactttcaactttttcatcacatcaaaattttcctacacacaaacttctaacttttccatcacatcattctaatttcaattaaactctcaattttggcatgaactaaacacaccccaggttatattttgcgagtgtacgtgccggcctgcaagccattttttggcccaacccgtaggccctctttgtttaggcttataagccaacttataagtcgaaaagtctaagcctaaacaaacaagcagcttttccatttgggcttttttttgaaagcccccattaaaaagggcccccccaaaccccttttttacactttagccaaagctaggtggagaagctttttgtttatgtgaggtagatgtatgactcaactactaaactaggacattaaatccacccggcttataaatcatataagcccataagctgacttaaagtctaggccatagcctaagcctaaacaagagggcccgtatctgcccacaaaacttgcatatatgactgttcgtggcccaagccattccat

SEQ ID NO: 62371 - DNA, 669 bp, Oryza sativa
agatccagtgcacgataaatttgtcataaatgccgtgtggccagtgaggggtcaacatggatggcagtggagagtagtggaggttgcgtcaactgggagttggaggaagtttgttagtaaagtaagggagaaaggctatagcctggcaatagtggtgcagaagacaacatgtgttgatcgatcgggggagtcaagtcatgcaggtattccaaactccgccttatgttcacccctcgcagggagcatctgggtcggcacacttcccttacatgccaacgggggacaacgtgttgaacacaccagcatggggacttcatatcactccgcgtgcgccagagcagggccacacacagcacacatgtaagtcattttaaacaataacacgctttagtttctaattatatgtatcgttactaactacgccatattttttggtttctccctcttgtacaaacagacgatgagtacggttcggcgtcgacgcatcacggagtgcctgcttactcccctcgcacagcattcattgaggacttcttttccactgatcctccccaggaggaagtagggatggattactggcacgcagcacctcaggtcacacagccgacgcaggagacggaggccggtcaggggccagacgtgacaccacagcagacagctagagatagg

SEQ ID NO: 62372 - DNA, 2531 bp, Oryza sativa
  unsure (1)..(2531): unsure at all n locations
gcggcggtggccggcgacgacatgattgaaccgtcggcgatgaagaagaatgtggagcgtgaagactagtgagtcgtcgtcggctaggagttgacttgatctgaacaagtcagtgcgaaggcgtattattcgttgttacgtaaacgttctcagaaagcggaggcatgcttgttcgtgtcgtgtgcatgaaaagcgtgctttccgtatcaaagagtgggtatcatttactagtccgtttcatgattagtgctaataaaccatggatttttatactttgttctatcttaagcttcttgttgcaaatctttgccaacaacataatatttcatctacaatcacttatgaagtctcctaaactttttttatctccaaatatagtttggcaaaccagttttatttgttgttaataactaaaattttgttaacttaaaagacatatttaagattacttagggcccctttgaatcaaaggaattatgaaggattttcataggattgaaatcctacaggaaattttcctacgtagccctttgattcaaaggattgaagttttccaaatcctacaaaattcctatggaatggcttgttgcatataggttttggaggaaacttagggcccctttgaatcgtaggaatgaaaaaacagaggaataggaaaaacacaggattctgacatgaatacaattgtaaaccagaggattgcaaaacacaggaaaaacacaggaatgaccgtttgattggaccacaggaaaaacgtaggaataagatgagagagatagactcagaggaaatgttctaagaggttagacctcttgctaactttcctccaaaatgtgcataggattacctattccataagaattttaaaggattgaataggattcaatcctttgtttcaaaggccttcacaggattttttttcataggattaaaatcctccaaaattcctacatttttcctacaaatcaaaggggcctttagcaagaggtccaacctcttggtaaaaattctttgactctatctctctcatccgattcctgtgtttttcctgtggtccaatcaaacgatcattcctgtgtttttcctatattttgcaatcctctgttttacacttacattcctgtcagattcctatgtttttcctattcctccgttttttcattcctacgattcaaaggggcccttagtaattcccgtaggaaagtgtggggaaccacctaatattatttacaacaagtgccataatagaggtgactactaccttcaattttatccatatcactcactcataaataaattaagagacaacatatatgatgtgtcacttctaatacataaatatcgataactttaatattttcacactatttttggagtttgtgtggaggtaacatgtgtaaaagaggtatattgtaggtgtatgttaatgtgagtgtggtatgaatgggttgtacgtactccctccatcccaaaataagccaacctcatactaggatgtccaaatttattgtattagaatatgtcatattttaatatgaggttggtttattttgggatgatgagagtatctaattgtaactaactaaatatatagaccctatatcatatatgggtttaaaacaaggggcaaagtttgttacatgacattgaaaaaatgtgtaattagctggtagataccgcaagaacgtgaatttgctgttgggcacaaaaactggtaattagctatccgacactcacggcaccaaaataggagagataaacactcattaaagacaagtttgcccttagtcgaacttgctccctggtcgacgttgcaatggaggaggtggctagaggaggagcagagcgaagccgaccggcggagcgatggtgggtagagtaggccggcgaagcttctggagttaggcggcggacgcactcgcacttctcctcctcgaattcgtcaggggacctcggcaacggcttggctctatcgctccttggccgtgcgctaaagcgcctccatctcctcggcctccttgagccgccgcgccatctccgcctcccacttcctctgcgcctcgtcctccgacggctctccagtctcctcgctgccttcctctgaagcagaggccacgaacctagccacatggccatggccacggcggcacccacgtgcacgagagaggagacaacaagaggccgcgtcggcaccaagcaaccgccactgcgtcctggggggctagttgtagaggcgaaactacggcccgtggacggtgaggtcacccttaggctggtggtgtcaccgaggaggaggccagcagcccgcgttgcgcgcgggggaggagaaccaccatcgctcgccgctgctccgctagtcgccgccccgcccagcgcgtcggcaccgagcagccgccaccgaggcctgggggcctagttgcagaggcgaagctatggcgcacagatggtgtcaccgaggaggcactactagaaaataattttnnnnnnnnnnnnnnnnnnnnnnnnnnnnnngagcatgagacaggactcac

SEQ ID NO: 62373 - DNA, 9794 bp, Oryza sativa
  unsure (1)..(9794): unsure at all n locations
taaaggcgggaccttttataatgtcccccaagcaaaaatcggcggttttcgcctggggggctacttaaagaatccgctaagttaaaaaccagaacccccgcaaaaaattttgcccggttttaaaaccccccggccgccatttaaaccccacccaccccaaggccttntggtgttcccctttccctgcgcccctactggcgacggcgacgacggcgaccacaacgggccgagccatgggcggcggatgtgtggcaacgggagggggcagatgaaccccgactggagggcntcctcctcctcccctccctcccccagatctagctggagggagggggcagcagccgcagcggcggtgacagcaggcgggcggcgcggagctgacgacaatgacgatgctgtcggatggtgcgatgcgggcggcggtgcttgagcacgggtagggagggcggatccgccaccgccgggccacggggagagcagatctaccgccgctggaccacggggaggctctctcccgtcgcggtggctcggcgacggcggcgacgaggcggaggcggtggcagggcttggcagcggtggcatcgagatggaggtggtggaggccgacgaaactcggcagcggcggcgtcgaggcggatccgacggccacttcaaggacgacgacggcaacctcgagtgcgacgacgctggcgatgggtttgcttgggccaacggtggccgtaggatttttgtgatgacgatgtcttgtaatgctgctgctgttgatagttgtaatgcttgaatgatgttcaaatttttgttaatgtgttgatattgtgatgcttgaatgctatgttaatgtccattttcaattttttttcaactttctggatgagatggtagaaagggatttatttttttatggaaaattatttttactggcggttagcataacacaaccgccagcaaaaactattttcactggctgccttgataaggcaaccattagcgaagataactttcactggcggctgtctccagcgaaaatttgtttttgctggcggctgacttaagatgccagtgaaaatatttctttgctgaccgtcgataaccgctagcgaagatcttgatcttcactgccctttgctttgtggcggctctaaattccgctagtgaagacccaaaatggccaccgcgaaagatggttttcatagtagtgagaaggccatcggccctcgccacaccgggggggaggggggggagaccaccaccggtcaagaaccaccttcgcccgccgccgtcccgaccagcgtctacccactctatatggcgccctctgccgcgttcgctcgctgataaagagaagagaagaaaagagagctgaagcaggaagaagaacaatgtccaggggcatttcggtactttcaacgctctttctctctctatcttcatcgaaaataataaaataatgcattgggtgtccagctgctaattaccacatttttatagtgtccacgagaagatatatattttttgagtgtctcacaacaaagactaaaactttgagtgtccttaacagattttgccaaaacaaaatgaccctacaccatatagtaacttagggtgcgtttgttcctgggggattgggtaagaaagcctatcgtattccgcgcgcacgcttcccaaactactaaacggtgtattttttacaaaaattttctataggaaagttgctttaaaaaatcatattaatccatttttgaaatttaaaatagttaatactcaattaatcatacgctaatggttcacctcattttgcgtatcttcccaatccccttctccactcttatagtactccgttaaattcatgggtgcaactgagtatgtaagtcatcgctacgagcctgagcctacgatcacatgggcggtcaaattaaatgcacatgttctccgttgcagacagtaaaatgtcaactcccccgtatataggaataattatttttagttacttaggcgacttgcaagcaaattaaattgctgaagtcaagtcaattgcttgctcatctcaccctcactctagatcttcaggttataaaatgccaaatgctccaatcgatcgatcagagctccaaatcagtaagagacagctaggtaggtaccagcaaaattaccactaatataactacgagaattagcaaaatttgattagcaatgagaatgagaggcagtaggattgctctcctgctgctgatgctcctgcagtgcggcggcttgccggggatcgccgtcggcaggtgcgtcgtcttcaacttcggcgactccaactccgacacgggctccctccccgccgccttcggcttctacctcggccctcccgccggccgccgcttcttccaccgccaaaccggccgctggtccgacggccgcctctacatcgactttatcggtaagtactactccatccgtttcgaaatgtttaacgccgttgactttttagcacatatttaaccgttcgtcttatttaaaaaatttaagtaattattaatcattttcctatcatttgattcattgttaaatatatttttatgtaggcatataattttacatattttataaaagtttttgaataagacgaacggtcaaacatgtgctaaaaagtcaatggtgtcaaacatttcaaaatagatggagtacaaatcaatcaaactatcaaagccaggtttcaaatctccagcatatatagctgccgctatattcgaagataattgtttgagcaaggtctagctaatttatctagtatactatatgacgtcattgactttttaaatacaattgatcattcatgttgtttaaaatatttatataatcattatttattttattatgatttgatttattattaaatattcgacttaatttttttatatttacacaaaactttttgactaaaacgaatgttcgagcatttattaaaaatcaacggtgtcatatattaaaaaaataaatatagtacaatttagtttattattaactgtttgaaagagtatacctctaattaaatatcttaacccgttatttaaaacacggatcaaagctaccaacatcatgaattcatgatcaactctgatcattcgatcatctgaatgtgtgtagctgagaagctcaagatcagctacctgagcccgtacatggagtcgtcgggctccgacttcacctccggcgtcaacttcgcggtggccggagcggcggtgacgcaaaagagcgccatcccgctcggcctcgacacgcaggtcaaccagttcctccacttcaagaaccgcacccgcgagctccggccgcgcggcgccggctccatgatcgccgagagcgagttccgcgacgccgtctacgccatcgacatcggccagaacgacatcacgctcgcgttcctcgccaacctcacgctgcccgaggtcgagcgggagctcgccgcctccgccgccatggtcgccgacgccgtccgcgcgctgcgcgcgagcggcgcccgcaagttctgggtgtacaacacggggcccatcggctgcctcccccaaacgctggcgctgcggcagaagcccggcgacgagctcgacgccgccggctgcctcgccgagtacaacgccgcggcgaggtcgttcaacgccgagctcgccgccgcgtgccgacgcctcgccgcggagctcgncggcgccgaggacggcgccacggtggtgtgcaccgacatgtacgcgatcaagtacgagctgttcgccaaccacagcaggtacggcttcgagcggccgctgatggcgtgctgcggccatggcgggccgccgtacaactacgccaacctcaagacgtgcgggcagccgacggcgacggcgtgcccggagggggagaggcacgtcatctgggacggcgtgcactacacggaggacgccaacgccatcgtcgcccgcaagatactctccggcgacttctcctcgccgcgcaccaagctcaaggcgctctgcaagtgatgaagaagacttctgcaccgacgaccaaattaattaagttgataattaaccgaggttgcatgttaacctgtgattaattaagaaattaattagatgaataaaatgactggaatttgctttcggtcacaataaaatgcgaacaatctcgattcatatcttacagtgcatcttatgtattgccgtataaaaagggcacatgtcatagttccatgctgggttcacaccctctgctactattaggggtaaatggtagagacaaacagtaaaatgtgaggagcgaaacagtgaagagtactgtttaattattttattgaaattaccgcagcaatttgatctcgtgtatccaaacttgatccaacggctataaatagctaatggcatggatcactgtagttctatgcgatatgatcccttccatgcttggtattcataactactagtagaattttattttgttgctagaatatttttaacaaacatttttaacgagttcgaattgtaaaaagtgctccattatatgattggaaaactaacagtactaatgcgacacacttcccagaactggacgatttctacgcagctttctttatatactaatttctttgaaaatgctttaaatccattttatatttcataacagttaattaattcgtttatatcctcaaacgctaatcacaaaatcatccagctagttttcggtctcctcatcatctttaaaaaattatagtttaagtttgataatatacgttatatattaatttagtgattaaatatcggttaatatgtcttaatggacaatttaatatgttcctcttcttctatcttcccccttcttcctcattaccttcattattttttctctacgtctatcatagtggacaacggtaagaaaacagacggctagtagttgccaatcataacccatttcccattccttgtacccttaagtgcgccgttggctatgtctctctcattctaccaaaggtcgtcaccttccaagaaacctctaccgcctacataggctctcccatacttggtagtcactaacgatgttaagtattactcggtttgtgcttgttgttggcttagggcatgtctattgcaggtgatgctaaatttgccacatcattacaatatcaaacaagtattggatttcatttttcttatctagtgtgctcgcaccgatgctaacatccgatgatgctaatattaggtggactcattggtgcaaggatgagttgagcttgggagaaagaaaacggataaaccaaatgggaaaaattattcataagatttattgtgtctacatttcacaaagtagatggtattttgtatagggaataaaattttcagaaaacttgatccttttgcaagtgtcctaagttacaatctaattctctctatcaaaactacagtagaaaaaaaacaaatgccacaccactatagtgatctctatatccaaacacaaaaaagaaaaaccacaagaccatggccctatttggaagattagcccatggctaattttgagagctaatgtttactcttgaattggtaggctaaacattagtctatggtgatatgtatggattcatgagctaatttagggctaaaaggtggagagaaagtagagaggagagagagagggtgatagggttgccttttgatggtcctcacagaaaattagccccattagcatcccttgtaggggctaatgttttgaggtggggctaattcactttagccacaaattagtctacctgtttggatccttggaggctaattcaggactaaaagatggggggggctaataattagcccatggaaccaaacagggcccatctcgcatctatctctttccacccaactaaacgtgcactaacatcccatgtgagttcacggtggatgaaggttaaagttgggcgcgaaaaaacataagtgcatgattaattgagttttaactattacaaatttagaaaaaacatatctgttttatatttttaagtaatttctatatataaaactgtttacacgaaaaatatcgttgaatccttggaatgaaaaaatgaaggaatagaaaaaacacatgattataataggaatggaaatgtaaaacaaaagattgtaaaacacataaatgatcatttgattggacagtaggaaaaacacaggaattagatgagagatatagactcaaaagaaaatttccctcttgctaagtttcctgcaaagtctctataagattgtcaatttcttaggaattttaaaggattagatatgattcaatcctttgattcaaaggcttttataaatatcctctaaaatcctatatacctatacaaatcatccccactactacaattctctgcttcctggtgcttccacgtcaccctttttatccccaccgttggataagcatcgagcgcttccttctttccgcatcgctcctctcctcccctctcccgcatcgctacacgccggccccaccttctctcccgcatcgctcccctcctcccatctcccgcatcgctactcgccggccccacctcctctcccgcatcgctcccctcctctcctctcccacatcgcgctgctccgccggcccacgcgcatcgactcccttctcctgcatcgctcctcccctctcccacatatcgcgcagccgcccccccccccaccgaatacacgccgcaccgcatccacgctgcattccactttaccttctcctcttgcgccactttttagcctccccctttcccccttaaggccacccagcccttggtttgtgcgacccacaccgcccccaacgacggttgcctgtccttctcccgcgccgttccgattccatatccgagagaagcgaaacgaccgccgcccactaaaaccagacttcatcaccgtcatcaagacattaattttgtttgctcataacgccatggcgatatcattgtggcccttcgcttatattgccaatgaaattctgcaatccacctccaccaactgcttcgtttcatctgaatctcattgcatagttattcggagtacaatgatcttctgataggttttttcatcagtttgaatctttcatgtctacagaagggtatttgtttatgtggtaccgatggccttccttttgaatttgttttgtggctcctgtggattttcattcaggaaagataaatctggtatgtgcctcttctcccttatgctttcacccggcttttgtttctttctactcttgatgatgaatgctcaatttgacctattatctttttgtaagttcaacaattgtttacaagataagttcagtttgattttattcagtaatagtacacctatttatttcgacttataggattcgttggtttatgctctcgggtagaatggataatacggcaggttcttctcaaccaattatacgtcgtcgtggtcgaccacgccggcagccttctaatatcccgatcccacgtcctaatcaacctgttgctgctgaatctcgacgtaggcgtaggcaagttatcgatacaaataggaacagaggtttgttagaagattaacattcctacaagttgtcagtattttatgcagacaaaaaaaatgactcacattatcaatttcatcatttttccctagcatcaacctctgcagatcaacgaatattacgcccacggttaattggtgaatcttctaattctaatcatatagcacaaaatgaaccccatattcgtattggttcatctacatccaatcaattattcaatcacaggcgtaagttgtcttttttactcctaggatctaaccactttaaggtatccatttgctgtaaagattccttcacatatacccatgacacacctttcaggcactatatttgaaccattgaatcttggtggtccacatcattcttgcagccactgtggtgcttttttttggtatgaggagcgaatacgtagagagagacatacttcaaatccatcatataatttgtgttgcaaaggtgggagaatatggctgccaccctaccaacctcctccacagccattgttggatttattgacctcacaaaacagcactctttctaaccacttctttgatcatattcggcaatacaatagcatgtttgcaattacttcaatgggagctaaaattaatgagtccataaatgatggaagagcaccatatgttttcaaaattagtggtcaagtctgtcatcgaattggttctttgctcccaccacaaggtcatcgtccagaatatgcacaattatatatttttgatacagaacatgagatctcaaaccggatcaatgttgcttcatctccccatgtcactttccatgctaatgaacaaattgttgcatccttgatagaaatgttgaatacaaataatcccattgttcaactattcagaacagcacatgaaagaatatccctagacgcatctgatcaattttgcataaggttatttggtaagccggatgcacatggagatatttatagtgctccagtcgcttctgaagttgttggcctgattgttggtgatgttggatcagctgatgtagggcgagatattataatccaagatcgtgcatcacgtttgcagcgaatcaatgaaaatcaccgcaagtttatggccatgcaatatccactgttgttcccatatggagaggatggttatcatgaaaacctcacatatcgtacaatagcacgcactcaatccatgcaacggaataaagttacaatgctagagtgctatgcatataggttgcatgataggccaggagacttcaatacaccgttacggtgtaaaaggctaacacaatcttatgaagtagattcttattgttgtgtcgaggggagccggatagcacattattgcacaccagccttccaaagtaaatatagatcatcaccattcaactcattgattaattctgtctcaagaggtattacatctggatcttctattgggcaaaggataatattgccagcttcatttaccggaggacctcggtatttgtatcaaaattatcaagattctattgctatttgtagaaaatatggttgccctgatctttttttgacattcacatcgaattctgcttggcctgaaattagagaagctttagcattaattcctggccaacaaccttccgatcgtccagatattgtcaatagggttttcaaaatgaagctcaatattttaatggatgatataaagaagcacaaattttttggccctataaatgcaggtatcaaattttacattggtttccaaaatataaattttcctttctcttccttttgtaggtttaaacatgcatgttaccaccatgcaacccttaaaacatatcttttttcatgcagttatctatacaatcgaattttagaaacgtggtttacctcatgttcacatcatcatatggttggccaaaacagaacccttagattccaagaagattgatcattatatttcagctcaattaccagatcctgcaattgaccaaataggatttgaggctgtatcttcttttatggtgcatggaccttgcggtcctcacaacacttcttcaatctgcatgtctgaaggaaaatgcacaaaattctaccctaaggaattctgtgaagaaacaactatattagaaaatggttttacacagtatgcacgtccaaacaatggaagaactgttacaaaaaatggagttgacgttgataacagatttgnggntcctcataaatgttgattggntgtgaagnttcacgccccatataaatctagagaaaggtattatgatggcatgcc

SEQ ID NO: 62374 - DNA, 885 bp, Oryza sativa
tctccttctttatttgcttgctcaatctactattatttctatttattcttcttggaacctttaaaaattagattttatagtttttagagtttattgtcacgttgagtttcgtatttataatttctagatgttccgtcaaacgttgccattatactcctctacggcccatccattgtttcttctctttattgtcattgagattttaaaaatcgaacataattatcgtttgggttcattttttactttctagaagtcccgccaaactgtcagcggctttgccattgtactcctctacggctcgtccgctgcctcccttctttattgtcattgagattttaaatcgaatataattatcattgggttttttttactttttggaagttccgaacctttaaaaattagacttgtagttttattttttataatttttagaagtcccatcaaacgatgccattatgcccctctatagcccgtccgccgcctactctttattgtcattgtgattctaaaaatcgaacataactatcgttggaattcattttttattttctagaagtctcattaaccgtcggcggctctgcaactatactcttatacaccccgcccgctgcttctcctttttattgccattgagattttaaaaatcgaatatgattatcaatggggtttatttttttttactttctagaaatcccagcaaccgccttacttgtttgctttacggcctgcctgacatccctcctttttttttagaaacacagtacaaatataggcgctcacaacgtgcgcacactcacccctatgaatgcacacacgcacaccctacccctatgagcacctccgaaagactgggccggcatatcttgacatccctccttttaatcg

SEQ ID NO: 62375 - DNA, 6494 bp, Oryza sativa
  unsure (1)..(6494): unsure at all n locations
cgcgcgctgggttgaanactgaatatcntcttcccnnnnnnnnnnnnnnnnnnnnnnnnnnnnnnnnnnnnnnnnnnnnnnnnnnnnnncaatcatcaagtgaaactatcaatgaaatagataattatctagaatgtcgttgtgtcactccaaatgatgctgcttggcgattgcaacaatttgacatccaccacacagatccctccgtagaacgccttcttgtccatctcccatttgagaataatgttattttcacagaagatgataatcttgaagaggtcattgaagatccaaacagctctacaaccaaactaactgcatggttagaagctaatagggagaacccttctgctaggcaacttacatatatagaattccctgaacattggacatggcacaatcaaggcaaatattgggatggtcgtcgtggttctcaatgtagaattggccgcattgcttatgtaaacccttcacaaggagaagcttactatctgcgaatgctactgcacatcgttaagggccctagatcctttgctgaaatcagaactatatcaggtcatgaatatcctacatttcgggcagcatgtgaagcattaggtctccttggtgatgaccaagagtggtcaaatgctttgaaagatgcagctcaatgagccttaccatcccaactgcgacaactttttgttacaatgttactcttttgtgaggtaacaaatcctacaagacttttcagtgaacatgaatcatatatgagcgaagatatatcatatagaatgccccgcaacacttctcaggccagcagctccaccaatccttatgttagatctgttcttctcattaagttagataaactgctaagagatgctggctatgacttatcccattttagtttgccactaccagatgatattggaagtgttttagcacagaatagacttatactagatgagctcagctacgatgtttataacatgccatccactatagatgaagctatttcaggtttgaataacagccagaaggaagtttttaatgctatttataattctgccatcaataatgaaggacggactttctttgtttatggatatggaggaaccagaaaaacattcttatggacaactttgcttaattctataagaagccagggaaagatagcattagttgttgcatcatcgggaattgcatccttgctgcttcctggtggaagaacacctcattcccgtttcaaaatcccattggaaatctctcaaaattcaatgtgcagtataaagaaaaatacaaatttagctgaactgatccaaaaaacatctctcattgtgtgggatgaagctcctgttaatcataaatattgctttgagtcattggatcgaactctacgagatatattgtctgaaacaaacccaaattcattagacaaacaatttggtggtataacagtagttcttggtggagatttcaggcagacactgccagtcatccaaaatgctacaaagcaacagattttgagatcatgcattgttaactcttatttgtggaataagtgcatacttattgagttaactgaaaatatgaggcttacctctgcatctatttccgcacaagatagagaagagttaagaaatttttctaattggcttttgaaaataggaaatggcacagaaccttttgttgatgtcccagagcaactaacgaacatgttcatagagatgcctcagtcccttcttctatcaccagactgtaggaatctagatggattgatttcttttgtctacaacttaggatgtcaaccatcaaatcttacatcatatctgtgtgagcgtgcaattttagcacctacaaatgaggtggtttcagaaataaacaatagaatgattgctcagttagaagcgagtgagatgtcatattatagctcagattcaattgatgacagttctactaactgtactgctatagaggcactatatccaacagagtttctaaacacaatttctataaatggacttccagaacatgtgctgcacttgaaaattggtgttcctataatgcttttgcgtaatctagatccatcaataggactctgcaatgggactaggctcattgtcacacaactaacaagccgtgtgatagagggagaaataaacacaggaaaagcgaaaggtacaaaagcatatattcctcgcattgttacaacattaactcaatccaagtggcctttcaaattgcggcgtcgacaatttccaatacatctttcatatgctatgacaataaataagagccaaggacagaccttgagcagagttggagtctatctaccttcacctgtgttctcccatggtcaattatatgttgcattctcgagagtgacttcacctaatggtttgaaagttctaatagagaacagccctgcttcttatgaaaattgcacacacaatgtagtatattccgaggtattcaacctaataaatagaaacaggaactgataaggtatattgtgatgcataggttggtttcgttattagttttgtaaatataatgttttactgtacttcaatttccatattttgctcagtacgtatgacggagcgtggggctcctcaccaggagactgcgcaggcccccctttgccggttcggccgggggcactaagtgaggttcctcgccctcgatctgaggaacgtcagcgagagaagaagtgcacaagacacgggcgacgtagacaggttcgggccgctgagaagcgtaacaccctacttctgtgttatggtggatctgtgcgtgaaggaataccgagagccggagagcgagagagagttcagactctagaacccccccttcctcccttttttcttttcttcccttttttcctccttttttttcctccttttttttttctctccctcctaggcctgggcctcctttttatctggtcaggggtcaccacaagggcctctagctgcctaagaagggaaacatgctttttacaatgagggctagtctacagccggaagtgacctctgatgtcacagcctgaatttccgttttaggatttataaattatttaataaattattaatagaatttatattaaatgttcattaatttacaagtgaagttaaatgtgggaaataaaatttcctaaatgtaaagcatggttggatttaatttttattaaattctccatgattaattatactctctgaaattttctcggaattttcggagctcaattcctaatgttaataatataaagaacagtttagcaattatttaaataataaattaatcattaaatgatctggatattattatattaaatactttgagtgtccaagtatgttcaagatttttcttggaattatttgagcattggaagtatttttaacaattgaaagatcatctggttggttaatttatttggaaaagtaaataaaagtcctcctcctcagcttgggccgaatccagcccattccctcctttcccctctcccttcctctcagcccagataaagtctgtttgacctccctgtcgctacagtactccatcttcctcctccagacagagccgagccagccgtgctcgtgcacagtgccgccgcctcctcccaccaatccgaccccccgttgctcctctttccaaattagttgcgggaatggaatcccctcaatctcctcttccttttccccaagaaatccccaaaattttctatggaaattctttccaatttcgcggatcaaatccttcctttttccggcgagaaccctagactttcccgagtttttcccgtcgttgtgggcttgatcccgagctcccgtgcctatataaaggaccccctagtcgtcctctacccatcccctcaagtcccgtccgccgccgtcgccggaaacgctctccccgggctctccttctctctccaaacgccggcgccgctccagccgtccctagacgccgcctcatctgcctccttcgtgcgccgccacctccatcggctccgcaaggtcgagctccaccccggccgccgttccccttgcgcggaaacttcgccggaagccgtcctcgccatgaaccattgggttgctgtcatgttccgatctccagccgcagctagcagccgccttagccgcggcatttggtcgccgctgccgccgttgggttcgcaagaaggagagggagcccggcagccatctccccgaagcggaaatccaccagagttccatcgtcgccgtcaacccgaagctcgccgtcgcgttttgatctccggcgaagccctgctgctcctccggtcatcgccaagcttcgccgctgcctccattggattcgcagctgcgaagtgaagcccggccacccctccgttgtcgccgcacatcgccggaaagtcgtcgcctccgtggacagtacctcgccgcccttcgaagctcgtcgccggttatcttccgttgccgttcgtcgtcgcataaatggtggtaagagtcactttgatcccctctcgctcccggtgccctccgtttgcgttattgtgccgtggttcgcttgcaagattaatcttagccgtccaaaattgatataaatccgttctttattttcaatgacatattattcctttttaatatatgtcatctaccaaatatgatctaatctttttccggaggatgttttaatcttctgtctcagctataaatcatttgtaaattgtttgattaatttggaatagtcttttctttaataggtttaattggaatttaatcttgtaaaatttgtaactaattcatatgaaatcagaatgaggccgttcaagtctcataattcatctaaaattatagtctacatgtttgtttactttttatgtattgtttatttggtttttattagtcttttttcctcgttttgcgtgttagcttgtcgtttccgtcgttgcgaaggttcgcgagtgcgccggaagtattcaagaagattaattgaagaccgattattgcaaggcaagtcacatagatcctaaacacaatcctttgagcatgttgatcctatatttaaattctctatttatttcaactgtgcatttattttcgaatgtcaccgggtggtgtgaacctattcctttgttatggcctgtttgcattgattactctattccttgataccttgggatattataacttgactagttgagctttatatattggttcagctagatattagatatgattgcttagccatgcttagaaacattagcacactattggaataacttatgacttactattatttaatgatggcttaatgatagttcatgatggtcaatcgtgattggttaattaattacttgccaactaaaacttgataatggtgggttgtgagcacatggttttgagagtcgtgctcatgacaattaaggaccggttcgcgagctactattgtgaaacattaaccgtgccaaccacaagccagcgtgggcaacggctttaccttttgtatagcatggttcattgcagagcaccaggttgagaaatggcggagataagcccacgggggtcgctggggagtccataccttgtttataagggggtgactatgatccgggaatggtgcactgtggtgagttgtgttgtgcagagagtattgtcacagcctctattcgggtactttccagtatcgcgacgcatggtacacatgatgttgaggctgtgtcttgtgggtacagtggtacacctctggccagagtaaaactattcgaatagccgtgcccgcggttatgggcgggttgagcaatgtttttcgtgattagtctcacacctctcacaataattatggatgttatacctggtaataatttgcttagctcctggtttagagttagatctgtacagccgggtatggttgttcagaatggttgggcctgtgcagcatgggtgtgttgttcagtgttgattaaaatttctgattaattactccactgttttacatctcttaaatgttttgctaagtgctgcttttgcaaatgagcctatattatgccatcctttggtatccttgtgcacttgcatatttgctgtgtggcttgctgagtatgtcatatgctcaccttgcaataatcaatcaacctcagttgaagaataaggatccagaaggagaagacgtttggcttataccccagttgagctgcctgtgggagtggagccggagcttcgctagattttattttccgctgcagttttcttcatggtgaggactaagagcctcttaagtaagtacttatcgttttagttaatttgatgaatctatatattaaattgtcagtttgtgtacctcggctgattcctggacgaggattttatgcacaaataagttcggaaatcactagtgaatttccgggcgtgacatctgacaagcagagcccatgcctcctgccccgctnnnnnnnnnnnnnnnnnnnnnnnnnnnnnnnnnnnnnnnnnnnnnnnnnnnnnnnnnnnnnnngagcttctaatngnaacacg

SEQ ID NO: 62376 - DNA, 5051 bp, Oryza sativa
attcctgcagcccatcacacttcacataacaccgttatatgataattaatgatataataataagtttgatcaacaatatgaacagaatttaacaatatctcaacaccgataagttgagtagaccaaagttcagcaacgtccacatgccatgccctagcgttaacagcgttttcctttggtcacttcccctttctaatgtgctacaaacctgctaggcttccttcattcataggcttccgatatgtttgattggttgagtcgctatggaacttttagaattttgacgaaaattaccatacaaatacggttatcgataaaacggtcagaaaaaccttcatcctatttccggaagatattaccgttgccatttctaacacggacggtaaccaatactgactgaaatggtcattggaaacggcagccgaaaatcttaaaaattttcgtaccgttttcaccactaatcggagccgccggatgggggggtcggcctgaccttcggaaacagtcgtgctctgaatcgcgcgtattgacatttccccctagcaactcttcagtactccacaatatcgatgcttttgagatagctactcggtgaatgagacagtccagtgatgctacctgtgagaactgagagcacaaaattcagcaacttcgttattgcgtttacgtgctaaaacgtggtgtttctgtctctctgtctcgggtttctgccctgctgatgccaccaaagacgaccgttaaggttcgcttcgactggaacttgtactggtggtccgtcggctacacggtcaccattctgagagcaggtaaaataggtaaaatagaaggctataaaccagctataaacatattttaaaataataaagaaagagagagaagagcagcagactacatatctgtagcccagctgcagcacgaactctaaaatgtaatgtgtgtatgacaagtgagaccatgtattaatagtataataagcaactattgtatgaattagctagtagtgggttatattattaaacttgctctgagcatcgtcaatgggcatcggcaattcggcatcctgcaacctgaccagaagtgcagaaaaaaacgttggtgccgttctggtcatcatcgccagcgcggacacgcggaacgcgacgtcggccgccgttcgcctcggtggtacatgcgtccagtgcacgctggcgctcagctcctccagctcgctgcactcctctcgtagacgcggcccccggcggagaacgcgcggccggcgtcgaccacgacgtcggcgccagcagcgaggaataggaggaggcggggaggcgaggcgccatcaaggaacggcccgagcccatcatcgcaggtggcgaggatggaaggatgcagaacgggaaagaaggttgtgcttggagtgtgccaggagagctggagatgaacaagtgaggagatatgccctgcaatagtgcaatttgtcagcgggagaccgaggcgtacccggagaaatgtttggttcatgcctgcatacgtgtggagctgtgggctgggacaacatgggccaaatgggatggaatgtcagatcggggtaaaaggcctagtttcgtagacttgtggccttttgggcttacgagctttgacggccttgggaaaataggccagctgttgggttggaacttggatctggatctgaagtctggaaaggaataagttcatctgaggtcccttaactcgtcaacgaatccgattttcgtcattcagccagaaaaccagatacagtaggtccctcatctatcaaaactggtaaagataaggtccctcggcggtttagagagcagttttggctgacgtggcgtccacgtggttaatttgactcggtcttcgttacgcgtggcattgatgtggcgctttcgtggcaattctatcacagaaaaaataataaaaatcgtgggcccacatgttagttacacaaaaagaaaattagaaatgttggggcccaagtgggccccacatccctctcccttctctctcttcttccctttccctctcagggcctgtttggtacagctccaactcctaaatttaactccaggagttgagtctggagtggagttgtggagctgcctaaacccagctccacaactctagttcattttgtgagagagctccacccagctccactcccagttttggtagagccgaaactgtttggctgagctccagctccagaaggggtgaagctggagctggagctgtgccaaacaggccctcactctctctcttcttcccgggagcgccggagcggacgggcgagtgggcggcggagcagcagccggcgacctcagcgaggcggcgcccttgctgccgccttccctcttcggcgatggccttcacgcggcagctggaccaagacggtggacaacagcgccggcgacggaagcctcaaccgggggagaggaggtgccgcggtggccggagccggggtggtaggcgcggcggcgggtgtggtggtggtaggcgcggggtggtgggtgccgcagcgggggccggtgtggcgggggtggtcagctggcagcaggcgtcctccttctccatggacaccggcaagcagcacttgctcatcgtcggcagcaatgcgacggcctcgatgcgctcatgctcgaggtcgaacgacatgatctacttgccctcggtcacccagtacgtggcgccgttgacgctgacaacgccccaggcgacgcacaggctccacggcgacgcccccaccgcgcgccgccggcggcggtggtgtcgtctcccagcgtgaggatattcaccaccccatcaccgttgccgccgccatggcgggaggggacgacgacgatgcggtgccccccagcgtgacttcatccaccagcccgccattggaagggaaatggacgatcttgtacttgccagtcgtcgaatggtagccgaagctgatcatacccgcgtggctgcggctggtcgccaacggcggcgacgggatatggagggactcgccggtgaccgggttgatcacgatgatgctgccgcagacaaggggatgtcgcttgagccacaggcagttgcacgagccaaccatgtcgtcgttgtcgttactggctactggtccaggtgccgcgtgaaggccatcgccggagagggaaggcggcgacgagggcgccgcctcgccgaggtcgccggctgctgctccactgcccaccagcccgtccgttccggcgctccccgcgaagaagagagagagggaggagagggaagaagagagagaagggagagggatgacgggaggagtgaggctgatggtgtgcaacatctcgtcttccccgacgacgtacacctcctcgcacggcttcaccgccgcgccgcctagccgccggccgcggacctccacggaccacggcctcagcgtggagcgtgcacaacacaagcctgatcagtgccattgcgaagcaccacgacgccgtgtccgttgccgacgcggtccccacggacagctccgccgcgtcgttcatattccggaggtggagagaccaggcgcgcacgcccggagtcagccgtcgctccatagctagcagggagagggagaaacaggggagagaggaagtgagaagagggacttgtggggcccacgtgggccccacctttttttgttaatttgtgtgtgagacagacatgtgggtcccacgaagtttttttttgtttttgggattgatttgccacataattgccacgtcaatgccacatcatatgaagaccaagtcaaatttgccacgtatacgccacgtcagccaaaaccgctctcaaaaccgccgagggacctcatctgcactggttttgacagttgagggacccgttgtatggtttttttagttgaaggacgaaaattggattcgttgacaagttaagggacctgagatgagctcattccgtctggaaatgggttcggtttttcttagagggaataagttcaacggagatacctcaacttaacaccaacattctttgaggtcccttaaccatagaactagaaatgtgtatccctaaactatgtaaaaccatttaaaaaagggacaatttcgtttctgcccctattttgatgtctaatattgattttacccctacttttttcgttttacttttttgaactgaacgcttgttttgcccctactttagaggtgaagttaacggtgttaagtaattgacaaaatgacatttataccctctcatgtatgttcattaattatgtttttgtccccattttatgcatgtagctttataactttatttttgtgagtatatttaaaattaaatgaagcacattgactagtatctaaaggaacagataattacattttataaaatgttgttaaaatgttgattaagttatatcaaaatgctgaaattttgtcaaaattccatcaaattcagaatttgtccaaattgttatattagtcaatgcgggtcatgtaattttaaatatactcccaaaaataaagttctaaagctacatgtataaaatggggacaaaaacattattaatgaacatacatgagagggtataaatgccattttgtcaattacttaacactattaacttcaccatccaaagtaggggcaaaacaagcattcagttcaaaaaagtgagggtaaaaatgaaaatcctaaaaagtaggggtaaaatcaatattagacatcaaatagggttagaaacaaaattgcccctttaaaaaaggtcccgaggcagtatacccgctgccgctcccccaaaaaacgaaacagaagagaaaaagggagaaaaaggagattgctgattaggattgtcgaccccatatttttttcacttacgtgtgggtcccacatatttatttatttttatttttttgttaactaggatgccacgtcagtaaaaccgggcaaaaattgagtcgatactgccatgggacctcctttgaacgatttgaataagtttaggggtaaacatttctggttttacaggtaaggaacctcaaaaaatctcgctgttaagttgagagatatccggtgaacttatt

SEQ ID NO: 62377 - DNA, 9245 bp, Oryza sativa
acaggtgggccccacccgtcaactagggtgcggggcgggccgccccgtcaacggcgcgcgcgcgggaaaaagccgattggcccgcgggaagagaaaatagaggggaagggagatggaccgaattcggcccattagagagaaggagggattttagggtttttctttttataaaacctttttaactttgtttatttcttaacaattattatttgtgctctgaaaattcaactaaaatttatttacgtattttaggcttttaggaaatatataaaaatcctctaagccttatttgacttttaaccttgcacattttaattgttggaggctttcacacggtttttaatgattctaggcataatttagaggatgtattttagagtcgttttggggcgtgataggcacgagctcgaggaggaaggctaccctgttgtcgactacgagtcagagcgtcagaccgccatatcgacaacagttagataggctaccccaaacattgtactggtatgattatggtgaataaagagcaactccggcttcggccaacaggacgtagggttattacctgacaattcaggggtcccaacctgtataaaaatccctgtctccatctcttttacctcagtctcgcgtatatcctagtaccgacgatccccatactatgcaaatactagaattgcgacatcaaacatcgacagtagtagtgtagtaggaaccaaatctaaccattgatcctgatggatactttagaattttacttttacaccgtggaagggtattttcgttatttcaggtgctcccacgaaggctagtgattcgctcgttcccgttcgttgcgcacgacggccttcgcccgtcctcgtgcgcccgacgtctaccttcgcctttcgcgaggcctcccgttcttttcgcgcgaacccacggccacggcggcaccgcccctcaccttaatgcgcggccgccgcccgccgcccctccttgcgtagtcgcgtgaacccacggccacgtacgacggcgccatccctccaccccctgtggccctgtgcaccgcagcaccgcttcattcttgggatatgatggtgtacctgctctagggaaggtcgctttgttgaaatgtgttcttgaatcgctcaattgctatactgcaaaactaattactgaatcactgatgtttagctgatgatgtataatttaatcattttcgcattagcatcaggcaaatgagctaatgccgaagctcgtttatctgcagcagaactgagacggaccaagtactgagttctagactgaactgaaataaggttaaaaaagaaagctcaacgactcgcggttgcaagcacactctcactctattagcgtcattctaatcagttatccgaatctacaatttgactgacaaaaataactacaatcagatatgagctaaaactgtgttagtgtcttcttaatcagctatttcaatctgcaatttgaccgacaaaaacaacaattgacaagaaattgatcaacatcagcatggctacgacgatcttgaacccttcatcggtttgattaccttccggccttgccttagattctgatatggatcatcccacttcaattaggtgttgctaaaccttgacgctacggttgaaacaggtgtactagcagagtccctttttttttttgcgagagtactagcagagtcctttgacaggatctcatcatcagtatcaaattgacggcactgccaaacgcgtaaagtgcggcggcctccgtcgcgcacagcagcactgcaggtctgcagcatctcgcctcgcctccgttctccctctcgcatctcatttctcgacaaaacgactctcgtcgccatccccgcgtgctgcagttgtgaaccgattgagcatattgacccgtggactagattacgaacttacccctatgccaattgcaaattcatcacaatgccatctattacatttccaacattacccctccatgaattatactacggggctgtttgttttggtgccacacattgccacaccacatgttaggcatgccacagattgttagcttagcgtttggttgcttgtttcagttgtggcaagccacactttcttgtttcatgggcctacatgtcatatactcattttctagctaaacattgccacacttgtggccaacaaattgttggccacactttgtttgccatgccacatctatggcaaattgagttatggcaatgttaggcaacaaccaaacagaccctacatctactaccaggtgtagtaggattgaatctaatccattagatcgaatcaaatggacgtctcacattcattttgaggtactttaaaaaaatcctaaattaaaattctaaaccacatatatatcacaattggactgaaagaaatatgatcaaattaaaatcctaaaagatatatcacaactggacggaaggaaatataatcacagaaataacaacatgaacctacaaataactttgtcccaaactataattcaaatttgttaataatttttaatacaatagtttttaatggatcaaatagtgctaaaattaataatgtaaatggaaaaacaacttagaggagttaggcagggtgatcctctttctcctcttttgtttgcccttggtgctgatcttctgcaatctgtaattaacaaagcacatcaaaggggggtgttgtctttgccaatcctggtcagtaacgatgataactttcatgtgatacaatatgctgatgatacctttttttttttaagcttcctccactcagttatttgctttaaaggctctgttgaactcctttgctgtctcttctggcctaagagtgaattttgcaaagtcctgtatgatccctctgaatatctctgaagaaaaatcacagctgttggctgctacttttggctgttccattggatcattgcctttcacatatgtaggtctgccactgggaaaaaaacgatcgagaatggttgatttctctccttcaacagacagaattgaaagaaggttaacagccactcactttggtaaaggtgtgtagaccaaaagacaagggggggggattgggtgtcattgatctcagagtacaaaacaaggctcttctccctaagcatctacataagttttacaacaagttggacatcccttgggtcaattttgcttggtcttcttactactctctggaggcccctcaagttgccagaagccatggctctttctggtgaaaagatgtttttcaatatgatgtcctcttcaggggtattgcaaagcccatgcaacggacgagcacttcttttagtagctaaaaaaaataaaaacatttacatcgttcgtcttttcaattccacactcacctctacctcagtgatatttcctcaaagcaccgcttggcctttgtttgtcccctctcgcgtgagtgcaaaggcatttcaccttttcgagagaacgggcagggagctcctgcaatttcactatagaagaagagagttaatccagtttataaggaaaaccggacccaaaaaccttacaacaatatgttaatttatggaaaccaatgaaaaccccggcattgataaactaaacctaagaatagcagtccaacaagggaaaaactcctaaaacgaagcctccaagaaagatacgccgacaaaacggcgacatcgcccgatccaaacaaatctaaggttttcacccttgatgtggagttgaatgagggatccaatagcaaagtcttcaagaaggtaaacggtgcccgagggtgtcgcccttgctagcattgacaagccgaggaaggctttcacctcgaagtccccttcaaccatagtgtcctcaacggaacccaccaaatgccacgtgtacaccgaaggtacctgcacaattcacaccacctgcacaacgaccaaaacaggcgccgttgacgacctgctctaccacctagccagatcggcagagcttcactgagccgcggagccagaccgtcgatgccaccgaatggccacataggtcgctgaagctccaccaagcgacctcgtcgttgccactgccactgggggtccggccttgcccgactccaactgggatgtgccagatctggctgtccccctcgctgccatcaccaccaccgacaatgtggccgcgactggggatctggcctctcgtgctggagagacgctcagatcccattggagtggttccagatctggacctagggtagctaggtccgatcatccccctcgctgccttcaccgccgctgctagctagtactcaatttttagaaatttgttgtaatataaatgaaaattaaaaacaagtacacatgttataggttttatgtcatttagaagtagatattttttatttcctttcaatggcaaaaacttcatatagtttagtgacataattatataattatgtgactagattctttgcagatttttgttgctcacatgtagtcaaaaattcataaatatttcgtttactatagggatgcacgaaaagttcatttatttactcttttttggaaaatatttagatggattataaatttacatcatatttcaatagtatttacatagcaagttacagtggtattatactataattgcaagtgtaattatatgtatatataaatgtaaatattcaatactaatccccaatttgcacaattctcataggaactgggtaataatgtatgtatatgaaatcttatctggtacggtcgttattttcctctttgctgattctgtagctgattttgatcctttcgatattgggagcgtatcctatacacacaggccctcgcgtgtacacaccgtgtacaccaactaaaatttatcacaaaaagttctagaaatattcatacatatactttcaatagtattacatctgcttgcaaaatcgcatcttcaaattcattctacatagagagtaaaaaaagataaaattctgacaaaattacaatattaaaactgtcagattttttgtttttttcttacagctaaaatataataaatttgaggttaagattttaaccctaggtataatactattgaaagtacatatatgaatttttctagattttttggtgacatttgttagttagtgtgtacgtatgtacacttgagagcttgtgtgcatgggatatgttactttcgatattttcgaggctttttgcactttactgatttcagaagatcctgcatttgtataaaaagatatatatatattagaaatacacacatgatgacatagtgcttgcaaatttatgtaaattatatatgtgagcacttacataacaatcgaaccatatttacacgctatttacatcaccaatatactaaactaacatatgtaatttcaattatattgcagtgtagcttttagttattatccatccaatgtgataacattgaaccattttgaagtgaatatattgtactgatgcagctaatttgagcttttggatcatgtagagagaagtaagctaatttgagtacctgtttttttttatagatgtccccaggtaatttccattatcaactatactgcagattttgatcacagtttgtgattatgagatgtataaacttcaaatttcatcagaccaaagaggttgagatgttgtacaaatcaagattcagaggttagaggaattgcacctttcaaattcatctgatttatgcattcttctgtaagatttccttttgatttgtggggttgatttaattctgtatctttgatttgatctatagcgtatcacctgagttcttctccctcaatttctctctacttctccatgggttttgttcaggttgttgagttctggatctgggaagaatatcacgtgtgtgctgttgcttcaggctgtgagcttttttaactctcaagttggcgttgtgcttgctttaagatttgtgctttttggtatctgcacatccaatatttgggttttttttttaaggaataagttcatccgaggtcccttgactttacaccgaatccgattttcgtccttgaaccccaaaaccagatacaatacgtccctaaactgtcaaaaccggtacaaattaggtccctcagcgttttggaaggtggttttggctgacgtggcgcttacgtggttggtttgactagatcttcgtcccacgtggcattgatgtggcgcttacgtggcaattctatcccgaaaaaataataaaaaccatgggcccacatattagttaaaaaatataattttaaaaaggtggggcccacatgggccccatatgtcagcctcactcccttctctccttccatctccttctcggggagcggacgggcaggtggggggcggagcgcacgggcggctccttcgacggcgtggccgctgcgtcacgggcgactgcgccagcgtgctgtcctgctccgtctccggcgagccgccacgctgcccgagtacacggctacacgctcggctcctgacccggcgccggcgacgacttcctcgacctgtcgcttgtcgacgggttaacgtgccggtaagcttccagacgaccaacggcggcggcgccaggtgcagcaaggggcgcgggccgagctgcgccgtggacatcatggcgaggtacgtgcctccccgagctccgtgtcccaggcggctgcgccagtgcgtgcggcaagttcggcgcggcgacacctactgctaccggggccagtttgaggcttcgagcacgtctgccctgttggcgttgacagacacggtagctagctggatgaacaaaagaagacttgctacatgcacaaaactaactaaccggtagacttgctccactagctcatgcaggacatgcaagtactagcatagcacaaagccatagctaactactagctgatttggcgatccttgcaagccactaacatgaacatatcacatttggtagcaccagcatgcaaccaggtctaacacatgatgtgatccaaaaactaaacaagtacttaaggatcctatgcaacaagattagtgctaacatgcccgccgacgagctactccatgttcttaaggggctatgccccgacgcctacagctacgccaaggacgaccagaccagcaccttcacctgccccgccggcaccaaccaccgcgtggacttctgcccgccgacgagcggcgtgacggctggcgacgacgacggtgtgcgtggccaccgcctcccgcagctgagctgccggatttgtgcagccgcggcggtggtcctcctcccgccgcaggccacggcctcccgcggctgagctgccagatttgtgttccgtgtgcatccgcggcgatggtcatggtcctcctcccgccgccagccacggcctcccgccgtgagctgccgaattttcgtggcttcggcgtcggtcttcctcccacctcggccacggtgaagaccggtattgagctgccggattgtgcagccgcagcaacagtcctcctcccgccgccgttcacggcctcaagaggagcatcctggtggaggtgtatgccgcggcgcacgccgagctgccgccgccggagctcggacagcccgcctcgctcgcctgctccgccgtccacccgcccgtccgctcccgggaaggagagagagaggggagagggaagagggaagaagagaggagtgagagggtaggagtgaggctgacatgtggggctcacgtgggccccgtcatttttaaattattttttcatgaaccagacgtgtaggcccacagtttttattattttttcgaggtagaattgccacgtaagcgccacatcaatgccacatggaatgaagacttagtcaagccagccacgtaagcgccacgtcagccaaaaccacctaccaaaccgccgagggacctcgtttgtactggttttgatagtttagggactggttatatctggttttagggttcaaggacgaaatccgaattcggtgtaaagttaagggatctcagatgaacttattccttttttatatctttattgcaatagctgggcctttcaattcgtcatattgttgattgggttttcgaatgggcttagtaaataatttgggcttttgcgttttagtgcattaatttgggttggaaaaagtatactttgactccctcaactatcacccgagtatgattcatgtcctccaaccacaaaactgggtatatcgactcctccaactaccaaaaccggtgcaaacaatgcccctaggtggttttggaggtggttttggatgacgacctacgtggcgcccttgatggagtcgttgtcctacgtggcgcttacattgcattagaataaaacaaaaaataaaaagaaatatgtgggacctatatatcattcacacaaataaagtattgtgggacccacatgtcatcctccctctccttcccttcttcctcctccctccctctctctcccttatctctcttctcctccggcctttcccttcttcgctggccgcgagctgctactctggctcctcctgccgcgctcggtggatggcgtccttttcaactacgtcgaccaccgtcgcccgcacctcttctctcacccccaccccgcctcttcgccatcagtgccggcgtcgtgcggcggcggcacggtcgacggcgacctcacctccgtgtcggccggtgaccgggcgtggtggaccgtcgttgaccaccacgacgaccttgtcctctacgacgtctactggggtagccgcctcttcgtctgcaacccagcaacgcggcggtgggcaatgctgccgccgccgtggccagaaccggagcacgagcccagcgcgtacgccgccgcacaccgacgatggccgcgaagaagggaaaggccgggggagagggagagataagggagagagagaaagaggaggaggaagaagggaaggatagggaggatgacatgtgggtcccacaatactttatttgtgtgaatgatatgcacgtttcacatacttctatttactgcattttttattcacatcccacgtaagcgccatgtaggataaaaaattggtctagatggttaggtaggcgccgcgtcatccaaaaccacccaggggcattgtttgcaccggttttaatagttaaggagtcgatatatccggttttatagttggatgacatgaatcatactcggactcggacgatagttgagtgagtcaaagtatactttttccatttgggtttgccgatttatgggcatgtttccattattttgggcctgtttgttttatttaggac

SEQ ID NO: 62378 - DNA, 7717 bp, Oryza sativa
aaaaaatctgttaaatgatgtgtaggcagtactgtaatttaatggcaagagatgatagaggcaaaatagacttgttccttggtacgggtgaaaacgggacgggtatttctcgcccgcttgcccaaccgtattaatctaggataaattcgggtacctattttatgccggatatgatatcgggttcagtagggtggtatccgacggatatggagtacctgttaaattgtgcgggtattaccgataaactacccgtatattatccggactgctaccaccaccactccaccaggccaacaacccaacaacccaaaaggcccaccaaacactaaccctagccacttaggctgggtttggaatcagccgttcccaacttacacagtgcgcatgaaaaatagagcagtctattagtgcgcgattaattaagtattagtttttttttcttcaaaaatgaatcaatatgatttttttaagcaactttcgtatagaaacttttaaaaacacacatcgtttagcagtttaaaaagcgtgcacgtagaatacgatggagaggggataggaaccccgtaattttgacaaattgacccttctataaaacttattttcaaaataagccatgtcaaaaactaattttaaaactaggccgtgacctcagcgccaaccccgatggcgctgaactaaaacgttcgcagcgccagcattgttggcactaaggtcatatctgacatggaacatattagccataattgaggttcagcgccaaataagttggcgctgacctcttagaacgtttaaaagtagtgtggacaataactaacacaagtttcattcaatttaaatgtttttatcgttccttggtaagaactgagaacctaaatcatacaacataaaattcaaaattcaaaattataataattgaactaagtattttattgagattaacattttaattaatgttttcaaatttgtttattccagattgaacataaaataaataatccccataaaaagtaaaataaaaataaatctacaaacaaaatatgtgattgtttggaaaaaaaaatcaatagaacaagaatcatgcaacataaaattgaaaatacaaaattataataattgagctaagtattttgttgagattaacattttaattaatgttttcaaatttgtttattccagattgaacataaaataaataatccccttaaaaagtaacataaaaagaaatctacaaacaaaatatgtgattgtttggaaaaataaatcaaagggggataagtaagaaagaacctgaaaaggggcttccccagttcgaactggcaacctgagagcaggtgcagaacagcagaagggctgacaactgagctagcttctgcattatgtgtggtgtttgtatctcatgaagataaagattaagtgtttcacgcaaaacgaggtggtaataatatgtgattaattaagttttaattattataaacttaaaaaatggactaatctggtattttagaacaacttttatatacaaagtttttttttacgaaacgcatcgtttagcagtttgaaaagcgtaccacgataatataaaattttatcctccactagtagaagaaacgaacagcggcagcacacatatgcttttaaaccacacaaatatcagcgccaacacacatagcgctgagctcctcttttgtcgctaatccgtgccacgttggacgtaatattagcgccagccgctaattagggtggcgatgggacgtattatgtcagcgccattagggttgacgctgaggtcatggcctagttttaaaattagtttttgacacggtttattttgaaaataagttttatagaagggtccatttgtcaaaattacggtagtaaccttggtttcaaacacagcctaaattatgtcaggcagccaggcaggagccacacgcacttatgtcaccgagggagccacacgcacgtacgtcaccaggagagagtcgtgggacgatattcacacgtatcagggacgtacaatacgtatcggacaagtatcggtaattcttttatttgcttgaaaaccgagaaaatgtcggatacgtacggtatatgtacgtatctgtatccgtcgacgtatcggggattcggggtaacgtagctcgccagcgcccaacaccgccatcgtatgttgcgttgccgcggcgctggctgctagtggctacgctgccgtgtgcccgcgtccgccagccaccgtgtcgtacgtcgccgcgtgggactttgatactaatgtagtagtaccgttacttacggagttattgatacatgacatatatttgtccatatttgttgtattagaatatatcatatttaattatagatttgtttttttatggggtatatggtatatatatatatatatatatatatatatatatatatatatatatatatatatatatatatatataattgttgctttgatttgatatccgaataaatattcgcaaccaatagtatttgtgtccatcttggtaagtattcattctgtatttatcccccgatattatccgggcctatattctatccgataatatccgtctccgacccaattcaaattataaaatatgggttagatatgggttctttaaatcaaactattaccgggtgttgatttctgaaggggggaaaataatctctctatttattgtttgcgtgacttgtttagtgtgtgttctggattccagataaggttttaaaaagttattattaactaatactcaagaggttcagtttgccatgtagtttccattaaatctgaatgcatcaatgcatcaatcaatgtaaggccaagcatttatgtaaaatgtgttgttagttgtagctaaaacaatatcaagatatactgaattatgtttacagtagactgttaacatcaggggcaaagctaggatatgatatgacattggggggtgggggagaagggaatggggggagctgcaagaacaaatggccaaagtccatatataataatcacagcttctacattggttgggctaggattttcaattgcaacagaaaagtcctaggaacaactagcttatagaatcaatcaatcgtcttcctcttcatcttggctgaagttatgatgggaaatcccaaaattcagaactcacaaactgactgatgtctacatgactacattgtctatgtgtctaaatcagggactagtgaatactggacttgtaaaagaaaggagaacaattgttattttgttgtgttgggggagaaaaggagaatgaactcacctctggactacggctcgcagcgtgctggactgtgcttgacggcgagatgcaccgcacgcgattgctgtcgctgatgaagggtgaagtcgcggagaagctcgctgccgtctgctgacaccgcatgctgcgtttttgggtcgccgatggctgctgctctcgctactgtgcgtgaacttgcgaagctgaagcgatgggcactcgataaaaaaggcagacagtttttactaatgggcttaccagcgagggagaatttggttttttttttttttgagggggggggggcgcaaatctggtagggaggtgttggcactggttaacatcctctttatagggcctgttcagccagcaccaacagttacgtgcacgcacaaggaagtgcagcagctgcagtcctggctgccgaacagagccatagatctctcatagagcatctgagttcacctcaaatatatactccctccgtttcatataataagaatttatagtattgcctacatttatatagttgttaatgaatctagacacatgtgcatctatatgaatgtgtgtgggcaatgctagaagttcttacattgtgagacggaggaagtagtcagctagatgtttcttgctttgttcagtatttgatattgtggaatcgtcgctggtccatggaatgtatatcaagtttgctgatttataacttatatgcaagagttccttagcagtatattctatgcttcctacagaatgaatctgggcagatttttttatgatgtgctttactcactaagtcaacattgtgactataactcaacatgttctagttcaatagaaaaggttatatagaattagaggttatggatcgattatcatattgtatcctaaaaactgtagaatatgtgtatcttttttgtctttcagcaatttactttcttcatgcaggtgttgccggcttgccgtatgacaagctaatttggaacgactccggtggcataaattacaggcccagtcttctcacgggaccatctgagcaaaaaaaggcaacttactggagtattatatttttagaaggtcatttgaattgtatgacacgttcttaaggaaataggatggatctgtggatatccaacctgccctatagtcaattgcctgaattacctgagctatcagagctaagcattacaggctattgttataccattctattgctagtcgaagtaaaatagaaacagacaaatgctaaacaactggagtacttccagggttgtctttcagcggaaaaaaaaatctgatgagatgtcaacataaaatgtgactgcagtgtatcgagtagtacatacgactgtgtaatgctcaacagcaacgaacacaaagtatcacaaagtatcactaatcacgggacagacgcctcgtcacggacggggggagactgtctcgtgggtgtccgtccagctcggggggtcgcggaactgggtgctgaagctgggctctgagctcagtcgcttcggcatccactctgtcatacgaagcaaggtgggagaggactgtactgactatagaacggattgtctcccgattgggagactcggcctgtgccctggcacattcctcgactccccgaagaccttgaagcagctcctgaatcagttctttttccttcagtaaagacgagtaaaggctttgaagcttcttgttggtgggggacaggtcagcgtcagcttcggcgggaacaccagcagcagcacgagccggggcctcagcgccgccatcgttcagagcggcacgccgcgcgttcctctcacgcctgatgcgacgacggcctggctgcgcacacatcaaacataccaacaattaatttgctaggcatgttaatttgctaagaattaaacgcaattcagtcattcagtgtactcgaacctctcggccgacagcgccgccacctatagctggtgggcgtggggcatctgctgcgcccgccacggcagcgtcttgatcaccaccgcctcctctagctggtgggcgtggggcatgtgctgcggccgccacggcctcgccctcatcgccaccgtggaagaacagctaaaacattgcaaacactcgtgtcaaaatgaagaaacctcaaaataaaattacacttaagctcgctggagctaacctggcggcggatgagagtgagacggtgtctaagatgtacgggcaacatggagagctggtgctctccgcgctgcccggctcccaggtcgatctcgtcgccgcgcatgtaactatgtaagcgagactagctcctgggaggtcatctcccaacacgcgccgcgagctccctgaaccatcccggcgcggccgcccagtcaacccacacgtctcccccaccgttgaggagagcctcgccgacgccgtgcacgacgtcgccggcaatgtagacaaactgatgcagcgtccgcccgtcgtggacaaagggcatccagaaacgtacgtcgaggtttgcgtttgcggttgtgagcaccggaacccaaacctcacggtgacggtccgcgcggggagggcgtcgtccgcctctcgcctggagctccaggtcgacgccgacgccgcgcgctcctgtcccgacgaacggaacagagtcctgatcgctcgccgaaggagggccacagcgctcgctccctcgagccgcgccatggcctccatcgttcggcgtgcccccgtctctcgcctggagccccaggtcgacgccgacgccgcgcgctcctcccccgacgaacagaggagagtcccatccccatctcccgcacccgcgcccaggggacgccgcgtggtcggcgaagcggctggcctggcctgcgacgcgcggcgaactggaattggcgtccccgccgcagcgcccgcgcccgcgagacgcggcgtgatcggcggagctggggctcgcttggccgcggccgcggtggtggtgctgttgcgtcgaaacattgccaccgcgacgcacgtcacgcacagcgtggtcggcgtggcctccgccgtgccgagatgaagcggaagtagcgtccccgctgcggcgcccgcggccgcgagacgcagcgtgatcggcggagttcgggcccgcttggccgcggccgcggaggtggtgccgcggcgaagcaggaccaccgtgccctccgccgcgatgccctcgcccgtggcccgcggcgattgcgatcggaccctcctggccgcgcccaccgcggccgtgtcctccagccggaggagcgtggcgggggaggcgcgcgtgtgcctcgggagctccccgagtctggcgatggccgccgcgccgctccctcatctttccttggtggggaaggcgaggcgcgcgcaacgtcggcggcggcgagggatggggatacgggcgcagtggcgggtggtggaggcgacggggaagaggtggggaatggagggggattcgaggggttggcggtggcggaggcggagttgatggttataaagccgtggggaggaggaggcgacgcgaagacgaaaggttctagaagcttagctcatcggcgagagacgcgaagaccatcttgttgcgcacgatttgcgaaggaaacagcggcgaggtgggcccgcgcgcgctcggcacagcagccgttgtccgttgcctcgcggagagcggagagaggagaggggagagagagatggaggggagttggggagagagaggaggaagaggagggggtgataatgacacgtgggacccctccatttttaaattaattttttgatctaactaacatatggcctcacaatttttattattttttaattaaaataccacgtaaacgtcacgtcactgtcaaattagccacgtaggcgtcacgtcagtgaaaaccgccgtctaaaccgccatgaaacttatattgcaatggttttgacagttgagggatccgttgtatctggttttccggttgaagaacgttaattagattcattggcaagtcaagggacctcagatgaacttattccattcgtgcaactatgtagtccgtttcctatttcgatcagtgggtttccttttgcgctttgggcttttcagttgggtttacatctgggcttctgtgggacccaattttttataaaattctttttttgaatttttgtggacccactggcactgtttgattttttgaaatccgcgctatcttttgttgcccagagagagagatctttctctcgttctcgtcgtctcaggcaacacggcgacgatttcgctcggcgatgcgaatgcggctgtttcttctagcacgagattctacaactccggcaatgactgctgtgacgcagcgctctgctcagctgcatcagaacttgacgcggtggcaaattttctggtaagtactttcctctttcttcatcctcttcattctatttcgacgatgcggacatgacgaggttgcttgcgatgtagttcgttgactcattcc

SEQ ID NO: 62379 - DNA, 15506 bp, Oryza sativa
aactttgtttatttcttaataattattatttgtgctctgaaaattccactaaaatttatttacgcattttaggcttttaggaaatatacaaaaatcctccaagccttatttgacttttaactttgcacattttaattgttggaggctttcacatggattttacttattctatgcataattttgaggatgtattttagagtcgttttgggacgcgacatgcaactaataatcaggctgagtatgaagcagttctcaagggtttataattgctaagggaggttgaagccgatgctgttgaaattatgggagattctttgttggtgatcagtcaattggcaggggaatatgaatgcaaaaatgatgtgttgatggtctacaacgagaagtgccgggaattgatggatggatttcggttggtgactcggttggtgactctaaagcatgtgtcccgggagctaatgacttggctcaaggggcatccggatataagccgatggtaaaagatattgaggttgaagttgccacagtagcagccgatgattggaggtatgatgtgtatcaatatttgcaaaatccatcacaatcggcttctcggaaattgcgctataaggctttgaagtacaccttgttggatgacgagctatattatcgaacgattgatggggtgttgcttaaatgtttgagtgccgataaggctaaagttgtgatgggagaggtgcatgaaggtatatgtggtactcatcaatcgtcacataagatgaagtggttgcttcggcgtgcagggtatttttggccgacaatattagaggattgcttccgatattacaagggatgtcaagattgtcagaagtttggagcaattcaaagagcaccagcgttggctctgaatcctatcatcaagccgtggccattcagaggatggggtatggatatgatcggtcagattaatcctccttcaagtaaggggcatagatttatattggtcgcgaccgattatttcaccaagtgggtagaagctattcctttgaaaaaggttgatttaggggatgctatacaatttgtcaaggaacatatcatctaccgatttggtatcccttggaccataacaacagatcaaggttcaatctttgtgtccgatgaatttgttcagtttgccaatggtatgggtatcaagttgttgaattcttctccatattacgcacaagctaatgggcaagccgaggcatctaataagagtttgatcaaattaattaagagaaaaagttctgattatcctcggcaatggcatacaagattagctaaagcattatggtcttatcggatggcttgccatggatcgattcaacttcctccttataagcttgtttatggacatgaggcagttttaccatgggagattaaaatcgactcaagaaggataagcttacaagatgagttgacagccgatgaatattataatctcatggccgatgaaacggaagacctagttcagtctaattgagagcccttgtgaaagttactaaggataaggaatgagttactcgtcattataacaaaaaagtggtacataagtccttttcagaaggagaattagtttggaaattgattctaccgattggaacacgtgataataaattcggcaagtggtcaccgaattggaaggaccgtttcaaatccataaagttgtatccaaaggagattatatgttacaaggacttgatggtgaagtttatggatgagcgcttaatggcaagtacttggtggtgaagtttatggacaagtgcttaatggattaattcatgatcggctgaggtttgccaatacatgcaaagccaatgtggttaacatcgcctttagatggccgatatatgttatatcgccctcagttgtttttaattatcataatcggttgtgttctgccgatgtatgatggttcataattgacatatcacccttagttcaaattataattttatcaatgtcttcaacattgcaaaattaggggggcagagatatagaaaacatggatttcaaaagcgaaatttaaaggcaggagattaacatggaattcattacagcccaaaagtttgcatgtttaaagttaattttacaagatatagctcatccagatatatttctttggatggctgatattgccctttgtctaatttgatccacttcatctatcatcttggcgtcggccgcatcagtgccagggatcggcttcagagattttgtcaacttagttaggtgtttgatagaagccttcaacttggacttttgatcttcaatggcttttggcaaatcggcaagctttgcttgttcgagagcaagttgtgcattgcattgctctagttcagccaggagctctatcatccgattgtttagctgatcaatgtttgtttgggttgcacttggactggcttccaattcatccagtttagctgtttcctcattgatagaagctctgtttgcttggatggttgcagttgcttcaagatctcttctttcatgtcgatcggcaattctattctaggctttttgaagcttaagccgatgttgctcaaggtatgctgctagagtaatggcttcgactagctcatctggaattttgtcatctatttcatggagcctatctctaatagggaccacctgcgattattccaggcggtctatttatgtggtccgcctatgaagctccatcttcgcaggcgcccattttttgccacctgcaaaattcattcacggcaacaccatttaccgcctataaaaatctggccgactatatagtcttcttcctccccgagctcctgttcatactcgatgattttctctctcttaaaggcaccaaaatataggggggaggttttgaacttcaaatcttcgagggatttttctactgtagttagatctatgcctttgcactctatatacataattttttttgtaatttaaacccccatttgactatggatctacgtatgcaaaatagtgaggggaaaagctagctcccatgattgttttttttttaatttgctttgatatgtgtgctagatttatgtgtgtttcttgatgctatggggttctctcatcttctagtgattttataatgtaatataatggactaaattatatactttgctcttatgtatttgcctagatctagataggagagagaaaacttcatgacatgaagaaaccaattattatgtttaatttcgtacattatgattttgttggatttatgtgtaatctttgatgtcatgtggtcgtcccatcctctagttggttaaatataatatgttaacttcaaaatgttacatttgatttcattatagttatattttgtagaaataagactagtatgttctcgaaaatttataggttccaattcgttgtttacaaatatatttgtaaaaaaaatttattaatataaattttgcagagatatggaaaggctcgaatggatgtatcattggccgatgtttttatcgctatatatggaacaagtgtctaaatttattgatattgccaaggagcacgctaaggagggtgttgacggtcgttatcgatcagttttgaccgtcaatattaccaaaataggagagaactagtgatgctagcaatgcatatgtttgctagaataataatattccactagtattaggtatactaacctttttgtagagaataacactaaagtggaggagaattgacatcaacatagacgataaatcaatcggacgatgtcgagaaccagacttatgtatgaatgggccaagaactcagaattgacacgatgaattgggccaaaattcacaagtctacaaagtgaagcaatagaggaggtcgccagccgaagatgggctggtttgggccagcccatggttcagccgaaccagggggttcggccgaaccccatctctaccgttgaggccagggtttggcatggatgtccaagattgcatcccaatgacggttggagggtactttggacaattccccttccaaaaccgtcataaccacctctatataaaggcttcactctcttcacttcaacacacacctcaagcaatatctaaactaccagatactactctaatatcatcgtcatgacgtagagtaattgcataagcaaacactatacccgcaccaaagcatctcccagataatctagccgtatattcagtataacaagaacataatgtaaagtaggtactcatatattcggagagtatttcaataccataaatgtatatagaagagtattctaataaaagtacaaatcttacaaaagagaagagataagctactagagccatacccgaactcttccgaaggcttcgaactttccatttttagctttaagtaatcgatgctgcgggaagtcgtcatatagaagaagaagaagaagaaggagaagaagaagaagaagtggtagcaccatctccggccatccctgtaagtttcaatcttcatcttctcaaatcatatcggctatcacatgactctaactgcccatattattttcagactttagccgatatgtttatggatgaagaagaagagaccacgagcacagctttggcacctttagccgatgatgtaaaagcaatcttgctagatatttcaaattggctagaaggttccttcactggtggagaaaccatctttcgtcggtcggccgaattccacaatagtcccggttgcaataaaaaccggggctaaaccctttttaaccgggactaaaaatcatctttagtcccggttcaaatgctgtcagggcctgtcaggcccccccgggatctttagtcccggttggtaacaccaaccaggactaaagatcgtaattttagtcccggttggtgttatgaaccgggactaaagatcccggggatctttatccccggttggtaacaccaaccgggactaaagtcccacccctatatatatgtcttcttcctcctccagctgcccgagcaagcttcaaaatttcttcaaaaaagaggggaggtcatgccaaaatttctagtgaatttattttggtgattatatacaaatcggaggtgcctaaaaggttagcaacttcatcctccaatgttttttttgtcatattacatttggtgctatgttttgcacacttttttgtctccaaaatttagttgtaagttgatgagagaaaaaatttgtatggggaagaaagaatatatagaaatttagtttatttgctaaagaaggttttataaaatagttgagaaggaaaatatagtgaaagttaatcttaaataatagaaaacaaactaaaatgaaaattaaaagaagtaaaacacattaatattagtttaaaactttagaaatagtaaataagaattatttggtgtaatattttataatttttgtatgaataatgatatgtcattattgtatgactgttgaaagagtttgtaattattttataattattgtatgactatcattattgtaagaataattatttgtgtatgattttttttatgtcatgtagatggattggtaatggttgtacgctgaccggcggtccaaagagtttattgacggcgtgcattattttttgagagtggccaaagctaacaggcataagggttttatttgttgtccatgcaataagtgtaagaatcagaaggagtattctgcatccaggactatttatttccacttgtttgagtcggggttcatgccaagctataattgttggacatcccacggagagcaaggtgttgaaatggaggaagatgaagtggaagagaacaatattccggactttgctcagtacgttggatttgaaggaaatcaaatgggcgaggaggaaagggatgctgatggtaacgacgctgcggatgatcttggtcatatgttgcaggacgccaaggaggactgcgaaagataaagggggcccataaattggacaagatgttagaggagcacagaatgtcgttgtacccaggttgcgagcaggggcacaaaaagttggataccactctggagttcttgcaatggaaggcaaaaaatggtgttagtgacaagacatttggcgatttattgaaactcgtcaaaaacattcttccggagggaaacaaattgcccgagacaacgtacgaggctaagaagatagtctgctctctaggactggaagttcagaatattcacgcatgtccgaatgattgtatcctatatcacggtgaggagtacgagaacctagaagcatgccctgtttgcaaagcactacgatacaagattagacgagacgatccagcagaagttgatgggcagctaacaaagaagagaattcctgctaaggtgatgtggtatttccctataataccacggctaaggcgtttgttcaggaacaaggggaatgctagaatgatgagatggcacgctgaagagcgtcaacaggacgggatgctgagacaccccgccgatggctcgcagtggcggaacatcgatagagaatttaaagactttggaaaggacgcacgaaacatacggtttggtttgagtacggatgtgtcgcgaccgagaaaaataccttttcccgaacgctagtgtattaatccccgtcccaggaaaagccggggtacaccaaacaaacatgatacaaaaggcacatctttattatatcgataatatatacattattacaaaggcgcttcaggcctgataaacaaaaataaacagcagcggaaaagcgggcctacggctccatcttcacaggcgctcaactggggtataagccaggactccacctaagacatcttctccgaagcttctcttactgaaggggggaaaagattgagcaagaatgagtacaaccacagtactcagtaagccacaccggcagatgcatgattaatgcaagggggtacaaggggtaataatataggggttaagttttgcagaaaacagcatttaaaagtcacttagttgcccaaagccattttataaagacgatcctagagttacacagtattattaatcaaggccgtgaaccctcacgaacctgccttaacccaaggcctacgatgattcagaccgaactagcaacccgacccttggtcccagctcgtcccaagccaacccaggccaaccattccacattttagttgttaagcaaattttaagaattaaaacactaacttgggtacattgctcggcttgcccataaccgagggcgcgactattcgaatagattatactctgatcagaggtgtacatctttacccacaagacacatcttcctcacgtgtaaccacgtgccacataccaccacggtatacggacggaagacgtgacatagttcccaacccatcctagccataaacaagagtaccgacccaaccccacctacggccggaacccccgggacaggtaggcaggactgagcccccagcagcaggacaccggccctgtgccatgacatctcgactaccgggccgcagctcgtgtagccttcatttgtcctagagatgtccatcgacccccgacttcgtccatgtcacgcccggaatttctatccaaaattccaaacgcttacatgtgtgttaaaccctcgtccaggaatcaaccgaggcacacaataacaaattgataatagagtacaaataaataactatttaatattcgcaaataataaattattagagaggtagatagttcctctcaaagaataacattctacgcagcggaaatataaaactataacaaactacggaacagctatggcgactccactccacaggcatcttaaccagaacaagctcaatccttcagatcatcaccttcgctgaaatactcctcttctgatgattgaatattgcaagaatgagcatatgacatactcaacaagccacacagcaaatatgcatgtgcacaggataacaaaggatggcataatagggtttcatttgcaaaaacagcatttagcaaacatttgagaatttaataaaacagttaagtaataaacaatattaatccaacgctatacaacataccctgttgaacaggcccaaccattctgaacaaccatcccggctacacagttctatctccaaaccaggaatataccattccaaaccaggagctaatcaaattattaccaattaaagcatcattcactatggtgagaagggtgagactaatcacgaaaaacattgctcaactcacccataaccgcgggtacggctattcgaatagattaaactctgatcagaggtgtaccactgtacccacaagacacaaccccacatcatgtcaccatgtgcctcaataccaccacggtacctcggaaaggagttgtgacaataccccttgcacaacataatccattacagcgcacctttcctggatcataatcacccccttataaacaaggcatggaatccccagcgacccccgtggacttctcgccacttcaaagtctggcgtactataatgaatcatgctatacaaaagataaagccgttgcccacgctggcttgtggttggcatgataaatgtttcacaacagtagctcgcgaaccggtccttaattatcatgagcacagccatcaaaaccatatgctcacaacccaccttagccaggttttaattatcaatcaattaattaacatcacacgattaaccatcgtgagctaccattgaatataaccatcattattaataatataatatattataatctatatttaacccctttagttagctaatgtttctaagcatggctaagcaaacatatatatagcatttagctgaaccaatccaatatataaggttcatgctaatcaaattataacccataggaaaataagatcatcttcggccaataattaattaggaaaggttcaccacccgatgacattcgaaaacaatgcatagttgaaataaaataatagctttaaatgggttcaacatgctcaaagggttgtttgggatctgtgtgacttgccttgggcttccgcaaacgcttcggaaccttcctcaacggaaacactctcctccggaacgtcggaaactaaagcaattaaacaaaaatcaacaaaacagtacaaaaacaagcttaaacagtacatgtggatatttttaacatgtagatcctgattttagaaaaatttagcaacttgaaccacctgaaacggatctacggttatttagttatgattttccgaagatttaatctattagaaaatcgggaaaaagaaaaaccgatgatgtcatgatgacgtcatcaaaggtggccggctcggattggcgacctcgccggagctagggtggtcggccgggattttggagaacacctacgcgtagaggacgacgagacgaacccaacggtactcaccaaagcgtccaacgacgagggacggcggccgacgacgagcttgtgcggcggcggcggttcggtcgacggcggcgacgggtctccggcgaccggcgacagcggggagagggcggccgaggttcctcacctccgtgcgcacctaacggcggcgaggggaagcggcggcgacggcggaatcgacggcgcggcgcggctgggcgtcggccggcgacggcggcggcttgctcggcgtggcggcggcgctacggagcacgagagaactcgggagatggggcaaacgaaagaggaggactagggggtcctatttatagccttggattgaagagatcggactcctcccgcaagaaatcgattcgggaaaaatctaaactcggttttggagataaactcgaaaacaaattcgattcggataaaatacccaatgatttgctccgattcttgaggtgaaagatagaggaggatgtggggataaaaacccctcaaacaatcggaagaaaaagggccggattgggtgctgattcggagcgggagacggcgtggcgcggccggcttgggctcggcttgcagccggcctgaggttagggaagggtccgacatgtgggccccacatgtcggtgacccgaggaggaggggcgggcggcgtcggctgggccggcttgggccggttcggccgcgcgggaaggaaaaggatgttgggccggattcggcccaacggcttagggaggggtttttggaactttttaattaaaataatttgtgaaatgttgtttcatttattaaaaatacttcccttgctcaaataattcccagaaaattctagaaaatagaggaacaagcaaagtatttaataaaattttatctagctcatttttatgttgaaaattttcctagataattagggtttagcttgtaggcttttaattttaatttctaaaaaaatgatttaaacaatgtatttttacattagacgatttttagggcgtgacagtccatctccatccgtgtacttttgtttataaccagactgagccacaaactaagccttacccactagacatgtggaagtacggtagtgctttacatcagaggcctgagcttaatccttatagtacccgaggtacgactaaccaaacccaaccacgcacctcgagcccagcctaaaaccatttttgggggttttgaatagagggggaggtgtgtgtccaattccaacaaaagccatccattccatagcatccaagtgatatgaaaattcccaaagtctaagttataaaaaccacctaatgttgtcctattaatcagcgaagcatctacctaaattcatactagtggaaccatgaatagagtacccactagttggggttttgtttatcctagggtgaacaaggtaataataacaatagcaataataataaggtcataacaaaggtaaataggcatggctaaataaaacagtgataacgcgggaatttaaataaagcgataatgcattaatttaaatcaaaataattttataaactgggattcaatatgctcaaggatgatgtgacttgccttgctcagagagaacggccttccgaaccttcggcgacggccgcgaaccacgcttcgggaacctccggaacgacagaagctacgcgaagcacacaagcaaagctacaagcctaaaaagaagcaataacaatacataaaaagaaagcacagggttctttaggttataacaaacattaggagacttgaacgggtcgattcagagttcgtatgaccaagatatgatcatccgaagtttaatgctgttatatggagatttgcggattattataattaagctttgcaactataaaacatgtgtaagcgctagcctggaaaagacaggaaggctgcgccgttgacatgcgcactccacatgtcaacctaagggaccaccgtagaccgagtacacagagacggtccacgggtcgacagaagtggaccccgtctgtcaaccgaggcgagtggccgacaaacgaactccactagacaccacgcgagctgcacacgtggaaaccacgcggctaccgagcgggcacactaacacggtcaccacacgcacaagcgaacgactaccgacaccggtacacgggtaccggggtcgacaaccgcacaacgggtacggggcgacaccgaaagaacgaggacggggcagcgagaggagagatccttaccaccacgcgacgaggcgtgggaacgacaacgacgaacgggcgcggcggagacagatgggcacaacggagacgaacggcgaggggacggcttcggcggcgatccttggacgaaggcgagacgcggccggcacgaggcttgacgacgcggagctgaggacgaagacgacgacggggctgcagcggcacacttgacgaacgcggacgacggacgagaacggctcgacggagggacgaacgccacgacgatgaggacgacggacgacgacgacgacgcccggggccggcgaggagacgacgagggcagccggcggcagctgcacggagacggggacgacgtggaacgcgccgctgcaaatccgatgacggaggcggcaccgcgagacgacgagccggcgaggatgaacgggacggccgaagggacgtcggcgacgatgaggatggaggccggcacgggcgacggcgttccggcgaaacagaggagcagctggaggtgaggacaacgctgcgacgtcgacggaggagatggcgacgtcgatcggcgcaccggcgacgtacaggagccgaccggagaccgggaggtactggacgccgacgaggaggccactccggcgagcttcgggcgaggaggaggtgacgccggggaaggagacgatgccgcggtgtcgaaggaggagacggcggcgtcgatcggcgcaccggcgacgaacagcagccggctggagggagtacagtggcaccaatgccactggttgccggcgggggcaccgttccggcgagtttccggcgaggagacggtgaggccggtgaaggggacggtgttgcagagccgagggaggcgacggcacagccggacggcgcacgggcgaggcgggaaaggcggctggaggcggccagcgcgggggaaagagaagggcgacggcgggaacgagcctccggcggtcaccgcgcgaaacggagggcaggccgtgggagaggaggcggctgcgaggccgagagaggtggtggcgcggccagccgacgcacaggcaaggagacagaggcggctggagacggccggcggcacgggagagaggggacgacggcggggaggtggctagggaccacgggagatcgcgggagggggctaaaacgatataacggagcgaggggattccgttttataggatgggggagggagccgggcatgggagtgggcggaacggcgacgggaaacacggccggcggccatggaaggtggccggagaagacgcggccgttccgggcgttagagggcacgaatcaagggggaaaatgggggaaatcaaagaggatggaaaggggattaaaagcccccacttaatttggaaataagggaattgatttgcgcggatttgagggaggaagaaactagggttcacgggagagagagagaagctgggcgggaggaggacgacgaccgggcggtgggacccacgcgcggcgcgcggtcagcgcgcggcaacggcgcgcacgcgcgcgcacttgcgcggcacgggcgggagggcgccgctcgggttgggcccggaggcggcccaggtgggagggggcggggaggcttgggccgagaggcggcccaggaggagaggagggcgaggaggcccgggagagagaggggaggggagggagctgggccgggagggggagggaaggcccaagagaaggagggagagaaggagagggagagaaagagagggaggaagagaggactttggccgcgggccgggagagagagagggaggactttgggccaaatttggcccaaaagaaaaggaggattatttttaggtttttctttttaataaactttgataattgtttttgttgcttaataattgtttccggtgctctgaaaattcaagtaaaatttgagggctccttttagaccaaggagaatttaacaaaaattctccgggccatattcaaatttttcttctacgtattttagtgtttgccaatttcttttcgaattttaattaattctattattccttttagcgaatgatttttaatttcgggatgaatttatcaggacgtgacaaatccacccccctttacaagaatctcgtccccgagattcgaggaggctagcatgaagataggttgggcggtcttctcttcttgtctgacttcttccgtcgcttcttctataacgaacttgcctagcaaaacttctccactctggactgcttgtctcgatctcctgttgcagatggaatcttctcttcacccgacttgtccctggttgcacctttaactgactcagactaggctgcggtagttgaggatggggtttcagttccagaacttcttatccttggtgtcaatcctcatacaagttacccacttcacgtcatgcgtcgacaccagcttgtcattactaggataccatgcttgtcatcatgagattaccatgcttgtcatttacttctaacttgccaccaactgcctcatatgagctttcctgctctccgggtgctagctacttctgctattcgatgcaagggtcgataactttgcctttgaattatgtttcttaacagaaccaacttatcccccttgacatgctttgacgtcttcccaaatggctttactgctggacttcttattgtctgatcgtgatcctgccaaatctgaagcttcgttgttagatgtgcttttaatctaacatctgtagattatctttgaacatatcacttggttcataactgggaatagctctcacgaacaagcaactcggattcactttctttacatttggttcacttcccactattctcttcatgttgtcctcagttagcattcaacgtattcctttacacctttgaccttgatgtgttctttcccgatttctcttatcaatcacctttcgacctacttctttgcctggtaataaacatctttttcgatatcttctatcaatcatcttttgacctttgtcaactaagtactcttcactccgagagttgtggatgcttctggtgacgatgtggtacttgagcctgctgcctttcagagcaaccttcaagtggttcgtcaaaagctagactggcggttgttgcctttgatccaaagaggacacatctgaaactctcagtccaaacaaaagtctctttggctttttaatccaacacagtttaattggtttttttttccatcaacaaggttggttattaactcgagattagaacatagttcctctggaatgagaccctaggtctcctttgacagtaaacaattatacgcatgatcccatatcagcatcttccaaaataatcctcatagaacttgtttttatcacacatgtctcccttattacatgaatacaaggccctaccttaaacaaaaagggaaggtgcttagcatcggtacattgtatcctcgacatgattcatccataaacataacaaactcattgtttataatcatgaatatatttatttattacatgactgctgaaactcccggttacagtgataagtagcgaactgaaaatcacaaacatggctactcattctagttctggagagatatagctggcattgttctagtgactgcatcatccttgattggttctgtgatgatgtgataggactgcatattgctatcattcacaggagaagcttccttctgattgctggttgaagcgaataacggtcttctgcttggtatcgccctcctgaggttgatttcccttcgctcggcctggagtaggtcggggagagaaacaacttcttccatcgacgacaataaaaataaaatatgagtaatattaatctagggtgaattcattagttgagataatacacatattgagtaaacttcatttatgcaagatttagaaactatagaatcaaattcatatagcaaataatctaaaatcgggagaattagaagaatacactattcattag

SEQ ID NO: 62380 - DNA, 14063 bp, Oryza sativa
accggccaccggtccacccttccaagccggcggggggcctcccccctccccctttggccagatctgaagggaagggagaaggggaacctcccccgcccgccccgccacgcccggtcgccgaaggccccgccgcgcccggccgccgtccgcccttcgccgccggcggggaggtgaaggggaggagaggagagtgaggggagggaagaggagagtgaggggagaggtgaagggagaggaaaagacacttagaaaatatcagcccatgtgcctcatatatatacctcgctaattttcgcaggcgcaccttgtgtgtcgcaggcggacggcaaacttcacgcctatttgcatttctgtagacggctatttggctctaagggctatgtccgcctgcgaaaataaatacccaatgttgacgaaaatgctttttctagccgcgtgtcaaaagttgtagttcaatatataattcaattaatttgccattcattatattgatcaggctcctactttgattaacttgtctacataacggatgacatgcctccatagtttgggactaattaagcagctctctatccactgaagagtgtgctgggaagtggcatattagcataggtagcatattagcatagctagctagttaactaattaattgagatggagtttcttgcctaacttgtatgtaccaaagcgtaagctgtgaatcgaatgaaatatctgtttttttaataataacagtaatacgaaatttgttaagagagaaaaccatacaggtgaaaaaagagttaacgattatgttatctcgatcttaatttggtcgctatggtatcaccacctttgtactcgagttgtgatttcgaagaaactgattatttttgctgaaaatatccgtggtacaataatcctgtggtgagaagttgacaagagtttatacacaaaagaacctagatcgaccatgcaatacacatggcaagaaagacgctttttttgggggagatgaagaagattcttctaactaattaaccaaaatggatagctagccatggtcactgtaagagttctttcaatgctacatatatgtgcaagagttggcaggttttgttgcacttaattaattttcaaaggcttcatcgtcactagctgacttcttagcattctatgagcaaaagaataaaacaatatagctctgtagaaaattagcaattgcatgaaggtcttaattagtcttggcctagtctctgggattcaatttatcttggatacattcatgcaccttctcctcctttgcgacactaacaacaaatagctagtacttgtctacaagctgagtccaaaccaaatgatcctgcaaaaacaaaataataagtggcggcaattgaacttctagattagtactcttgttctttcttggctgcatgtgtgctgcattcctttattaaactaacaaccacgtttgagaattgatctctcctggtcaaagaggctgcaactactcccttcatcccataatataagagattttgacatttaatttgcttgcactgtttaaccactcgtcttttttaaaaataattgtaattattaattatttttttgtcttactttattatctaaagtattttaagtacaactttttgttttttatatttgcacaattttttttaataaaacgagtagtcaaacagtaccagcaaaatatcaaaatcttttatattatgggacagagagagtagtacataagtacattgatagtacgagatatgataatcgatgaaatatcaggtaaaaaccattaaattagtgaaaatccataaaaaagtagatatataagttttctaaatttatttaaaaaatactactagagattggtacagccatgaactgcattggtacaaaatctaagtctaaattagactcgacttcatgctgagagagaaaaaacaaattttagctgaatatacaatatttatgggatttaacttttttaattattttcaatggatattgcctcatgataataatccaagctgcctacatatatttgatatatatgtcagtgaaaagtacacacaagtttatttgctaatatttgctatagtttgtatatagctgcttgttgcagacacatgcacttttcaatgtcaggcatgattaatatccaaaacacagaggagatacagaggaggacaagctatgaaaccaaattttgtttctatctaaaataaataagaaacagaaaagacttaattactttgtgatattttatctgaatattttacttaattttaggattctgaattatataatacatgtcataatttaaataacaagaattcaatctcactcctatttcacttctaataataaccgaggaaaaactaatccacgtgggggtgcagtgttgaagtataaatgatttgtcttatcatttcctcaaggattaaactagttagttaatgaagctaattattatttcatctgtttcatattatgagatataatttgactttttcctaatcaaaattctttaagtttggccaaattgatataaaaatttagcaacatccagtcatccacaacaccatactggtttcatcaaatctaagattgaatatatttcgatagtatgtttattttgtgttaaaatattactatatttttaataaactaagtcatttttttttaaaaaaaaagaaaaagtcaaaatgtctggtaatatgaactagatggaataaaaaaagataatcatatatatgaattctatgctagtttggcacttatgaattttctatgatccgagtggagagaatatatggtgcgaaagaaacatgtgtgaacaatgaaatcgatttgtcaccttttacatgctcagtttttccttgactaatctcacatcaagtctacctctaaacaaactaattatgagcatagaaggagagacataaaagtagaaaaattcaatctttcaacatcaaaagacaaaagaatgcagcacacatgctgccaagaaagaagaagagtactaatctagaagttccattgctgctgccacttattattttgtttttaggggattatttggtttggactcagcttgtagacaagtactaactatttgttgttagtgtcgcaaggaggagaaggtgcatgaatgtatccaagattgattgaatccccagagactaggccaagactaattaagagactttcaattgttaattttctacggagctatattgttttattcttttgctcatacaatgctaataagtcagctagtgatgaagccattatctaaaaaaaaaaagctagtgatgaagcctttgaaaattaagtgcaacagaacctgccaactcttgcacatatacatgacattgaaaagtgcatgtgtctgcaagcagctatatacaaactatagcaaatattggcaaataaacttgtgtgtacttttcactgtcatacatatatatatatatatgtgtgtgtgtgtgtgtgtgtgtgtgtgtgtgtgtgtgtgtgtgtaggcggcttggcttattaccatgaggcaatatccattgaaaataattaaataagttaaatcccataaatattgtctattcacctaaaatttgttttttccctctcagaatgaagttgagtctaatttagacttacatttgcgcaaatgcagttcatgcctatatcaatccaataccacatgataaattttcttggacgccgcccctttttgtttctatgcggttcgtaagtggaaccgcacggaaaaatagggggaccggcgccggattgtcacccgcacgggaaaatgcattttcccatgcgggcgtcttaatccgaccgcacgggataatcctcattatcccgtgcagtcgacttaagaggaccgcacggaaaaatcgattttcgcgtgcaggcttttcaatggaccgcacaggaaaatacctccctcctttccctcccacccacttcaaatttttgacatcctctctcttccttttttttcccttttattctcgctcaaccactaccctctctctaccttatctctattctctacctcctcctcccctcattcgtcaacagcgggcatcagcggtggcctcgtcggcggtggccccttccgcgcgcgcggccaggcggcgagcagcgaggcggaggcgtcaaggcagtggcggcgagcgggcggaaccttctcctgatcgtcatcctcgtcgtgcacgtcgtcgctcggctcccttgacgacgacgccgtctgcgtcgtcaaggcaacgacggcgagcgggcggcgaggcagccgggtctggcagcggcggcctcgcccggatctggtggcggcggcggccggcgcgactgtggtggcagcgggcgggctcggcagcgggcggtggtgattttcgcatttttgtttatttttggttttctttttggttccgtgcgggcggtataatttgaccgcacgggataatcgattatcccgtgcggttaggtcacccgcacacgaaaatattcatttttccaaacgcctggttccagacggggaaaacctcccacggaaaaatcaatttgaccgcatggaaaaataggttatgtagagtgatctctagtatttttttaataaaaatttagaaaatttttatatctaatttttacggatttttactaattaatggtttttaccggatatttcgtcgattatcatatcccgtgctattaatgtacttatgtaagtactaagcacgtgagctgcagcctctttgaccaccaggagatatcaattctcaaacgtggttgttagtttaataatccactttgtctccatcttattctttacaatattttgaccagtgtagtagtgcaatggattcaatgccctgcatgttgtcattgccctgctactttagagtttagaccaactttatgccatgttaactcgtttactaacgtcggatggtaggacccaattagcataaattcaactattccatcgaacaattggttgctcgaatgttcttaagtcaactcactgtttgacttgagaattaatctaacattttttgttcttcatagaactaatgcatgacagatacaaacaaatatatatgttaattggttgaccatgcacgcatgttggtgttaggattgtgaggacttagcagaggcttagctacaggtttagtctgactttggtttcatgatctattcttataaaattgtcatgttaggcgactcacattaacactatatgcaaagttttgattgtgccattcttgacctggttatacacttgggaaacatgaagtagggtcaccaattataagatgaaacaagatgccaaatgatgatgatacatcaagcatattgagaattaattggtttttcaacattgcagtgttaacaataatatctgttgtcaaagctagaaatggctgctatagctggggtaatgcaacatgcatgagtcaaagcagttgtctgccaagctagcttgttgagacatcagattaatcaacataattaaaatggtattagcttaggaagtggattgttatcactctctctactttatgttttagaccaaacaaaattggtggattgttctctctctagttatctacaatgttagctaggtgcatagctaggtagactaatccacaacaaatatctccctagtagctagtctaatcctcagcattagagggtaggattattcagggatgttacacatcaataaagtgtgtgtagaagctagcatgttcctgtatattcggtttggtgatatagaaaaaatgtaactaacattctcatctaatctatatattttgtggcgaataattggaggactgatctgcagtgaagttggtagaaagtggctggcgaccaaactgaatatgtcaatttcctaattgaacagtgtaaatatgcatcatatatatctatgccaacacacgtgcaaacagattctctagctaattagctaattaattaacatcgtaaactaccaagataattttaagcgactgattaacaacaaataagaaaaaagaaacaagacaactgacaaatacctctgtgatttgatttatcaccaaaagaactgacaaatatttttttatgtttgtaaaaaagaataatacaaatggtcaaacatgtcaaaaagtcaacaacgatatattaaaaatagaggtagttccaaattggagctgatatcctatcaggttaacggctgaacatgcgcagcaggaggatttctttgctagggtgtgaaaaccagctgaaaacatcttgtctaaaggatgcaaccaaaagcacatttttcgaacttataagtggtacgattttcgtaaatactttttatatgtgatttttttaagaaaactgttttaaattcacttttcaactttgcgatagttaatatattcatttgtctcaaatagctatcacaaaattattcagccattcagttattcagagagaaaaaaaagccctagtactaattaggattacgtgctatgagttaagaggcttaggttgttgctgtcatcagtcactgcacaaaatcaaatcaacacggctcattcgatcaatcggttcaaaaagcagctgctgccacgattaagtagtcgacaattcaaagaccttttaccagcccaaaaaaagatctagctaagagctaattaaactgtatatgcttctttagtggtgcatgccggccgttgcaattgcaaagcccggttttaatcattattcttctagcctagttagcaagatgaacaagcatacgactttgtctgatgagttgcaaaaggaagaatttttcagctagaaagtagagaagaggagacccaaaaaggtgaagctgaattgcacatcatcagtctctctcatgctcccctaccaacagggtgtgtgctatgtgtgatccctaattatttttttcgtttttttttcttgccactattgatcactgctgttcaaattttgattgatgttttaacagtaattcataaatacctaaaattgtacaacgggaaatatatgggatgcatgacagctatataatcatatcttacaaattccattaattaagccggctatatatgctagattgtgttgtgtgtgaatactagcaaggccatgtatggaaatgtgcatgcgtgcatgagtgcatctgaggttgaaattgtacatttgtgtagctatcacaaagttgaaaaatgtagtacatgtgttaaagctctttgaaaaatgtagtacacatgtgttaccatcaatatgacaataggcaggttaattttgattagaaatgaggactcaagaggtaattatatgatgtttcattggtctcattatttcccgccttaatttcaggggtttggagttctggaaggcgcatgagctcgtcagaatttcagaataacgcacttgataaattgtgctttttgatgaaaaatacagttaattatatttggcttcatatcaatgaaaaaaactgctatatccttctgatggttttcataatacgcatatatttcaagatttaaactttatttttactaaacatttagtccctctggctctatagttcttaagttttgaagaagtttgatgttacacaatttgaactttaactatcaatgccttttaaaatttttgttttgaagacactaaaacatgatatgtagattggtctaaaaaatacttaaataaaattaaacacttttttacatattataatatagaaaatcatagtcagtggtaaattttagagaccatgccattgttcaaaatatcaagaattataacactagagggagtagccgaattgtatgtaaattttgtgaaaaaacatagaaccattgggctatcactagaattcacttacatttagagaaacctatggcttatgcacatagcatccaattgtcgatattaggatttaaaccttagtagattggagtcacgtccatagttccattcacttccttatatatatatagttccgtcatcttaataaagctgcttccccgaattcacttttatttattccgacattgctacccacggtacattataagacaacttaacagttaaagttttcagatcgcaatgactcaaaactatccttacaaaaatcaaccgagagatcagaaagcaccattacttgatcaaggagacaaaaaatatctcacacaaatgatcgatgtcaaactgtcaaaaagtcaaatgcacagtggcagatagaaaggtaaaaaggcagaagaaaaactgtgattaattatacaaacaaaatcgactcaaccgtgttcttgtcattaccgcagatgctttgctacaacactaaaaaaaattattcacagcctattggtcatatagctgtgaacttgtagctatgaacttgtagctgctttatatagttaattgactggattaattaagagaaattaacgcgtattaagatcgagatctcgcctgccaagcttatcctatacatgtcaccatcaaactcgtgtacacgatcgatcaaatcgaacatgcatggcgatcgatcgatcatcgatggatttgcagatcgagcagattgttgttgactcgttgcaaaaaaagttgtttcaactcgagaaattaaaggcatgcaagcacgcatggactggatttttcacattttggtccttttgaaaaacttatttcgcaagtagatccctagaaaaacttatcccaaaaacggtcctttttggggcgccagagtggctggcgccgtcgttcaacaggacggcgccagcctctttggcgccgtcccaccgccgacgtggcggggcgatgctgaggtggctagggggagtgcgccagagtggctggcgcccccccccccgaaattttttatttttgttttatttgtttgatatttttttcacgcttagggacacacaagaaccaaccatagaaaaattgaactcaaatggacgtaatatgtgacatgtagaatttttcctctcctctcctctctccgaactagtgtagaggagagagatgtgcaacttttttatttttattttttttaatattttttcacacttaggaactcacaggaaccaaccacgtaaaaaataaactcaaacggacgaaatatgtggcatgtggaattttccaaagctccaccgaaaaacttctctcctcgaaaacataatcttgcaagcggaatttggaggttttaatatcgccaaacccggcaaagcgggggagaatcggatgtaactttttctgtagatgtccgttcatatattatttgcctgattccgagtccgtatgagaaagttacgcctattttaatagatggcatattttgtccgtttcggtagagttttggaaaattctacatgtcacatattttgtccgtttgagtttattttttatacggttggttcctatgttctcctaagtgtgaaaaaaatatcaaaaaaatgaaataaaaaaaattgcatctctatgtactgtttaacttatatgtcatttcatgtggttatattttgaattagattaagtaatttatatagtggtagagtacattatgtttaacatgctgatcaaagggttttactaaaggagttatggtctaatttgagtgaaggtgcaaagtagactaagtggtatgctagatattttcagacttagctaagtggtagttcgagtttaattttttttttgtggttggttgtatcgtgatcctgagtgtgaaaaaacatccaaaaaaataaaataaaaatgacaccgttgcaactctatacaaagaaacaggaatggaggtggcggcaccagccatgctggcgccctcctccctggggcggcgccagcatggctggcgccctcctcttgccacgtcagttcgcgtgcgccacggtggcaggaggacggcgccagagaggctggcgccgtcccgttggatgacggcgacagccactctggcgcccaaaaaggaccatttctgggataagttttttcaggggtctatttatgaaataagttttttaaaaggatcaaaatgtgaaaaatccagcacgcatggatgcaattggcaaatgtgcgagttttgctgaatttgcttgcttgactggaggactctttagacttcagtcttcgtttggctaggttagcttattaggtaggtagatggatagcttatagtgtatagcttagtccaaagctagcaagctagccacttgttgtgtttacatcagccatgatccatgattttgagcttaattagttagcgagttaattttacattgatgtaccagagaaaaaaaatctaaattcattagtatgtaagagaatattactacatccgttccaaaatataacaacttatatctttgtatccggatattctaggatggagtagtaggatttgataaacaaaaatatttttttaggaaaaatgatattagtatagttgacctagaaaatacttcctatgtagttgaaaaaagtaatgataaagtatatgtgcatggtcctattagaaattatgttgatatcaaaacgtcaaacaaaaaaacgaagatgatacaagctaaatgtgaatacatagatctcaaattcttttataatttatttctttccctttttatcatctatagataaatctaataaagtatgcaaatgccactcattggatcaatatacaaaatatacaatgatcgctctaaatatttttattttcaatgaaccggaattgttttgtttttgctaggacttagtttttgaccccttgattttcgccgctaaagctatcactctaaacaaatccatttagctgctaaaataagttgcttagatctctgggtgatgctgtgagtcacccaaagaaaaaatgacgcaagctaagaaccgtgtattatccactacagtcgtactagcataccctagcgagaagccgcatcgtatcgaacattcgaacccgtagtacgtgtggccacgtcaggaattgacacgtcaccgtgccaaaaaaaatcgcacgcttgtatatgtacacgtggcaggctgtagcaagtacgtggtgacgacgacacgtacgatacgataccagctgcggctaaaattgcacctgtacctaccttgatcaattctggccggtcaaccgtgtacttgcacaagtggcatcgtgcagcaatgtaccagtatctgtcacgtacggctcatgtagtcaaacatgttttttatttcttcttctttttttgagaggagtcaaacggtcaaaccttgttggatgtttctcgatgcttccagtaactagtgtcttctagcatttccgtggtttgggccttgttgaagtgggccacatcaagcccaaaagcccagcccaatctagaattacttctgcccatcacccatcaaattctggcagaattcacatgaatttcccccatctttgttcataatgaaatccagttcatgagtttgtttctggcaacaacattttcagtgtaagatgcctggagccctggactggaggggcattacgttccagctttattattgctgctggagttcacacaggcatgatcatcatcatcactaatcaacaggggagtgcagtagtggtacctacaggaaacatgctctctcatgagatcggcattgctgaggacagcttgtccgccagccctccggccatcctctccgctcgctcccctcgttcgccggtgcgtattctgatcacgtccgacacgggtatcactgagaaaatgtaacaccatacaagtcaggcgtaatagcagagaaacattacatgatatatgcaaaagaatgcgacgtttggttgcacggaacattagtgcctttaggattgaaagggcgtttatgttggcatgtcgataaattcgttatagtagctgcctctgttgaaaaatcaattttaaataattttttttccagaatggtatggtgaaagcctgattagattactctatgctctagtgcaattgatactcaatatttttaagttacatatattttctttatgtcagagataaaatacatagagcacatgaagagaaacaacagaactcgatagatgcctgctcagggcaatagaagctcactttgatacaaaggtgaacagtgggaaactgggaaatgatctgaacgtaacaacagagcaataaaaggtcatcagaaacagcatgcacttacaaaatatttttccatcaccaatttctcctgttcttgccttttcaattatcttgtcaacaacagcttcaacctagagaatgccaaaagggaaaaagaaagaaagaagaataggctgtttaagctgttgtttttaaattgtcacaaaaacatgcagaacaggcagtaataatatcacggagggacagcaaaacatgtttagaaatgtagtagtagtgatcgtacccacatagtcaatgatctcggatgaatactgggaaagtttaggtatatgttttttcaaatttcaacattacaaaatagtcatgaagaaatcacctgatccttggacaccactatttccatcttaactttatcaataaatgtatcttctgcaaattctgaccctgcacgacaacaaaaaaaaaggagcaccatcagtacagattaatctagccttcacacaataatacaagcatacatgcatgctcagttgtgcagagaccaaaacttctttgaaccataattaacatgccaatgttgctattgatacaaatgcttaaactaccctcccttatcacagtaatcttcttattcctaacatttcccaaatccatgcttcttttccaatcatataaccgcagcaaactatttggataaaaatagtgatagtagttgattcaagtatgtgcacagatagtttatgccagtgcccagttgctccttgcaccagtggcatttaaagcatattgaagataatgaggatattgtgtgcatctttggctgtaacccgtctttgaagctctcaggagcgagactatggaaggtatgattagaacaggcatcattttaagtgcagtctgcctgtgctatcaacttcttggatacatcagcagccctttagtttgctactttactgcactctgcacgtggagaccttcaagatttctggcaagctcgataatacctaggtgttgtaacagagtacaacacaagatgctgctgctagaatgcctctttgagacaagagcacaactttaccaatcgtaagggctagcagggtgctctcagttcatctaggctccaacaggcgaaccttatctttttaactggaagcatacaatggtacaaaccatgcgaggaattttatgagttgagcaatccccattctggacagaagtcgtctgtcattgcacagacatagcaatatcctattccaaactacggtagaaatcaaagtacaatatacaaaatggaacacatcgcatcaacaatttttgatcagtttattcagtggaaaccggtgagcagattcaggtatatccattctatcgcattgctagccctacgaaacgtatccgtaactacaaatctaggctcacaatcaacaggatgaaatttctacacactacaaacaaccaccaacactaaaaaaaataggcaatgataaaaccatgagcagagccagcatgtataccttcatgcctctcagttgacccgccctgtgcgccgaaaccccgcacgtcggacaccgtcacgcctctgatccccatttgcagcaaaccctgcaaaccccaattgaccaacctaacagctcgagtgcaggaagaacacgatttacagcagtaacacacactatactcaccgatgacacataaggcaccctccatggcctgcaagaatcaacccggcacatttcatcagcaaccaaaaaatgtaatcacaatcaacacggatcacgatactaatcggtcacaaacgaatttcacctcaggattgcctccaccttgtagaactcggactcgcgctggtaccctgaaaaatgaacagacaacgacgaccaccacgacgatgacccaatcagcgataaccaatccaacaaaccgatctcgatggat

SEQ ID NO: 62381 - DNA, 674 bp, Oryza sativa
attcctgcagcccaacagttagtaacggagcttgagcatagaccacgtggcatggtcgactgctcagcatataatatagacatactatagtggtatatatatacctccctcatatatatattaagctttcttatgtgatgattagtctaagagaaaaaaaaatggtcgctttcgagtggattgaatgcgtatgctatcctcgcccaaccgttccggtcgtcgcgattgtcacagctggtcgagtgacaacaaatcctgataatgcaatgcaggacgcagtcagtgagtcagtgacgctttggcttgtagcctcgttagtcttttgcttacatggtttggtctctgcactcaacggaagaaaatgtgtcctgcttctaccttatcagattcacagtactaatacatcacattatctattatgacagtattattacagacaccaacgtataaaacaatatatagaaagatataacctatgtaccagtaattgtaatagtattaatattattgtagagtatcctcacccggttgctacctgctagttggttgtataaggggcacgcagatggtccatgtgtacttgtatggaccgaccttaatttgccgatactacaaaataaacttattaactgcttgatcaattaaacgtacgacaaaaaactgaagttactgtt

SEQ ID NO: 62382 - DNA, 4698 bp, Oryza sativa
  unsure (1)..(4698): unsure at all n locations
cgcgccgtgaancgcccacgagatgcgnctgtagacnagccgaattngagacccccgacagccggccgagctattgacctcgtggccgccgccgacaccggcgccggtgccgaaacttcgccggcggcggcggcgtccgcctggatccgctcgatgaggcgcggcatccagacgtggcggacgacgtcgcggaactccttgctgttgacgtcgcacctcagctgcttcgcgtgcttttgcactctggtcctccaataattctttatttcgttatcagtcctccccggcaaatactgcgcgatcttagaccacctggcacacagaagtattcgcatttaggtccctggaaaggactgaagtgtaattaattaaggtaattaaattaattaccggttgccccagcgagagtggaggtcgaggatgaggagctgctcgtcggccgtgatgttgccgcggcggacgtcggggcggaggtagttcagccaccggagacggcagctcttgccggtgcgcctcagccctacacgtgtccacactctaagtccatcagctagtgcaaaattaaccgatcgactaatcactgaagattaattttatatctttgattttttgcatgcagagattaattgatgaggatggagagagagctcgcgcaatgaagcttaactagctaaactagataagcttctagaatattccagattaagacgtgcactagctagcttatcgtgctcagtggagcaagccaaataggcaacacaacagtattggctatttggcacacagagatcgttaactatttaattaatctcaatctctgatcgatcgatcgaatgatcaactgattaatcaattgactgaataattaattaatcacctgcacagcgagcaagcgagttccagcgaccctcgccgtggttggcgatgtagtcgacgagcagcatgtcctcctccaccgtccatggccccctcctcaggtcgccctcgtcctcgctcgccgccgccgccgtcgccgacgacatcgccgggctcatcgccatcctcatcatctccatctccaaatccatcgatcgatctcagtagctagctagtgatcagctgtagctgtggggtgtgtttgagaatggaggagatgtcgagagggaggcagggtttatataggaggggggacatgtggggttgggaggaggacgaccacgacgatggctaatgatgatgcggatggatgctgctaatgactgtggttagagccgcaattagctggctggctgttaattgtatagagacagttttaaaagcctaaagtggaggaggggggtgtcgcgggaataaacaattcaagcggcttaagaaaacaacgtgtctgtctagctgctccgaccagtcaaccgttgaacgttgactccccatgtaatggtgtcatggccagcactattagctgtaaaaaccgtttagctattctactcgtttctctaacctaaacaccgtacccttaatttgttttgcctatttagggtttattatttcaaacgtataaatatttcagaatcatataaattagattattttatcaatcacgcccataaaatttggacgcaactagtggctgatatatacgctaggaaaaacatatcggattgtactccatcacttgtcaagaattattttagatgtttcatcgctcgatgaaaaatatttcaatcagatgcaacattcaaaaatattaattgcaaacctaattgaccaatatgcacataaacagtaaaagaaaacgataaagaaaaacaaatgttgccatgcaagaaccttcgagatggtgaagggtgcaacacggctttgatgagatcacgtgtgagcaaggatttaaatctccggctatagcagtagaagcaaccgctaagatatgtctaatttacagctacacgttctaaggcgctattagctgcctttagctggagatagccgctaaatgggctctcaagtagcggcagctaactcgttggtgggctgaaatcctgaaattggcgaacggcccatatcacctaacgaaaccctaactctctccatcttccactcagtcactctccgtcctctcctgtcgacggcggcttgcaggcttgcagcggctgctcaaggaggcagcagcagccgcgacggcggttgatcccgaaggcggtggctatgacctgcagtggcggcagctgctccccaaggtggtggctgcgacctgctgcggcaacggtggcggcggcggtggtgactctcgaagacaacggatccaccaatctcggccccaagcgacgactgtgacaggtggcggcggcagctattggtgttgcaagcggtgggcggcggtgcttgttctgtcagtattctttttcttgtgctcgagccaaccttgtgttgtttcttggttcaaagatgggttggtggcttggctgctcatgaattgtttcttcttggtttgttggtggcttggctgctcatgaattgtttcttcttggtttggttggttgcagtagcctcagggtgaggagtatggaggttcttgaattgttttttttgttcaagttcaggaattcacgggggaggaattcatgggcatgttcctcctgtaatttagcaagatggttgaggaagtggtgaggatttgatcctactgattatcaagcaattcctctctccctagtcttctctgctttccccaagttaaatagctttctcttccatataactgattatcaagttatttatgtctaatttttgcaaaaaccgcttaatagcttagctgcagctatagccagctatagctgatcatagatgatagagaacctagcagctaaatgtcttagccggagatttaaattcttgcgtgtgagtgcaaccttcaatcaatcagagtgaaacacttgaagacaacaaaatgcaacatgaaaagcaataaattcaaataaaaatccttaaacttcgacaaatagccttctatccgctttcttcctctactctagtggccgaatctgccttcttcctccactctggttgaggtcgatcaggagtgtatggcagtagccaccgcgaccccagtgatagaggaaatgagggccacattctccacggagaggttgttgtgtgagtaaacgattcaagcgccttaagaaaacagcatgtctgtctagatgcttcgaccgctcaaccgttgaatgtttaccccccacttttctaatcaaacaataataacactacaattttttgagtaaattttagagcccttatattatggttcaagttgcacaaaactaccacaaaaattttaacaagtggtacataatcaagattatgtattatggctttagtgtttataaaagcacactattgatcaatctgcttaatattgtagcagataaaaaataatactaatgaacttatatggctgcagctttcttgaattaaagtactcataaatttcagacataactttataactcatatgtaggggagatcaaagaaaaactaactataatgtatatatgggttaactcttgtgttttatgtaactacttgagcatagtatgtggggttttatgaaattattttttaataatagaaattgccacacagcccgttaataacactgtcggatgacaactcgatctaaagaataaaagatcagcagatggcaagaattaaaaatttaaaagtaagcagaatatctgctttgtcgacagaggaagcctactagtaattatactggatactgtggaatggtttcaaagatgcagcaagacttgaatggcattaattagtttgttaatctaatccatggaaggaataatgcaaaggccagaattattgcatatgattcctcttgaaccgcaaagtagaaatactttttctgtttttccagccgtagtagtgataaagagatcattagctgtttattttaagggtgagggatcgatcaattaccaatagctgcttagctaagttcgaattgatccggattgttaagagtaagaggagcgggcatctttgaacaccaaggaacttgtgctatatgcgatatgaattcaaaaggtcgaatttggtgtattcctagatatatccaagtagctgtcactactagaaaaagtattttcgcaggcggccaaaagtgatttttgcaggcggagggcaggaccgcctgcatcccaacgttttcgcagtcggggcaatggcccgcctgcgaaaatccgttgagcgagcaaaaaaaattgcaggcgccttgccgccgcccccatgcgccttgagtcgccgccgccaccacgcgcctcaccgtggtcgtcgccgtccacgccgccgccgtcccgcaccgtcgtcgcaccgccgcccctgtcggcctcccccctccctcctccggccagatctgggagggagggggaggggagcctctgcgccgcaccacgccgtcgtcactgccgccgcccccgccggcctcccccctccctcctccggccagatctgggagggaggggggaggggagccgccgccgccacccctgccgtcctccggtccgtgtttcgctgccggccgccggccaccccccctctggccagatctggaggggagggagggaggggagccgccgccggccgcctcgccggggtacgaattcctcagtctanggnggtnnntgcancgccagtcctctataagcaccg

SEQ ID NO: 62383 - DNA, 3182 bp, Oryza sativa
cgacaacatctcataggtaacgagacgatcaaccaataactggccttcctgactaggggaccatctgggttgatcgcgacattccagggatatgagatcaatgggtacacattctacacgagaacccaagacataaagagcacgaaccaaaatagcgttgttcgtatcgatgccatgggacacgatggaacaactggcacgtattacggtgccatcaaggacatatgggaacttgactatggtcctctcaaggtccctctgttccggtgccaatgggttaggttgactggtggaggcgtaatgattgatgacagtgggatgacaacggttgaccttaacaaggttggatactcggacgaaccttttgtccttgccaatgatgtaacgcaagtcttttacgtgaaggatatgtctagcaaaggaaagaagggcagagggcctgacgagccaaagcgtcacgtggttctcccaggcaaaagaaaaatcgtcggagttgaggacaagaccgacgaggattatgatcagttggatgggcaaccccctttcacggtgacgattgaccctagcatcctcctaccaaatgaagacaccccttactcacatatcgatcacaaggagggaacaatagtgaggagaaagtacgtgcggtcaaccgtcaccgccgatgtattgccgtaattattgtgtacacgatgtaaactattttggatgtattgattatccgtataaatcaattgttgtatggcatatgttaattacgtacgattattagaggttttaacaattttaaatcatgtaattgctagttatatgcgataattagaatttttaaaagttttaaatcatgcatgtggcatttacatatgttacttagagtttttaacaattttaaatcatgcatatgctagttatatgcgataattagaatttttaaaagttttaaatcatgcatgtggcatttacatatgatacttagagtttttaacaattttaaatcatgcatatgctagttatatgcgataattagaatttttaaaagttttaaatcatgcatgtggcatttacatatgttaattagagtttttaacaattaatttaatatcattcatatgctaattatatatgattattagaatttttattaattttaaatcatgcatgtcgtatgtatatacatatgttaattacaatttttaacaatttaatatcattcatatgctaagtatatatggttattagaatttttattaattttaaatcatatatttgcttattacgttttatccacttaatttactatagacaacaataatgtttcgaagtaattgtcattaatttttcgactttaaataattttaatgcattattttctattttagaaacacatatgtaatggaaattaatattcattgcgcttatcagtagtcccgtttcttaaccctaaccgggtttaaaaagaatttggaaatagcgggaaaatatctttagtccccgttgatgagaacaaccgagagtaaagatatctttactcccggtagttgagaacaacagggactaaagatctaggggtgtatatatattccagatgcgcaccctcgtcttctccaccaacacttagaagttttttccccgattgatctctctcggcttctccttcgccgccactccatagggcatccccgcaccgacgccgccgtcgtatctcgccgttgcttcgcgcgcgtcgtcatcgctgcctccgccgccgccgcatctctggggtgagagccgccgccgcctccctctctctctctctccgacctcgatctctctctctccccaaaccgccgccggccgcctcgttgccgacgccgccgccgacgtcgtcgcggccgaacacgactccgccgcgccgacgatgccgactctgacctcgatgcggccgccactagccacgacgtcgcgctggcagtgccgacgaagccgcgccaagccgcagccgcgccgccatgccgccgctccgctgccgccacgtgaacgaacgaagaatgatcgtgaacgaacgaaacgtacgtgaatgtgaatgaacaaacgaacgtgaacgaacatgaacgaacgaaacgtacgtgaacgagaacgtgaacgtgaacgaacgtgaacctaacgtgaacgtgaacttaacgttgtatgtgaacgtacgtaaacgaacgaacgtgcgtgaacgaaaagtgaagttaacaagaacgcgaacatgaacttaacgtacgttaacgtgaacgcacgtgaacgaatgaacgtaggtgaacgaaacgtgaacttatcgagaacgcgaacgtgaacgatcgtgaacgaaacgtgaacttaacgagaatgcgaacgtgaaatacaatatatgttactttgcgtttatcctaatacatcttatgttgcagaaaagacgttgtcgtcgtcgtccctcaagccggagtggtagctagccctcgaaggaattcgcgcaggcaagtgatgtaaatatatgattgttagatttttaatgcaagtaagactattagatttaatatacgacacttagacttagcatatatgattatctaggtttgtaatgtacgacacttagacgacttagcatatatgattacctagggtcctaatatacaacacttagacttagcatagtataagattattagatttgtaataagacgcatataagattgtttgagttagcatagttctaatacaagattatttgagttttaatataagattattagatttgtaattagacttagtatataattattgtctagggtcctaatatatgacacttagacttagcatagttgactattagagttttaatacaatattatttgagttttaatataagattattagagttttaatataagattattagatttgtgtaataagacttagtatataattattgtctagggtcctaatatacgacacttagacttagcatagttgactattagagttttaatacaatattatttgagttttaatataagattattagatttgtaataagacttagcatataagattgtgtagggctctaatatacgatagttagacttagcatatttgacttagcatatatgattgttagcatataagattattaaagcaaaaatgacctatagacttagcaactatttcttgtataacagggg

SEQ ID NO: 62384 - DNA, 509 bp, Oryza sativa
gtggagagggatgcggaggggaactaggaggggaacgtggagagggatgtggaggggaactaggaggaggaggctagtggaagtcaaccctccgctggacaaaagagggcacgcgggcaatgaggtgccgcgaagaagctagagggtcggcacatcataacggaagtggacgaagacggccgacctagtgccccggcggaagcagccaagaactacgtacgacacagcggttgggttgtgcgggataacgtgcctgtcagtacagtgtactggcgcagaacaagggcacacagagatcatgagagctttgtcccagattcggagaaagagatgctgtggaccacaatgctcgagacattcacccttcccgcgggtacagaggacaaagtgaaaaggtggactctaaagaaaatggcagaacagtttcagagcttcaagggagatctgtaccagaaatatatcctgaaggggcagacaccgaacttcgacacattcccaaagctaaggga

SEQ ID NO: 62385 - DNA, 726 bp, Oryza sativa
  unsure (1)..(726): unsure at all n locations
cacgtgcactgatagaacctcttcctnnnnnnnnnnnnnnnnnnnnnnnnnnnnnnnnnnnnnnnnnnnnnnnnnnnnnttgtctctatgtcttgggagaatcttttcgttgattgaacaaaagttctctaagggatgaggcgacgccctgggtggatagagatcatgccggatacttatgcttaagtggatgcacgtagataatggagattccatatggcataccaaggagttattgtgtgcctatggtatgcggtttcaaatttggaaagagaaccaaattaggtacgattgggtatgttaagtttctttctcgtactacagggtttactaaggtgtcgaagactattaatatgagtgtgtaaaagaggatttaggctcactaccttatgtattaatagatggggagcggaaagatctccggattcgcttatgagagcaggtgagttgagacaaaaggaaggatcttgagtttcatctgaatctctataaggagtgctgttggcggacttaggtgacacagagaggaacggtaactgtgacatctactgttggagttattaaatatgtgtttgatcatttatctgatgcctaaccggaggcatacctgcggacatatcagctggaatctgggtcgtaagacctgatgctgtcatgaccgtcagaccgggtccaagtacggcttcatgagccgattttccatgttattaccaacaatttatatag

SEQ ID NO: 62386 - DNA, 1180 bp, Oryza sativa
atgccaagcaatgcttttgccgtgaatcactgattcacggggccatggcatgacaaccgaggttgattcagatttcagaatagctctggaatccccagaaattccttatttcaagagagagaagggtgtaatgtgctaaaatgctgtcacacgcgacactaatccttctggtattttaagcgtttattatgggcttcttataagaccaaaagaattatttgagagattaatgacatttagctctgcggtatcctgaattcctgatgaaatgatcactttaattctgtgtcgttttactctaaaaaatatgagtcgaatttgagagattcttgtagtacacaggctacacagcaaacacacagcagcgactcaaaccttcgggcccaagaatactggcccaataaataaggcctagttctatcgtttggtggcccacctcctcctccttccaaaccaacccaccatctcattccgcttctccctctcaaaaaaaaaaaaatcccattccgcttcgagaagcagaggaatcccgcacgcacagcgcatcgtctcgcctcctctcctcgccaccggcaagccgcgcctcccgcctctccaatggacgacgcgccatggcgcgaactcgacgccgacgtcctccgactcatccacagccacctcccgtgccacgtcgaccggcgccgcatgggccgagtctgccgcaactggcgcgtcgccgtcgcgccgcagcagccgccgccgccgccgctcccgtcgatcctcgtcccgcgcgccgacgtcgagccttccttcgcgtgcgccatcgccggctgcgccacccacgccttccgcctcccgctcccggccgacgcgcgcgccgcgcgctacttcggcgcctacgacggccggtggctgttcgtcgcgttcggccagaccaaggactacgcgctcctcagcctccgcacccaccaccgactccgcatcccctacccctacgtgtcctgggcgacggtggccgcgaccctctcttcgccgccggaaaacgaggactgcctcgcagccgccatctgccactactgccaggagaccggcccgcgagttcatagattctggcgcatgggccagcatcaggctgagttgatagtactaggatttctgttcctaccatcatgagtgcagcaaatctggaggatgtcataca

SEQ ID NO: 62387 - DNA, 899 bp, Oryza sativa
gcgcgtatgatgactctctgcaagtacctcatcaggttgggaagatattgaaattctaagattattgaatttttggcctaaaggaaaaggatttaattaaaccctttttggaaaagaaaaagaaaaggaaggagggaggaaatttagactttcctcgggcggctagggtgcggcccaagggatttggggcggctcggccgagcttaatgggccggccggcccaaaaggcggcccagagcgcgcgcgggaggggaggagagaggggaccggtggaccgggctcaccgcgcgcggtcccgggtgggacccgcttgtcagcggctcggctcaccgcgcggagggagcacgcggtgcacgcgcgcgggcggggaagggacgcggtgcatgcgcgcggtccgcggtggacgcaggtgcggcgggcccacgcgcagcctcacggctcgcggtggatcgcgcgcacgcggagggaccgaccggggtcggcccgacccggtctggctgagctggcaccgacgtggcgcctacgtggctgccacgtgggctggcgggaggtagacgacgatccgtccgcgaaaggacggcgggcggcggcggcggcgagcggcggagcgaaccacggtgatacgggcaaagcgagcacaccgggcggttgttcgtgacgaggggagacgaaccaacggctcggattcgccggaggttgctcgacggcggcggcaaccggcggcgggagaaggggaaaacggcgacgaagctacgaggggtcgattcccgcggtgagagcatctacgcggcgtcgggaactcgacgctagcgtcggattggacggaactatgccgagcgaggccggcgacaagcgggtgctacggagcttgggcggggaccggggcgaacacacggcgg

SEQ ID NO: 62388 - DNA, 32558 bp, Oryza sativa
  unsure (1)..(32558): unsure at all n locations
cctttaggatgagatctcttaactccttcttggccggtacacagatgcgtggaccgcaccaaactgtgccttggttgtctatggagaaattggtgtctttcttctcctgtattccttttattaattcttttatcccttcgtcgtctttctgagcctcccggatttgcgactctagggtaggctatactgtcaagctggcagggacacctgactgtaccacggtcagccttaacttctccaattctctgcacaggtgatcttggtcaggccgtatttgagctacattgtgataggccttgcgacttagcgcatcagcgaccacgttggctttaccagggtgatagtggattccaagatcgtaatccttgattagttccaaccatcttctctgtctcatatttaactcggtctgtgtgaagatatacttaagacttttgtgatcggtgtatacttcacatctgttcccgattaaatagtgcctccagatcttaagagcatgaaccacggctgccaactcgagatcatgggtgggataattgacttcatgaggcctgagctgcctggaggcataggccacaacctttcgttcttgcattaggacacatcctaagccttgtcttgatgcatcacagaagatctcgaaatcttttcggatatctggcaaggtgagaactggggcagtggtcaaccttttcttcatttcttggaagctgtcttcacaggctgcagaccattgaaatttcttttccttctttaacagctcggtcataggtctggctagcttagagaatcctttaatgaatcttcgataatatccagctaagccgaggaggctgcgaatctctaacacattcttgggcgggttccaagcaagtacagcttcaaccttgctgggatctacttcgacaccattggaggaaatcacgtgtccaagaaatgctactcggtctaaccagaattcgcatttcgagaattttgcgaatagttgacgatccctgagcttttccattatcaacctcaggtgttcagcatgttcttcctcgttcttggagtatatcaggatgtcatcgatgaataccacaacaaactggtccaggtattccatgaagattttgttcattaagttcatgaagaatgctggagcattggtgagtctgaaggacattactgtgaactcatatagaccataacgcgttgagaaagcggtctttgggatatcttcagatctgattttcagttggtggtaacctgacctcaagtcaatttttgagaaaactcttgctcctttaagttgatcgaataaatcgtcgatccgtggcaacgggtacttgttctttatagttacttcattcagggctctatagtcgattaccattctctcagagccatcctttttcttaaccagaagcactggggctccccaaggggatgagctaggtcgcacaaaacctttactttccagctcttcgatttgtcttttaacttctgctaactcattagctgccattcggtagggtctttttgcaattggtgcggtgcctggtgccagttctatggcgaactcaatctctcggtctggtggcattcttgttaattcttccggaaatacgtcgggatattcacaaactatgggcaccgactccaatgaggtgacttgtaaacaggttaagatagaccgacttgcggtaggagtgttaggggtaaagcggacttgctttcctccaggtccttgcaaggtgatggacttttcggcacaatctatctgtcctttgtacttagccaaccaatccatccctaggatgatgtccaagctttgcgagtctaggactatcggtttggctaggaagtcaacttcctcaattctaaggttaacttccgggcatatttgagttgcccttatattccttccaggggaatgtactatcattggtacacgcaaattttgggttttccaaccatttcttttcacaaaagcttgtgatatgaaagaatgggaagctcccgaatcaaccagaactattgcgggtatggagttgacagagaacatacccatcacaatgtctgaagcatcctgagcggtttcagcttgaatgtgattcacacggcctcgaccaaagtggttggaagcacgtgaaccttgtccacttgcctgagagctaggacgagactgagctgccgctgggtaggagttctggcagtgctgccattcgcatgccctgagctggtgttggtagggttctgagggcactgtctagcatagtgacccatctggttgcaccggaaacactgaactactgtcggtccctgtggtgacttgaacgaggtaacactgtttggcgcagtattgccactaggggcacgctgctgtggctgaggtgccggacggttcatctgaggacgaggggcgtaacctggctggcggttagcctgagtgaccgactggtggtattgcatgggttgtccgtagcgagggcgaggtgcgcctcgggaagaatttccctgatggttagacttgcgtttcttgtattcttcggtagcctcttttctagcatcctcgagtagaagtgccttgttgatcatatgttgaaaagtggggaaatcatgagcaatcaactggagtctcattccaactgcgattcctttcaagaatttcctgatcttcttctcgtcggtgtccacttcctcaggggcgtaccgagccaacttgttgaacatacttaggtactcattgacactgctgttgccttgcttaagtctgttgaattcttctttcttcatatcaatagcgctttcaggcacatgagctgtacggaaagccatagcaaactcatcccaagcaatgttagtgggttcagggtgtgcattgcagtaattctcccaccaatctgcagcaggtcctcttagctggtgagaggcgtagagcgtcttctcaaccggagtacactgcactaagttgagttttctatcaacatcttttagccaatcgtcagcctcgacgggctcgacggtatgagagaactctggcggacgagacctcagaaagtctgtcagcttggatctattgttgcccacgtgagggtggccatttccatgcgcattatgctgaaaactggctatggctgtggttaatccctgcaagatttgtgtctgaactgccattaagtgctgcatgttgttttccacatgaggtggggaaggaaggcgttcttctccagaattgtgactggcagtgcggtgagagcggtgagattgttccatctctgcattacggaaaactgtgcgatgcgagcggttgctgcggcggggttgctcaacctctgcgttgcgggaaacagtatggtgtgaacggttgctgtggtgagactgctcattagctgattcatgatttgcttctgcttcaactctaccatcttcaaaaccaaagcgggctggtgcacgagctgcacggcgggggcggctagccatctaaactcccagaaaagggcggggtaagagtcagataagcacttaggagggcaaggagcaatagcaactcagatagcacacactaggcataaactggatttttcaaatcataaaaacacctgatacaacgggtgtggacaagtcacagagctacaccgagcttgactgtgcgcacaccacctaggagaaccagactaccaaacaacacccacaacaaacacacgcacgcactacctcgccacgactccaaaagagttggcggcggaacaaaagggcctatcacacggacggctgctgaagactgcctcctctactcctcgtcggcctggctgcctcctgtagtcggctcctcagtcgaagaaacgtcgatcggctggcgcgaagggaccggcagaacctgtcgagggccggcagcagcacgggccgctggcggtgggggagctgggtggcggaaacggaacacggtggaagaaccaacaacacgcttccgcgcggtgcggataaagcgtgggccacggcgggaggaagcaactggggtgtgtccgggggtgtaggaagggctaactgggtgtgggtagggggagtacactggtgagtacggcgcacgcgagctgggggagcgcgggccgctgggggtgcgggcagagccgcgggagctgtgggaggacaggtggctggcgtggcagaggcgtcctgagtcccaagagatagtgtcaactgaggtgacaccctcctcggccagacgggcctccaaggcggcgtagcggcgggcaagggagcggtaagcctcaaggagtaggtcgtgctgagtggcctgagcctccgaaagctcaaccatgcgagtcagcactggctgagactcgctgtacggacaagggtacctggcgtcttagtggccagagggaaggcgtggaagctgccggaaggcggagcctccgagacggtggctgtagtcgtgggacaggcgacgaagcgccgtccaggagaggtcctggtacgcgatctggagagtgggcctggccacggtgaagtggtgtgggcgaaggccagctccgtgtatacctccacgggggtaatggtacacagagagctcacagtgagggggaacacggtccacggagtaccccgtgtactcgggacacgagaagccaaggaaacgggagaggtcacgccccgaactagtcccgaccggaactagcccgtgacactccaaattaacctgttaatcgataccagtcccaggaaacagtactggtatcacagggagacagaatatcacagcaacagaggtctctttattatagagtagttgtacagtcatgttgggctgcggacagatcccgagctcacaactgcattacaaaaggaaagcggaagccaggacttggaccaatcaacacaggcgcgacttgggaactaggccgaaaccctaaaacacatcgtagccggcttgctcctagaagaactcctcatcagcaggatccgcttcatcttcttcagcaactaggggggggggattatttatatagagcaagggtgagtacgggagtactcagcaagccaggggaaataagtgtttaatgcaggcttcaaggaaaggctgttgttttcgtaaatgattttatttgaactttttttctaaaaacatctaggtgagtgcttctcaaacgacatggttgagacagtgcgtcccgtccggtcggagtatgtgcaatgtatcagtctttagaatttaaacaaggttggcacccggccaacagctttttcaacggccacccgggccaacaactcttcaaacggccacccgggccaacaacttttcaaacggccacccgggcctagctgatcccatcagctgcagatttttcaaataccgaaccccttttcacacagcaatttcacaagcagtagtcaaaccaaactacgctaggaatcacctcacatccgcccatgaccgtgggcacggctgttcgaacagtttgttaatctctgcagagggggtacactttacccacacgacattactaacccggatcacccagcccgtggggatcagccacgtcgggagacctccaagctttcatgacaaggcatttccaaagctgacacaggcttaccatatgccgacgagaggggttctagaccaacaacaggttaggtcccagaccatactgtgccaggaagcccaggggggtcctctccgacaccaccccggcgaatccacatgtctctcggcatcatggctcccctgataagctagttactcagccaggggtgtcccattccacccatgtggtcgtacttgtcttatgttcggatgaaattccaaggaatcggtccttaagtgcgggagcgggaaaaccgtacacccggtacgttccccggtccgcggttttagaaatttatttagttcgcaagcaccgacccaggtgtcgggttttccaaatcttttgtaaaacccaagttttacccaagttgtttttcagattttaagtttgaaggcgaccgtcgatactcgcacagagtgcacgaatatcgaggcgcaactgggtggttacaaggggacatggtataacaattaacaatggaaggatcaaatgcaacaagttaggtaggtccgccaatctgccctgcaggcgggacaaacagattaagtgtgatcctatcaatgcataatatttttcaaacaacataattaaatttcaaatataggctcaagatgttcaaaggtggcttgccttgctcgagatctggagcttgatcctcgaaatcctcgcactgcgggtcttcgggctccggaactacacgcgaaacgggacaactcaacaaacggcgaaaataaagccctattaatgacctctaagcgtgccattagatagatctcgagatttggggaattttggaagttgaacggagtcaacggatttacggttgggaagatattgaaattctaagattattgaatttttggcctaaaggaaaaggatttaattaaaccctttttggaaaagaaaaagaaaaggaaggagggaggaaatttagactttcctcgggcggctagggtgcggcccaagggatttggggcggctcggccgagcttaatgggccggccggcccaaaaggcggcccagagcgcgcgcgggaggggaggagagaggggaccggtggaccgggctcaccgcgcgcggtcccgggtgggacccgcttgtcagcggctcggctcaccgcgcggagggagcacgcggtgcacgcgcgcgggcggggaagggacgcggtgcatgcgcgcggttcgcggtggacgcaggtgcggcgggcccacgcgcagcctcacggctcgcggtggatcgcgcgcacgcggagggaccgaccggggtcggcccgacccggtctgggctgagctggcgccgacgtggtgcctacgtggctgccacgtgggccggcgggaggtagacgacgatccggccgcgaaaggacggcggacggcggcggcgagcggcggagcgaaccacggtgatacgggcaaaagcgagcacaccgggcggttgttcgtgacgaggggagacgaaccaacggctcggattcgccggaggttgctcgacggcggcggattgcggcggcggcaactggcggcgggagaaggggaaaacggcgacgaagctacgaggggtcgattcccggcggtgagagcatctacgcggcgtcgggaactcgacgctagcgtcggattggacggaactacgccgagcgaggctggcgacgtgcgggtgctacggggctcgagcggcgacggcggcgagcacacggcgagcgaaggcaacggccggggcggcgccggctaactacggggaggctactcaagctactaccgaaagctaggggaaggagatggagcgaggaggaagaacgaagagaggcactaccgtgcgggacagggcgctgtgacgagaggccgacggcgcgggagtaatctctccggcctcgggccggggaagaggaaggagagggcgcggccggagtcctccttcctcttccgcgtccttgctcgtgccggctcctccgacacgcgcaacgacgatcggcgacggcgaaatagagggcggcaatggcgcggaggcgaaaatgagggagtttggagggggagggcttgggcttaaatggacggcaatgtcggtttgggagaggggaaccgacattggacggttaaggcgcgagctggcgctcggcgcttgcagccaaagcggcggcaggaggatgacgccggcgaggaggaaaaggggaaaaggagggggagaaaggggcttgcccctttgccgattcgggaaaaagagggggaggggaacgggagcatcgcggcagagggaggaggggcgcggctccatcccttggcggcttgcgcgcggaggggcgggggccgggcgatgacggcgggccggtttggagcggagcggcgacactggcgacaagcgcgtgcagaggctgccggcggcggcgatcgggcggtcggccaccacggcacgcgcgcgcgggaagcaacgggcggcgtccgcgcgggcgcgcacacgctggctcgcgaggacgagcggctgcgcggctgcaggcgcggcagagcgaggggaaagggagggggcgctcggcgcggcggctcacgcgcacgcgcgcgcggcgtgcgggcgaggctgagcggggagagaggcgctcggggcggctctcgcacgcgcgagcagcgtacgggcgaggccgagcggggggggagatgggagagcgagagagagagagagagagagagagagagagagagagagagagagagcgcccggggagaggggggccgggggagagatgggccgagcggaaatcggcccatcgaacccgggggaggcaaactagacttttgcggaggaatttggtttggagggattggattcggaattgaactcgacgatagatcggggattgagatcttgagatggcacggacactagacaacaagcaaggaaacaaatttcgcaattagggtttttaagagataattttcccgctaggcgccacgacggaacgggcgctacactaagctgccatcagctttcctcttcactttgtatacccacttacaatcaatgatatttttgccttgctgaggaggtacaaggtgccatgttttgtttctcattaatgcagtatactcaacatccattgcatttctccatctttcatcagttaaagcctcatctaaagtttgaggctcacctgtagcagcaaacccagtatatttatatggaatggttccatcagtatataccttaggtttgcggattcctccttgcaaccgtgttttcggtgttgtaggttctccccctgtctcaggcatcagtatcgtctgctcgacagtactatcatcaggagtactacttgcatctgcagcaggagcactggtgtcaataattatattattcaccggtgcatgcgtcagggagggagtgccaacagcttctccctctctttctgttgatgtggacgcgcccggttggtcagtaccgacgcaagtatgcgacggtgttgcagtgccgctatcacttccatctatctgcatggagctgtcgcttccatctggctgcatggagagttgttctgcttcctgcacaccatcacttgcacccagattttctgcattttcactaggagcattagtggtattaggaaaatcaagcacaggattatctatttgttctcccccttgatcatgtgcaactagagagggtgaaagtgatgtaatttctgcacgcaaccgtgcacctgcattgggcttgaggctagaaaaaggaaacacactttcatcaaatataacatctcgggaaacatatatccttccagatgagacatcaaggcatttaaaacctttatgctgtgtgctatagccaagaaaaacacattgcttcgaacggaactgtaatttttgagaattatatgggcgcaaatgtggccaacatgcacaaccgaaagtgcgaagagaggaatattcaggactttggtgaaacaatcgatcaagaggtgtctcaaaatcaataactttgttaggaattcgattaataaggtaggaggcagctaggaatgcctcatcccagaacttgagaggcatggaagcatgggctaaaagagagagaccaacttcaatgatatgtctatgctttctttcagctgacccattctgttgatgggtatgaggacatgagacctgatgggagatcccaatttggcgaaaaaagctatttagtttttcatattctccaccccaatcggtttgcatggagataatttttcgatcaaaacgtctctcaactagagcttggaattcatggaaaattttaaaaacatcggctttgaactttaaaagataaacccatgtatacttgctataatcatccacaaaactaacataatacttctttcctccaacagaagtgggtgcaggcccctaaacatcagagaaaatgagttccaaaggaaagttagagacactattagacttatgataaggtagctgatggctcttggccatttgacaagcatcacaaaccgactctctactttccacaccttgacatggcaatttatttttgctaatgactcgagacacgataggattagcaggatgtcctagacgaccatgccaccttgcaaaagacggcaccacagcatgagcttgttttgttggtgaagtggatgacgacgaagtgggcaggggggtagaggccttggcgacatctcccctcaagcattgtggtcctcatggctcgatccttaaccaagaaatatttaccatgaatttcaacaaaggcagagttatcggaagcaagttttgatgcggaaacaagattttttgtggcttgtggaacatgtaagacatttttcagatgtaaattgcgcatgggggtagaaacaaaagattgacctatgtgcttgacttccatacctgctccattggtggtgtgcacatgatcattacccttgtatttgtcgcggatggaaagtttgtcgagctcgctggtgatgtgatctgtggcaccggagtctatataccaattggagtcagctccataggcatatgagactgctgctgctacatgacgctcttccggcacatagttctgatcgaacctgtgccagcagtcagacgcagcatgtcctcgcttgaagcacacctggcacacaggccgggtgtcattgcggccaccgccaccagtccggccgccacggttggcgccagcgctcggagctccacggccgctgccgcgatttccacagccaccgcgactggagaagccaccgcggttgcctcgccctgctgcattggcagcgatttctgctctcctcatctcgagcctgttctcaaaacttaatagttgtgcatatgcatctgacagtgtaagtggttcaaccctagcaactagagccgaaacaataggatcatattcgtcatctagaccatttagtataaaagcaatcaattcttcatcatcaggtggttttccagacgctgcaagttcatctccatatgccttcatcttaccaagatattcagagattgtggatgaccccttctttgttgtgcagagtgatagccgcacgttcatggaccttgctcgagtcttcgtagtgaacataccttgaatcgcagcccatccttcaaccgccgtctgcaccgtggctacctgagacaagacgtctcgagataacgaggagaagatgaagccgaggacctgttggtccgcagcgaaccactcgtcgtacgccgggttcgccatcctgacgatcttgtcgccggtcttcttgtcatctgatggagtcttgtcgatctccttgggaggaacttcggtcttgccggtgatgtgtccctccagtcgtgccccacgaatcgtcgtgagcacttgagctgaccacagttggtagttctgcttgttgagtttttcggagacatgagatccgaatagaggattggtttgggaggtggaagaggaagaactggccatggtggatggatagattggatctaaacttcagagctcttataccatgaaggaaatcacgagaactggagtaacgtcgcccttcacgctagggtcaacggtgcgtgtttcacttagtgcacaaatcggcacaggtaagtacatatatatgcatagacttgtgaggctcggctggggttgtttacataacaaacttgatcttgtctaactatctaaaccaccggccaagcctcatcttgtctatgtttgttacatgggatagtatctctaacactcagtgcctctcctccccatccggcgccggaaacggattccccgagccccggagatgcttccgccgccctcaatcgatccctcgttaaccgccgccgtttcccctctttgctcgccgccggtatgcgccgccgcgattcgtcgccgccggcctccctccggtgaatccgggccggtggttcgctccttattgtccctcccgtcgctccggtgacctccctctcccttgaatccccgtgtgctgccccggcgaatgtcgccgccgtccgccgtccatccggccacggcctttctccctcctcccgctcgccagcgtggccgccacctcggctttgaccgagccaagtcggtcagccgcctcctccctcccccaccctcacgcgcgcggtccacggtgcgccaaccggctgcgcgtgggcccgccgcatccctagtccatccggtgcacgcgcgtgaaccgcgctcacccgaatcctagcgccacccttacgtgcgcccatccctccatgagtcgcgtcaccgacaagcgggtcccactcgggacaacgcgatatgagcccggtccaccggctccctctctcctcccctcccgcgcgccctaatgggccgtgtctccttaggccggccggcccgttagctcggccgagccgcgcctcttctctcgggccgcgccctagccgcccgagggaagtctaaatctcctccccatttcttttcctttttaaaaagggtttaaataaatccttttccccctattccgtaaatcaattctttattccaaaaattccatgaatcattttccttggttccgcacgtcagtgactgtcaataatattcttgagaatattatttctataaattccataaaccattcctctcattctagaaattccaaataaacttccgaaatccatatcttctcaaccgctcatccgattgactccgttcaacttccagtaattccgtaaaattaagaactatctaatggcactattaattagtctaaatagggtctttcttttgatcttttgtttaggtttttgattgtttgcgtatagttgcggttgcggattttcatcaatcaaggatttctcgaagattcgtgaagcttcgtgaagaccttgagcaaggcaagtcaccctttgaccaattgctcctataatcgaaaaaatcattattattttgtttgcaacttgcattattagaatcacccgtttaacttgcttggcctcggtttgcatgccaaaccgacagacctacctagtagtcgcactaattcctgtaggctatactaccctgactccttgtagctccacctttgtggtacctcggtatccatgttctttgagcgcgtataccaaatatcctacatacaccgttgtttgtcgaaaacttgggaaatgggtttgagaagccttgaaaacccaacatgtggtgtcggtgtgtttgaaaataaaataaattgtgaaaactcacgatgtgggggttgtgcctatgtggcactgtcccgtattcgcatataaggaccgattcctgtgggaaattcatccgagcatataacaagtgcgaccacatgggtgcaatgggacgcccctggctgagtaattagctaatcgggggagccatgatgccaagagacatgttgattcaacggggtggtgtcggggagaaccctcgggcttcttggcacagtatggtctgggacctaacctggtgttggtctgggacccctcttgttggcatatggtaaacttgtgtcggctttcgaaatgccttgtcatgaaagccttagggtctcccgacgtggctgatctcacgggctgggtgatccgggttagtaatgttgtgtgggtaaagtgtaccccctctgcagaggttaactaactgttcgaacagctgtgcccatggtcatgggcggatgtgaggtgtttcctgtagcgtagatttgtttgcttgtgctttgtgaaaagttgttgtggtgtgggaatcgttaccagaatcagcctatgtggcagatggatgacctgagtggtcaagaaacgaatctgtgtgattcgggatgtctacgggcatcatagactagacttctcgagcggaagcggattgttgtgctgctgggcagctggactctgggagtccgagaacatgaataaggctctgggagccgcttaatcaagtgaaatggctctgggagccgagaagtaatgatctgacctggggggtcggtacattaccaattgagttgttgaaaaacatctcttaaagtcgaatcgagacgcaagcctcttttcggcccaaacttagaaagaagtaaaccacttagtgatttcaaaatgatttcaaaacaaaagatttgcaaaacaaccttgcctctcttccaagcttgcattaaacacctaaattcccgtgacttgctgagtacgaaagtactcacccttgctctatataaatatatatagttcctccgtcctgaagttgaagatgaagtaaagtgaagattagggtttcgtcctggttcccagccgtcgcctgtggtgttgggtattagtccgttggttccgctgctgctgctgttggtgtttcctcgtccgtatcgtcggttgtattctcgggctgtcttgagctgcaacctaagttaaggtaaataagtcctctatttattttaaggattgcaatgattcatatttgtcaccgtgggtaccaacgctatgtcctaggattggtactgagatcgcggtttcgtaggaagcggttcgcgccgtttttcctactatacactcctgtcaggtgccgttgtacggtggtgccagattggggtgtgacacaatggaatgtgaggcaagatttatgatgtcatttcatttgcccttgtatgataaacacgactgcaaaaattccttacaataattgattgcggagcaataagaaatagccttaagcttaagactagcctttactagcttataactcatccataagaaataaaaaagtgttctttctcttacttcctttcatcatgtttatgtttgtgtctgcaagctttactattctggatatcttttttctcgtgggatccaccttatggctttacgtactattttgtttttattcatagaacaccatgaccagcgtgagatctcaattaagggtcgtatgacctccatacattgaggatgcccatagacgattatgctgctaagaagcatgcgaacgaaacaaaataggagcagcagttctgatataaatgcagccgaataagcaccgaatctgacgttcctgctcagctagcaccacgaacgtgaagaagccaagccgatcgaaggatggctgccgtgtcgtgtaatcgtgttcgtgtagaaccacgtgaagaggctgcataatttaagaagctgatcctgaaaatgtttgagaaattcacgaacttcgatccctcgagtcagttatgaaatcttcagagttccggctatggatgtatggaactcatcgagtcctctcgtttggcgtttggcgtttgtatgggcctaaaactcggcctgatgatatatatgggcctaaattttagttcgactttcttagcctatgccggatctggccgggattgatgagacccatccaaacaggtaagatcgtaacagatgtggaataggtccgttttgctttccctatctttgcattgagtttaaatcgcaactctgaatcactcaataatgagtattttttataatgtaagactttctagcatgcattgtccatgaatgtgagcaatgctagaaagttttacattgtgaaacgaaggaagtagaaatcttgagcacctaacttgtaaaacgggattaaattagatcctctgaaagtatagatgattggtttccctgataaaccgaatgatcaaacaagatagaagcacatgtcattactttgccatgtctcttgtcttattgatgtcaaaggtactagacaaagacggatagacggaggcacactataccacatttacatagaagaggaactccttttctatagagcattaactatatttagtactattcaatttcataagataataattagtacatgcttttgcccactgattgatacttgagcagatataggagtggggtacatgtagtaattctatactaaacttctctagacattaattaagtataagaaacagggtttatgattctgagatggtcttccattttgggctctagcgaaatgacggttttcgcgaaatctagtggaaagccggtagattccgaacaaattttataaagcaaaatttgaatacaaattccttgactttaccagttggctttgatgaaattctgagtgaaatcatcgaaatttcaattggtaactagaaaaagaggtgaactgaaagtgcttttcttttttttaattcgttattcttttctctcttaccgtaagttttagtaaatacacgaaatatattatttttttcgaaaatttatatcccaatatgttatatgaatatcatactatatataatattttatttgatattttccttttttatcaattcaaatttgaatttggatataattcattgaaatctcagacggtatctactttcgagccttatcgaaaccttgaaattttacggaatttgaccggtttttgtcggaattgtgaaccctattagtatcgaggcctttacaattatgcttaggccccattctaaactacaattccaaattattttttcgttagcgtgtccataactgctaaatggtacatttatttttaaaaaaattatataagagtttctaagagaagaattaaacaaatttattttaaagattataataattgatactcgaacacaaccttagttgagattacagtgtagtagtcatcaatcctatacatgtgagtaaaaaaagttataacatattttatgtatgccaaactaaacaattctcaagttataaaatgtacaagtgtacaaacacagctaattcgataggtaaattaaaacacaaacatgacttggatcataggcaaacagcagctcactacaaccaaaagacacatttacagttaatcatcactgtttatttctgcaatcctccacccatgaaattaaacacactacacctcttagcttccaggcgtaaacttcatgcagatcggtggcttaatcttagcgagagcaaggatagaagaagggaaggtccaaatgccatcgccacacatgagcccagacgcaacagcaggcaccatgaaggcagcctccttcttgttcatcttgttccaagcaaacagcaccaggctcccgacgcacatgtcgatggcgaagctcgcccctacgaggaacggcacggccatcgccgtcggcagcggcacgagcttcttgtacctcgccggcagggcgtccctcgccacgttcgtgagcacggcgaacgcgaagaacccgacggagagcgagaggcagtgcttgggcagcgccgagatgccctcgatcccgaggatcgccatgttgcggtagatcagcgcgtatggcgccttccagtagccatcggggttcccgatgtcaaacgccctgtagaacagcatgaacgtcagtggcgcgatgaagcagccaatgcctgtcccgatgagctctcccacgagcatggacctcggcgatgtcaaggtgagatgtcccgtcttgagatcgtgcatcagatcggcagagacgagcaccagctgcttcaccagggtgccaaccacaaggccggctatgacgccattgtccttgccagcccaagctgcaaagacgaagagagcgatcttgccgtagttgtaccccatgttgatgtccgtgagccctgctccgtaggaattggcgaatcctagcaccgggccgagcgcgtaggctatgatcacgtagtaccacttcacttgtcgaaacattatcggtatggtgattaccgcaatgatgcttagcaagaagtaaccactgtatgccatccaagaagggacagtacccctcttgaatacctcatcacgttgtagatcatctaatgaaaccatatcaccctcctctgatgctgcaattcatttcatttagccatcattaacagtgttatgagtatgtgaaaattaaggtgatggaagagtgtgagaggcattccatttccatgtagttgaatttgcaatggtttcattttctcacctgtgttgctaacgctttttcggttaaatctattatgtaaactcttagcagtgacaccggtaactttaacaaaatggtacaggccatcccccataatcagagcaatgcataaaaacgactgcaaaaggagcaatttacataagttatctgatggttttgtaagtagtatctgcttttacattaagcattgagaaaatatgagaccttgtaaccatacaaacttgtcatgctgctttcaggtatgtttgcagggtaccagtcccccttatgtttgctgataagtggccacattattccccatgaaatgaccgcaccaaggagggtagagaggttcacaaggtgtgagcaaatcatccccgcaccaacatatgtgaggctaaaatcaaagaagaatctgatatccaaacaaattcagacttagaaaatttgtcaccgcatgctacaatttatataaatctgtgatgaacaattaggaaattagcatataattcttacgattgtttccaggctttcagaccaaaagtagggaactgaacaaatccacaggcattgcctcccgtgtagaaccattggaagaagctccaaaataagctaagcccaaaatattttagaaacccatggagttgcaatctgtcatgaatgcagattgcagaattagttcatttagggtcaacgactgtctaacaagaataatgcaatgagcacaattaattgaggtgaaaacacgtatactttgcattcttatctccttgggctgtgtggaacccgttgataagaacagctgttgcagttccacttggataagttaatttgtagtctacgaccaaagcctgaaagcatttagtaccaattaatttagtaggaatagataattgagacctattttttatccttaaaaaatgttttgtgtcacatcactacttatataatgctactgtagtccatgaatgttcccatcctttgggctctgctttttttttttacattgctgccacgtaccaactgcatcttggatttgttatttccaaaggtttttttttacttgattgcattttcttactgagtttatgacagctttgtcaattgtcaaccaactggctttagaaattaggagagggtggcgcagtttgaaacagatcattattgagcggattattgctacgaataatctacttttatatgtatgtatatatatatatatatatatatatgtatgtatatatatatatgtgtgtgtgtgtgtgtgtatatatatatatatatatatatatatatatatatatatatgtgtgtgtgtgtgtgtgtgtgtgtgtgtgtgtgtgtgtgtgtgtgtgtgtgtgtgtgtgtgtgtatatatgtatgtatatatatatgtgtgtgtatatataaagaaaatattttaataaataaacttaacaaatctatactgctttaaaagattgtggtggtagtgttcagccaccaatccaccaccaacaactatcatgtaggggtccatggaaagtgagataacactttgattttttttagccacctcacacaagagagttatgataactgaatatcctttttaaggaaattttattaatctatgatatattagataatagggatgacttttctaaaggctctaaaaatatatacaatgaattattttttaaaagtgatccaaacagtacactagtagaaagttttatcagaaaacacaattttcaaacattaagtaaataatttgtttcaacaattctataaacaattaaaaagaactaaccgaagtggatcaaattaagggaagaaaggcacacctttcttaggggaatcaagctgaggttacccgcgaagctaatagccaggaggagccctaccatccagccaatcccaggctccttatagctccctggcacattgcctggtgagttcccggccagctcgtacgtcctcttgttcaggcccagcaatgtcgatccgaacccacctgcatgaaccactcacaccgatcgatcaatacagagcacagatcaacatctatgtgaggttcacattctcggtgtaaatttccaaaatttcaggttttacggtggtatcggtacaattttccaaaatttcactaagattggctctgcttaaaaaaaaattttgaaacataaggcggaatgaactttgttccacttttatatttagaagaagagaattgatacagtttataaggaaaaccggatccgaaaaccacacaattgcacggttaattataaggaaactggctgaaacccaccgctacacaactaacaacgacggtggagcccaaagcttaaaaaaaattcgcatatgtataaattagctaaaatatgtttcaaacttcaagaaagttattccaaatttttgaatttcggtccttttttttccattttgaaatataaaaccctgcttagagtcaagttattgaaattgaaaaacatttcaggagtactgatagaagcgaaattttagaaattgtgggaatctcaagatgttttggacgaaattaaatacttaaatttaaacaaaatttatttaaatttaaatgttttcttgaaaaatggccgaaagaatattctattggaggatcaaaatttcggaaattccgttccaaaaatggaaccctctgcctatatagtaataagagatcgacgcagaggctgcagcccggcgacgtaccgccgaaggctatggtgtagcaggcgacggcgcaggtctggacgacggtgttctcctgccgcgtgaagggccgcggcgagaagccgaggcgctccagcgcgcgcgtccagccgcggagcgcgaggaaggcgagcagcgcggcggagatgttgagcgtgggcaccagccccgtggtgagcgcgatcttcatcacgatgacgctgaacacgaacccgatcagcgccgccgccaccaccccgcgcgccgtcacctgctcccgccacggctgcagccgctccatctcccgcgcccgcgccgggtccgcctccgcgtcctcgtcgtgcaggctcccgatctcgggcgccacccgcgtgcggtccgcgtcggcgtgctccatggcggcggcggcggcgtcgatctcgcttagctgctcgatctgcaccacgaggacaagaaagaaacacggaattgattatctcctcttcagcgacgtcgaattccgacgagcattatttgggccaagatcgatgaacacggcaggatgcttcacctcaagttcgcactgctcgttcgatcagtgcgccaatggaacagttgctcactgctcaacgtgagctctgcagcttgcaagttcgagtgatgcaggggtgatgctaactgcgatcgatggcatgtatttatacccacgagctctggaaaaggtctacgatatacgtacaagattttttgtgtccaatttgtcacaaagaaattcccggattacttttcatgcgttggactagttttgcttcttctataaatgtttgctgcagtagagatgcacacacaaacgcattctatctgtgcttcctcccaaatcttatcgttctactatagatatcctaatcgcggttccatttgactgagcaccacttgtctaggaactttatattcttattgtgtatcactatatattacgtaatcagtggcggcacttttcttgccgtcatatcattgatgtggaattcacttcggcaatgctctactcatgattttgttgaatccgaagctgatgatatgtaccgaggaaaaatgctcactaatagtacggcaaagtcaaaaccccaatatggttagttcttgtttttcttaataagtgctctaataaggaagcggaatcattaaaccacaagtgtttcatggcagtgcaaaaaaaattaacgtggtcaacttcagtttatagtaagctcgtaaattaacctgaaagtaacttttggttgtacattaacctgctattttttaaaacttttttttaacgaattgacgatatttttttcatagcttgatttttacaaactttgaaccgggaaaaaagcatgaggaaattcagcaaaaaacattgcgatggagaatctggagacatgctagatttcgcactacaaaacttggcatgttttcctgttaagccggctctaggcctctacttatattaagtgatcaatattcatagagtaacagaatatatatactccctccgtttcaaaatatttgacaccgttgacttttagtacgtgtttgaccattcgtcttatttaaaaaaattaagaaattatttattcttttcatatcatttgattcattgttaaatatattttcatgtacacatatagttttacatatttcacaattttatttgaataagatgaacagtcaaacatgtgctaaaaaatcaacggtgtcaaatattttgaaacggagagagtaattaactatttttgtagaagactatataaaaataaccaaaaccacactgacggggttatttgatgaataaagcaagtaagcaactgcagctttcggaatgtcaaacgagagagaaaagatgcttatcacgcaacgccaaatgcactaattcaataagtccgcggagtcaaatgctatactatatgcatcatggttcatcatttcctggcataaaaaagagtagtagaacagtacgcccatttcatgccgctttgctcttagtcttagtggcctatgccccttgaaatgatgggttgaggtatcaagcaacaaatgcttttgtgctctctcttttgattttaaaccacgattcaaggatgaatgacaactaattgccctctttaagcgaacctggtttaagaacgtgtttggttttaaaactattttttgagatgaatggtacacatgtctgatgtttagaggacttgtttggctgaaaatcatacaaaattttggtagtgccggttggcaagttttagcactaccaaaaaattagtaaggtagattttaaaacccatttgaattgatgccaattagacacatgtatatgggtaatgccaaattgttttgtgaggtatcaaaaccaaacaggctagaatgtttcagtaatgccatagccttgcctgaatacttggtttcggcccaaactatgaataaagaaggaataagtttatctgaaatttgtcaacgaatctgattttcatccttcaacctgaaaaccagatacaacggatccctcgactgttaaaaccggtgcaaaataagtcccaatgcagtttgtatggcggttttagctagcgtggcgcctacgtcccaagaccgagttaaactagccacgtaggcggcacgtcagccaaatccgtcttgggacttatttcacaccggttttgacaggacccattatatctggttttcggattgaatgatgaaaatcaaattcgttggcaagttaaaaacctcagatgaacttagaccaataaagaagtgcggtgcggtgctgggctgggcggcctgcttgctgcccggcaagccacaggcccacaaacaccgaagccggcccgcctcgccgcagacgttcgcgccatcctccctcaacaaaaatggaaggcgctgcttccagctgtcctcaagccatcctccaccggctactcgacagcgcaacctagctaatcacctacacctactgcgcagcgcagctttactgcttaccatctccccttgccaattctgttttccgcttgcattgtcacgatggagaagagggaatgagggatggagggcgagagaggtcgggcgccatggacgggggcttactcaccaagggtcaaccggtcgacgtcgcgcttgacgccgcagtgggtggcgagccgaggagatctcaccgtgcatgcaatgcagcccctgtggtggctcgggaccgggaggaggggaagccccgggcgacgtgggccgaggcgctcgccagctgttcgatgcaatgcccacgcctgcctctggttcatgtgcctgtgggaggaatcgagggggtggagtagtcaagtgagatcacagacttccacagcttgtttcaggcaatgaggcaagtgttagtcatgattggcatagcttctttatctgaaagaggctatgaacttatcatggcatcttgtgactggtatgcagataacttgagagtatatgatctgaaaacttacatggcatacacctatatcataattcataacttacaagctcaaattgtcaagtgctgatctacagctagactctgaaatgctactgctcattatgtagtttcagtggcctggcttgctgaagtctgtgtacaatacactgactggtgtcagcccagagttaatttgcactatggacactcttctcctttgctggactagaactctggaagataataaccaagtcactgtgagctcatgttttgtgaacatcaagtgctatgggttgccaagattgggtcggatttcccagaaggacggaatattgattatgttgatcatttggtggccataatcgaaggtcagcagttcttctagttctattttcgtaaccaatgagttaagtcgttaagatattgatcgatactaagggcatgtttggttggttccccgtaattagccaaactttcaagccacatgttttgtatgatgcaattttggtggtggcaaaagagctcagtgccattgtggcaaagtttggctaagagatgagcctgttgtggctgtgtacatccttcgggatgtagaagtcgggttttatttaacccattatctaaaaacgagatgaacctgtggcatgtaaggattggggataggaaaaggtggcaagtattgggtgcaaccaaatgcttccaactgtacgtcaaacttgcctaaattgtgcgtgacaagtttggcaataaaccacaaacatgccctaaaattcatgtttactagctaaaaatgtttttctgccatcatgttccgttatgcactttacgatgttgcacggtggtaatttctaagtattcggtgtgctttgtgattagtgtttagtacatagtgttctcttctcaaaaaaaaaaaaggaagaagaagaagaaggaagtacgtagtgttctgtttttttccatgtgggcagagatccttttccaagccagtcaaaagaaatatatactacagcatagtaaggttgtgtttagttcacactaaaatttggaagtttggttgaaattggaactatgtgactgaaaagttgtgtgtatatgaaagatttgatgtgatggaaagttgaaagtttggaaaaaaactttggaactaaacagggcctaagcttaaaaaagagacacatgaaaattcttaatcctaactattcataattggaagcaaaattatgactcacatgttagattctcccatgagaaagggaactgttacagtcaaccaaatcacttattcatcactaataaagaaaatattaaaggggaaaaaggacaatttgttgaagaaaacacaggagatcagtttaagttttaccttacaaattacaagaaatcaagaatagagtgcaacatcatatttcatactaatggtagcaggcaacattatttcatactaactgcaagatttttagtccatgcaaatatcaaatcaatcacaatttttttcatacggaaacattttcagagtctacattcacaagttcagaactcgtaacaaaaaagagaaagcagaattacattttgtatttacaaagacaccacaaagaactcctcacagtattaactgtaagtctgatgtttgactgaacctacagaattgtgtattacaaatctacagtaagcaaaatgttggatctttttaaagtatttatagtgataaaaaagttgactaatggacctacctttacaagcacatcagaataatacagtcaagaacaccaactcttgcagaagtttatgttggagttggagcagcagctgccctcatgagcatgaatctcctcctcgcaatattgtttgcattttcacctagcgcagccaggtgaagcatccgccgccttgctgccgccacagcaacatcatctgcggttggcttcccaggaacctcatgaggtggtgagctctcccctgatgcctcgacgtcaccatccaattcgttgtgctgcatcacttgctttatgctctccaccacctctctcatagttgggcggtcttttgcatgttttgcaaggcagctgttggccaatttggcaatttctctagtgccctgcttagagtaattgtgcctgagtctgatatctataatcctgctgaacctcttagtctcaacaggatactgcctcacccattccaggagtttctgctcgttcttgggacgattcctttccattgaacggcgtccggtgaggatctcatataggacaactccaaagctccaaacatcactcttgtttgtgagatggcctgtctcaacatagtctggagctgcataaccataagtccccataacctgatagcagtaaagaaaattgttcttggtgagctatgaaatccatgttccattatctattttgataagaactggaatgtgcagaagctgcatagaggaattcctttactttgatcaatgaaaataaatcagtacttaccgctgtggacacatgagtgttatctgcagttggcccttcccttgctaatccgaagtctgaaagtttcggtctgaattcctcatcaagtagcacattggatgctttgaaatcacggtatatgacctataaaattttcaagtctgaaacaagaattttctgtgtttcctcaagcaaagtcaaaaccataattgacaggattgcatttttaaggatctcttaaaagccatttacaagctggaggtaacattcatcgttgggagaatagccactatggtccctgaagtttcgctctgagatcattttagtccctgacctttcaaattgtccaagcaagcccttaaactttatcatgtggacatatacagtccttggcccatcgaaaattgccacgtggacatgccatgtcatcttccaatgcaaatatatgatgacatacccaattttcccttacacatatcgtcatagggaaaaaagagagaaagaaaaggagaaaaataataataataaagaagtaggtgatcctgcatattaaatatccgttagagttttaacattgaaatgcaactacttacatgaaatttatttggcatgataattatatatttagtggttgtagctaatttaactttgtattagcataatccagtgaaaaaagtttgccatatatccagtcacattgaataaagtttgtaaattcttttcattattttttatggtacatggaagggtaaattggacattttaccatatattttgcatgagagcataacatggcatgctcatgtggcaatttaagtggaactaaggactatattagcccacatgacaaattataaggactcgtttggacaatataaaaggttagggaccaaattaatcatggagcaaaacttcaaggatcatgttggctattctcccttcatcgttcatggtaatcattttctttcaagtatgtcccattcaatcaatatgtcatatgactcaacggacattcaaaatacttgcaataaaaaggattgagtaatatgtccatccaagctatatgattagattcattccagatctccagtcatgaaatatatagttaactttaaaattcagaagtgttgcaaaaagatcaacataattgacttgcagacaaccattcttgcacagcatttgctaaatcacaacattaatatggtatggctcagggacaccaacaaactgtgaggcctttagcaatataactctattaaaagctgtcctatttcagactttaggggagaaaatgggtaatccgttatgattcagatgaataaaatgaatttcttgatggtgagttgccagcggtgttacctgaacttccaatccctcatggaggtacaacaacccctcagcagcacccaatgctatcttcaacctgatgtcccatgggaggacgggatatgctttattgaatagatgatcatccaaggtcttgttcgacatgaactcatataccagcaacctctgagggcctcgttcactctgagcggcacaatatccaatgagcttgacgagattcgggtgctcaacaacccctagaaattgaacttctgtcagccattgcttgtgaccctgatcagaattgggataggacagaaaaggataaggtaaaacactgaatggtttctaggctcttaaatataagcattgaaatgaacctacaattttaattacatagaaggcatgcatctatgtacaccattagaaactacagaacaaagaagtgagaagacaaaaacattgaaatgatacactaacgccatcacaaatcttattaccgtgttagcaaattccatattatctactagactatacatagttattcagaccatgctcagcttaggaagccaatatgccgcagagttgcataattcacatattagaactaccacaatagaagtcagaagtatgaatgtcaattggcaggtacttataaattgtaaagtactggctagtgatcagggattccaaaagtttgagcccaaattttttaattgaaaaacagctgcattttctttgtttaaaatttttgggtttaaacttcagtttgataatttttttctagtgattatatactagtaatatagttggattaacccggacaacaccgcccaattggacaattaaattgcagaggaaggatacctgtcggctgttgggattgagcttttttatggcgacctcggtgccaccggcgggccctccgggcagccgaacgacgcccttgtagacgctcccgaagccgccctcgccgatcttgagcaggcggctgaagtccctggtcgccgcctggagctcccggagcccgaactcctgcagggagctcgcgcccctctcctcgtacagctccgggatgctccgcgccgacgagaccgacccggacgacctgctccacccggcggcgggcctcgccgccgccgcgctcgagtcctcggtcgactggctcgtcgcgacggccgacgacgacaccgtggaggtggagtgggacgagccggcgagcgccgacggcggcggcggcggcggcgctggcccctcgtgcggcggcggcctcttcttccccttccgcttcttgatcatatccctcacgcggccgaagcagcccatctccgaggaacagtaagctggagagagggggattcgggtcagctcgtggtgctcttctccatggccttcacctcgtcagctcgaatcgtgaggagaaagggagcaacctttcggcgatagaaacggaagccttcttcttcttccttctccttgctgatcggatacaactacaagaactattttctcctggcctccacgaaacacgacaacaaacggagacgaacacgaacgaactcgcgtgagtcggtaaactgacgcagaatcgtttgacgcaagcaaggacgagggaaggatgacaccaatttgtgctgggtgaacaggaagttcgagtgtattttccttgttctttttcccctgggaggcgaagaattttgagccacgcttgctggacaagtacgggagtagtacttgaggaagcaaagaaagcagattaataaaagaggtggttgaagtacaaatctcgaatcgcgggggctcagaacaaatcgtaagaaaaccttgtagggggtcaaacgaaatgggctgaaagtgacaggagaggccgcggatgcaaaactgcaacaactactcaccccggtcgcagctcgacaggcccccacgagactcgtagggaccacctatacatttgtcgataaattttctattaaaaatttgacagatataattatagtacaatcgtagtgtaattacactgtaacttgtatgtaattacactgtaaattgcaagtaactacagtgtaacttgtatgtaagtttcatgtaattttgaatcgttagatctattacaagatttgttctggtgaggaagaaaaaaatcacagcacacacatatgtgaaaggatttgttcccacgacctctattttactgaaataatatgttaccgagagattcttgaaagttacatacaagttacattatagttacagtgtaattacatacaagttacagtataattacactacaattgtactgtaattatatctgacaaatattagggggagaaatttgatgacaaatatctagcaaaatcggactcgtttggtgtattttctattgtgcttagtctttgataaaatccaaccacgttacaaaaaattttgtaggtttaacactaattttgtttgaagtgttcaaacacgtgaacaatcaaccaccaccaaaaagattcacacatagacacgctatggttcgtccatgaaccccctttttttttggaacgataatgccgttgctaacgttttatatatagaagaagatgtctcactctaaggagaaaatgagaccaaaccttatagcgcacagttaattagaaataattggatgaaaaccacaactacaaacaactcataacaaacaaacctaaacaactaaactataagaacacgaaaactgacaaccaggcttactaagtagtgaacccctttttatgctcttgaatgcaagtttatacaagagaaaaactacaacaagatcgagaagtgtacatattgtaatcacgcacaaaatataattaaggtaagtgatatctatatggtattttgctaaaaaaggtttaacaaatcaatcaaactataaccgtcggatcgcaaaatggatggtccagattaatccttatctcctatataaagttcacttgccattcccaaaaccctagttctcttcctcccactccactggccgccttccgccgccagcatcaattgtccttctctccgctgcttgcctccctcgttcctcgtctttcatggcagcacaaccttcttcgttgcttgcttttctccttccttgactccgcagcaccactgccttctttactatctcttctatcttaccccttacttgtgagcaccgactaccaccctcgctcggcccggcgcgtcgccaccccttgccatccctcttgtccctttctactccaaccccaaatctaaacaagaaaatacataggagaggatggctcatcggacttataaacgacatcgaccgtggttagagcatggatttggacttctatcctaaggttaggatttctattgtaaaatcaaaagttatttttagttgagcacaaaagggatcagatgtaacatatgttagaagattggaatccgtttcaaaatggtgtggtatcaggtggtaccaaatctgatacctatgagtaccagatctgataccaaggtattggtacccacaggtaccagacctaatacctgtgtatcagatcttgtacctaagtattttacatgtaccagcaacaggttccatcctaatgggtcatgtgcaccattgcggagatcgggcacaaccggtgatgtgtctgtgctagtggccagaagcaggtcacaacgctagtgttcgccatggccgtctgcaccgagatcgttgttacggttgtgttgctagttgttattgttatagtgatcatgggggtcgatgttgtggaatcgtgcgggaactgtacaaaggagatcatgttgttgtcctcagcgccaccgttgcattcaatcatgaagcaaacgatggcgcagagggcccgcgagttgcttacgtaatggctatagtctgggttgagacgcgttggagagcaaggtggaggcacacagtggttgccagccagcgaccaccgcatgcgctgcatatcatcaacctgcatcacgtcgatttacagccacatcaccttattgccctggcaaacccgccccttgtcgtcattctcatggaagttgatgtcgcgtggaggactatgacggtggcacttgcagcgggaacacctagctaatactgtcgtgcgctgcgcacgtgatctcatgcactagcattttcaatattagaattcctatttccaattattttatggtcatattttgaacctatgaatccaaaacttcacgattctatcctatgctttcgtcgacatgatgatcaccctctctataatactcctggcatagtacttcctccatcatagaaaaaaggggattcctagttctccaaaacaagaagagtagtgagaagtaaatactaaaatgccactcattaataagaagatagaattggtggttggggtgaaggggtatggaaacttggaaatgatagaatttcgtgatggacccgggtagatgagaaggtataagttgatttatttttggataaagtttaaattttagaagttgttcgctctttttttttactgagggggtatgattgtgtccaatccactgaagggctctcccattttcttggcggaacagatcccctagcaagactttagcttagaaatatatttcctatccgtctagattcgtagtattagacggataggaaatatatttctaagctaaagtattgtgatgaggntgctgtaccatgagttgttctagtngcccac

SEQ ID NO: 62389 - DNA, 26928 bp, Oryza sativa
ctcgtcggagccctcctattcgcagcaaattagacaagcagatgttcatctaaagcgttgggggttagaaatttcggaaactgattggtctcgtaaagcgtctccctccccagactccagagagtgatgggatttgggggggggggatgattatgctgtacaagagtagtttgatagcaatgttagtggtagaagtgaataatcttgtatggtctgatgttgtgtttgctgggatgttgcataatggtgtgtctctttttttttactgcttgtgtaggtttttgtcatattaatcatggtgcttagcaaggttgaagtgaacttgataaggctgcttgaggcagctcctcgacagcagaaccagactaagcttgtccatgtaagtgtacctcgtacggttttttcttagatacgaatttttccatcatactttgtttatgttaataggctaattatatacctttagttaggagaacaaagaatccctcaagtgagtatttttgtgtgtgtgttgaaagtaagaagggaatatttctggattacctcatgtgtttcaattttagcacttactagtagctaatgcatgttctttttaatcttcttctctatcattttgaatggaatctgtggttgcactgagattctccaatcaactgcagtatgtaaccacagccagggaactgttggagcagctaggatcagaaactactccagaagggatatcaaggtattcattcatgttttatttgttctctatagcactacacatatctttgggaatatcgacatgttggctgtagtataatcttcagtctgtgacccagctataatctgttgagcatccatacttaaaaagcactccagttagtatatgacaaggcaaaaaccaccaaatctctgatccaatataaaactgttataggtgaatctgatctctagatcctacactgtatttcatgacactaatatgaccaattcagtgaattgttttttttgttaaaagactactggatgctaattttgtttacatgatgctgctagtttgctttggtggatggtgtgttcatactttcaacctctgtacatgaatgaatcaggcataatctactgtaatactattcaatgagcgcaaaaatttgatgcactaactacttagctacacgtatcttaagttagttcctagtcaataattgatcttcttctactagtataattctttagtatgcaccatgctttcccacatgataaatactctgtgggagagcattgcatattttgtagctctgttttcatttggtagcagttgttcttgaaaatctcaatactcctttaaagatatgcttttctgtgcgtgagaaaagaacagttatatgaatgtttacaacgtaaattttagtcaccttccttcattttgatgaacctcagtttattatgtagattcctggatttttgctaccttttccattagcaatcttataccttgtttaattgtcctgttacccagtggagcagagcaagcatttacctacattgagttttctttttttttttgtgttacttgtgtaatataatatttttccccatgatcaaacgatgttcattcatgaatttcttctttgtccagtgtatcaaaagctaagacaagtgagtattcagaaaagattgaagcattggctgcccggcttgctgctccagaggtatgctgttgtcgtgctaatatcttaaattcctcaattgatacttcagttctttttttgggtgtggggaatagttcaattgaatgcaaaaccaccaactgcagcatatggtttacttagttttttcttcaaacaaaatcaacttacttttcagaacatatgcagccacaataactcagatggattatacttttgtttgatttttcttttgttcagccagaaaatgaaatgccagttgatgagaatagagaggtagaaagctcttatgaaggagataagccaggaagtccaatatcattatcatcaggattacgtaggagaccaatgtaagttttaaaatttgtatgtttctttttcataattattacaattagcgagctaataatggatgtaaattgaatagagctcacaacgttgttggacctagcagtcatgagagaaaagacagagacattggagcacctattaaattggatgaagaagcacaggctcatattgagaagcataggtacattaaactcttctgtatcggcaaagttcttttctttcctggtctctggtttagcttctgcgttattcttagcggcaaattcccttgttattttctaaactcatcttctaatcgcgcaggaagctgcaagaagatctgactgacgaaatggttgagttagcgcgccaactgaaagagagcagtctcaccatgcaccaatctgttcaagaaacagagaaggtagtatgcttctttccttcacctctttttcctgcagctatggtatgttgacattggcaactgtttgggtagatccttgattccaccgagagagctgtcgagcatagcttggcgagcactgggcgtgcaaccacgcgagcggcagaggtatactcgctggcttccaagacgacatgcttccagtggctgctcatcttcatgatgacctgcatgttcattatggtggttctgctcatccgggtcacctaaaatattgtaattggtgttgtttgagactgactgattgagttttgtattcagttgtgacaatgagcatgaacggaaacgaagtaaaaaaaaagtttggagaacctctgccccttggttgtcaccgcaattccttatccagttttcacataaatatacttgcattttggatatttatatgcagtatattttcggtgcaaattagattatggagctgcttattttggctctgacgactctgtgttgccgaagcacatgcatatattacaaactgcatatgaaatgcatatagtactatagtagcactttctcagttttatgttataagactttcattggtttcatattataagacttttattgaccacattcatatatatatatacgttaatgaatctagacacacgtatatagagtcattaacatttatataaatgtggacaatgctagaaagtcttatactccctccgtattttaatgtatgacgtcgttgactttttgataaacgttgaactttcatcttaatcaaaaaatttatgtaattataatttattttattgtgatttgatttatcatcaaatgttctttaagcatgacataagtatttttatatttgtataaaaattttgaataagacgagtggtcaaacattgattaaaaagtcaacggtgtcatacattaaaatacggagggagtagtagtgtagtgccctttttaacgtggatgggctgaaaagcccataaaattcacgtggcccatcaagtcaccatcaatccatctccaattctccatctctcgtgcggctgtggcgttgagctgagaagctgagcacccaaaaagcagcgcgcgcgcgccggccctagccacgacgcaccacgcgcgccggccgccggcgaggcccacgaccgccgccgcacgcctttggccagatcgcgcaggcgagatcctcctatggccgcctccgtagcgccagcgtcgtcgtccggctgggacttcacctggtgactctccctctccctctccctctccctctccctctccttccgaatggtgacgatttgcgcggtcatatttttttttcaacgattcgtgccttctcgatgagcaatttcggatgatatttctcctaccggagtgcatatgctgctgtggtgctgtgctatccccgtgttgctttcacctgcgctcgtggtgttcgacgaattgcctaaaagaagcatttgctactgtttatgctttctttggctaggcggcggtttcatttcagtttccctgcctatcaatgtgttgcgcatacttccttatacctttttttttacccccaaattcatgcaaatttgagacctattgatactatgatacatagtatagggcaatgactgctattttcgaagcattttgaactgaatcggtgggaatacctgattattttcatggagtaaatatcctgtcgtaattggtaaagctattattttgcgagggtacgcaaagctttgttctcaatgtaaagccacgaactgatggatcattaaataaaccacttccattggcgacatttagtttcttaagagttaagactggaagccagaaattctgtaataatttatcgtagtgttcagagttcagacaacacagaagaaatgaaagtgtgcagcatctgttaggaagttacaatgatgtcccactgacgcacaagcaaatttgctgggttatggaaattagagcagaatagtgattttatcgtttgaccatatagtgttattaaatgatgtattttcatgagcgaatgatcaatgccaaaaaaaaaatagcttaaaaacttgtggcgaatggctgtttcatggctatagtctcacaaacccagccttgcagaaaactcttggagctagtagtaatcaacttgatatatgttgcttttatgcatactgaatcatctgctacctttaatcatcctgttcctcagacattgctacttacgcatagtattgcatcaactatgtagctcatatgtagagaaaatttatcttgcactaacaacctttttgtatggcagtgactttgaaattgattatggatccgaggaacgcgcatccatagtttacaaaacgctagctgttgataaggaggtaagaagttatagtacactttaacatggttcttgttttcataaggagtcccaatgtttcctcttttcttcatgctagcttgttgagaaaagaactcgaatcctgtggtatttatcttgcagttgcaacctgacaaggtaaagagggagatgtctgtttctggtggcaagctcgtcgtgtcagtaaatccattcttaacaattgctatcgattgtgtttactttgattcacgatgtgtactgatacaaaattttctgaatctaattcaggcactttgaagctgtagaggctcggttcctgcgagcatcgttcagcgcgttcgtcgatcttacagtactggttaccaagcttgttgaagaatatggcatcagcaaggaaggagaaggcagtatctagctagttttactcccctgtatcttagaaaaatgttttacaacacctttgagcattcataccttcttttatatcatattatgtgtgttcttcgtttcttaggccagaaatctacaagatagaagcagctgttgtaattccagatttcttgaatcttggtatgggatttgcctctcaagagtaactctgaacatacttggttgggatagtagtcagttcttgtcgccttaaatgaaaaatcatgcatgtatagctcactgtattatataacctgataatgatgatgatgaatcgtaaaaaatggacggaaatccaagaatgcttcgtaaatatatgtagctgaaaataaattgactcggataaagctaggaaaaaacagaaacaaagtctcccctcattaattaatttagtaggaagagaagatgacaagagtgctatctcattgatagaaaaatagaattggcggaatattactccctccttccctaaatatttttgatgccgttgatttttttaaacatgtttgataattcgtcctattaaaaaatttaagtaattattaattctttttctatcatttgattcattattaaatatactactactatagtttttaataagacgaacggtcaaacatatttaaaaaaaaatcaacggcgttaaatatttagggacggagagagtattacccaacaatacaattaaacacgacgtacgcacgatcattagactcaatttaaattacgacaatacaattagccagtctctcatagccgaccgatcagctaagcgacatacacgcgtacatgcaactaaatttaaattacgacacacacaaaacctagacacacagcaaactaaatttaaattgcgacacacacacagaaacgaaccttagctagctctctccaacctcactaaattgaacatgacacgaacacacacaattagtacagctacatagtactacgctactactcctatatgggacacaggtgcatgcgtggcacggatcgatcacactagaaaatgatcgaactacgaacgtcggcctgcaggaggtatcttcctgggcggcgtagcgtccctggggctgtccgacttgatggagcacagctcgtccgaatcctcgccatctgaagtccgagttatgatcaagtcgtctatgtccagatacatcggtggcagatctgcaaagtttattaattttacagcaattaatgcatgcaataatcaagtaagcaattgaagctatggcaataatgcaagaaatcaagaatcaagaagaagaagaagaagaagaaagctagaagttatataccgtgtttctccctctctcgttgtgtttcactcacgctctgctgcttctgggatgatgaggatccctgactttgctcaccttcacctccatgctgctccccggtgcccttctttctaccagacttgagagctaccctgtgggccgctagatttcctgtaggttccacagccaactcacaggaatattaattttcttgacggggttacttatacccacagaaaaattgtgttatttttgtaggttttcacacagacccacagaaaaatagcgctgacaagtaggcctcaagaaccatcaaataaaactcaggcagccaagtcccaaaacctaattccccacccctcttcccaaaccctcgagccgtcgccgcccctctattctctccagatccgcatggcgagcgcctgtgcgataccttcgacgaacggcgggtcggctaccgagcctccgcccagcgccatcggcaagatgcagccgaccatcaccaccatctcctgccggcgacgagcttccaccatcccctccactgccggtgctagccaccccaaggcccaagctcagaacctctagatctggatgccccaaccctgggaaccacggatccagccgtatcgagtgtgggtgctccagatctcgcggttctcggctccggcagcgccggcaggagaatgggcgctgcccctccttcccctcctcttcagtaagtaaaagcatccaaaaatatgtgtttcaatggtgaggaaacggtttggagcacctctgtccatgctagcatgtgtttccgctgctaatcccaaacaccgatttgttcagatagccgccggcggagatttctaggagttcaatttaatctgctccaaagttgcagccaaccattctccttcaggatgaaaaagtgtaagtcatactagtttacacttgtggattattttggctttgatccgtattacgtgactgcccagtagtagatctagattgggttattggcccttgaccacaagtttaatgattgtcagtggaatgtcagtagatctagattgggttcttgtgtcaaaacctgcgttgctgcattcatcaactaatctagattggattagttgatccattactgttgttgccaattattattttttctcagagctctgattcccagatattaagcaagacaagttggttcccatattgtctacattatgtgatttagtttctataatagaaatttaattttcttggattacttactcctagagtataatatttattttacatctaaatgatttgtttcttgtttcagccttgtaagacaattatgtctggaccaactaattttcctctagccattttgtgaagacctaatgttgtggcatgacagattgacaggtactcccacactagagtccctgctattcataaaactttgtttgtgtctggtactgagttgtttgacatggaattaatctatcagtggattatcatgcactatgctttcttggtcacatttagttagaatgcagatgcttttcttatgctatttttaccttgcaattcatggtaaggattgtgtgaataatgagtattatagtgttttattttctctgttttagtagctaagaaaacatatttttagctcaggttgtatgcatgaaatcattagtgctttctagtctctactagtgcatatacatacttcacaagtccaagtccatgtatatcttttggcaagtcacatactgctacatgtgttggatagatacatgccatcagaacaataaattagtttcagtctcttgtttttaaaattttcttatgtacaaaccctttataatttaccttgttcatggcactttgtatttttcttaacaggccatagcttgaatctttaagtgctgcagttaaatatctacagaacgttgcacatgatgaaaatcaaggtatgcttctcattcagtggatgaaatctttcttagtctaagatgtcctagcatttgcaccatgaaacttgtcatttaagcatccatagaaaatgagtttgatcctattatcctagcatttatgtcttatctgaattggcagagtactacaggaagtattttcatggtcacttttcatttcagttgccatatttcattttcatgctttgtagttgacaaatttatgttgctcacttcagtttttcctgtactaatctatttgtttctctataactggggtattcagaatcattgttatttattttgtaatgaagaaaattatgaaattgaacctcttttttaaaaccttttagcttcctttgcccaaggttgaagcaccacggaacacggactgctgctggaagacaatgttcttttacatatgtttgatgaattgtaactgaacacatttatcttttctatggaccctttgtatattactaaatccggtttgaatgaatttgtatgtactgaacttagatggactatttatgtaagctttgcagacttgaattttgatgtatggattgtgattgatgttcatatatttatccaaatcaccatgtgtttttttttgggcgtggaactcattttttctgacggtggatgatggtttttcctgatgggtccacgtcaaaaataagctttcacaaacctgacgccagttgattttttttgtgagccaaccgacaggaattcccgacagaaatgatatttctgtcaggaaaacgacagaaaaatttattttctccgtggtcttttttctgtcggcaaactctgacggtgcacccacagaaaagtattttctgacggtaattcatattattctgacggttttcggcctacagggtagacctcttgatcttctttttcttctcatcatcctccttcttgtcttccgacgactgtggccgctcagcacggttcttctgcctgtccattggagcttaatttgctagctaactaataactatagctaatagctaggcgctggctaactcgatcgaaaagagctgcttatcccacagcttgtctgcaggttgcgatgacctatatttatagtcagtgtacatcgatcattgaattgatctttgttcatgcttacctttaatttgcttctgacttgctgcattatatataatccaggtcttgagatgaccagatcagtgcggcgcatggatgtgtcaaaagagatcactgaacaagtatagtacatgcacgtgaactagctagctactgtaaaatggatcggagtacattgcgacagagagcacatacgtactgtgaaacaaattaaacatcataatctaattcttgcacttaaatgtccaaatgctagtttctcgcaatctctggttgtagcagaaagagccttaattttggatcttaagagctgctattattacttgatgacgagaagtctctgtactttaattagccgtgcatccaaccaaagagtgcctccatgctggttctcatttcggtttagaagaaaacggagacggcccagcaaaccaaaacgacccatctgtgagcatttaatttgcatgtgtacgccttacgcatttcttcgctaaaaaaatagttaaaatttttcgggcttggttttgtatatatatctctctccctgcccaagctcgtccaataactatcgtgggccttttttttttttggccagacttcttcggccccggggaggcaagcctagggacaatgcatatttataaatgaacaataatccaaatgatttaagttatttatatatattattatacggttggtcagtgttggagaaatttattacttctttccaaaacaaattaaccaaatataaaatgtttaaattcataatattatgatgtatcgcatctcatatttaattggtttattgtaagatagagggaatactattaggtacgcttgatcatgtggtgtgtgccttgcattcatatgaatactactctcttcgtcccttaatataagagattttgacattttagttacactgtttgactacgtcttatttaaaaaatttgtgcaaatataaaaagcgaaaagttgtgcttaaagtactttggataataaaataagtcacaaataaattaaataataattccaaaatttttttgaataggacaaatggtcaaacagtgtaagcaaaatatcaaaatcccttatattaagggacggagagaatagtattcatatcaaatggaccaaatacaggcagctgatagatatagggatatgctacacaaagacaagctcaatgtttgtgtggtgtgatgtaatcttaggagtgagcccataaatagtgggataatgttaaagcaattcgcacaatgctattgctatggctaggatttaagtaaccataagatagggccacatgagatagaaaaaaaaatacttcagctcttgtttatgaggtgaatgagagagataaaaatattttaattttgtttgtgatagaccttaagtataatgtgcaccataaactaatgctacttaccacaatatatgtgacttattttataagtgtaattattattttaagattatatttttcataaattattattgttgcgctaacgccatatcgatcaaaaaaagtgagcagaggggaatatgcatgatatatagcatatcacgggtatgattttgactgctagctgctgctgtatgtatgataggcacaaagctggttggccatgcatgtactgcgtttgcgtggtccatttgaccagatcgacgtgagccaaagcttaagtgcggtatctccaatagggaagttttttttgctagtatcataacacttatcgttttgctaaaactgaaatcaaactttgtacagctttaactatgaacaaaatttaaaatatttattttagaagcatggaaactatatgtatatattaatattgaaatatactttaataaaatcatacattcatgatatttatttaaatattgtaatagaaaatagtgataaagttgcttcttaagattgtgtcccttgttcaaaacaacaagcatatttttaaatggtactacctccgtcccatataaattataattctagatggttgcatatattaaggattgagaaaaaaaactataatcgatgctccttattaaatgttctatatatagataaaagtggaggggtagttgagggtaaaatagagataaatttgaatgagaagtgattaatgagaccattaatactatattgtgataattattttgggacaaatttaaatcctagaaatataactattataggacagatagtaactagcactctttttaaaactaattaatatgggtgttaaatgctgcgtgcatcttggaatgcgttatatataggagtatactactagtagcttgtgtgcctataaatataatcgtatgtcatatttaaccatattaattgtgatatatattatcacgattgcatgcatggtcaatataattcttttatttattaattaatgtaagagtttctggcatttagagtaaacgcgatgttacctttattttactatgtttataatatatatagtccagtatatatatctgatacattggttgacaaacttagtattacttaaaaaaagatgacatcaatagcagtttatttcacgtacggtagatcaatgcggcgtacgttgctagacaaaactagtgcgtaaaaagtttcgagcacacgcagtcataataatgcagtaatgcagatgaccaaggtgaatggggtagtgcatgcatatatacacttggtcaactctgtcgtatacagtagtagacatgtaaagtactaaactttattcggtctcgtcatcgatatatcgtcatactactttactgtagttcatcagctctgcatttgcatatgcatgcagatatgattcgacgaccaaaattaattaaggctgtgtttaatccaaagtttgatccaaacttcagttattttttatcacatcaacctgctataaacacaacttttcagtcatatcatctccaattttaaccaaaattcaaactttgcgctgaactaaacacagcctaaggtgatgtcaaccacacgacgaagacgcgcgatatgaagcggtccttgttgggataagacgtactacgagcgatccttttggacctcatggtcagtactccgcatatccgtactgacgattatattgctggatggagcggcttgttgcatttcatttccagtagatatagattaattgtttatttctttatttttttcttaaaaatccagttaattagattgcacagatggttttatatatgatcttcattttggacgtcaacgaaattacaggagagtgaatcgtgttagcctagataaagtatggttgggctagtttgcccatataaatatagtttccgtttggtccactatgaactctgcttgtctacctaccccaccaccaccacccttttctctcccttggtgaataatccaacattttttttcgcgaaatacattacagacggagacactcatatatacaaacgtgcgcatgtaccctatatatctctatgaaatatacaaaaatgccaataaggagtacatgacataaaaattgcaaattagctccatcagcatagactacgaccttcttttttgaaagtcatggggatacgcaaatgcaaagcattcgagtggctagttatctactccctccttccctaaatgtttgacgccgttgacttttttaaacatgcttgaccgttcgtcttattcaaaaacttttatgaaatatgtaaaactatatgtatacataaagtatatttaacagtgaatcaaatgatagaaaaagaattaataattacttaaattttttgaataagacgaacggtcaaatatgtttaaaaaagtcaacggcgttaaacatttagggatggagggagtaatatagaatttggacggaggacacataaactactattgccctctctgcaaatataccttcgaaacttacttccatctccacacgaaaggcagatacacaagtatctggaacatattagcaacttggatcggctgcgaggagggacttctgaaaggttacaaatacggtgcacaagtacgtggagtgcccacctaaaggtcctgtctagacctatgatggtgaggcgaagactgaggcacagttacacgctgttctattgtgagcatgaatgggatgatgttgcgtgccgggcggctggcttgggtcgctgtgtgtcaacctcgaacgacccaataaatagtggaacccgattagagcaaggataatagtgagatatgcttatgtggaggagagagaaaaaaaggtgttggctctcatgcaagagctagctttgcacgtgctccaagacaaatacattaaatgtataaatgagagaaaaagataggagaagaaaaatcaaagataatcttagagctagctctgcacgtgctgtttttcggaaaaacccctttattttttatctttatagcgctacctctagaagcggaattttcttttcttcgcattgtatttctgtgaaataggagggctttttcagaacaaacacaacagggtgttgtccagtttgaggacatatgcgatattttgtgcaaatacgaggagtttttttttttttgcaaaatagccttttaatgaaaccggctccaacccacggtgcagacccatagcgcctaaaattgcgtttggccggttaccgcctacaagcggtcactcgtgcgcgcgcgaggagccaactacagcaaatgggcgacgtgtaaatttacgggatagctaaaaaataaaaaacatgagaaaaagggtacggttaggctggttattgattgatgataccccatctaccatggggcatagagagaaacaaccaagcaagtggttgtgccggctcaggtacgcacggagcccagcattgagacctcatacatctacaacagttggtatatataagcagtagatggaaatacattgaaatccctaagttaaggagctgcaaagacagatgaagtagcactgcaaaacaaatgtccctcttaggaggatgaaatggactacataaacacgagtttcttagtgcccaaatatatcaaccacaaagttctgtaattgagcatagctgcccctgattttagatatgcagaccacagtgaatgattttcttacaagttccaagctaagatcattctacagttaaactcatgatctcaccataatacgctgggttttctctgggttgacaaatacactgattatattcatgaaaatcattaagcagtgcaatactacctacatgactcagcgacacacagaaggcaacgacggacgaagttatggcagaaacactcttaattttgtaagtgtttttgtatttggaagatcaacaaatcttcttttggatagggaaggtcaacaaatcatttgctcaagcttaatgttctcgcaatatcttctcattgtaagtgataaaacgaaacctgttagaaacttccgtttgaaagaacatgttattgaccctaaggaaagaatgtggtattgaagcattccaatcaacacaataagttattaaacagttgctatgatcacaaaaatgttcgttcttttagaaatcaaggtacaaaggaaaatatctggtttcatgttggagacatggcagcatctgattcatattcatgcggataaatcagttatcacatcttctgattatgtagagcttgtttttatacactcaacaagctgcaaccaaatgtcagttcgaccaaagtgttctgctcacatttcctaattaagtatgtccctgtttcagctaatatataaaagagcactctataaagcaaccaacctcatcctcagtttttgtgattctgaaatttgcttctttcctctaagaagcggctaagttcaatccctaagattgaaccagattatcaaatgagagacacgccaagatgtgttagctgctcgatttacacggtttctctagaatttatgttagccgtacaaaagaaaattaaccagttgtattagcactatcagttgtattatcactgtgtaattaagtacacctctgaaaacctggcgaattttgtttcacatttacctgcccctgcagagaattgtggtgttgagattgcttgaagtaggtcgaggtaagtaattatctgaaacatgaataatagcacgtacagttttgcatcaatttagggttgaattaacattacgatcaagagctggtggcggaagtagggccaccaggggcgtaaccgccactctgtgctgcaaggacggagcgacgtacgcatggcgagatgaggcgaggtggttggcaaagaagacgcggcgttgattgaaccgctccttgccggccgtccaagtggtgaaaggcggacggcggaggtcggcgcgaggaccagcagattcaagtgcaggtttagcatcgacggcagatcaaccggtggccggcaattgagcggggtgcgggagtggaggcaatccagccgggttcactcgacgataatgacttgaagccggcgacggcgcggtggaagagccgttagcgagggaagagaggatgtggcgctgcgggtggggggcgcggtggcacgatggtcggcgaatcgcgggcatgggcgggttggagattggtggcggcgattatggagtcggactcgggaggggaaggggaacctgcggggtaggaagaggttggaggtgggatgaatctcaagcattggatttaatatggacaatttgaaccattgcattgagtgatgaatgaaagatagataaatagatagataggcatagagaaaattcctatatacccttaaaaatttactcaatccctttaatacccctgaatttgacctcatcccttatatacccctgagttttcattttgatcttctctatacccatctccgttagttaaccattagttgaccgttaaatattttaaaatgactatattacccatcctatacatatgtggtacctacccaataaattttcatatgaaaaaattaacttatacaaaatacaagcaatataatcatttgatgcccaacttaaaaaataaaacttattattttttattattttttaaaaaatgattaaatccatacattagtttcaccagaaaattaagagcaaaaactaaatgttatttaggtttaaatttttgggaagatatacgaaattcatcaaatttgatctgaaatttatttaaaaattttaaatttgttttctaatttgtgataaactaattacatcccctttgtttttttacaacgaatctttttttactaaatatttgttgaaaagtaattttcaaattttatgcagaactttttttacaataaatcttttttattttcatgaaataatgttttgtttttaaaaattcataacaaatatttagtaacttattccttattggttttcacaactcaaataatttacacataaaacatttctagcttttaacaatataccaaggacaataaagtaatttcttcaataactaacggtcaaactaatggtcaactaacggaatgggtatttaagggatgcaaataaaaacttaggggtatataagagattaaacaaatttatggggcgtagaagggattgggtgaaattacaggggcatgtaggtaattggcccataggcatatgcttgtggttatagggcttgtttggttctttaccctaccaattcattggtagtgccaaagtctagaaaaattttggcactaccaaaatattggtagggtaaaattatttagctaacatttggattgctaccaatttaaagccaaatttttatagcatagtgaagaaacttctagaatatgaccaaatattttaggggcactaccaaatatttagtctcaatccaaactaacacacaaactattcaatttgccaataaattggtagggtatgtttttggcatcaaaccaaaacggcccatagttttgtcaaggtctaagatatagaataagtttagtaaaaggggtaaagtgtaaaaattcctgccaccccaatccttctcccggccgtacaccatttcgttccgacgcgagtaattcctccccacgggcggcgactagggcggctagggttcgtcgggcgccgccgtgccggagatcgcctctcgccgccgacacccggatctccgccgccgccggtcgccccaggttatcccgctcccgcagtcaccatcccgtcttctccgccagtcgcctcacgcccggcctggacgccccggaatccattgtcggtctcgccccgccgactgccgttgacgccactggctgaaggtaataagccgctcacctctccctctccccctccccctgcgagctcatggatttaatccattcgctcgtgcgtgttctccgtacttgggtgaactaaacctagttcgtgttctccctacttaggtggagtaaaatagttgaacgtttgttctctgtacaacaactgtcacctatcttctcatttaggagcttcgatttatcctagaatgaacggaaccagcggttttggatgagttcagtactgtggtactcttgttctcgtggacgatttagaggagccactcctgttgagaagaattatatttcatagttccccgatggtaatgaatcactagagcccgtattttgctagtatatattgattaacttccacaaatgtgaaggataatcatggtgcatagtttttgtatgtcaagttttctcaatcaggtggcagctgtattgcttgctagtaaaaatgttgtgctgattggttgtttttaaaggcgatacgcagattggttgcttttcttagatgaaattctgattggttgctagacaagcagtttgcccttcaaatgctatggcccacctgcaaacgccctagagtgctttggtgctctaatctaaatgacctaggaaaggattaggatgctgttgcttaagttgtttgggctgcaatggatacaagttagttagggctggaaatgatgatctccattttcagaacatataaggctgggaatgggccttggcctgtcaccaggccttcaaatggagaatagacaaactatgtcgacttattagttgtgttttctcttgctcttcttttgtctgtaagtgttgggtgttctatttgtttttatacggaattaattgcacgcaaaaaaccgagtgctcacttctgcaacgttctaatggttgcgaccttgggtcgttctcccggtggactcgtaccacaaaatccgcaactgccgctgcacattaatcacttcctccttgatttttcaattttaaaattgaggcccccccacccccgcaaacgccaatcagatggatcggaattccttaattattgccgaattattatggaatcctatgggttgtttgtcgtacaaagccctttggaaacttcattttgctcagcggaggacatgtgctggttagttacatatggaattataagcaggaaatcagctgcattttgcattctcgttagtaagattttctttttatataaaaaagaacccatattaggaccgttatctcgttctcaccccacagattgcgtatcttctgcttcttcttcttcttttttttgctaaactgtgaaatcatcgagaaaatcccaaatttttaatatcatttttacagtttaagcttcaaaacctccaataacatgaatataaatgtttatccataagatttttttgttagttcatttgtttttttgtcgccttatcaatgatagttcaaatgattagagcttagcaatccttttttcaatttatactctcattttccacgtgtttcccgaattgctaaacggtgtaattttcttttaaaaatgttccacaggaatgctactttaaaattatattattttttattttagttaataattacttaatcatgcgcaaataagatacatcgttttttttcgggagaaatgggctagcagcaatgttgcaagctactacatccgttttagattataagctattttgactttgatcaaaattaatctactctaagtttaatcaagtttatacataaatatactaatatctacaacactaaattagtttcattaagcttataattgaatatattattatagtatatttgtattgcgttgaatatgtgactacttttctaaatttaatcaaatttgaaacaattttactttaatcaaagtcaaaatgacatataatctaaaatagagtgagtatctctgtagggtgtgtttggataataggaaatagggagtgagattgggattgaaaattgaatgaagagttaggattaaatgaaagagagagaataaatggttaggatttaaatatgtttttagtaggtgggaaatcatttccatatcctattagccaaacactggcctaagctaataccaacattcttcaggagctggatgcaaatttggcagaccaagtccaaaacacgacagccagcagcagcagcaggacaccaacgcgacgccaccacagtataactcgacgcccccactcgctctctcccccaacccaatgacagcatcagtattccagtagcagcggagagagagagggagcggccaaccaaaagcccaagccaagccaacgccgcgtcgcgtctcagccagccagcgaactgcctccccgcccccgcgcttgccggcgaactccccccacctccggcggcccggccccgcctcgctccccggcatcaggcgatcccccccatccccttccccgccccctcccctccccgcgcgcagcattcgcagatcgcatctggctcgctggccgcccgggccctgctctcgcttcgcgtgtgatgtgatgtgatgtgatgtgatctcttccccccatctctcgcggcgggattttctgggggattttgttttttttttttttttgttttttcttctcgggatttatgggggttggatgggatgagatctcgctgccggacttagggatggagtacagctgaaatggcgccgtcggtgtagtgtgtgtgtgtgtgtggacagcgtgcggcggtgtgggggtagttgtgaattagcggtggtcgtggcggcggatttggaggggagatctagcccccgctcggtgcttcctaggtttgttttcctaggtcgtggacggaattgaggaggtactgattcggatgagggtgtcggtagaatacggcgttccggacgacttgctggttgctgcttgttgtttcgggttgttgagttgactgtagctgagttgctgatccagttcgttgtgaattatgcgctaatgcagtggtacttctccatgatgatgattttgcctttttgtttccccttactattacatgattcctcagtacaaatgagcaatcattcgctttgtttgctttggagtatggatattagtggcggtttaattattgtggtacacagtggtggaaggattgcagagttatatatatacctggtggaatttggattaacgagagctcaataacaaccacattgtggttgatttggtcacctatagtttcctatgagcatctgagggctgactaattgctggactttagaaattagaatagctgttgttgcttattgtatttacattgctgttgttatattgttcctatatggatttgtaggctacagctgtaccatattttaattgaaaatgctccaattacttgtcagatatgattcactagctgcatatgaaactttaggagaggtctgagttgtacatggccttatttttctacaatttctctgcacaggtgtgaatatgtcggacagtgcgttgaaagatctgaatctagctcagtcagcagagctggagaaaaccaaggacagttctgccaagtcttgcatcaccaagcctgtcttgaatggcaacaaatgcaacaatacggaagaaaatgctccacctgtactccctgatgctgtgactaatgggtgtgaagctggaaatgcagatgttgagtatattgattctgagagtctgacagatcttgaagatgctggtgcaacccttagtgtatgccaccagatgtttatattcatgatcttttttgtgcttggcatttttctgattggaccagccctaacatttgatcatttcttactgcttgatagactttagttgcaaggttggattcaaaagactgggttatgacatgtgaagctctaaataatgttcgtcagttggcaatatttcacaaggatagattgcaggaacttctgtaagttgcttaccttgttattcaatcaaaaggatctttgtttttgggcaaatgttacttatccatgcctgaagctatagaattacatcattctctgtatcttaatttttggatttgaattatagggaacctctagttcctcttatcatgaaatctgtctgaagaaattcattctgttttttttattggacccagttttattctcttcgattgcttgtatctcaaaacactcaagaatccaaggagcgctgcctgtaaagctgcactcatgacctgttctaatcttaatttttggatttgaattacagagagcctctagttcctcttattgtgaaatctgtcaagaatccaaggagtgctgtctgtaaaaccgcactcatgacctgcgctgatattttcaaggcatacggtgacctaatggttgactcaattgatccactggtgtgtgtttctcagttctcaaacttccattcacaattacactagttctttttcctgtactaactacgctatttctcaaaacatcttttctgccaaatttgttctcagttagtgcagctatttctgaaatcttcacaagataagcgttttgtctgtgaagctgctgaggcagccctcatatcgatgacaagctggatcgccccttctgctctgttaccaaaaatgcaaccttaccttaagaacaggaatccacgaattcgagcaaaagcatcaatgtgcttcagcaagagcgtcccacgcttggtaagtgaaaatctcacctgaaatttattttaagctaaccgcttttgttttgcctcaactgttatctgattatctcctaattaacctaggagaggccaaagacaaactcaacataggatttagctctcttttctcacattacaagtactcaatgaatatcttaattcgtggtcttgttggttggcttagagttaacacgcagttttctcgaccttttttagtctatttagatatgcagatgcgggatgaggtttctgtattataagacagacctgtagcttttccaaaactatgggctagtgtgtttggtagagattctatatgccgagaataattagctgacaaatgatttttacctgtggccttttacttcgaggaacttcatctaccctaaattgcctggccattattagtagtgtgacggtatctggaatttttttttcttaattggcttttatgtagtttgtatatcaatggttccatgctctaaccaatgctgataacatcagttttagatgttttacttaaattgacctattttgtttccagggtgtggagggaattaaagaatatggaatggataagcttgttcagatcgcagcaactcagcttagtgaccagcttcctgaatccagggaggctgctcgcaagctggctttggagctacaagcattctatgagaaatcccaagcttcgagttctggtgaagttgacgacgcacctgctacctcacctgatgctgatgctgatgctggtgctgaatcatgggaagctttctgccaatcaaagctttccccattaagtgcacaggcaatccttcgtgtcacctctacgacgaaagagggtgtggctgtgggtgtcacctctacccctccgaaagaaggcgtcactgttggttgctagcatcaggaggtagtagatgcaatgaggttgtggtttttccatccgattcaccttttgctgtacatggttatggttgttctttctctacatccaatctgggattcgttcgttaagcatcggttcgagagttgaggtgtgacctgtgggtgttaatattggtgcgagatatacctgttatagttgactgtatgatcttccttttctcccactgcttggtattgattggtcaggcgaattgtagaatttcttccactattcaatattactacacagtaatttttccatctcgtggccttgtgtttatttgctggtgttcactatttcgtgtttttgaattctaacttcttccattattcaatattatcgaatcaattctcatcagtgctttcttccactggtttctattttactgaaatttttatgctgttctatgagcaagaaataactaactgggctcaaccaactggtactccaaagaactgtgacttgtgaagtttgatcactgtacagttgtacatatgtcacagactcatagtacacgttaaacatcagagaaccccagattatcacagctgcacgaagattaagatgatcatgtatgcatgcgtcgccggcaacacattctgtgcacagagaaaaacttggacaagaacatgccaacagctagcccatcagccggcgatcaccgccggcgaccggccttgccgcaccggacgctcagccaacgatcatcggcggcggcgtcgccggagcaaccagcatgaggtgcgccgccgggtgcagcctgaacaccaggccgccggcgcacccgaccgtcctctcctcggccatctcacgctcgatcctcgccaggacggcgacgaactcgccggcgtcgcaggggagctcgagcgggccgtccgccacgtacccgtactcctcctcggcctcctccagcagcgccctgaacagcgggtggttcacgcactccgtcctcaccacgaacctctccctcgccgcccctccgccgccgccgccgccgccgacgtacaccgcgaagctcccctccggcggctccggccggccaccattcctgtgcttggacaaacacctgtccagcagggccttcatgatcactccctgcttgttcctcacacctctctccttcatcaacacaacagcaaattaaccaaagcttatctgaacacaactatcctatctaatttacaacttagtgaaggttgggttgtattaattagctgatcaagtgttgctaattgctatggccttgtccttaagtgacatcagatcaaactgagataagatggttagtgatcaaagttttgggagggggtcagctaagacctggcctgaagaaagagtgttgcacttgcacccctgcaccatatatagactgtactgtgtggggccttcattttattttaattatttggtgtgtgtgacaattaggagtaagattgtatatttggtgtagatgatgagatcctgtgggtctttcctaatcctacccatcattagatatttaatccatggttaggttaatttttaccatcttgtcctcatattgcacaagggacctgttcttgacaagggttgtgttggcaagatggcaccatgttttgtgaaaaccagattatattgcaagggtaagttagtaatttcacatcacgttgaagacctttgtgtacttgaccgtggtaccggttcaaagtttaggatggaattgacaaaactgaaaatttgtttagtgtgaagctaaaatggctaatgcgaaaccagaggttggacaggattccaccatctcattgtcaacccacttaatatccaatgtcatcagggcaataatacacatgttagtataagatcataagaaaaatgtcactttattggttgcaagttgacttggagctttgcatcggtcagcaagtttaagtgaaactctccaaccatgactagtttactctaatgaatttccttcttcagaatctgccttttcatttctgtcagcttgcatcgagatctgtctgaaggattcagagaacggcacatcgacatcctaaatctgcccaagggtttaacacctggatcaatgcatgtcttaatcctatgagattagtttagaattcttgtcttgattaatggtgctctaatgacaccttgaccgacaatgagcaccacttgtcttgatttttgtggtgcaaaatgatactaacaaacaatagtaaagtaagggttaatttgggaggtagagtaaaagattgttcgaacaagacattgtttagattagataaaatcataaaatacaattcatttcgtcgtttagcgtgctagtctacttcaccttccatcatccgctcaacggtgaaattttttttatcgcccaaaccagctattattaccgcggaattgcgtattctactctatctttgtcaaatcactccacgataatctgcttgttaattcacctggtaatgctgtcttttattaatttggaaggttggaccccctactgcaaatctgcaatgatgcagatttttcatgcgtgctgaattttgtgctctaatggtggattgtgatagcgatttgcaccattttgtgcgaagaacttacatgaatcagatagatgaaaaacctcgagctgtcagatgatgctggagaggcatatgctattctcctgaaagctcaactgcctgaagtctgaactctgaacatgttgttcagttggcctcgttttctcacctttgctggaacaggggtaaataaatggtgacgaattgataccagaagaaagtgtggtaattaattaattaaaaagcataattaacaagctcaaatcacgatgctcaatataataattactctttttttttgttcttcctcgaactcgaagaacgcacaccgtctccctctcgactgtgactctccccgtgtttgggccacacgaaatcgagatcagaatccgttccggcccaatgagtagcatgggccgcacataagtctaatcctactcctttgcagaagagcgttccaccaccgcgtccgaccgccgacgcgaccggcggcgaccctccctcttcagccgttcgccggacttgcggccagactgatccccttcgccgccgggagcaagatcaggcggtgtccgcggcggggctcgtcgggatctgcccccatccatggtcgcacggcgccgcttctgactgctccgcccccgcgttgatgcgctgcccgcggcatcgagccgcaaggtaattcctcgtcggagccctcctattcgcagcaaattagacaagcagatgttcatctaaagcgttgggggttagaaatttcggaaactgattggtctcgtaaagcgtctccctccccagactccagagagtgatgggatttgggggggggggatgattatgctgtacaagagtagtttgatagcaatgttagtggtagaagtgaataatcttgtatggtctgatgttgtgtttgctgggatgttgcataatggtg

SEQ ID NO: 62390 - DNA, 640 bp, Oryza sativa
  unsure (1)..(640): unsure at all n locations
gagagtgggntttgactacgtaagagcttcatagagcnacaccagnncatcacacacgagctggcaacatgtccgatttctccacaacgagagcatgccttacgttccattttatcctggttgaaaccttggggagatttctcatcttcatcttctgaggagacttgatctgaatcttcactatcagacactctacctccattagctaaaagatgctctgtcaactgtggtgcacctcggaaggtgtttcttctctgacgtcttgtcattcctggtggaggccattctgtgctggtaatgatcatcttacgaacttcaccttcggttcgcattggtgcttttcttttctgctgaggacagttccttgcgtagtgcccttgctcatcacacataaaacagatgatacttgcttcttttgggtcaacatgtggcatggcatgaggggccttctgggatgttggctgagcccctaactttgtgtggtaagtggcttgtactcgcctccaacttccccctgaaggttcattttgactccggtttaaaatttgaattccatactggtgtaatatcttattagccattttttctgttaaacaagtgttggcccactcccctacaactcgtgttttgggccccatct

SEQ ID NO: 62391 - DNA, 8404 bp, Oryza sativa
  unsure (1)..(8404): unsure at all n locations
tgcactcggagacacaagcagcagagactgtgtggcctgttgattatcgcttctgtctcaacgcgaatgcacacacacattgatatcgatcagcaatccacgatcgatcgatgggggaaaatagctcaagttcagaggtgagactgtgcctgcaggggctagctgctgtagactgtagtgctgttgcagtgttgctgatctcatactatagcagagtggcgagtaagtgccgtcagtctatcaggatgctcaacaacagggatatcgtcaactgtatccctatactccctgcgtcacaagaatactcaattcttgaattttcgtgtacaaagtttgatcgtctgttttatataaattttttttatgattagcatttttattattgttagaagataaaatatgaatagtactttatacatgacttacctttttaaaattttttataaattttttaaataagacggacggttaacgttagatacgaaaacccagaaattgagttttttttggacggagggagtatgtcataacctagctagctggagtatacctaaatgatggacgacgcacagatatactcttgcatggcttcaattggcaaacgggacagagggtgtgtgcccactgcgacagaaacagtaaattgaccatggtcatatatatatatatatatttgagatggataagacaagagaatccggctggcgtacatgacaaatatggcaatgtcgcgttttccccgttgccagcgtcctttcaaacctatctagagtcgtgcgcatgccattaccattatattgggaccagaaaatgatcaaaaaacattaaaaaaatgtatactggctaggaccaatggattcaataatatataccacaattaattagtatattgcacaggagtgatatgcaaaccaccatgttgtctggactctcgtagcaaccctgtcaccactataattctactttttgcgtacagtgaaatctacaggttgatcccctcggtagagttagccgacataagtccagatcatggaattattacgaacagttctagtcctaatcatcaaacactatattgtgttagctggccaatctgtacatatcattatatatctaaaaagatttgtacatatattaccatatacatatgtcgcgagataattatatggtatgatgaatgcctctcctgtcttagtcgtcaaacgcggtgcattgtgttacagaggaatatctatatgattgataggtcgcaacatacaaacagaatatggcgctatgtttcaatttgcacaggtgtttttatgtttttcaatataattagtgtgggctaaaaattgtttataagccgtaacggcttattagcgatatcagaaaatattttgtgtgtaaaacttttatatatatgtattcttagtgccttaaaaaccaatactgaaaaaatctacgttgaaaatatctcaaagtcaactttaaaattaagttttacaatttaaaatttgactttttctttggttttttaggtaataaccaatggagctataaatcacttttcggtgcgttaccctaggtaggtcccatggaacaaaccacaatatattattatacagtggtgtgagtgtgtgacatatataaccatgtggttaggattgttgtagtagccagtacccaattatttcgattttctgcgttcagtgcaatctacatattgattctcatatatgtcaatatcatggaattatatatgttgagcagtttgcagtcttagtcagcaaacagtacgtacatttgcttttagctagctagctagccatacatacagtatttacatatatagtatatatcgtgaatagttctctagtcttagtcatcaatacatacattgtatttttaaatatgtggttgccaattaataactttttggtatgttatctcaggtaggacccaaagaacaaaccgccggccacatggctaggaaccgtatcctctgacattacacactaatatcatggtgtaacattcttgaatccagaccatccaaaataaatcaatggctatagattaattggcatacaagtaatcaaattaattagcagattatgtagttaaacattaccatacttaatgagtagaaaatttttttagcactaaagtagtcccttcatgttcattaacatgagcccaccaacttgtagattataagagaattgtctttttcttatggaagatgaggcaacacaaagaaaattgatgcacgagattcattccttaacaggttcatatgctaatcattgcgtctaacaggtaagttaaaccattatcgtcatgtgctagttacttgccgattccggcctgtagcatttagcgatatttgcctccttgataatatatttgatctaaaggaatttgtttaactacataatctactaattagtttgattaattgtatgccaaataatctatgaccgttgatttagaatggatggtgtggatcaaaggaatgtcacaccatgacattagtgtgtaatgttagaggatacggttccacatggctagctagctatgtcaaaacattacattgtgttcatacatataacatatatatatgtacactatatatgctcgtgaaatgttctcgtcttagtcgttaaaaagtacaatgttgtattatgttggagtagtacaatgttattgtgtttttaaaatgtgttccttctaagataacgtgtgtttttcttaattctctgaaagcacgatacagcggcgcccgtatatatttggatcatctgctagctcccctagctagcagatttcatctattcgtcggaggcagcattcaggcatgcatatttctctctgctcctccattgaaatttacacattaattcattgcttgcgccagaaagggagaaaaaaaataatgaccagccttaggacaaacactaggatcagaaatgtccagcaaatgtacacgcatatgattaagaaagagaaacaacgcatatgccgtttgtgtacttattgcatctgacaatgatgcttctcgtctcttttggggaaaatcaaaatttatacttttggagctaattttaagatactttcaatgtaattctttttagtgtgggtttttaagtcgctacaaataaatatataaaagttttacctctaataaagtcttgtttggatccagggactaaacatatcggatgttggaacactaattagaagtattaaacgttctataaccctgaactaattcgcaagacgaacctattgagcctaattaatccatgattagccgcctatgtgatgctacagtaaacatgtgataattatgcattaattaggcttaaaaatttatctcgcgaattagctctcatttatataacactggtggagaaaccctttgtagtcccggttcgtaacccccctttagtcccggtttccaaaccgggagtaccaatccgggactaaataaccgggagtaaagatctatctttagtcccggttggtaacaccaaccgggactaaagatggctcagccaaccgggactaaagatcgagctgacctttttttttttgcatggccctgttgctgcatggtatattttatatatatatatatatatatatatatatatatatataaaccatgcatatatatgtttcaatacatatatatgcatacatatatatatgtatatatatatattatattatattatatgtatacatgcataatatatatgtatttatacatatatatgttatgcaaatgcatatgtatatagatatatatatgaccaaaatatatttacattatagaaaatgtgtacacatgcatatagaaacatatgtagtcatgtattaattacaatccattatatgtcctagctagctacgatttcgacatagtagtactcgctgctagctcagaagctaaggaccggtgaattgtgtttccgtcgtagtagaattcacccttgggatcaaggatttcttcgttgatgaatcccatgagttgttcttgaaccgccgcgataaattccttgtgtgtggtcaggttatccctcatgtgaataaactatatgaatgtatgaaattgattagtaattaaacaagaaatcgctacgtaatgaaattttgaatttatttgtacgtacatcgagctctcttgtggtgatgatttggtctgcaaggcagtggcaatactcgcacacgtaatagccgcacaagttagttccctgcttttgctttgcgcactacaaataaatgacaaacaacgagagatctaattaatatacacttgtatgtatttgaatcggagaaatataaatgtagagcatgtgtactcacaggaaatttgaacttccgcctaagtctttctctccatttgccgcggaccaaatgacggaaccgataccaagccctacatggagtttaaagctatgattcgtagtagcaattaacataacaagattttcttcattaacaaaggaacttatgacggtacctgtctataagttcgaaaaccttgtcaaacgtagactcttttttatccattgagtcatatacgttgacggtgcaggcctccaggtcgaagagtaaaagcacccagtggaatctgcaatgtgcgtgggatgcattacatatgaaacacttagcaagttcgtacgggaatgaaatttggtatgtaggaagacagtaaaattaaactaactctgtgttgtatggcaacagtatgaacgtcttgtaatgctgcgccttcaggagatggacgagattgtcctctgtttcttgtggatattggtcgagcattgcgacgtttactttccgagggtcgatgaatccagtatcgaaaaccctccgccgtcgggccctttgaatctccattctacaacgataaaagggagtatattattttctatagtctacttatatacaaggacctaattaattaaaggagacgtatagtaagaaatctaactgaacgatatacttacaaaatccagcaactcataatagagacgtcgagggcgtccagctggtatagttcgtagattcccctgaaattgatccagagaatgtcatctccttgcaagaagtccgtgtccctgatcctcgctccgatcatctctctaccggtggcgctcatctccatgtacagctgatggaacttgtacatttgtgtgggtagggactgcagcagctcaggcttgacaagcggtttaccgagttcgtacatgtatttcacttccgccttttcgattggtgcgactcctagcaattgatccgtagttagaccggtgtcagtaataaattgttctatcgtcatttctttaccggtcaccaacggctcgatctcctggtttggttgctctccaagctgagggactggtttggactttccagaagatgctttcttcagcgttcgctcatagtccgatagcttgatggcctccttgacagatgcagacatacccctgaagaagttcctgacactggggtctataggaatcttcttttgtggacttcgaggcttgaattgtctcttgacttctgatgcaacgtaagcgtcaagctcctcttgcgtgcaatcgtaccccgggtccttgttcttggcggcgtcaactttcgccttcttcgttgcccttgtgtgggcaggcggtggagctgggggggcccttgactttgaaggtgccggaagaggagcttgcgggggagtaggtgtaggagcacgaggaggagtcggtgcaggatcctgaggaggagtcgatgctggagcctgaggtggagacggtgctggcggagcatgaggaggagacggtgcaggatcctgaggaggagaaggcggagccggaggagatggtgcacgagacgccgcttgtcgcccaaggaggatgatgtaccgcctgcgccatagaataatggcatggcatgtgtctcgtagatgcgtctcaccgtctcctccagggtaatccagctcgaggtcctcgtacgcgccttcgaccaactcaactttgaccttcgagtatcctgctggaatcggcctgcagtggtaagtacctgaagggtccgttgggatggccatgcccgacgccaccttcatgttgtgagagattatttattagtaatcaacatatataagcagcaactagcggaatggctaaatcttacctttattgataagttcttgaaaggaatatgcagctcacatggtgtccgctgagtgatgtcatcaacgggacaggtcgattcgtcctgtgtttgcatggcgtccatgctctgtgatcctacctgccccgttgaggcgcagctgctacggtttcctgacgggctcaccattgcaggaggaatggtcggctggggatcatgggaccgatgtgcggccatgcgttcatcaaccttccttgccacctcctcttgcatgttgagttcgtagctcgatacccggaactctaggtctgcaatcttcgcctcggtatctctcttgctcctcatccgactcctgtacgtgtggatgtcctccttgaaaccaatcttccaaggaatcacccctttccctcgtgttcatcctggatgctctggagtctgcagggcgagtgtcagctcgtccctatctctgtctggttggaacgtgccctgagaggaggcttccactgcatctgttagtcgtcgcgcagcctctcgtatctgatcgccgaagaccagtgagccatcagctgggttgagcgttccaccgtgagcatagtaccagaacttcgatcgttccggccaattggctgttgccggttcaatacccctctcaatcaagctagcctccatctgctcccacttcggcatcgcgacgctatagcctcctgaccccaagtggtgatggtacttcttcttggcggcattttctttgtttctttccatcatcgcctgcccttgttcacctgtcttatatgcaacgaactcgtcccagtgatcccttagctttgggaatgtgtcgaagttcggtgtctgccccttcagtatatacttctggtacagatctcccttgaagctctgaaactgttctgccattttcttcagagtccaccttttcactttgtcctctgtacccgcaggaagggtgaatgtctcgagcgttgtggtccacagcatctctttctccgaatctgggacaaagctctcatgatctccgcgtgcccttgttcttcgccagtacaccgtactaacaggcacgttatcccgcacaacccaaccgctgtgacgtacatagttcttggcggcttcggccggggcactaggacgtccatcttcttccacttccgttatgatgtgccgaccctcaagcttcttcgctgcacctcgttgcccgcgtgccctcttctgtccaacggagggttgactaccactagcctcctcctcctggttcccctccacatccctttccacgtgcccctgctggttcccctccgcatccctctccacgttcccttcctcgttcaagtactggtttggatcctcgttcccctcttcttcattccagtactggctgcttccctccgcgattgtatcgtacaatatctgttcctcatcgcggtcagccatctgttgatacaaaaacatctactaagtcacgagacatttatgttttaacaatctaagtcatgtatgctaagtgtaaatgtcgtacattagaaccctacacaaccttacgtgctaagtctaattataaatcgtgatataagctaagtctaggtgacgtatattatacaaccctagctagtaaataattatatactaagtctaattacaaataaaataatcttatattaaaactcaaataatattacatgctaagactaaaatagtcatgtatatgctaagtgtttcgtgcgtatatgctaagtctaattaagactacaatagtcaattgctacttgtcgcaccaattccgtagtcaataattacatactaagtctaattacaaataaagtaatcttatattaaaactcaaataatattacatgctaagactaaaatagtcatgtatgctaagtgtttcgtgcgtatatgctaagtctaattaagactacaatagtcaattgctaggagtcgcaccaattccgtagtcaataatgtcatactaagtctaatttgcaataaaataatcttatattaaaactcaaataatattagaacactacacaatcttatatgataagtctaattacaggtctaataatcttaattaattgcattacaaatataacaatcatttatattattacgtcacttgcctgctccaattccttctagggctagctcttccactcaggcttgacggacgactccgacaacacgtcttaatgaactactgtaccatctatgaggagcaagngcaaanngacgcccc

SEQ ID NO: 62392 - DNA, 16190 bp, Oryza sativa
gcctagccgcgtcgtgcgcgttccgtctccttttcctcagcgcgcgctcgccagcgcccaaccagcccgaagccgccacgcgtcccgctgagccgctcccgcgcgcgcttgcaaaatcgcgtgtgggtcccgcgctcctgcacccgcctccgatcgagtcacgcgaaacggaggttgccgcgtacggttttcccgcgcgcgtccttgcgcatgcaagctgcctgcacctcctgagcccatgcgccatgggccgccgtcttgggccattgctgcttggacgatgcaggcctgccgagccgagccattcaccatcttgggccacgtggaacggctggattggcttggcctccctgccaaccaatcacagcgcacatgcacagctagctagcttgacttttccaccgagccatgctagtagcaaccagtacaatgcaagctcctccttgcacaagtacagtacgtgtacatgcatgtatgctacctacagcaagtactgtagcagcaatgcacttgcacagtcccttctgatttcttcgcgaatccgatgcttgcacacttgaccttgtgaagcctgttgcaaagacctcctcacacggtgttcgtccaccgtgtgcaaccttgtgtccaatcttgtcacccggcatccttgatcgctttggacctcaactcctccctgagtctagtcccgatccgccgttgaccaagatcgaccccgatcacctgcacacacatgaaccaaacaaccgttgtcttggcacagatgtcgcaacctgaccaacgttagtccacacacacacttcttgcacatccggtacttgtcaatttcccatcacaaaagaactataaccacacatggtttcacatccggtacttgtcaatttcccatcacaaaagaactataaccacacatggtttcacatgttgcaaaaggaactacataaggtcgttggccggagaaggtttctgctcatgctcgacgatgtatggaatgaagaaaagaagaagtgagaggaagacctaaagccactcctgtcttctgttggtggtggtgatggaagtgctatactagtgacagctcggagccaacaagtagcatctataatgggcaccctagaatcccataacctagcttgtctgagtgacgatgattcatgggaactattctcaaagaaagcattcaataaaggcgtacaacagcaagttgaattggtcaccgctggcaaacttattgtcaagaaatgtaaggggcttcctcttgctttgaagacaatgggtgatatgatgagttcaaagcaacaagtcaaggaatgggaaacaattgcaagaagcaatactggggacaatgacaggggtgaagatgatatactacctgtactaaaattgagctacagacacctaccacctgaaatgaagcaatgctttgccttttgttcagttttcccaaaggaccatgagatggacaaagaagtgttgatccaattgtggatggcaaatggtttcattcaggaagacgaaacaatgggtttggaacaaaagggggaatatgttttccgtaatttggtttggagatccttcctccaagacgtgaaacaggaaaggtttttttttccgtttgcaaaatgcatgatttgatgcatgatttagtaaaagatgtggcagatgatagtgtaatttcagaacagttaatcccacaggaagcatataccggacgttgcatatcagcaatgagtcaaacagtgggattgctcaaaacatcatcttgtctccgcactttgataactctgtggttaccagtacatattaataacttaagacagatgtcattaagagatattggtactgacttaagactgatgtcattaagagctttgggtactgtccgtatgcatgattgctcttttcatagccaggtcatcaatccaaagcatctacgatatcttgacctttctgggtctgacatggatgtgctgccaagttcaatatgcacgatgtataacttacaaacactaaggctgaaccgttgcaaaaaactgagatatttactggaaggtatgagaacaatgagcaagctcatccatctttatctttttagctgtccattgaagcggatgccaccaaatattagcctactgaaaaatcttcgcactctaacaacatttattttggacactgaaaaatcttcgcactctaacaacatttattttggacactgaacctggccatggaattgaggagctcaaagacttgaatcaccttgccaataggttggaattgtacaatttgagaaaaataaatagcaggaaaaatggaaaagatgccaatctccatctgaagcaagatctaagtgaactagtactttcttggggtagtagtaaattttgcatgcctttatgctaaacataaagggaaatgctgaacatagccatcattaaatcggacgtgatggctgcgttgctgaaattttgctcagccaactctcagaatttggaaatgctgaacatagcgattattacgttgctgccaaagaaggaggcctctacccttttgaaggattatagacctattagcctcattcacggctttgccaaattggcaacgaaggtcatcgctctgaggctcactccgagaatgggtgagctggtctctcgcactcagacatcgttcatcaaaggccaatctatccatgagaacttcattttcgttcaagggctgacaagataatttcatcgacagaggaaagcaatggttctccttaaacttgacatctcgaaggcctttgattcagtttcatggagcttccttttggatatgttaaaacacagaggttttgggaggagatggagaggttgggtgtcggctcttctcctaactgcagaaacaaggattgacatcaatggcactttaagtgaccccttcaagcctatgagggggctaagacaaggggatccgttatctcctcttctttttgtcctggtgatggatactcttcatgctatgttgcagaaagcaatgtcagccgggttgcttgacaaagttaaccagtggagcagagcaccaaataattctctctatgccgacgacgccgtcatcttctttaaaccggttcgtcatcttctttaaaccaaattttgcatgcctgaaaacaagggatgcaacgaggaagaagtgttggagtcgcttaaacctcatgctaagctcaaaattttggaactacacggatatagtggcctaaagatcccacaatggatggaagacccacaaatgttgcagtgcctaacaactctccacttttccaactgttcaggatgtaaggatctatcgactgtgtggtttttggtctcgattgagtgtatgtctttatctaaaatggagaatctaaccacattgtttatgaatgtcgttggtgtgaaagccgaaggatactacatccctctacaaattttcccaaggttaaaggatatgacactaagccagttatcgaacttggagaaatggacagaaagtactgctggagaggccaatactagcttagttacgtttccgaagctcgcaacgctatgtatctctgattgtccaaaacttgcaagtgttccagattgctcagttctaaaagaattgaaaacatatggatattgcagtcttgcaatgagcttacttgcacatctaaccactttgtctgaactcatttaccgggaaaatgagtctatgagaatgtcgttgggctcatggccatctctcacgaaactacatattagttcgtcatataaccaaatggccactctggaggtcgacacaaaccaaggcccactagaaaaccttaggattttgaggctatatggcctcaacttcttcacagctgcatccggtttatccaaaatgcatcttgggctatggaaatgctttgcctttgtggaggatttgtgtattggtgcatgcaacgaccttgtgcattggccaatggaggagctcatgagcttgattcaccttcgatccctgtctattgaacactgtgataaccttgaaggaaagggttcatcatcggaggaaatcatgccactctactatctagagaagtttcacatcaaagactgcaaaagtctattggatattccgacgatgcctgcatcccttgaggagctgtgtctgctactttgccccagattagtggcactgccttcgaaccttggaaatttggccaggctaaagactatgagttttgagcactgtcatgacctgaaagagttgcctgatgggatggatggccttatttcccttgaagaattgaagattatgggggtgcccagagatagagagatttccacagggtctcctccatcagattccgacccttcgatacctaatggtagcaggctgccctagcttggaaagacggtgcagagaaggtggcgagtattttgatctgatctcctccattccacgtatagttgttccagtagcaaaacagaagtgacggaatcaacatcaagcctgaagaagcttgtaaaggggctcctcccctcctgctcactctcaaagtgaggtgtgtatgctttgctcttccattatttcactctgccattattcacaagctaattaattaattacataagctaagcgccgggagtttgctttggaattgccggaaaaattggatcctttagagtagtaatattttttcaggaatacgcaaggagcgcatcttttccattaagagaaataaaagttatttacatttgaaagaaaaaacagcatgggactgatacaggacattgacagttaatcctaggtctatctatcgcactgagtttggcaaccaaactccagccgagtttagttccaaaatttttcttcaaacttccaatttttctattacatcaaaactttcttacacacacaaactttcaacttttctgtcacatcgttccaatttcaatcaaactttcaattttagcgtgaactaaacacaccctccctcctgaattgcagcgcaggaatcgctgggtttgctttatgccaaagagaagcctcgtcagccatccctttggccacatctacccaagatctgcactgctgattgagagtagtagtattctttagagtagtagtattcacgtaaactttgtgacttaggcgcagtctccatgcctctggtgatctttgtattctttttctgcagcgaacatatagcttgttcttgaagatgaacagcatcaggaggatttctgggatgagcaaaagtctaaggtcccctctgcaatttataaagagaaatatgagagcatagttttcttcagggagctgtaaaagcgtgacaaagataatatcgattaacctcctggaacacaagtactctgttgagtttgatgctatccaaggtgagatctttgcctcttgcatttctatttttcctacacatgttgtcagaaatgttatggacatattcacaatctcttaatatgtctaggcgtgattcaaagatggataaactcactgcagtttttgtattcctctcaatctgaatctgtgatgggtggccacaccagcaaagccccatcagggaaggaggatttcctcataacagtggatgagaagcatgattatgacaggtaggttataattcacttgttctagatcatatacctgtgttgttggaactatttttgagaagcacagctcgtttcaggctgaagacgcctccagttacaccactgtttctttccatagagacggaaaccaaccaactcctctcaaatgattttccagaagaagcaacctatccctcaaccagttaaaccttcagcttccagggtatactatctgctctgtattatcctacatctaaaaaaaaaatcccagatgcagcttttctcctcaactgaaaaccacatttctagaacctgtttctttttttttttttttttgccgggtcggcgaaggagccgaccaaatttcattaagattgaaaggggaaagttatagattttacacaacattaaactgtcgagccggggactaacacccctggagagcagaaaccgggggggaggggggggtgggtggcgcgggctactcctcacaacactgaaaaacacccgcagctctccaaactgcaacttcctctttaatatctgccacaaggtgcttagccgtcttgcttctttggtcgaaaactctgatattgcgttccttccaaattagccagctcaccaacatgaaaaaggtgtcaaaagcagtcatgtagcgcgtctgaaatagaacttgtttcttcatcgaagagcttatcttgatcttgactttatccatgagagctttctgggaggacaaaggcaacaaaaaaaaatcggttacccacacctgactcatcatcaaagaacttgttcagacgggctgcaccatccatctccactgagaataaccaaccttgcacaattgaaaagagatcaacttacgcaggcataatgagcaggcaaacctgttgctgcaactgcacctacagtttctacagcaagtaggaatgcaaacaagaaacactctgacagatgctacgtacgcaagccaaggcagtaccacaagtggactcaagaatgtgacgaaacctgaactcccttacaatgcaccgaagaatctgaccacaacaagatctatatttacatgccgtgcgccagcattggatgtaggtgagaaaatagaaaatggcaggataagaagaaaatcatgcccacctgttgcaacaatagggaccaaggagcagagattagatggcaagaagaaaggcctaccagctaaagtgaaggctgtgagcagtagcaatgagtctacttctaataatggtggccgttctggtgaggccacaacaatgaacggaacgagaaaaacagatgggaagaaagagcacatgtcaaagcatggaaaatcggctgaagaagtgaacatgtcattttatacaagtttgtttttacagtttctagtgttctctgcttcgtactcttctttttctaatgattcaaaggacgaaactgttttgcatgatccgaaaaacatacatgttgtaaccaattaactatccggtgcagatgtgacttcaaatgaggaacttatgtgttttatgggttcgaagtagaaggcttttacctgtgctattaggtatctaggcaaaatgaacagacctctttttcatctacatattctagtaggtaagatttgttcacattgctagcaccattgctgtatcagtatacatgcatgtaccagtaatacttctatttgaagaatcttgccacaaaacgaaccaacacatggagtatctagctgtaatatgaatggtaatcggtttggagcctgatgcaaggatcagatttgcaagagaaaacagcacagcaggctatcaccagcatggccaccaccagggttcacaattccgataccaccttccatgccaaacgctggcagcacgttggttttcacgaaatccgattgaaaaccaacaaattcatatcggtcggtctttgtgtcaaaaatcgattggctttaccaaaatttcgaatggaaacgttgaaattcttatcgacagttggaagtgaaaacatcaatctgtttgtatcgaaaaccgattgattttgtcaagaaaccaatgtgaaatttcaaaaaaaaattgtttactaaaaatgtggaaaatagtgaaaaaaaaaagctagaaaattgggaaaatttctaaaagttttggcatgccatttctataaatttgacccattgcttgtttctgatcacaaataatgaaaacaaatgtttaatcttctatgtaaagataaataaatatatgcataggattgtaggaatgctaaccttactaagctagtctaacaagttttttttctggagtattctgttattaaatgaaatgacaacaaaacaagctaacatgtatttccaaacgaaaatgttataaagggaaatgcatgcacctagatataacatagcaaaggacgatggcaccgaaaacctagaatgaactaagtaaagtgcgggaacagacaaaggtattggacctgtagacttttttttttttttttgctagtagtagctcaaactaggtggaaggtttggatatatttctaaattcctcagcatgaactttaattttgaagccattgcctctttataatggtaaacagcattcccttgacagttgattggtcaccctctcatgatatgttattagcgggatgtcacgatggaacggtaccttttccttacccaacaaaattattttcttatcttaaatcatgtgacctttgagtctttcaagttgctgttctgaaagttctgtgattgacttttttatattccaggttgctttagggtgtgtttagttcacgttaaaattgaaagtttgattgaaattgaaacgatgtgacgtaaaagttgaaagtttgtgtgtgtatgaaagttttgatgtgatggaaaagttggaagtttgaagaactgctttaccgacaacatgtctgactgtagaactgctttactggtttaaaagcagccagttactggagttcccaaatcttcgcttttcttattctgttctgttttcaaacaaaactaaatcatgtgttctgttgataaacaggttcaaaaccttttatgtgtgtaactgctgaatctgctcccatcagaaccgtgtcgtgggcaccatctgtgaggtagccagttgtactgttactctggtctattccaaaagataatttttgagttttgactcttgtcattctatcagtaaggaaaacgtgaatacctttgtcactggtggagaggatggtctgaaattcggggatttaaggtaggtgttggccttgttgtgaactgaagcaatgtttaaaacatctttcgaactactctcttatcctgcatgaatttctaatattatgtatgggtcctcagaggtctgaacattgagggtagtctctcccccttcctctctgaattcgtggcacctcccaatttctgaaccattcatatttgtttctgtttgtttcctaatggtaaaaattccgagttaacaaacaaaagataggcacgatatgcagaatatgttattatcacatggaccaatgatgtcagtaggagtttctttatgaatccagtgcgatatacggtttttttctttagcttttcaatgggcactaagaaacttgttctagaagctgcagtatgtttggctatgaatatactgattgttatggttaaatcactacctgtcacagcccccttggatttgctattgttttctaccgtttttgttttgtaatatttgggaattttagtgcatctcataagatatctttgctgcagagatccatatcgtcatctttgggagttaactactgctcgaagggccgtaataagtcttcaatggttgaaggatgcaaggtaatatttgttaagcactaaatgtacttgtttttcttcactaacacggtgtttacgttgttttccttgtctttgaaacactgcactaattttaaatggagatgtatgttttcattaatgttggaacacatactagaaaccatatttgctagaatgttgacaattattttagtcatgtaatttatgttcatagggcctgtacttctccgttagtgtgtgctaaggtggatattgtctttgtttatataattagttccattaaagcatcagcgtatttttttaagtaattctatttgcactttttttttgcaaacgctctatttgcacttgtttacataattattaatataaatgtttgtatttgcccacgtaccttctaaatgagatgcaagcttccttcactggacatggtcttgatgtattactggatcaaagtagacgtgattaaatagaccacattgtttcattcatggtgatattgtgtgtatatatgccagacataccctttttactagaatggtaatgttaactgttatattttttatctttgtgttcagaggtattgtcatatcattggaagatggcgcattaaagttcgttagcttgttaagaatcgcaaatgatgttcctgttactggaaggccatttgttggaacgaaaactcagggtgtttctacctatcaattgcctgaatatttgatctggagtgtccatgcctcagaaattacaggtgcatttcacctcatgtccaaccatagtagatgtcaagtatcggaatattggttatagccttatatcaatatttagttccacacatttgagcagagtaaaaatgtcaaatatatattcatgatagttcatgaatttgtaattttgttttgctgatatccaggctatgcggcttattgtgtggctgatggaactgctgtttgctttgaggtaaactaaacagcacataaactattgatttatgcatgctattgtgattctctataacattgctaaataaatattcaacttactgtagcttactccgagattctaggaaaaggaacctgggagaaaccgtgtaccatattttctttgtggttcattatcagagggaacaaccattaaaattggtatcgcattaccaaactctcctttgtcaaatgttcctctggagaccaaacgggctactaaaacttgcaaagatgtagctcaattgcatgttatagaagaagggaaacttcttaccaactcaggtaatcgctgtcacctgcaacttgtatcattttgcttgtacctgacatgcctgcttaaccaccatacagaatgcaattgtgctataaatccgagcatcagagatggtcaacaagatgaacctgatgaaggacaagaaactggtgccatagttttagctgctccttcaatgcaagagaactttggcacaagcaccagcaggggtagcgaatcccctgaaaattttgaggtatttcctcctaaagctgtagcaatgcatcggttgagatggaccatgaataaaggtagcgagaaatggttgtgctatggaggtgctgcaggcattatccggtgtcagaggatctaaggaacaagagcacacttgaggaatctccttgtatatcaggaaaatctgcatgtgtccatctacacaataaactgttgcatgctgtggtatgtttcatccgtttctttcctctactgttattttgatcaccatgtccattttgggttatatgtattaacttcttgcactgtgcttgcaatataacagattatggccctgtttggttcatgggctaatatttagccctcaccttttagcctcaaattagccctcagagatccaaacaggtgagctaattttgagctaatatgaattagcccccctcaaaacattagcccctctaaggggtactaatggggctaatttcgtgtggggaccatcaaaaagcagctctctctctctctccttctctctctcctctctttctactctctctccaccttttagccttgaattagcccatggatctaaacataccaccctaggctaatgtttagcctaccaattcatgactaaacattagctctcaaaattagccctgggctaatctttcaaagagggcctatctttggaactcccgacggagctgtatagccttatggactgaagctttacctgagctgcgaggttctctgtgttttgggaccagcaattcattgcatgttggttcgaaaatagaaaatattgtcactccatgcgattcttcctccacattactctgaaataagtgcaatatgtgcctttggcgatccagattcgcaaaatctgttgtaattgtaattgtaattgatagctattcttattcatttcctgtaacatatgtaagatcgcacagattattgatgcagctaaaaaactgcacgatattaggtgggatttcatgcatcgctgtttaagttttggaagtcatacagccttgttgcttcataatatgtactactctttttaaggattgttgagttgttaggctgtcgaagcttttttaaacaaatcaacagcaatgtgttgaggcatttcttcgctgctgtgctcaagttctcgtagggagcacgaccctacgacataggagcatttctgtccttgctccttaccagataaagagaagatctgatgtatctttgttaacacgatatcataacagttgggtaaacacgatataggagcattttcattattggagagagaatttggcatatttacatttcacttagctgtctttatcaaagtgatatttcgggtgaaactgcaggatgaagtactgtacaatagtaataaacgtggcttcccttaaaaaaagaaaaaaaaacatggcctgttaacatccctaatgtcaatgttcttagtgtacaatacaactatacatgcataattctcagtcgctccagttatcctcatcgactacaaaatccatttgcctcttgccatcatcttcctgcagaggtttagcagtgctaacaatcaaatgcctaaaaaagcttatgcaataatatcccaatatgcccgactactcctgagaaatttgaatttgataggatgtaggaaaattctacagaaagatatatgataacaagaaatagaaaatataccatttcagtaaatgctggagttgatggagaccacacaagaatttgcctgtcattgctgccagtataaagctcctgaattccaaaagactcagcaatggtattgatgcgggaacattcagggttaacagaggataggagtagagggaagacttacttgttcttgtgcactatagtagcagcaattaacaggttcatagtgcccacggaatgtttgaaatgtcataccagaccataaattgtacgcctacatgaatttggcaacacaaggtgaagtataaaattcagcgtccaaactgagaagctaaaaaatgaccacaccttaatgcttgccatgcatgggatgaatacaagtgatggatcctcagtgacagctaattgtagtggtttgctagtctgtaatcgcatagcttcaaaattgaccaaagtattacagcctgaatcaatatcccaaagtcttaagcgagaatcagaacctgaagagagaggataacaatcattaatgcatactgcatacaggcataacaagaagatagccataggcaataattcctttcaagcaatagcaatcgaatgctcatagaaatagcaattaaattcaatcaacctgagctaagaaggtacatcccatctgtagttgttcttaatcccgtaacagcaccataatgcgccgttgcacgattttgactagaagacaaaccagggtgcaatctctgttggatatgtccatgtccagggatttgacttttgtgcaatttgtgtgactgtttcttactcttgcctgtcctctgctgtgcagagtaaatctttgaagaagatgaaggttgtaaagagttcaaaggatcctagtcaaaattaaaaatgaatacattgatcatttgcacaactagatcaatgagtttgcgcgtcatttctagggcacaacaatcaacaagaaacaatgtatgcagaccttatattgtaagaattggagcactaaactgatccatagcacctatatactgacactaatatgtgagacaaacctataaattaatagccgcagaaatcagcttttacttgaaggctgacagtattgatctgtagcattacaaccataatgttttacttaaagctgcaacatttttgaagcttttgcagaaaataaaagtggaagtccagctttagcgttgcaaccaaatattttgaaaacaaatgtaagtgatggataatggtgaccataccttatctgaggtgccctcaagaaaaggaggccgccttcctagttgagaccgtgattgatcaagaacaagaaagcatccagctcgtcttatgtcccaaaatcgtattgctccatcacaaccaccgctcatcaaaatccactcacttgaagtagaccactccaaagacatgataccatctgacatgtcagataccaaggataaggtggtaaccatacaaacaaagcaagcatattttcatcactacactagaagtaagcaactaaccacgatgaccagacaacgtgtgggtaaaggctccagaagcaatatcacataaacggacctgaacatctgcacttccagtagcgatcagcatatgtgttgttgcaattggggacattgctgcactgtacacttttccaggcatcttaaaatccattacgacctagaaaagaaaaccaggcaaaaaatcagaacatcaggatcacaccattgccaccacaaaggaggcaagacaaaagaaaaattagcaatcgacaaagcagatgaaagcatacttgagtcgaattagtatcccacactttgacatactgatcaaaagaagctgtcacaaacagcccagtgtccacaggataccatacggccatagataccgcgaacttgtggccattttcatgctgcttgtccacaaggagaatgctcctatgcttggcaatgaacccagcttcgtattcgatcgcattctgcacatcaaatatagcggctgatccatccgatgcgcccgagagcaggtaccgccgctctatcaaatcaacctgaccatattgtcaaattacaaaacaccagcgggagcgactcaggaattgcacaccaaatacgcaagattccatctacagggtgtacaaatcaaattgatctaaaccactaaggtgagagaaggagaaggggagtgagggagtgagaagggggtgtacctggagagagttgacggcgccgttgtgcggggtggtgaactccttgcggttggagagtgcgagtgaggcggtgcggcgcgcccgggcggcggtctcgaagcgccgtgccccaagctccccgcgttccctccgcctcaccgcctcacaccacatccactcggccgcgcacgacagttgtgtccctcttctcagcggtgacagcgggcgatagaaacggtgcggtgtgccagtgagggatgagcggcgcggccgagcgggagctatgctgaccggagatggagaaggattcggcggctgcactgggaagcttctattaaattaggcagtttcaatccgtgttgatttatgatggctcggatcctcccgtgtcccgtgttcgactcacatatggcctcatggggcacctgatggatgtttgtctctggctaatcatgaatgatgagttgtggtgtgaacattgataaatttacatatactataaaaatactcgtgttgcaatgggtgaatactattttaacattattattgttatacggtttagataggataaaattcactataggaattcgcttggattttttttttaagaaaatcacaagctacaattacaagtccaacttttatctcaagttagcatgtgagtgttctttaaaaaaaagatttcttatacgactccttttgtattttcaaaagaaaacgagcttaaaatctaactcaaacacatatctgtatttctaaaagcgtacgaacttaaaaaacaactcaaacacggatgacgtaccaaaataccgataaaaacatcttcaatttttataatagcagagatagagaagtgtttcgttataatatcattgtttaaatgggcttgatagaatatcataagttaaacgaagagtgttcgctacgatatcgctcgttcgttttattatcgaaataaaactaactaaatttatactaccaccatctttgtatatatgacgctggatctatatgatttttttaagcaacttttgtatagaaactttttgtaaaaaacgcaccgtttagcagtttgaaaagcatgcgcacgaaaaacgagagtgggcagttgggaacgaggggaaacgaactaagcctaaagctgttactgaaactgccaatcctgaatacaaagtaacagctaacaagtagtcttcacaaataaaggtggggctcactgacttagtgacttctagataaaggggatcatgtttcgctactcctctgtgccttaaaccataacatcaaatggtaagctagaaagtcacaatgtgcataaatgatcatcgattagagtcatcaaacaacaaatgagtacagattaaggaaatatatctaccagaacaaaagtgacttaaacttagtgaattagtaataaaacaagtaaaagtgcaactgcattttgttcatgacctgaaaaaaa

SEQ ID NO: 62393 - DNA, 621 bp, Oryza sativa
gagcttacaacgacagtatgctgtcgaaaacagattggggcaaaagcccacacccggtaagccagaaaacttctacaaattacaatgcatattacgtgatctcgctattgcacgttgtgaacactcctgccgtcttccagacgatgacctcttccttgatattttgcacaagctgttctatgcttcgaaatttctgttcaaagacacgcgcattgcgttcttcccacagcagccaacatgttagcgcgaatacactgtcgaagatgctcctgtagcccgtccgaaaagccatcctcgccttcatccaccaatctgtgcttcaaaagatgatgaccacattggacaaataaccatctcacctgttactaatactcaactttttacatcatgtacatagtccaggaataaataatgtcacaggaaaaataaatccagtggtatcaacaatagtaattgcaaaagaacaaatagcacaggacagatcatttactactaggtaacttgagtaacccccatataacttatcttaaagcagctagtgctatcaagaaagctttacttcttgcacaggtagctcaaaccggtgcatgatgacgatgttatctcagtataacaaattaa

SEQ ID NO: 62394 - DNA, 2577 bp, Oryza sativa
  unsure (1)..(2577): unsure at all n locations
aaaacggcactataaattggcnccaacactttctcggctggcanaagcttggccttctctgcttcttccaaacctcccattcactctgttcccctctcttcccctgctccagaaagccaagttcaaacatggcgcacaacgacgaagcgtcctcgtcgcgttccaccacctcctccgccgcccaaccctcgccaccatcacgcctcgcccccgcctccgccttcgcctctcccatggacgcggcggcgcccgcgcgtgacttcatggcggaagccctccgcctcgtccacaaccgcctcacgtgcctcgtcgaccgccgcaccatggcccgcgtctgccacgactggcgcgtcgccgtcaagccgctgcagcacgcgccgcatcgccgcccgctcccgtggatcctcgtcccgcgcgccgacggcccttccttctcgtgcgccctccgcggctgcggcggacacggcctcggcgtcccgcacgacgcccgcgccgcgcgctgcttcggcgcctacgacggtggctggctcttcctcgccttccgcgagaccttccgccacaagctcctcagcctccgcgacgttcagctgcgcctccgcctccccttctttgtccgcccggacatgacggctgctgaattggggcggcctgtcccttacattggtatggtcatgctcgccgcgaccctctcttcgccaccggaggacgaggattgcgtcggcgccgccatcatcacctacgggccctacgaggctggtcgacgcactcacgcattctggcgcgtgcagtcagcgaaggctttcccggatcaggctgcggcgatgggtcatggctccgatgccatcgacgagccagctctggaggatgtcatacaccacaagggggccttccttttcctcatcacagaagaagacctccatgttttcgcagtacgggatttccatgaagacggcaaaggcaacatgaagatggcgcccagggcgattcgtcgcttctcgcgaggtgggcgcgattatggcggagacatcgttgtccgctacctggtggagtcccgcggcaatctcctcatggtggtcaggcgcgttcctgatcgtctacacgcgccgccgaggacgtccgcgttcaaggtgttcgagatggtggagccgccgtcggggacgcgcatcgaggccctgtacgcgtggaacgagctggaatcgctgggtgggcggatgctgttcgtcgcgcgaggctgctccagatcgtacgacgcgggcgactatccgggcgatgagttcggcgagggcgtctacttcctggatgacgggaggctctaccgcgagtcggcagtgttcacggctcggcggcggcgacggcgatatccctgcagagacaccggcaagtggctaccggcggcggatgcggcgggggttcctcgtgtggacaagttcttgccggagcaaggcccgtcggactactcaccgccggggtggcttctcccctgagattgctcatgttacttttgatcgtcctggtacaggtatgattcgctgttgatttgatcctccgagatgtggtttagtttgcagccgttgtactttgtcccgtcccgtctcctcttgctgcgatggattagtgtagtttcagtcaacagttgcagtttcagtctagatttgatgtcataatcatggattggtagttgctatgatgctggagaaattctccttttgtagcagaaaatgttttcaagtcagaactacatgaatcgtgaacgcagtatgaaactatgaatttgtgtgatctgatgctgcagtgaatcaagaacgcaatatgcttccaatggttgccgttcgtcatgacttggattgcattagtacatcgttatgctgcagtcaataacaatgcaatgtgtcacttgcagtggctagttttcctgatagaagtatgttttgcatcaaacggttttgcagtgaatctgaattgcttctgcgtcctgttttgagtttcttgctgacagtccaagatgaactgaggtaggctagtgccactcttcagaggatcgagaaatgcccaggggtcttccggctagctccacaaggtggtgggctagacgacctggattcaaagcctcacccctcctaattatttgatattaggtccttccctaatattctagttttttttttctcttcagaggatctgttcctatgttatgtgcataatgtaaaatgtggagtatatttcttcagtcaagaggtatttcttcagatcctaagttatcagcatttcttcagtaacacagatgataggcagcgtgttaatatgatcactagtactgatcagatgatgttatactatcagcatttcttcggtaacacagcctgatggctgatggtaggttggtaggcatcatatctgttaatctgtacgggtagttttaccatcatatctgtgttactaaagatgatgatcacattggaccaataaatctctccttttctttttcctctcttttttatttttggccgggaggaccaataaccatctgtccaactctacatgctcccatgtgtccatatgaatcaacctagtgaatcc

SEQ ID NO: 62395 - DNA, 1940 bp, Oryza sativa
tcgcggttatgttagaatgtgcctctagcaaaagaaaaatattgatttttttaacttagcaaaaaagggtttcaaagtcagtaaaaccctgtttaaattctactattttcttttcaaaactttagtccctatttttgcattacaaaatgaaaaatcatagtccttaaaatgctccttaaggtaaaaaaaatattgatgtttaggaccagatttgattctcaaaatattataagtttaactaaatcttattctgaacattaaatatttatttatgatagaaatcaatgaaaaggataagtagtcaaagtcaatggacttgtttgttcgagcctatttgttgcggttcatattttcgttagtcgaaggcatgatataaaagtttacatttctacttttattggctctaaactaaaatcgaataccgggaaacctctaatgatgttatttcatctatcagagtttaaatcttgatgcacacgaatattacgcatattcaagtgagttttcaacaggattgcagttagatcagggatgtaacgttggtttccatttattagagcatgtgttaaggggacatattcgtgggagtgtgagtgtggcgttggtgtgtgtgcacgcgtttcgtgtaattaaaaaattaaatcaaatatagaaatgaacggaaaaaaaaatccaaaaatgaagtttgaaaatcttaaattgactacggcgccggatctgctacaccccaaaatcctgtggtgcacatgaacccaagagagtctcgaaccggcgaaaagtcaaaaattctctcgcggaatcggatagaaaccggaggggcggcgcggcgtcgacgcgtggcgcgagggggatattcgggtggcgacgatgaggtagacgacgcgcgtgggggcggcggcggcggcgtcagcacgcggcgtggtcggctggagattacgatggctaaacatggtttttattaggggagattattattattattatcagtggaagccaaggaaatgatcccatcaatcgactcgtacacccaatcacagtccgagatttatatcgttagctgaccaagaacgggtagtcaagttgcgttgatttttttctgctatttaggtgcagctctttttattattattattttagattttcatttcaagcttgccaaccttgtaaaaagttaattcttcgtttatatattttctgtataaaattatctggaaatttttttgaataatatctttttagttttgtaaaagttacttcatacggtcatataataacccatcaattattcataaatttcaactatatcaaacttgtagtacaacgatatgatacgagtttatatcgatcagaaatgcaactgtcatagctagcagaggggcagagacaaaaataggatagctagggctgcagccctacacatgaatctaaatatccattagcactgtactttaaaacttcaaaaagcagaaaattaaaggcaaagctacgtaaattacattagttgaggcttagacttaaaagaatatggcagctggtaattcgtattttatcgggtgaagctaaatgaccaatggtctagtcgtccaatggtacgaatccgcgacaacaaattctggtttaatttcttctaggaatttaaaatatttttatttttctctttttttatgttttttctttcatgtttatgttttttttctcctactagagtgtagcgcccgttccgtcgtggcgcctagcgggaaaattatctcctaaaaaccctaattgcgaaatttgtttcttcgcttgttgtctagtgtccgtgccatctcaagatctcaatccccgatctatcgtcgagttcaattccgaatccaaatccttccaaatcattcctccgcaaaagtccattttgcctcccccggggtcgatgggccgaatcccgctcggcccatctctcc

SEQ ID NO: 62396 - DNA, 14218 bp, Oryza sativa
  unsure (1)..(14218): unsure at all n locations
ggttagggttaagaccaagactaaagattatagcactgcatatgattttcgcttacatatgtgtttataaaatagaagttaatgcattaacattatttaaagtacaaagattaatgacaattacttcgaaaaattatttttgtctgtaataaattaagtggataaattgtaataagcaaatataattaataaaaattccaataatcatatatacttagcatatatatgaatgatattattatattggtaaaaactctaattaagatatgtatgtacatactgcatgatttaaaattaataaaaattgtaatcatcatatgtacttagcgtaggaattatattaaattaaatgctaaaaactctaattaacatatgtaaatgccacatgcatgatttaaaccttttaaaaattcgaatagtcatatataagtagcatatgaaagatagtaaattaaattgtgaaaaactctaatatatgaatgatagttttaaaaatatattaaatttaatacttttaaaaattctccagtcaattataattagcatatgaatgatagtaaattaaatgttaaaaactctaattaacatatgaaattgccacttgcgtgatttaaaacttttaaaaatcctctagtcaattataattagcatatgaatgctagtaaattaaatgttaaaaactctaattaacatacatatgaaattgccacctgtgtgatttaaaacttttaaaaattgtaagtatcacatataactagcatatacatgatttaaacttgttgaaacctctaataatcgtgcgtaattaacatatgccatacatcaattgatttatatggataatcaatacatccaaaatagtttacatcgtgtacacaataattacggcacgtactttctcctcactattgttccctccttgtgatcgctgcgtgagtaaggggtgtcttcatttgataggaggatgctagggtcaatcgtcaccgtgaaagggggttgcccatccaactgatcgtaatcctcgtcagtcttgtcctcaactccgacgatttttcttttgcctgggagaaccacttgacgcttaggctcatcaggccctctgcccttctttcctttgctagacatgtccttcacgaaaaagacttgcgttacatcattggcaaggacaaaaggttcgtccgagtatccaaccttgttaaggtcaacagttgtcatcccactgtcatcaatcattacacctccaccagtcaacctaacccattggcaccggaacagaggaaccttgagaggaccatagtcaagttcccatatgtcctcgatggcaccgtaatacgtggcagttgttccatcgtgtcccatggcatcgacacgaacagcgctgttttggttcgtgctcttcatgtcttgggctctcgtgtagaatgtgtacccattgatctcatatccctggaatgtcgcgatcgacccagacggtccgctcgccaggaaggcaagttgttggttgatcgactcgttacccatgagatgttgtcgtagccacgcggggaaagtgtcaatgtgatgtcgtgtaatccatgcatcggacttaccgatgttcctggcgcgaactagagccaagtgctcctcgatgtaaggagctaccaatgaagagtgttgcagaacagtgaaatgggctttacggaataaattgttgtctaccgtcgttattgctttccttccgagagttccctttccccgtattctcccttcatggcgtgattcaggtaccccgattgggcgaaggtcttcgataaattctacgcaaaattcgatgacctcctctgttccataacccttggcgatgcttgcctctggacgagcacggttacgagcatacttcttcagaacgcccatgtacctctcgaaaggaaacatgttgcctaggtacataggcccgagaatacggatctctttcacaaggtgacaaagcagatgcgtcattatattgaaaaatgaaggtggaaatatcaactcaaaactgacgagacattgcaccacttcattctgaagggcttctaatctatccggatcgatgaccttctgcaaaattgcgttcatgaatgcacatagctttgttattgttgcccggacattgtctggaaggataccccttattacaactggtagcagttgtgtcatcaacacgtgacagtcatgagactttaggtttgtgaacttcttctccttcgtgcttattattcgcttgatattcgtggagtatccagacggtacctttatgctatccaagcattcaaacatactttccttctctgccttgctaagagtgtagctggctggactcaagtaatggcttcctttctcctttggttccgggtgaaggtcgccacgttgttccatatgcttcagatcattacgtgcttccagtgtatctttcgactttccgtatacacctaggaagccaagaaggtttacgcaaaggttcttagtgaggtgcatcacgtcgattgcgtggcgtacgtccaagaattcccaatatggtaactcccaaaatatagagttctttttccacatcgccgcgtgaccatcttcgctctctatatgctggcttccaggcccctttccgaacactactttaagatctttaaccatagcaaacactgttttcccgctgcgatgtttaggcttcgtacggtggtcggccttatgttcgaagtgcttgcctttcttccgtaccgggtggtttgctgcaaggaatcgacgatgacccatgtatacaaccttcctacagtgcttaagatacgtactttctgtttcatccatacagtgagtgcaagccttgtaccccttgttggactgtccggataggttgctaagtgcaggccaatcgttgatggttacgaacagcagcgctcgtaggttaaactcctcctgtttgtcctcgtcccacacggggacaccttccttcttccacaactgtttaagatcttcgaccaatggtcttaggtacacgtcgatgtcgttaccaggttgcttggggccttgaataataatcggcatcattatgtacttcctcttcatgcatagccagggggggaggttgtagatacacatcgtaacgggccaagtgctatggcctctccaaaaggattcatgccatgcgtactcaaaccaaaccgtatgtttcgtgcatcctttccaaattctttaaattttctgacgatgtttcgccactgcgaaccatcggcggggtgtctcagcatcccgtcctgttgacgctcttcagcgtgccatcgcaacattctagcattccccttgttcctgaacaaatgccttagccgtggtattatagggaaataccacatcaccttagcaggaattctcttctttgttagctgcccgtcaacttctcctggatcgtcccgtctaatcttgtatcgtagtgctttgcaaacagggcatgcttctaggttctcatactcctcaccgcgatataggatacaatcgttcggacatgcgtgaatcttatgaacttcctgtcctaacgggcagactatcttcttagcctcgtacgttgtctcgggcaatttgtttccccccggaagaatgttcttgacgagtttcaataaatcgccaaatgccttgtcactaacctcattttttgccttccattgcaacaactccagagtggtatccaactttttgtgcccttgctcacaacctgggtacaacgaagttctgtggtcctccaacatcttgtccaatttatgggcctccttttcactttcgcagtcctccctggcgtcctgcaacatctgaccaagatcatccgcaacgtcgttaccatcagcagctatttcctcctcgcccgtttgatttccttcaaatccaacatactgagcaaagttcggaatattgttgtcttccacttcatcttcttccatttcaacaccttgctctccgtgggatgtccaacaattatagcctggcatgaaccccgactcaaacaagtggaaatgaatagtcctggatgcagaatactccttctgattcttacacttattgcatggacaagaaataaaacccctttgcctgttagcttcggccactctcaaaaaatagtgcacgccgtcaataaactctttggaccgccggtcagcgtacatccattgccgatccatctacatgagtcaaaaaaaccgtacacaaataattattcttacaataatgacagtcatacaataattataagatatctttattcatacaaaaatcataaaatattacaccaaataattcttaaaaactatttgtaaagttttaaactaattttaatgtgttttacttcttttaattttcattttagtttgttttctattatttaagattaactttcactagagttttccttctcaactattttataaaaccttgtttagcaaatgaactaaatttctatatattctttcttccccacacacattttctctctcatcaacttacaactaaattttagagacaaaaaaagtgtgcaaaacataggtgcaaatgtagtatgacaaaaaaaacattggaggatgaagttgcaaaccttttaggcacctccgatttgtatgtaatcaccaaaataaattcaatagaaattttggcatgacctcccctcttttttgaagaaattttgaagcttgctcgggcagctggaggaggaagaagacatatatataggggtgggactttagccccggttggtgctaccaaccgggactaaagatcccgggggggcctgacaggccctgacagcattcgaaccgggactaaagatgatctttagtctcggttggtaacacaaaccgggactaaagatcaaatatgcccgttacccttttgaaccgggactaaagatcatctttagcccctgtttttattgcatccgggactattgtggaaatcggccgaccgacgaaagatggtttctccaccagtgtaattagttccgtaaatagtttatatttaatactctaaattagtgtcaaaacatctgatataatagggattaaagtttagtctctgatccaaacaccacctaagttgtttggcttactagggcaaccgataaggctcgaagtctactagtataccggaaggctggcatcacatgcgcatcttctttttttttttttgtccactcagttgcacagattggcacagaggaagaagagcaggatcagctggccggccggcagtctggcgcccgtcggcagggccgggtgccctgaaggcctgaacacatactgtggcttatattatcagtggcagctagacatgctcatctgatgaacaagctgttttctgcatgctcctatcattgctgcgcatatatactaactattcatcttcaaattaccaattcatccacatatacaaaccgcatggtccttctgtcaagtacagaatgaggattgtattgtacccggttatatattatactagtagattaggatgcatttccatctatatcctagacttgtttgaaaaccaagccttatatatcccctaaagcttaatacaatcgtctagttacatactagtaatcttgtatgtatccctatacgattcaacaatacatctacgaggcttccacacacgtgcatgatacgtacatgcacagaagaaaatgtatgtgtactcctatataggagtagtagttaggaataattgtctaaattaatctctctgcacggacgtaccgtacacgtattaatgcctgaaagcttgatctgcggaaaacatattctgatcaaccgctgcaaagcctggatcgtgcagtgctaattaaattggacgccggcgatttgtgcgctgaagcctggaggagagtacactgatgctagcttcatcgtgatgcgcatgcaatgaaccctgcgcactgcgcagcgtccgtacgttatccgacatgatcaggccgcatgcaggataggatatgcatctatatcgataaatctgcagaactatatattaactactataccttcatcccgacatataaagaattttgactaattatccatatacatagtcgaagtccttttacattttgaaaggaaggtactgtaataaattttggagacaggatcattcaaataagggcctgtttagtttccaaacaaaatttttcacgctgtcacatcgaatatttgaacatatacgtagagtattaatctagaaaaaaacaattacatagttcaccaggaaattgcgagacgaatcttttaagcctaattgcgccatgatttgacattgtggtgctacagtaaacatttgctaatgatggattaattaggtttaataaattcgtctcgcagttttctggtgtaatttgttttattattagactatatttaatattttaaatatatgtccgtatatccgatgtgatatgcatggactaattttttttttgccaactaagaagtccctaaatatatttaggaagatgaaatataggaagagccttctttaatttcagacaatgattagtgcagagcagttgctgataaggttaggtctagctagctagcgctgcaacgggctttgccttttaccctttggtacggtgtggagacgaagcacttttgttgctagctgctgagacagagactggctaatgacagggagcggtgtgacatacaaaccaattattcagagaatccgatcgatggatggatggatggatggatcgacctccggcgaggattgttactagatccgtctcatcgaacatgattaggacaacacaagaaagattgatagatagatatgcccggacggccgggaagatcatgtgtacgggaagagtatggcaaaagttaggtcaagccctgcaacaattttgctgctatttaaccttcggttggtgatggtcccgtttcttcgacgacgtgttcaacaccgaatgatttccgctgattatttgctacacgctttcagaaatatgtcttcttaaatgaaaactctcttctaatacttcctccgtactcgtaaaggaaattgtttagaataatatttaagtcaattcctaggaatataaatcataaataactctcaagttgttaagtttgaaaatgtaaaaattatatgaatagatttgtcttgaaaaatattttcataaaagtaaacatatatcacttttcaataaatatttttatagaaacaagaagtcaaagttgtgtttcagagaccgtatcgctgtccaaaacgacttactttacgagtacggagggagtacattgtttagaccacttgctctaaatagttttcttttttcacaactaacaatttttgctattcttatggacacagatgtaaggtggagctatttcttcattacagataattaacaattattgctattcttatgaggaaattgttctctatctgtcatatggtgatgtatggtatggacatgcacactccttccgtacggtaggtgcaaagccataagattgttttttttttttacggagggtgtactatacttgccatggaagaatacgctataaacctgtagaagtagacaatgaacacatatataaggtggagctcttttttcattatagatcaaatctggagtacaagtcaatcatatatatctcaccctgcgcccttttatatatagcggtcttaggaggagataaattttatctctactctggttaagattggcacacaagaaacttatctcctagagattgattttcacaacaaaattgaagtttgttgtgtatgtaaaatgccacatactcttccatgggatcttcagtactcctagatgggaacggtcttgctctcctgcccagccttgtgcacagataaaataaaaccgctgggtcaggacaaagcccatccgggaagcccacaatacaggctaaatcctacccttctacaggcccattgaaggctgaaagatctggccggtacccgggccacggtggcctctagcaagtcgccatgttttggaccattgagttggtcacgattttgacagggaataagatcattttgactccctcaactgaccaccgaatctaaatcatatccctcaactgcaataccagaaatcttaacccctgaacttataaaaccggtgcaatttgacttctttgatggttttggagagcagtttcactgacgtggcgcacatgtgacagtgttgacttagtctttgtccaacgtggcattgacatgatgtttatgtggcattaaaataaaaaaaatatacgggcccacttgtcattaaaacaatatgtgggatccattgacatgtaggccccacatatcatcttctctcactacccttcttcttcctcctctttcccttatttctctccctcccccttgactcccccttgacatggccggcggaggcgggggctcggtggcggcaacggcgggcaggtgccggagtggtggcggcgctgggtagttggtccttgtattttcatccatctcatctgcatttgcatctgtttctccctctcactcttgttttgtgttcgtcctcgtttggtctctgtttcttctcgatttggtttttctgctatggagcccatgaatcagcgagcggcagagctcctctagctcagcccctaacaacctataaactcctgaagaaggcacttacgtctgcgccgagcgtccatctgtacacacgtagtctttgttgacgatttctttgcctgttgctggaattgagcagcttgaggatgttgttgattcggtaggggtggagatggatgaggagtttgcagatgggtgggggcgtcgggtcggcgttgtcgggggcggaaacggacgagcggctgacgggtgactgcaaacataagagcggcgcaaggaaggtggttcatggcgagcggggacgccacgggcacacacgcgctggtccttccttggcttgatggcgagcgcctcggcgtcgtctatctccggcaccactgggagcagcagtacgagggaagcccacggcggctgcctcctcctcggccgtcttcccattggtgaagcccacggcggcggcgtttctcggcctcgaggcagcggcgcgaagcgagtggtctccggcccgccctcccgcctgccgcagccactccgtccatcgcccgccgtcgccgccgccgattcgaacgccgctccccacgcacgaagagaaagagggagagatagagaagggaggagagggaggaggaagaaggataagagaggatgacatgtgggacctacatgtcagtgggttccacacatttttttagtgataaatgggtcccatatatatttttttattttaatgccacataagcgccacgtcagttccacgcgggacaaagactaagtcaacactgccacgtgtgcgccacgtcagtgaaactgctctccaaaatcaccaagggagtcaaattgcatcagttttacaagttcggggggtcaagatttctggtattgcggttgagggatacgatttagattcggtggtgagttgagagagtcaaagtgatcttattccttttggcagagaccggcccagctctctcctctcgaaccgtcacctcggcgccaaaacttaaccggcccagttccgtgtcacctctcgcgcagccgcgccacagggcacaggcccagcgggacaccgagcgcgcgatatcgcggcccagccgctcgtcgccacacgaaacccacacgcagacgcaacgcacgtacggggaggggacggctggtttcgttcgactcgacttggtcgcgctccagcgaatgatgtgcgatcgatggagcacctgtgatacgttttgtacgcacgcaggcgcagcggatgagatgaagttgcattgcaccgataccaaaccccacgggatcgaaccagcaaacccccgcgtgaaggcgtgatttcgtggcggcacgtccgcaggagacgtgagcaatgaacggtcgcaggcgctgatcagcaaagaaatgagctttctcaagccaatttgcgaacacaatgaacggaccgagctcctaacgagcttgtgccagcctgtgcctctcctgaggctggagcccagccaaacagtttcagcttcaacagaaataggagcggagctgggtggagcattctcgcaaaatgaatagagaggtggagctgggtttaggctgctccacaactccactccaaacctaattcctgaagcataatttaggagttgtaactctactaaataggctctaagctcgcgagcttttatcaaagttcaactcgagctcctaacgaacctagcaatatattacttttattatttatttgacaaactaatagatcaaatatgtcattagtatgcatccacaaagtgaagtgtcttgtgtttatcttattatttttttttctattttggttattgcgatcaaataagcgaacgatcaaacgttggacatgaaaaaacataactacacttatattgggacgagggtaatattttgagacagagggattactacccatggggccttgcctgcccaatggcgagcgacgtgtacaccgtatttgccgcaggtgtagtactccctcgtctcaaaaaaaaaatcaatctagtcctctcctaggacaatatatgtggacacccactgtatccacatacatcaatataggaggggtcacatcccctattaagtacttgccactgcccattgctgtcacggcctgcagcgttgaccaaatttatggcccagtgtacgatggagacatgatttttgggctctgacattgaccaaaagtccaaaaccctcccgctacgtgaggcatcatgcatcaatcaatcaaatcaatcacacagaaccgagatatcgcgtggccgtgccatgccaccatatccttgcccaagtcaactcccgctccaggtgggtagtggtacgaatcgaccacgaaaaagattgcgtacgtgcaggtgcaggcgcgcgcagctgctcctgcaccttcggaccgcgaaaccaccgcggccacggcacacgacacaagggttagggcgcgagtcatctcgagagaacgcggaagcaaaaacatgcgtacgtaggcagggcgccacgagacagggatcagcgacaacgactacttaaccatcgatgagtagtagtagcagcaaatcttcaagggcacatctgttactgcagctaagctccagggttcaacgacatcatctctcttcctcctagcgtggattgagcgcaagtgcgcaaccgcggaagcgactacagacagcatctcgagcatggcaacgcttcttgctcttgcatcttgagtggaaggacaggttcaagtgcgtgtttcctgttgaacagtactacattggtcgtggaaggataaaacatctaagatataagtggggagcccctcatctcattggctagctttagggtgggaaaagccctttacgattctacaattggtatcggagcctagctagttcaacatctctagcccgagggacatagtaagtgaaggcctgatggaccgtggggggtggggggaggacggtgaagggctaagggacaccaatgtgtgaagggtgagattgttgaatagtcccacgttccttgtggaagggcaaaggatctaagatataaggcttctcacagtgcaaggcacgcaatagagggcttagcccaaaaaagtgatccaaagacactcaagcccacagtgcaggtatcttatttcgagtaacctaatgggataaagctacttttgaagactacaatgcccacagtgggcgtaccctagcacatgggggcactggcaggcgaaggaaattaattcctcacctacccttctcttcctcgcgacctcgccccttctctttctctcagccgtgccgcccctccttctcctccctcccgcaccgccgcccctcctcacctcccatgccgcggcggcgcggcctcggtgtggcggagctcgagcggacgccgccgcacaacatgcgacggctgcacatcgggcgcggcgacggcgttgtcctcagtcccgtcgaccgcgccgcctcctccccatcgaccgtgccgcctcgtctcggtcgaccgcgccgcctcgtcctagtcgaccgcgagctcgcctccttccttcacgcggcggaggtgaggaggaggaggaggtgggggagtagatccggcgggtggccaccggcctcgccgctgatcctaaccccgccggtgccgccgtggtcagctccatcatcaatcgacgtggcggcggacgggtccgcctttcccgccgacgggggcggtgggaacggacggcaccgaggatgaagagggtgagggagaagggcggaagcgggcgagcaggaagcgggcagcggcaagcttgagggcgacgaggagatgactccgatgccactgagcttgggctacgacgcgccgatggagcccaggcttggaggtggcggggttccctagtcgtgctggcggccgacggcgtggtcctcttgtgtgattcctcttgtgttcttgtgtgattcctcttgtgttcttgtgtggtcctcgtcggcgtggttctcttgtgtgattccccttgcaacgtcgtcggctcgccgccgcgatctgttgattttgcttgctgattttgaggattctcgacgcggctgaatcggtggcgggagaaggaaatcggtgtggcgggatcgccaggaggtataggcgcaaggtcacgggagggcgaggagacgcagcccatagcgcgcgttcccggggatttcggcgtcgcgcgctccctcacttggatcaggttctgcgctcctctgtttggggattagcaccctaggatggtatcgctcgctagctccacgtcggcccgaatcctatgtggcacaacgagatcacgcgccagctcaccgcactgtgagaggcctaagtgggagagcccatcacctcattggctagtttttggggtggaaaataccctttacgatcctacacttccaatcaattcagacgtatattttagtctatcattttgattctgaattgttgcattctattttatcgcaatccgatgccgtggactgttgtgacgttcaactcgattttcggcagtagtgttattgatttacgtaaaggaattacaattgttgtgatcaaaacatctcagaaaattaatggtgtttgtatgtggtctttgttaaatttctggatcgtattttctggttttaactcaatcccgcaagcttatgttcctgttccgaattgttcacctatcgatttaatcaatttgtcagtctgaattttgtgtgcgatgattagtctgtagttctgccctttgcatgctctgctgcctgaattctgtggaacctaatgggccagatatttccatcaagacaggggcaggccaattttttacccggtttccaagtggttcccaagtaggaataagttcatcggaggtctctcaacttaacagcgagatttttttaggtccctcaaccacaaaatcagaaatgttcgcccctaaattcattcaaaccgttcaccggaggtcacttggcagtatttttgcccgttttactgacgtggcatcctagtcagcaaaaaaaaattaaaaaaattcatatggcccacatgtcagcttcacatatctctttttctccttctcttcagtcttcttctcctcctcttcacttttctcttcaccggcggagcagcggtgggcgagaggttcggctgctggcggcgccgaacagcgacgcaagagaaggggagggcgtcggcgacggcggaaggtggccggagaagaaggtcgccggcgagcgcgctcctgctcctgctctggctgctgatgcggccgggaggtatcgccgatacaggggctcgtcgttggtcgtcgtcacgggaggtatcgccgtgcgctggggatgtcaaaatgcagagagttcgtgtcttagaagacggccatgagcttggcttctcccagcacatgcccctcgatggcgtccatcagcttgtccttgatcacctgtaagcaatcaagaatcaatcacagttaattaatccttaaacagcaaagatactcgctaaaagattgttcgatcgacttgccttgttgccgaggtgcacctcgtcgtcgaggacgtagagcttgaactggatgcggttgatgaactactgtaccatgtaatgaggagcgaagcgcaatnngaacncccct

SEQ ID NO: 62397 - DNA, 5206 bp, Oryza sativa
ccgtgccactccatcgccgcgcctcccattgcaagccgcgcgcgcgtgccgtggtggccgaccgcccggttgccgccgccgtcagcctctgcacgcgcctgtcgccagtgtcgccgctccgctccaaaccgccccgccgtcatcgccgtcgtcatcgcccggccccgccactccgcgcgcaagccgccaagggacggaggcagcatccctcctccctctgccgcgtcgcccccgctcacctcctcctttttcccgaatcggcaaaggggcaagccccctttctccccctccttttcccctttttcctcctcgccggcgtcatcctccctgttgccgccttggccgcgaccgccgagcgccagctcgcgcccttgaccgcgcaagtcggttcccaaaccgacattgccgcccatttaaaccccagcctcccctttcccttcctcttccattcgcctccgtgccattgccgccgctcccgtgctctgtctcgcctccgccgtccatcgccaagcgccgggagagccggtgcgttcgtggacgcggaaggggactccgggcgcgccctcttcttcctcttcctcggcccgaggccggagagatcactcccgcgccgtcggcctctcgtcaccgcgcccgtcccgcacggtagtgcctccctccgttcttcctcctcgctccatctcccctccttagctttcggtagtagctcgagtagcctccccgaagttagccggcgccgccccgaccgttgccgtcgctcgccgtgtgctcgccgccgtcgccgcccgagctcggaagcgccgctcgtcgccggcctcgctcggcgtagttccgcccaatccgacgctagcatcggattcccgtaaccgcgtagatgctctcgccgccgggaattagcccctagtgacctcgtcgccgttccccccttctcccgccgccggttgccgccgccgcaatccgccgccgtcgagcaacccccggcaaatccgagccgttggttcgtctcccctcatcacgaacaaccgcccggtgtgctagcttttgcccgtatcgccgtagttcgctccgccgctcgccgccgccgcccgctgtccattcgcggccgggtcgtcgtctacctctcgccggcccgcgtggcagccacgtaggcgccacatcggcgccagctcagcctaaaccgggtcgagccgaccccggtcagtccctccccgtgcgcgcgttccaccgcgagccgtgaggctgcgcgtgggcccgccgcacctgcgtccaccgcgaaccgcgtgcgtgcaccacgtccatcctccaccctagcgccgcgccgcgtgctccctccgcacggtgagccgagcagctgacaagcgggtcccacccgggaccgcgcgtggtgagcccggtccaccggactctctctctccttccaccgcgcgcgcgcgtcttgggccgccttgggccaccttcttgggccggccggcccgttaagctcagccgagccgccctttctctcgggccgcgccctaaccgcccgagggaagtctatattccctccctctccctttttcttttcttttcttttccaaaaaggatttaattaaatccttttcctttagaccaaaaatccaataatcttagaaattcaatatcttccccaccgtaaatccgtttgactccgttcaacttccaaaattccccaaatctcgagatctatctaatggcacgcttagaggtcattaatagggctttattttcgccgtttgttgagttgtcccgtttcgcgtgtagtttcggagcccgaagacccgcagtgcgaggatttcgaggatcaagctctggatctcgagcaaggcaagccacctttgaacatcttgagcctatacttgaaatttaattatattgcttgcaaaatattatgcattgataggatcacacttaatctgttgttccgtctgcaaggcagattggcggacctgcctaatttgttgcatttgatccttcctttgttaattgttataccatgtccccttgtaaccacccagttgcgcctcgatattcgtgcactctgtgcgagtatcgacggtcgccttcaaacttaaaatctgagaaacaacttgggtaaaacttgggttttacaaaagacttggaaaacccgacacctgggtcggtgcttgcgaactaaatgaatttctaaaaccgcggaccggggaacataccgggtgtacggttttcccgctcccgcacttaaggaccgattccttggaattacatccgaacataggacaagtgcgaccacatgggtggaatgggacacccctggctgagtaactagcttatcaggggagccatgatgccgagagacatgtggattcgccggggtggtgtcagagaggacccctgggcttcctggcacagtatggtctaggacctaacctgttgttggtctgggacccctctcgtcggcatatggtaagcctgtgtcggctttggaaatgccttgtcatgaaagcttggaggtctcccgacgtggctgatccccacgggctgggtgatccgggttagtaatatcgtgtgggtaaagtgtaccccctctgcagaggttaacaaactgttcgaacagccgtgcccacggtcatgggcggatgtgaggtgattcctagcgtagttttgtttgacaactgcttgtgaaattactgttgtgaaaaagggttcgatgtttggaaaatcagcagctgacgggatcagctaggcccgggtggccacttgaaaagttgttggcccgggtggccgtttgaaaaactgttggccgggtgccaaccttgttctaagatctaaagattgatacattgcacatactctgaccggacgggacgcactgtctcaaccgtgtcgtttgagaagcactcacctagatgtttttagaaaagagttcaaataaaatcaattacgaaaacaacagccttcccttgaagcctgcattaaacacttatttcccctggcttgctgagtactcccgtactcacccttgctctatataaataccccccagttgctgatgaagatgaagcggaccctgctgatgaggagttcttccaggagcaagccggttacgatgacttttagggtttcggcctagttcccaagtcgcgcctgtgttgtttggtccaagtcccggcttccgtttcccttttgtaatgcagttgtgagctcgggatctgtccacagcccaacatgactgtactcctactctataataaagagacctctgttgctgtgatattctatcctcctgtgataccagcactgtttcctgggactggtatcgattaacaggttaatttggagcgtcacgggctaattccagtcgggactagctcggggcgtgacatagagtatactcatgtctcttgttatatttttaatacaatgtaattattttaggtgtgtcgaccgagtttttctctcttttattaaaacaatgtattgtctttttcgtgctaaaaaattcctacaattttttaaatttgaaagtgtggacaaagagggcagctgggcctcacagttaaccacatttaagacgcacgcacagaaaagatcttcttcaacattgcatcatccaccctgtcgattgaatgctgaaaacaacaattccagcttgggcataattacaggatttcaaacttactttattaagtacattgttttgtaatggcaactaacccgatatgtacattggccgttgaaaaccacacatccacaaatctaataaaacgcaattaaacatcatcctgtcgtacattcagcgtgattataaaataatgcaaagaggctgatatttttaacctgatgatgatcagatcacattacgagcactgcatgaaccatcaaaaagatcatcttgaattagtcagggtatcagagaaagccaggttacggatggctatataggacaaattaacacggcgataattacatagtgcgacgcatgcttttgcacatgattctctaaagaagaagaagaaaaagaaatgctcagcgatgccatcggctaagctaataatatagttaatctaactaatttttggctaacactatagtctaattattaatcatgggtgatgtggtgtgactggaccagagcatttttgggtggcatcggaggtagatctttggggtggtagctgattgtaactagtaggtgtagtacatgttcgatcgatatctggacttgttttttttcagaggaaagaaagtgagatccagctaactagtattatagtacttttaaaagtattttttatatatatgctatcagtttgttagcttttgcttgttgctaaattaaattattgtagcctgtaatggggaaaattattagcatttatttacaggttgtttatttgtgcagatcaattggtgttcttgtcctgcagacagatcaaatgattttttttatgagagaataattgattagtttaatttgctacggcagatcttcctcttaagaaaaattgacctcattatcatttctttaatataagtcccataatacaatctttgaagaatcaatattactaactatataaccaatcattagatattctcttatcattagtgtatatgcagaaaaatgtacagattacctgctagctgaatagatggcaacgttatcagccgtatcaggcaaaaataattccatcatgggggtttgatgaattggtcaggaactttgaagggaatttagtatttttcctaaaccccaaatgaaagtgattaaatgatgttctaagtcaatttatcacgtccatatccaggactaaataaactgatcttgcaccgatgttccagagcattctccttacctgggctctgaaactctgaaggtagttgggatatttgccatgacttctgaccttctgtcctgttgatgttgccccggcccttccccgttagcttcttcgttttcgatgaagatgtaaacaagttggctgacttagcagttgacacaatcattaaccattaacctcttgttcttggctgctctctgaatggtatcaaaattttttagacggtttataactttatatgatgtcaatcacatggttcttgaaaaccagcggttaccggccggtaaccgtccggagttgacgatcagttcgagcaagtgaccaaaaggatatggttgtttttaaaattgaattaagaactattttgt

SEQ ID NO: 62398 - DNA, 18118 bp, Oryza sativa
aatataaaaagagtaaggtgtggtttgtaatgcgtacttaaaattatatgaatatagatctgcgttgcctacttgtatcatcttgagtttagatgcctttgatatttgactgcagagtgttgaagaagcagaatgccgtagagcatacgattctgctgcagaggtctatctttcagcttttgatcgcactaaacaagctgaagaagtaagttaaaaggtttattcagtatatagcacatgctacaaattccattatgccttaactctgcatttaggatgctttaagggatgcacatgaagctgctttaaggaaggcacttgaagcatatggtaccgttgctgttggaactggcacttcccgtatgcattatgagaaagttcttagcaacttctgcagaaaaacatttcaggtatctgcagttttactctaattattacatcgaatctggtattgccgttaaacataatctgatgttgtggaatcatacatatcgaacaagaagttaatgacacccttagtcattcacataaataacaagagcaccgttaggtgtaaataaaaacatttcttaacaatatccgctggtttatttgatcatggactatgatgttgagaaagtaagtttttttgtcttttatatgtttgtttgccttaaatgttaatattaacatagttaatagtaatcaagtggtaaaccttgttaagaaagcttcaacttgttttcattttgttaagctcaatcaactattcatcctattcctatctaatgcttaattcctctaattgatatcatgtactagcctttgatttatatgctggtatattcaacttttcgtacccaagaagtgagttgagaacattcctttagcgtgacagaatttcaattgagttagtgcacaatttgatattgattattttttaggcaatgtgcataagacttgtgcatcattgttttaagattgaacggagcaaagttgtcacacaaccattcacccaaggcaaacagaacgacccaaaatagaaaagaattagcagctactccctccatccacaaaagttacacctattacttttgtcaccaagaccaaggaaaaattaaatcatcttggatgctacaaaatggaggagtgaatgcaagcatgcaaccaatgagtatttagatgactccttggattctaatcaaacatttaatttatctcttcatttaaatcttgaatgcataaagactacaaataggaacaacttatttggaaaaacccaaatgtgaaataggtgtaacttttgtggatggagggagtatcttgcaagagctttctgcgatccactacatgattgttacatttgttattgatataagatccaacatgtagaagtctcaagccctctaaagattattttgtatagtgtatatatctctatcttgaattcttgattaaacattgtgttgttgataaaatatcaaataatagggtatgttataatggatgcatcatgctgcccccacccccaccccccaccccccaaaaaaaaaggaaagattaccttcattttataccaaatagctaaggatatgatatatgcctgtaaaattaattgagattcttctgtgtgtcattcttcgtatgttcccaaatattgcattgtggcttactgatgcctttggttcttattcctgtggctcatttggtttcatggacttacatttgtttaggaatacaaaaggaatgcctttttagaagccgataagcagtgctcaaacatgatacaaattatggagaggaaactccgagcagcgtgttctgctcctggagtcaaagtttctaatgtgattcaggtatgtaccgacatctatgctcctttaaaagactccaatggtgatggtgaatgacatctgccatcacccagcacaactgccatgtgatacccctaaatagtgagtaggtggactcctctatagacagatgtacaaacacatttaaaagcagctatgtagattgacatgcatgtaaaaattatgtgaaataattagtattgagtacaatgggaatatttttattatgacttttggggctttagagcatacagtgggggttctcttgtttaaattccaatgcaaaagcacaggcatttagctaatgacatggatgtttgcttgtggccatacttacttttaagtatgactgtcaatgatccaattaagctaatttgctactattattttattctcgatactccttatgttatttttcacctggtgtttttatggcattaacagtgtccaatacacaccgttgaccattgctttaataattttatgttcataaaaaacagtaaatacactgatgtcagtaaaaacagtagctttgatggaagcttttgtttcctaccgtgacattctttcatggaagctgctctggtgttatttcactctgtatatgcactcaagcagagaccacgttacattttgcaggtcctggaaagtttgctcactgaatatgaaacttcttgttctggcccaagcaaatggagaatgcttgcagcctttttaagacagtggtttgttcctgcccctacctaattgttttaatgcttgcacttacagatattttgaatttgcttttgtctggagatgaactggatgagaatctacaatacgccacctatcttttggtcaagtgagactatacaaaatattatttttctatatttagccaccttagtttctgctgacttgatcaagttgtttgtagaaatttgcctgctgtctcaactgtcccaacaactgataactttcatggtagttatgttatgttgttgaatttgaaatctcgaatggcaattgcatgttagatcatgtgttgagtggtgcaatattagatgctccatacccaaactgtagaatataattgtgttccagtcaattaattgtggtaatactaccgtccatctagtgcaatacagctgtagtaatttgttcaggaatccatgacatcaattattttcattccttctctttttgtaaatctattgtcaagttaaagttaaatgggtaattctggattttcattgtgtgttatcaagcctgttaattaaccatcatttgaatatggatcctttggtcaactggtcaactagttgcttagcaagcatatctaaaagttactacatctttttcttgcagtttggaaggacccatattggatctctgccttaagttagtaaatgaagctgaatcagagaggacttccttcgcattgaaatatcgttcaaatgaagatcagcttgagcttctaaaaaggcaacttgaagcaaatgaggcccataaatcggaatatctaaaacgatatgaagctgctataagtgaaaaacaacgagtttctgaagatcacagtgctcatcttgcaaacctgaggaccaagtgtagcacactagatgagcgctgcttgagcttgtctaaagaacttgatcttgtacgccatgaatgcactgattggagagtgaagtatgagcaatatgttactcagcaaaaggctgagcaagatggattcatttctcaactagcaactcttgagtccagatatagctctgcagagggaaagttgggagcagcccgtgaacaggcagcggctgctcaggatgaggccacagagtggagggataaatatgaaacagctgctgcacaagctaaagctgcattggagagattagcatctgtgcaagagcaaattaacaaaattgcccatgaaagagagagtggtataagggctgagtttgcttcacatctggaggaaaaggtaggccgtacccacaacatgtttcatatgcttgagtaagacggtatatatgctgatagcatcttaatattgacaggaagaagaaatgaagagattagttgcaaagatcagacatgcagagagtgaagaaagtgtgttggctgagcgcttgcaggtcacttaaccttcatcactacctttcaaccacttcatttagttgatgcatttattgtatgagtgctagttttctaatgctgacatgttttttcaggtagcggaatcaaaggcacaaagccataacaaggaaactgcagccttgaaggatgaaataagagaactaacaggaaaattagaatttctaagagacagggcggtatcatttgaaaagcaagcaagaatgcttgaacaggaaaagaaccatcttcaagagaagttcttatctgaatgcaagaaatatgatgaagcagaagaaagatacaaagctgcagaaagggaagcaaaaagagctaccgagttgtctgatgtagctcgaaccgaggccgttacagcccaaaaagagaaggacgaggcacagcgcttgtcaatggaaaaattagcagtgattgaaagaatccaaagacaagttgacagactggagcaggagaaagtaaatctactggatgaagtgcagaagatgcataaatcggaaacagatgccttgtccaaggttgccttgcttgagagtagggttgccgagagggagaaagaaatcgaggaattaatgatacagagcaatgaacagaggtccagtaccgtgcacgtccttgagtctcttttgtcaacagagcgtgcagctagagctgaagcgaacaagcgtgcagaagccttgtctttacagctacagtctacccaaagcaaacttgatgtactccaccaggagctgacatcagttcgccttgttgagactgcactggacagcaagctccgtaccaccactcatggcaagaggttgagagaaaatgaagtaggcatggagtcggtccaagatatggatattgatcgtccggagaggagcagaaagagatctaaaagcaatactagccctctaaagcatttccaatctgaagatggcggttctgttcatatgggtgaagacagtgtcacagtcagcacagacactaaagatggcaatccagatgggtataaaaagctcacgattgcaaagctgaaagaggagcttaccaagcatggatttggagcgcagttgctagagttaaagaatcctaacaagaaggatatacttgcgctctataagaagcttgtgttgggcaagtaaattacccccggtatctgcagaaatgcttgaccttatgcttgctgagctgtgtgaagtatgtggtggaagcgtttcagtttgcaatgtgcatttactgtttattagtacatagagtagcatgctaccaagtaggttatatttaacaagagagatgcctgattgtttagggcatttggtggtcctgctgattcgattgtatcttggtgtaaattgatcgatggttggtttgcgattaggattgcgtttgctagtttgtaattgtgtgaagattgctaggcttgtacatctgtgctaatttgacaaatgtagtgtttggctggctatcaactatcgcctgatcactgcccgatttgccgtatgtgttattaccactgctgtttagtgccggcgtaaatgttggccccgtatgcagggtaaatatatctagtgcatacagatgtgataagatgccaggcgcaaactgtggactggtatttgcggtaaccgggtaagcagggcgcggtgaaaatgacaggctcttcgtgcagacgttcaggcagcaacaccgcaacaaccgaaaatgtgcatgtacagccgtacaggtgtagactgatgacagaaagcctttggtttcatataataggggaaatacatacatatcgtatgtatttcaaacaatattctagctcctccaccaactgttccgtcgtcaacatgccttgagattagcccattgtcaacatggtttaagattggcccagctaggacgagaaatactcaaaatataaccaggggtaccctctgcagtccagtacaaaaaagaaaaaaaaacagagtttggaactgcggcttcattttgatagcctctgctcagtaggagatggcacacataagcacggcatgttgacacagaattatctattttgatgaattattctgccaaaattgacaattttaagttacaaaggtggaataaccagaacccacaaaaaatgagtctttggatggtattcacatttcccagcttaacatctgattggtctccccagtgcacccaaaaaaccagacaacctaacggtatattgtgttcctcaagaagctagtagcctcttaatttctgatttctgctcagacgtcagccttgaggggaatttgatgttgaacttgatcctaagatttcccttctttgatggatccttcggaattggcatgccctctcggagaacaacctcctcgtagccagggtagacgacattattgattggtactgttaggttccgaccatctagtgctgttacctgaactgtacatcctgtcaaggcctcagccaaggaaatcttctgtgtcatgacgagatcattcccctctcgtgtaaacagatcatgtggtttctcatcaatcacgaatacaatatccgcaggaatcacatgcggagactcgttacccttttcaggaaaagtaatttttgtccctttcttccatccaggttttatgtcgattgttaggatctcctcaacaaccatggttctcctgccaatgcagaaatacgctagtaaggcaccaaatggaagtctattgcaaagtatataaaaatggcatatcaaatattgaagacaacacaagataaacacagaatgaaacagactggataagagcatgtcccatatgacaaaaaaatggaaattagtggaaggcaacagtaacactcaaaataatccgaagcatagtactaaatagcggccactattgcagtagcaggctttcatagtaatttcaagcccagtcaatttcaataattacaggtcctagacaggttaaacatgcagaaatacaaagttgatggtgctagcttgcacatgcatgagttttctgctgttcctgtgcaactaagatataattgtttatcatgaatgtagctatgcatacataccagatcatcttccagttctacttatgattgatgtccttgtatgcagtgtacttctaatacatgtcttattatgataaatgccatcgtatgttcatggttaagttaaacttatgatttatgagtattttttatagtccgctttaggaatgtaacgccgacaatatcccccacaatccgctacaactctgctatctactttttgttatcttgatcctaacggaataatatgactcatactcaaccaagagaaacagaaccacaacacaaaattatgtttggccagtttgcgaaatattaattgagtagaaaccaaagcaaaatatatctttgatgtggtgacaataagaaactgctgatatttgtaaatctaataataagaatttctataaaagttgcagaaacaataacaagcctcgctaaattgataagccaacctcatgtcatgagtatccactgtattaaataaagtgttccacttgagtggtgaaacaattatatataaaaaccaagtgtttcctatgtacgaaaaaatcagaatgagtgaaatgggatgatgacatttgggccaattaggcaatgcctgaactttaaatggcttccaaaccagttgttgcgcttaaatgcaaccagaacaattacgcaacaaatctttgtccaataggtttttaacttccaaaaacaagtccatttggtcaaaatggaagacattaatgtgtcaagatgcatatccaaaatccaaaaaccaccttacggatatggccacatagtgctgtccataacagcgtaatcctaaacaatgagggcacggtttcacgttaatgcagtttttcttttatttgtagtatagctcatcaacaactgaaactgaaaacaacattttggtatattaacacaatgagtactcaaaagtgaaaaatctgtagcaatactgcattaatataatggtagatgaaaaatcaattgtgtccaataatatgggagattataaacatatcttatatttttgaaaatgatattggtttaacattgacatgtacacatttgactctgtttctcagcatatttttaatttacacaatattgaaagaaatataaaagatgatgttgtcaaaagtatgatataagaacacctatgcataaatgtgtccattcagcaacaatttcaacatcatagacaagatccatcaacatgctgatgaccaaatgtacatagaaggctagcggagcactaacatgggatgacttgttataggctatttcaaaaacaatagacgtgtgaaaccacccacctgaatgagcacaaaactactatttcaatatcaagactaaagcattgcgatatcaaaggaaatatgtcaagtttatagtcctagaaggaaatataacctgttgaacagaagtcctaacgaactctatactatcaccattagtcactacattctcattcatccctaggcaaccaatttgacaagggagtaaaaggatgttgatatctccttaatctgattcttaaaaaaaacagcgctttcaaggtaatgatgatatacattagacctagattgtgacatctattcaattgataacaggcaaccataatcatgtgcaatttgccatattatcaactagtgtgcagaactttacttttgtacacgccatggtaattcacataattcatagaccccacttgaaatgctaaaatgcttcgtacttttttatacatactaaacgtatgccacatacatattcagaaaccaatccagtactgaacaaggaataactttaaaatgacatgataatagagctaattacccgctagaatctaatatttcccgtgaaattttcatcttcttggtggtgcctttgtacaagtcagctagattgcaaggcagtcggttctcaattggtgcagccttctggggccgttggggagcatgcattgatgcctcaccagggaactgagagaaggacccaaatatatcattgtcatacatcccaaactttgatccccgcatgcccctgtcaacacctccacccataccacccatgccacccatgcttgagaatgggctggaaaatccgaagaactcagcaaatatatcatccgcgcttcgagggttgaaccggaacgtcgacccatcacccccatagtatgaagacccaccaggcccacctgctccaggaggtggcacctgccctttgagcccctcttctccgtactggtcatagactgctcgtttctgggaatcacttagcacctgaaatcatgcaaagaatatgaattataccataaccatccagtcaataataaagtgcataatagggttccaaatttccagtatgagctgcatcataattagctcattaatacctcctgcagcaatttttgttctaaaaattgaatataacatgccattccctgaagttacaaaacatacgtaaagatcaaaaagaacagtgggcaaattccaaaataacaaagaaggtggcacaataacatcagaatccagaaatacaaaaggccattgttcccaacctaaggtcaaatgttccatattgttgcatgaaatgaatcgtctcttgagtaacaaaggcactacattgctctgtttggatcccacaagcaccgggaaaaaatgcagcattttcagatcaaacagcattgctttgcagcacccagatcttcctaccaacaacatcgcatcgcaagaacaacctcgtttaggtaatggcgaacaaaaaaactacttcaatcggcgagcggagaggaaatgggggtaagattgatccctctcgtttaggtgcaccctctataccagcccccattcttggcggaccaacatcaactagggagcacaccgggcgcatatatacagatcagaggcgcaaattcgcgaacgatggggaatgcgcatatagatacagaagaaggtgttgtgacctcgtaggcctcggagatctgcttgaacttggcctcggcctccttcttgctgttggggttcttgtccgggtgccacttcatggccagcttccggtacgccttcttcagctcctcctcggtggcgccccgctccacctgcagcagcttgtagtagtccacccccataatgaatctcctctcctctcctctcctctcctgcgcctgcctgatgaatctcgcaacgcctctctctctctctctctctctctctctctctcctctcctctctcgcggtcgaggagcggagatgcggtgggtgatggaggattattttttcttttcttttccttttgcaatctcgacgggaggagaggaaagaggaggaaggacgcagcgggagggtgtccacgtcacgtcggttttgccgacgcgagggctcctctgggaaaatggattggcatgtgttgtataaaagtcattgctgtgttgggaactttggacataaccatttctttagattttgttaatatgtactagtgctatattttgggtgatacatgtcggtgagatttggcttattatcttttttaaaaaaaaagagtttggatgttgtgtcgataatgtttaattaagtcatattagtacaatactagcatgttacaatgggaaaaaacaaaattgtaattataacaaagtatgtagtataggagatatgtgataacatcatcatgatcatcttgagaaaaccatttgatatatccatgaatattctcgtgattttgcttgagatagctatttccccgcctattataaatcaaaatatttttccagttgaaaacttagttttatagtagctagtactatatgctctagaagtgtgtacttatcaatatataaatattaaatatgttcaaatgaagacatatataaacattgttttgttaacttcatcacaaatgatcattctcggatcgcataacaataaagtttcattacatatgttcctttttctactcttgaagggttttgtatttgttttcttacgatggcgtgctctaatcgtcaaacaacaaaccaagtgcattgcaacactcgcgttggataaagtggcacatatcggtgcagacattcataaagtagtgtttccttgtcgaattgttatgctacgggaggaatttcaagaatatataaaagaaatatgaaaataaaagttagaaattttgatgtccgcattaataaactgcattactatgggatagtatttttcaaagaacaaatctttgtatttatattgtccgggtttgttgtgtaactcccattaaccttaagcatctcacacatgtaatatccacacactacggtctctcggtggttgctcgtcctgtctttcaattattatatatgttattatagaactttgggcataaccatttcttgattttatggtattatgtagtactattatgttttggattatatatgttggtgagatttggcatgttatctttttgagtttggatgttgtgtcgatattattttatgtcatatgtgggcaagatttaacttgttattcttatagctcaagtaaaaaaaataagcatgagccaaagtctaggcttgatgacttttgatctcgatctaaggctcaccattagcctgagttttgaaggttgatagtcataaaagagggtatttggatttattagatgcttctgttgtctatagtaatggcatctgatagtaaactctaatcatttgagctgtggttgataagtcataggaaaatatacgatacaaaataatttattagtaagacttttgtacatatattatttgtggtttaaaattcattgttggcaatgaaaacaaatcaattctaaagttaagtttcacaatttaaattttggttacaactaataagctaacacatacacgataaaaagcccaaatatctataccaatcgtgggtccaatagaaaatgaagtaactctaaataaggaatcaatttattttattaaatccatgaaactacgtaaaggaaattcctaaaatttggaaagtaattatctcccaatataggtcaatggaataagccaccctttcaggaaatatgaaaactaaatccaagttcaaatcatccacacacaaactcaaataaaatggtaactctaaatatattcgctctttgggcccaatcctcattccccatcttttcttcccttttgtagtccaacccatctgagcatcatcccccctcccccctcccccaacctcctgttggaccggaccatcaaggcagcccggtccagctcgacacggaatggatcatcgggctaccaaatgtcaaaagacttggatccccttcaaggatgatataaaagcatgtacaatcttgcatttagagagggttctataaaagagagaagatgatagaaccgactctatacactataagattattttcagccactcctagcttagggccaaccaccggccattgtattcttgaactcacatgccatatgccattgctctctgaaatgaatatatcaataccacatcttccttgtgttaatcacagtgggtctcactctccatggcaccctgtggttatatacattacagaagttttcacaaagcatatatttttgttatgagatctacacatagtacgttgtctataaataaacactacatatgccctaaggtactcagggagggtattacttatcaccactcaacaccgtatttaccacctccacaccagccatctccactccactccacctttaaccatgtgtgggtagagcaatgtagtaacacccttgtcaacgaatacaactgatttaactattgtgtatatatcccgaaagagaaaaaaagtaaaacaagagcgaaaaatgttccgaaagaaaaatatcaaagaaaaaagagggcctcatcatttgccttataacttatagaccaatgccaaaaattaaaatattgaagttgattttaatatttattaacatagtttctttttcagttttatttttaagttgtcaaggacacatacatgaaagctttacttataaattattttttcactaataaactgatggagacttcgtgtaagggcattttgctagttaatattcctagttaccaatagaaccttgctatacgtacgacttctccatccgactggcgtacgaccaaaatcagtggcgatcctacgtgtagtttctcgggatcctcgaaccccgggtaaattatccaattcttactaagttatatcatgttaattagtatacaattaaaaaaatagataattagtacgtattgaacccccggtaatttctgttctgggttctccactgaccgaaacagcagagcagcacaatacatgacggcgtgaggcttcatgtgatgtatagcatgatgttgatgccgcgcggcactgtttgtttcagcttaagattattgaactagattactataagctgaattataaaagctaacatagaataatctgtgagttgtttgtttccctaaattataagctgtttgttagttgttagccacccaataatctaaaaaaacacctttagtggattgctaaattatatagtaatctggcttatagattataataatatatcataataagctatatgtttttttagcttatttctaataattcagattataataattctaagctgaatcaaacgggtcatccaaaaagtcagacgctccggtcgtttgtgtagcattttcgttactaatattagggcattttgctagttggtaccgatataaaattgggcctacactacaaaaccagtgtaattcagaattgagcccacggggcaaccattctgctccgcccgtacccgtcgcgtccacctctccagtccagtccgccaccgcgccaccatgaggatcgacgcggcgatcctcgccgccgtcgtcgccttcctcctccccctccgccttctctccctcctcgcccgcctcagcctcaccggcagcgccggcgacctccgccgtccctgcgcggccttcgcgctctccgccgcgctcctcgccgccatcttcgccctcccgcgcgaccacgccagggagtgcgccgcggcctccgtcgtcgtccccgatgacggagagggtgccttccgcggcgaggtgcggtcggatatcgagcagctgaagctccagctcgccaggctgggtacgtggggactggggaattagcggcgacccatacccctccatcgattcttttcgtggcctgagaaattaatgtatttttaatatcgcgtatgagttctctccaatttcttctattcgtggcctgatctgtgtggtcaattgctgaattatgccgcgcgcacagagtctatgtgggataacaattcaaaaccattggatgggaaaagtggtcctttggaggaggatggagaggttgtgagagcaatggggctggatattcagtccctgatcaatgagcatgagaatatcaaggtatgatgttcttttaggatttgtcatatcaatttccataatccatagttctgtaattggttgcttacagagttacggtgtcaaaaattacggtctacacatgcatgatgacggttcttgatcctcccattaagaccagtgattgttttttattagggacagttctgtaacaaggagcagggaaacactcatttctttgtctgattgtgtaggaaggaagaccaaaacaaatgactaaaaataggtcacttaattagtaataccatgcgcttcacttagcaacaaaacattacacatatatatatacaaagttacatttgtattttcgtacatctatggattcgtgcgcctaggaacaacctatacctggtaccttactgtcattctgataagttgcatttcctacttttggaattttggttaaataacagaatgcttacaaatcatgcattggtcttttgtgccttccaatcttgtaggaatcactttgtggctcatattctgataatactatcaaggcaatggaaaaggaggttctctctctctctctctatctatctacatgtgtggccccgtaaaattgtgcacctttttctttttcaactatgttatgtgtcaccaatcaccaatagaaacagttacattaataacatgtataaagtttctcaagctgtccatattcaatgtttcttcatacaaatgtatatgcttcattgagaggattatcatgtcttttttctgctagaacattgagtttgcagtatttgtgttacatacaaactagaggatactgtttctattcttggtctttattttcagccagagatcttatgtaagataaaaattcctatttgcattgctgaaggttgttcttgagcatcagcaacctcattccaatcgtgaatgaagctgttacactcaaacgccagtcccttgaactaaattaggttaactaatattgcaactggagtaactaaccgcattatttggaaacactttaagagtacatgagtatggaaaaatggattacaaagtaaatagtgacattttgtaagcatgaagcactgaaaaacatcaaatactagcattcatctaaactgaaatgccatatgatctggtgaaacaatttctgagtaagttaagaaacctacacataaaacgtactaccagtaatgcaacttgtagatttatgaaatattttcccttgcctatgattacactttataatggttttaatatctcccagtattttcaatcactaccggctgcaaaccaatcagaaaagtacgggtgatgtaaaatttccatgccttcccttgcaccaatgagcatatgctcatagcatgcttagctttgtttgtaccaatcttaggttatttatgttgcccttgcacaaaatgaattactttgagagcccttcattataattattatagtataatatattacgaaatctggttcaaggtgatcatctcatggatattatgattacagattcaaattctaatggatgaatcaagaaagatgaactccaatattcacaatatatggtcaatggcaaaggatacagataatagagtcagcgctctgcattcagatgttaatatggtaaggttatcatcagttttgattgccatgagtaactaccaattctataacattttattaatattagtttttgatcatgcatttgatttattgtgttttttcatctgagattagaaacctcacatttgaatacatttttttaaaaatgtctttcaagcctaaatacatatgaagactcagtattgtgctatcttatttggtaaataaatttgatgtgttgcaatattgtcattctgaatgttctagttcaatcttgatgtgttacttttctgagctattatgatttttttgggggtggaggtattttgattaattcatctcatcagcattgtgataaaaggttcaggttctaatggatgaatcaagacagatgaactctaatgttcgtgaattatggtcattggctaaggatacagagagaagagtagagggtctacattcagatatgagaaaggtatcactatctaggttattatttattttgattgtcttgactcttgaggttgttagaagctgcattgtactgttcctttgtgcatataatttatttgaatttgttatatgagagtagaattttaatttttcaaattcaagcacgtctaaatttatactcttgttttcacaatgtttgtctatttaattaggatatggcattttagagtgcttgtctatcgagaaaaccaagagtttagtcataattctactctctacccttaacctaatgcatgaaaggggttgagtcctaattgtatcatgccgtttaataagggcaatgtaaagccgttctgtagttaattcttttatgttaaatgccaccttggtctttgtgaatggtggcgtatgatgactacagtgtcttgcaattgcgctgacactcaaatattcaatggagggaagaggagaagagagatgagaacttgtgaattcagtgaccctagctgtaagcttgtacataaggtctcattgcatgaactggtagttgttgctctcgatattgttttctggccatgatgttaccgataggcaatagtgaggtgttctatgaccaattatccatcgacagcacgattgctcctccaagctatgtttcttttagatcaaaggcttttgcgcagctttttactaacaaagcataacgattgttctcctccaagctatgttggaattctattggccttttttgccattctatttgccttcaaatatcgtcatgatgttaacttatatcctacacatgaaattaaaatataagccgcttttgttgtttgtacttcctccgtttcatattataagactttctagcattgtccacattcatatatatgttaatgaatctagacatgtatgtgtgcctagattcattaacatctatatgaatgtgggcaatgctagaaagtcttataacttgaaacggaggtagtaatttatatctattctctccagtattggaagatttgatctgatttcctatttctttcttactatactactctaagtgatcatgatggtataatatgggtttctatgctttttaatttttgttatatactaaaaagtaaaaacattagaaaagtatagttaatagttaaatgtaaatgtgtacatttttatctacctgtgccatatagcttttttggcatttagatggtcatacatcacgcatttggtgttttgactttgacaactgggcaagaactggttcctattattggggctttttcatcattcaatctctttggattccgaaagttggtcaaatttttataataagggtcccatgattaccggtccaattctaattggtgaatcaagaaaaagggagttctgatttacaaaggtgggcatttgcaagcctaccgagaaagggtgtagaactatatttgagtgtaaaaagtaagaaatactttcctaaccaattgtaatcctaaccttttcacaaataaaataaaaacctggggcccctgcctatcttttgtttctttgcgcttccaaaacaaaaaataccctgaaacattttccacttgttaaaagagggccccaacaattgtacacatctttaagcttgggcaaattaaaaaattgtattct

SEQ ID NO: 62399 - DNA, 1404 bp, Oryza sativa
  unsure (1)..(1404): unsure at all n locations
cattaccttaaaataactatagtgtgtgcaaactccgtagtatccaatacgtaacttaaaatattgaatagggaggatatctagtcctctgtcttttccgaattttttcataactatttatgtactttacaattggaaagagattagagcgccctagttatcatttgagtagtattactaggtcaacctggaagctagtggcagtgtgagagcaatctacacggcaggaatctgcgaaacatcaatctgatgattctttggctgtattcagattggccagtgtaagcttggccggtacaatgagccagcagagctgcatggttttggtaagagtctttggtaattggttaattagctcatagtttcactgaatatttaagcagctaatgatcatcctgatcacatgtgtacatcaatccggtattttccagaaaattcagaggtaaatttattggagcaaagcaattctgcatctctctactagtatccaacaaagctcctgcaataacagttaagctcgacattgacacttcagattacaagattgattgatgaacaagtcattctgatgtgtaatcttgctaaggagagaaaaaaactgggtaggaatatattgcagtgaaaacgacgctatataattgacaatctgaaggcaacctcttcatatcttctttcccactagcacacaacacacgaaaatggaagcgccattctttgagcgtctcaactggcgaagcgatccttttgctggttggtttccaccatggtgtgaccgtcctttgtgcgattgtggggatggatgcatactcaagtcttccctcatgatacaaactcggggcaggagattcttccaatgcgcgaactttgatcaggtatgcttcatctattcgaagttcaaatggataaaaaaactaacttcttcgtacacaattgtaacatcttacgcagacatatcgtccaatgtgcaacttcatcgagtgggtagacatggagaacccacaaaacgacggaacccgtgcttacccacgtagtgaaacaagatcggactacctaaggcggaaggatgagcatgaacgtcgaattgctgctgaggctttagaatggcacgtaaatcccctaggactccccacgtggcgtgagcgtccggagtgtcgttgtggtgaccgttgtcaggtcataaggtccgtaaggcaccgaactcgaggacaaaggtgtttcgtgtgtccaaacattgtcgacgatgatttcgtggtaattacaactattcttttcatcactcctcagtactatcattaacttaactatcccaaaatgaatgtacatnnnnnnnnnnnnnnnnnnnnnnnnnnnnnnnnnnnnnnnnnnnnnnnnncgaatgatatntagttttcaaantcaacccag

SEQ ID NO: 62400 - DNA, 8345 bp, Oryza sativa
ttagtcattagcatcaccctacaaggattaatcgcgcacgaaaaacgagacaagtcattagcacataattaattgaatcgtaattattaaaagtttgaaaaatggatttatttgttttttatagcaacttatatatagaaaattttcgtacgaagcacactactttttaacagtttgagaagcgtgctaacgagtaccgaagaaaaaaaaatctttatcttgttagagtttagaaggagaccagcttttggactgaacggtttgcatcttgctcttgcgagcacgcagcaaccacgggcgcgttagtgcgttacgttggtacgctgcgtacgcacgtacgctaggagcaaacacggcgccggtattgccacagtgggggcagtggtgggctggtggccacttgttgctgctcgcggtcacggatcgcggcgaggctgggtctgttcgtggatatttagattttgagaagtggcgtgtgggaatttaaattgtgagaatatacaaaaaaaatcagttccatggactctgtaactatatcttctctgaacgaaaaaccgatttgtttaggagaaacttttgattctggagaagatgtaactgtctgaagctatcctaaacaaaccgatatctattttgggacgcggaatattttatcgattttctcgtggaatttcatatggaattcctacggttttttgagatgcatgtgttcattttcactcctatgaatctatgatcaactattaatcacttctgcttgctgaattattgcagtctgcggcaggataattaatggtttacgtcttcctgcactgtggttcagaatctagcttggtggcgatatcgtccccaagtcccatcactctaccaccaaaatgctgctacaattttgaagcattagaaattagttcaagatctacaagtttcagacttgaacttggcgtcagcaatttcttgtcacgcatgggcctagtttaggagagtaagcgggccgacatgataatgtttcatgggctgatctaaatgggcctacaggacccatagaagaacgggcctgaagaattgtttaggcagagaactgtcggtcgaaaatacagtaaaggcttcgcttttctagtcccaaataccctgttctgcgattgctagaattgtgaccttaatagcctataaattctattcgcgatagcactcgtaattccatctaataacaatttcgtaccgttagaaaacaatttcgtacccttaaaaaacatttcataccaaataggcagatccgctgatgctacaagttcaggaaaatggatggcgaatgcagattgcagataaacaatgtttggagggacgtctctccctccaaatctcagcgttcccggataaacatcctcttcgtgtctcaacatttactctcatttccccctttctttagagcagaaaaccatctgattactagtgaacaggttaacatggtgcttgtcaaaaggctgtgctactgaaaattgctgagcacttcagattagtaactaataaccatatcttgaccgtttagccggttcatctgctactgaaatatactcaatattctacaccatgcacataataggggaaaatcagggcagaataaattaagtggcatcaatagtagtcctacagaagaacaaacaacacaggacgaattatttactgtacgtttaaacttttttgtcacctttcaaccgatcagacaataacaagtatgaagaaagaaataaaaaatcatgtgcatctttcacagctagctgaaaagcctgaaaatgatgcgcagtgttatctcatctaagtttaaataaaccgagagcttgacatgccagattatgaaaatgcgaagaatactagaaatcagttatgatactatgtagcagcaactagaatcctgcttagatcgtcagaagagatgcagtagcttaccccagccccatcttggacagtcaacaagcaactgaagcagacaacattcagttgcttgttgacaattcactgtcattcttaaatccatttgatgcagagaatacttaattcttactgctaattaagcacattatgcactaatgcaatccaaatcatggctcatgggtcttggatctcgtaggcttatcaaactaactgttccagatgcttaacagtccgattctaaccgagttaacactagtaatcaagcgaccaaccatgaaccatctcatgaacaattgaccaactattagacaaaatggtgctacaagttcagaaaaatgaatatgcagagaaacatcctctccgtgaatttaacaaatttaccactcattctgccctgtttgcagagcagaatatcctctaatcaatccttagtttgtacaaattgtcctctaatcagtactagtgaacatattaacaaaagcctgttatctctaaatgattttggcgaccaagaagccctctgctactaaattgtactcaacattctacatcatgcacacaatctaggaataaatcgtggcacagaaagtaaattcagcaccatcagtagtagcaatctatagaagaacaaatgacattcagacgatcatacaacatcgcatgatgaaagaaaacataaacgacctgcatctttcacatctagctgaaagcctgaaactgatctgtgaacagttaacaaactgaaatttggcttcggagaagaaattcagctacattgcaaatccatttcatgcaaagaattcttctatcaagaaaattaagcacggataattgggcacattttctcattgcattattattaactgcataaacaatgatgcatagactcaatccaagtactgaaagccaaaacgttgctgcattcatacaaatcatcagaccagagtccagagatcacatcacatgcattgcgttcatgcaagtctgactcagcaaggagaattatactgattgatcgagaattatcataccggatcaggaagactacatcatccacccaaacaagaggagaaggacatctcgaacaaatcaatagcgaatcatacctgtaccaggacgatcaaaactaacatgagcaatctcaggggagaagccacgccggcggtgagtagtccgacgggccttgctccggcaagaacttgtccacacgcggaacccccgccgcatccgccgccggtagccacttgccggtgtctctgcaggggtatttccccgcgacggcgcgagaagcgaacactgtcgactcgcggtagagcctcccgtcatccaggaagtagacgccctcgccgaactcgtcgcccggatagtcacccgcgtcgtacgatctggagcagcctcgcgcgacgaacagcatccgctcacccagcgactccagctccttccagccgtgcagggccttgttccgcttcctcggcggcggctgcaccatctcgaacaccttgaacgccgatgtcgtcggcggcgcggcaagaggagcaggaacgcgcctgaccaccatgaggagattgccgcgggactccaccaggtagcgagcaacgacgtctccgccataatcgcgccggccacgccagaagcgaagaatcaccctgggcgccatcttcatgttgccgtcgccgtcttcatggaaatcccgtgctgtgaaaacatggaggtcttcttctgcggtgaggaaaaggaaggctcccttgtggtgtatgacatcctccagagctggctcgtcgatggcactagggccatgccccatcgccgcaacctgatcctgggaagcatttgctgactgaacgcgccagaatgcgtgagtgcgtcgagcagcctggaagggccagtaggtgatgatggcggcggcgacgcaatcctcgtcctccggtggcgaagagagcgtcgcggcgagcatgatcacaccagtgttagggacagggccgtctggccgccccaattcagcagccgtcttgtccgggcggacaaaaaaggggaggttgaagcgcagctgatggtcgcggaggctgaggagcgtgttgcggcaggtctcgccgaggaagatccagccgccgtcgtaggcgccgaagcagcgcgcggcgcgcgcgccgtccgggacgccgaggccgtgcccgccgcagccgcggagggcgcacgagaaggaagggccgtcggcgcgcgggacgaggatccacgggagcgggcggagatgcggcgcgttctgcagcggcttgacggcggcgcgccagtcgtggcagacgcgggccatggtgcggcggtcgacgaggcacgtgaggcggttgtggacgaggcggagggcttccgccatgaagtcgcgcgcgggcgccgccgcgtccatgggagaggcggaggcggaggcgggggcgggggcgaggcgtggaggtggcggtggcgagggttgggcggcggcggaggaggtggaacgcgacgaggacgcttcgtcgttgtgcgccatgtttgaacttggcttctggaagcaggggaagagaggggaacagagtggattggtttggaagaagaagcagagaaggccagccttttgccagccgagcaagtggttgggcccaatttatagtgccggttttcttgggcctgaagtttggatcgctgctctttgctgagcgtttcttcttgggcctaaatgttttttttttttgagaacgtaaagttcggatgtacatatggtgcagaatcgtgtctagcagacaggagaaacaaatgggagcagggaaggttaacccttttttttttttttgagaaaaggcattcaagcaggttaacagttcagatggacagatggttattatcctacaggaaaaaaaaagagaaaaaaaagatagaaaaagttattggtccaatgaggtcatcatctttagtaacataggcacacatgttttctgtaggcgatatggttaatcttttcattagtgctgaactgaaggatgctcagttcacagctcgtcctttacagagagaaggggatgaggaaatgttgatacatacacaggatgcttatctctgaattccttgttcactttttctgaacttgtgcatcagtctgatggtacaacaaaaacactagattagacgctcgccaagccgtgcttttgccgaaaatatacagacatggcacccatccgacctcaaaacaaaaatatgcatggcagagctggcatcacaaacgaactcccagtttgaattttaaattcccggaaggtcacttatgaaaaagaaaaagtaaagccttcataaattttagcccatttatccgcctcaagatttggggcccaagaaagctggccctataaatgaggcccagtcccccatcccccttccaaaccaagcacatctcctccttcttccagaagcagaggaatccatcggttccattcctcctcctcgcctcgccaccggcaagccgcgcctccgcctctccaatggactcgccatggcgcgacctcgacgccgacgtgctcggattcatcctcaagcgtctcccgtgcctcgtcgaccggcgccgcatggcccgagtctgccgcaactggcgcgtcgccgtcaagcctgagcagccgcggccggggacgaggccgctcccatcgatcctcgtcccgcgcgccgacgggccttccttcgcgtgcgccctcgccggctgcgccacccacgccttccgccccccgctcccggccgacgcacgcaccgcgcgctacttcggcgcctacgacggtggctgggtcttcgtcgccttcggccaaatcctggactacgcgctactcagcctccgcaacggcacgcgattccacttccccgacacgggcacggacatggtggccgcgaccctctcttcgccaccggatgtacgatccacgcgttcatgtacgatccacgcgtgatgtacgatccacgcgttcatgtgttctggcgcatggagcatcaagttgtggagaaggcgactgctgttgagttcgtcaccacgtcagttctggaggatgtcatacaccacaagggaagcttccatttcctcaccagggaagaaaacctccatgtttttcctgtagcgggcttccacgaagacgacgacggcaatctggagataccgcccatggtggttcgccgcttctcgcgtggtgggcgagattacggcggagccatcgctgttcgttacctggtggagtccggcgagaatctcctcatggtcgtcaggctcgttcctcatcctccccaactgccgccggggacatgggcgttcaaggtgttcgagatggtgcatgagacgcccatcaacaacgacggggcaccatacgcttggaaggagctggaatcgctgggtgggcggatgttgttcgtcgcgcgaggctgctccagatcgtacgacgcggacaagtatccgggcgccgagttcaacgagggcgtctacttcctggatgacgggagactctacgatgaggcgttccaaatcttgaatccctttgcccagttcccctgcagcgacaacggcaagtggctgccgccggcggcggcggcggcggcggaggcggttaccggccgcgtggacaagctcttgccggagcaaggcccgtcgtactacacgccgccggtttggattctgccgtgagactgccatgttcttagttagattgtctgatgacttgttgtcgtgttgatatggtttgttgatttgtgcaatcgatgatgtgttctcgagatccatgtgtgcttgcaattgcttgatccatcatagcatctcttcagtactctgctattttcaccatgttagactaatgcagaaattgttggttctcatgactcagattgcattaattagtgaatcattatattgcaacgaacaatgattcagtgtgggggatcctgttcatgccaatttttcaggctaatcctcctcttccctcgccgaaagtcgcttaatcagcatccacagtgacagttatgctgaatcagcttgattcatgtcgaatttcccatgggtcaataacttgagactcgtattattttaattttctggagtctgtgagttcttatcactttttgtttattgagttccagactgaacagtaaagaatctgcaagtgatacatcgaagtcgtagtgaactgccaaaattttctcgtggttattgctggtgattaaccaaccaaccatctaaattttaccaacattttcttaccatcattcacaagatcctgagtgcaaattcagaaaaatgaacgggcaatgcagagataattatcctcctctccgcgtgtcaactttttctctcatttgatccactcttctgtagagcagggagggcagaagaacatcataatctgatcagtagttcagtactagtgaacagaataccatgacgcctaacatcaggctgtgttactgaagtaatgcctaaatgctgataactttgggtgaataaccatctgttaactgtttaaccattcttcacaacgttctaccttatgcaccgtcccgtactgccgaagcgccgccgccgtccgagaagggagaggcggtgtagcgaaaagaggggggggggggggaagggacgcggacgacgacgacgacatggagatggcgcggagctggaggggattgcctgcacgccgccgccgccgatccggtggggaagagaaaagtgagagaagggagagagagagagagggggaggaataaaggatgatatgtgggccccacatgtcagtaggtctcacatatatttttttaaaattttaatgctatataagcgtcacgtggcatgaagaccagatcaacacccccacgacaacaaaaccacccttcaaaattgctagagaattcaaattacactggtttcaatagttcggtcttacccgatattttagttaagggtcacgaattagatttgatgaacagttaaggaagttaaagtggatttttttccgaaggtaaaatgtctttctacatttgagcccattaatcttcctcacggggaagatgcacttgggggcttggggcccaagaaagctagccctataaatgaggcccagtctgatcgcatgctggcccacccaccctcttcttccaaaccaagccgtcatctccacccgcttccagaaggaattttttcgtttttagatttttttttaatatttacagaaataatctatcgaccaaaaaaattgcagaaatagcccctgccgcccaaatggtgggcggcaagctgacgtagcagacggtgggtcgaccgcgccgtctgccgccgtcggccaaaattgcgattaggcccttgccgcccatacagagggcggcaaggggctaattgtaattttggccgcccattcagagcttgcggccatactttttcatctggg

SEQ ID NO: 62401 - DNA, 30987 bp, Oryza sativa
aagcgccttcctcgaatatcaggattcctcgaagccattagttggcatcgatcaccgcataggcagagaggacgctggcaccaaggtggtagtaggtatacacaaggatcgctacgccagtttggatcctcaacaccccggcgtctagccattgacgaaagccggtcggatttgtaatgaagcaagtggggaagagagtactgaatgtgactgagttctgaaagattgtgagggctcactctcaacaaaagcaaatgccaaaggcaatacctgattgttcccatctacccctattgctgttagtatctggccccgatactttcctgtcaagaatgtcccatcaatgcagagaacaggacgacagttcacgaatgccatcttgcatgcatgtagagctaagaacgccctttgcagcacactcttgccaggatgttcaattgaggggaatttcttcacttcgtaagagctcccagggtttctttcctcgataacaccaagcaggcgtggcaaattatcatacgaggcttcgtaagttccaaatctcatctctattattttctgtttggccctccaggccttggcatagctaatagtatacttgtatgtctcttcaatgtgtcggattattgaccttggttcatatgtgagattatcgatgacatgcgcatacatctcagatgcaacaaatgcacatgtaatgttcatgtggtatttctgaacactaggtagaaaacatgtatgcttggtaacaactgacactgtccaataatccttccatttccccttatacgcgtgcactctccagggacaaccatctttttccttaacacaccgaacttcatattgcgaccggttcgacttggcaacccaaaactctctatgaagtgacactgcaaaatgttttaccgcctccttcatatcttctgctctactataaatcgctccctgaataacctcattttctttgtactcccatctcacactatcctcttcagagacgatcagcctagaaaaatcctcactagcccattctgctggattaatatccgtctcatcatctgacgaatcaacttcctctacacgctcgttgtcagaatcctccctctccatttcatccacaatggcaccgacagtctccccctcgtcagccactccacctggttgaatgcccactggagctactacgcccccgtcctctcgtgcgttgacctcctccacagaagtctcgtttacttcagcacttggtccctcgccatcatccatgttcgtctgcacacctggatccttcgggtgaacaaacggaaccaaagctagaggccacccgcgttgcaatgcattttccaaataccatctccacactcgagagttttgaactggcattagttcccaataaaaaccctcagttgcccgacttactataacattgattgttatgtcacttgtctgtggatcaactctcaagcccctcattaaccatccttttatagaaggtacactcctctcagccggtctctcaattcccctttctgatacaataaaatctgacagatctaccccagttggcccgtaacggacgtttcctggtccatggtaaacttggaatatttgtttgttcgacatatctgtcaacgaaataactagatcatattactctttcatgcaataaacatctacaacgtaatatcttcttgtgtaagccaatgcaacggtaatgtattaattccaaactagcagatctacgtagttaccgatatctacaatacgcacttctagattagtacaactaaaaccctaaaaatataatgcatttattcaaacaaatttttaaagaatacacactatttaactcaatagtcacatataggatctatgaatattacctgaaatcggcgtctgaatccggcagggcttcgccccttcttctcttctcctcccctctcttctttttttttcactggaattgaggagagaagaatgagggctgggggctgggcagcaggccttttataggcagcgaggcctgccgcccggccagagggcggcaaggggccgcctgcaaaatagccggccccgactggcttttttgcattcgggccccttgccgccccaccagagggcggcaagggttttcctgcaaaaaaccctccctccgtcaccgtccgttcctcccccgtttgccacgtcagcttgccgccccagaggtgggcggcaggggctatttctgcaatttttttggtcgatagattatttctgtaaatatttaaaaaaaaatctaaatccgaaaaaaattccttccagaagcagaggaacccattccccacacacacacacctcgccaccggcaagccgcgcctccgcctctcgagccctctccaatggacgcgccatggttctacctcaacgccgacgtcctccgcctcgtccacaagcgcctcccgtgcctcgtcgaccgccgccgcatggcccgagtctgccacaactggcgcgtcgccgtcgcgccgcagccgcagccgccgccggggacgaggccgctcccgtcgatactcgtccggcgcgcatacaggacgtccttcgcgtgcgccctagccggctgcgccacccacggcttcggccacccgctcccggccgacgcacgcgccgcgcgctacttcggcgcctacgacggtggctgggtcttcgtctgcttctaccgcaccctggactatgcgctcctcagcctccgcggcgacgagaaattacccctcgctgacgtcgagacgctcacggacatggtggccgcgacgctctcttcgccaccggacgacgaacactgcctcgctgccgccatcggccacagctgcgtgatgtacgatccacgcgttcatgtgttctggcgcatggagcatcaagttgaggagaaggcgactgctgttgagtccgtcaccacgtcagttctggaggatgtcatacaccacaagaaagccttccatttcctcacgaaagaagaaaacctccatgttttttcggtaccgggcttccacgaagacgacgacggcaatctggagataccggccaaggaggttcgccgcttctcgcgtggtgggcgagattacggcggaggcttcgctgttcgttacctggtggagtccggcgagagtctcctcatggtcgtcaggctcgttcctcatcctcccctctttccgccgacgacatgggcgttcaaggtgttcgagatggtggagacgccgctggggactcccatcaacaacgacgaggcaccatacgcttggaaggagctggaatcgctgggtgggcggatgctgttcgtctcgcgaggctgctccagatcgtacgatgcgaacaagtatccgggcgatgagttcaaggagggcgtctacttcctggatgacgggagactctacgatgaggcgtcccaattcgtgaatccccttccccagtacccctgcagcgacaacggcaagtggctgccgccgccgccggcggcggcggcggaggcggttaccggccgcgtggacaagctcttgccggagcaaggcccgtcgtactacacgtcgccggtttggattctgccgtgagactgccatgttcttagttagatcgtctgatgacttgttgtcgtgctgatatggtggttgttgatttgtccagttaatcgatgatgtgttctcgagatccatgtgtacctgcaattgcttgatccatcataacatctcttcagtactctgctattttcaccatgttagactaatgcagaaattgttggttctcatgactcagattgcattaattgcatcattatattgcaacgaacaatgattcagtctgggggattgcatcattatcctgttcatgctaatttttcaatttttcaggctaatcctcctcttccctcttcgaaagtcgcttaatcagcatggcatctaccgtgacagttatgctcaatcagcttgattcatgtcgaatttcccatggaccaataacttgagacccgtgttattttaattttccggagtctgtgagttcttatgactttttgtttattgagttccagactgaacagtaaagaatctgcaagtgatgcatcaaagtcgtagtgaactgccaaaattttctcgtggttaatgctggtgattaaccaaccaaccatctaaattgtaccaacaatttcttaccatcaatcacaagatcctgcatgcaaattcagaaaaatgaacgggcaatgcagagataatcatcctcctctccgcgtgtcaactttttctctcatttaatccagtcttctgtagagcagggagggcagaagaacatcatcatctgatcagtagttcagtactagtgaacagattaccatgacgcctaacatcaggctgtgttactgaagtaatgcctaaatgctgataactttggattaataaccatctgttaactgtttaaccattcttctgctactaaaacatacacaacgttctaccttatgcacagaataaaggaatacattgtggtgcagtaaataaattcagtagaatcaatagtactccactaagattcagacgattatacaacaacagaaccgagcaactagtatcaagaacaaacaggtaaactatcggcatctttcacagctagctgaaaccgatgtgtatcagtaatttggtaaacttaacatgctacattatgagttaggaaaatatgtagcagccatcgaaaattctgctaaaatccactgaagagtggcactacctcagcccatcctggactgtcagcaagcaactgaaattcagctaacttatgaacaagtgaatagttaattcagttaggaacatgtgtagcagccattgaaaattcagccaagtccatcttgcactgtcagcaagcaactgaaagcaggctgcagaagcaaattcagcttcactgtaaaatacatttgatgcaaaacatgcttctatcctgaaaaataagcactgaaaattacacattgcaatcttaccgactaatgaaatccaagccaagaatggcaaccattgtaattcatgtagaattcatcagatcacatattcatgctgagttgaatatactgcattcattattcatgtaattctggcttgcatactctttctgatagaagaggagaatttaccaagtacaatctccactgctccagcattgtagcagctgtaccaatccacgattatgacatcaaatctggactgaaactacactaatcgatcgcagcaagaggagacgggacagagtacaacggctgcaagctaaaccacatctcgggggatcgaatcgacagcaagcaaaaacctgtagctcgacggcaatctcaggggagaagccacgccggcggcgagtagctcgacggggcttgctccggcaagaactcgaccactcggggattcgcctccgccgctggcaaccacttgccggtgtctctgcagggatactcccggaaatcgggctcaccgagcatcaactcctcgtcgtagagtctcccgtcatccaggaagtagacgccctcgctgaactcggagcccggattgttgttcgcgtcgtacgatctggagcagcctcgcgcgacgaacagcatccgcccacccagcgattccagctcgttccaggcgtatggtgcctcgtcgttgttgatgggagtccccagcggcggctccaccatctcgaacaccttgaacgccgacgtcctcggcggcaattggggaggatggggaacgagcctgacgaccatgaggagattctcgccggactccaccaggtagcgaacagcgttgttttggccgtaatctcgcccgccacgcgagaagcgatgaacctccacgggcggtatctccagattgccctcgtcgtcttcgcggaagcccgctaccggaaaaacatggaggttttcttctctcgtgaggaaatggaaggcgtcgtcgtggtgtacgacatcctccagagcgtggccgctgatgacctttgcaggtttcgccgccttctccggcgcagccgcagattgacgccgcatgggccagaacgcgtgagtgcgtagatcgtcaatcaggaaggagaggttgatggcggcggcgaggcagcgttcgtcgtccggcggtgaggagagggtggcggccaccacggccatgccgatgtcggggatgtggagccggtcgccgtcgcggaggctgaggagcgcgtagcccacggtgtggccgaaggcgacgaacgcccagccgccgtcgtaggcgccgaagtagcgcgcggcgcgcgcgtcgtccttgagcgggtgggcgaagccgtgggtggcgcagcagccggcgagggcgcacgcgaaggacgggccgtccgcgcgcggcacgaggatcgacgggagcttgctgcgctgcctctccgcgacggcgaggtgccaactgtggcagacccggcccatgcggcggcggtcgacgaggcacggcaggcggctgtggatgaggcggatcacgtcgtggtggagcgactccattggagaggaagcgaagcgaggtgaggcgaggcgatcgattgcgacgatgtggctgcgtgggattgattgctctgtttctcgaagcgggaggtgggagatgggtggctttggtttggaagaggcagggggttgggctggggaacgaagctatcagactgggcattatttattgggccagttttcgtgggccccacggttttactttttcactgggccaatagggccagcctgctcgatatttcaaaacccatattccaatgtactcgtatcataatctctcaaattcaacacgcattttttcggagtaaaacgaaacagaaatactgaaatagggtgaccattgctattctgcatcaaccgggtgaacacaaattattcagaatcaaaatttcaaaactcaagcagggagatgggtgtcaatgtgtcattctcggcaaaagcattgcttggcgttttaccatataggtactgagaaaggggaaacaaccgtctgaagaacttttttttggtggtaccactaccatcagactatgctacaatttcagaatgaccaaatgagcaaccaatttttcctgtagagcagatgaccaaatgagcagaacatcctctgttcagtagcagtgaactgattaatgaaacagttatcaacatacatgtatctgtgtggtactatactgatagtaccactgaatttgtttttcccgtgccacgatctattcctacagaagaacaaataacacaaggtagattatttactaccccgatgcaactgatcataaagcaactaactagtcctatgaagaaagcaaagataaacgatctacttcttatacggaaactgaaaatccgtttgatccgaagcactgctgcaaatatgcaatctaagccattaacaccaaccattttctggacagcaactgaaatcatgaagtgaagtattgaagagatgttatggcagatcaaacaattgcaagtacactgcacacatggacgaaacatcacagactgaagtaaccggacaatcaacaactgtcatatctgaagttcagaactggctcaaagaaaaaagttgctatgaaacaactagtatgaagaaagagaagagaaacaatctgcatgtttcccagcagcaatttgagaagcccattaaaaattcagctaacttatggaaaagtgaatagataataaagttatgaaatgtgtgggagccattgaaaattcagctaactccatcttggactgctagcaagcaactgaaagcagggtgcagaagcaaattcagcttcactgtaaaatccatttgatgcaaaacatgcttctatcaggaaaaataagcactgaaaattacacattccattactattgactgcaatatcattgctgcatagatgtaattcatcagaccacactgcatttctgctacaaaaggagaatttactaggtagctccagcatagtagcaactgtaccaaccgacaattatcacaccaatcttgacggaaacatcaaactgttgactgaaactacactatagcacatttcagacaggtgaaactaacatgagcactctcaggggagaagccaagccagcggtgagtagttcaacgggccttgctccggcaagaacttgtccatgctgctacccgccgccgccgccgtccacttgccgttgtctctgcaggggtattctggggaatcgggagccaagaacgataacccctcacggtagagtctcccatcatccaagaagtagacgccctcgttgaactcagcgtccgggtagttgttcttgctgtacgatctggagcagcctcgcgcgacgaacagcatccgcccacccagcgattccagctccttccaagcgaatgcgggctccttgtcgtggatgggagtcctcgtcggtggctccaccatctcgaacaccttgaacgccgacgtcctcgtcggcaagagaagaggatcggtgacgagcctgacgaccatgaggagattcccgccggactccacgaggtagcgaacagcgacggctccgccgtaatctcgcccgccacgcgagaagcgatgaacctccacgggcggtatctcaagattgccgttgacgtcttcgtggaagcccgctacaggaaaaacatggaggttttcttctcttgtgaggaatttgaaggctttgttgtggtgtatgacatcctccagaactgacgtggtgacgaactcagcaggatcatgagtcgcctcctccgcaactcgatgcctcaggatcccgaatgcatggattcgtggattgtccatcatgcaggaatggctgatggcggcggcgacgcagcgttcgtcgcccggaggcgaagagagggtcgcggccaccatgcccatgctcatgtcggggacgtggaatcgcgtgccgttgcggaggctgagtagcgcgtactccagaattcggccgaaggcgacgaagacccagccaccgtcgtaggcgccgaagtagcgcgcagcgcgtgcttcggccgggagcgggtggccgaagccgtgggtggcgcagccggcgagggcgcacgcgaaggaaggcccgtcggcgcgcgggacgaggatcgacgggagcggcctcgtccccggcggcggctgcggctgcggctgcggcttgacggcgacgcgccagttgtggcagactcgggccatgcggcggcggtcgacgaggcacgggaggcgcttgtggacgaggcggaggacgtcggcgttgaggttgaaccatggcgcgtccattggagagggcgagaggcggaggcgcggcttgccggtggcgaggtgtgtgtgggattgattcctctgcttctggaagcgggtggagatgacggcttcgtttggaagaagaaggtgggtgggccagcacgcgatcagtttggacctcttttatagggctagctttcttgggccccaagtgtatctccctcgtgaggcagattaatgggctcaaatgtataatgggcctcatttattctctatgggcttttagatggccttttatgtagcccacgaggccatgaacgcccaatgcgagaaggatcagacgatcagtatcatgtcctcctagtctcctactgatgtgtgcaatttttcctactctgaatcagcctcgtctaagataatttttctcgtctaagataattcctaatcctaataaaaaatttcaaaactaaaacaggggagtcggttgtgacgccaactcgtcatgcctagtgttttgaggtcggatgggtgccatgtctagtgttttgtgtagcacttttttaacgaaccggcacttttgagtagcattgaaaggaaacatattgaatgatgttgaaataagaaactatgcgaagtaaaatatagaaaagactcctaactaaatacaaagtaattatattgagaggagaaagtaattttctttatttggaagtaatcactataaatattttgtaaagagtaatttagcgtcatatagaaaataactctttaggtattcaaagtaattacacacttggaagaaaataatctttttataaaaagaatagaagtaactttttatggtgttagatgtaagtacacttctagagggaagtaaaactgataagatagaagtactttttatgggattagaaaaaactttgaagaaatagaagtagcttttaacattactagagtaactatattgctagaaaaaaaagcaagtctggagaaatagaagttactcttcacggtattagaagtaactcagtgctagaggaaagtaactctaaaaacaaaataaaagcaaatatttaccccacgttactagaaataactatattgctgtaagaaagtaacttttcatggtatctaaagtaactacactgctataagagctaagaacaagaatacaattttaaaataatttaaatatattaaatattggacttgttttatcacatattttgagcggagtacaataggtcaaacggatgttaaaaataatatatctctatctctactattataaaaattgaagatgtttttaccggtattttggtaagtcatccgtatttgaatcggttattaagttcgttctattttggaaatacatatccatgtttgagtcggattttaagtctgtttgctttagaaaatacaaaagaagtcatataaaaaatttctttaaaaaaacttgtatggtcacttgagagtaaagttggactcctaattataactcatgattttctaaaaaaatattcaagcgaattcacacagtgaatttcatcccatgtaaatcgtataacaataataggattaaaataacattcacctgttgcaatgttgcaacgcacatgcattttttctagtaatttaaaagatataagtggagaagaacagcaaattaatagttatgaacttaatatgtagcatccgcttaaatggatcctgagaattgaagcaactgaaaccaatctcaagaagcaattcatcgatcttcactgcaaatcggttttgatgcaatgcaatgcattcttttaacagaaaaaacgctaagtaatgttgagtaaacacatcgcagaaaatgcattactaactacaacacgacgatgatccactaagcatgtgtttggtgtcgggactagatgggatgggatgaaaccattcatccctaattttggggttgggatgattccactcacatgtttggtttgtaggatgggacaatcccaatttttttgtttggttgaagggatgagggagaaatgggatggacgctgtttgccatcaccgtcaacgaccgttgactgcgccacctgcatccacgcgtggaacaaccggatcaagcacaacggcagcagcaagacggccaccaccgccggagcacccaacccgctggcccaccgtcgtcaccgcggctggatcgggagatcccctgcgccagatccgccgccaccgctctccctaccttcaagtttcgccgccgccgagtccccctcctctggatctgccgccgccgccctccctacctccaagcttcgccgccactcgagcccgccgcgtcgacatcaccgcagccgctctcgtcgagcatcgcgatgagtggcgggatggtgccgagcatctcgctcgtggcggcgaccagtgttgaggcagggggtcgtggaggagcgtcggcggtcgtggaggagcgtcggcggtcgtggaggtggtggcaggcggtcgtggcggagcgccggcggtcgccgaggagacactgtgtgctccgtccaagtgggacgagctcgtccggccaattttgccggatgggtttgtcccggatctgggaggaatattcctctctagagaccaacccattccactcgcccctcaacaaaacacctctaaaagtaagttcgtcccatcccgtcccatcccatcctattccaccaaccaaacattacctaatgcaatcgaactatcgaagacatgaacaccaaccaccatgaggctggccttctctgactctgcctcttcttccaaaccaagccactctgtgtctcttctcttcccctgcttccacaagccaagttcaaacatggcgcacacgattctgcaccatgtacatccaaactttacgttctaaaaaaaaaggggaacatttaggcccaagaagaaacgctcagcaaagagcagcgatccaaacttcaggcccaagaaaaccggcactataaattgggcccaaccactttctcggctggcaaaaggcttggccttctctgcttcttccaaacctcccattcactctgttcccctctcttcccctgcttccagaagccaagttcaaacatggcgcacaacgacgaagcgtcctcgtcgcgttccaccacctcctccgccgcccaaccctcgccaccatcacgcctcgcccccgcctccgccttcgcctctcccatggacgcggcggcgcccgcgcgtgacttcatggcggaagccctccgcctcgtccacaaccgcctcacgtgcctcgtcgaccgccgcaccatggcccgcgtctgccacgactggcgcgtcgccgtcaagccgctgcagcacgcgccgcatcgccgcccgctcccgtggatcctcgtcccgcgcgccgacggcccttccttctcgtgcgccctccgcggctgcggcggacacggcctcggcgtcccgcacgacgcccgcgccgcgcgctgcttcggcgcctacgacggtggctggctcttcctcgccttccgcgagaccttccgccacaagctcctcagcctccgcgacgttcagctgcgcctccgcctccccttctttgtccgcccggacatgacggctgctgaattggggcggcctgtcccttacattggtatggtcatgctcgccgcgaccctctcttcgccaccggaggacgaggattgcgtcggcgccgccatcatcacctacgggccctacgaggctggtcgacgcactcacgcattctggcgcgtgcagtcagcgaaggctttcccggatcaggctgcggcgatgggtcatggctccgatgccatcgacgagccagctctggaggatgtcatacaccacaagggggccttccttttcctcatcacagaagaagacctccatgttttcgcagtacgggatttccatgaagacggcaaaggcaacatgaagatggcgcccagggcgattcgtcgcttctcgcgaggtgggcgcgattatggcggagacatcgttgtccgctacctggtggagtcccgcggcaatctcctcatggtggtcaggcgcgttcctgatcgtctacacgcgccgccgaggacgtccgcgttcaaggtgttcgagatggtggagccgccgtcggggacgcgcatcgaggccctgtacgcgtggaacgagctggaatcgctgggtgggcggatgctgttcgtcgcgcgaggctgctccagatcgtacgacgcgggcgactatccgggcgatgagttcggcgagggcgtctacttcctggatgacgggaggctctaccgcgagtcggcagtgttcacggctcggcggcggcgacggcgatatccctgcagagacaccggcaagtggctaccggcggcggatgcggcgggggttcctcgtgtggacaagttcttgccggagcaaggcccgtcggactactcaccgccggggtggcttctcccctgagattgctcatgttacttttgatcgtcctggtacaggtatgattcgctgttgatttgatcctccgagatgtggtttagtttgcagccgttgtactttgtcccgtcccgtctcctcttgctgcgatggattagtgtagtttcagtcaacagttgcagtttcagtctagatttgatgtcataatcatggattggtagttgctatgatgctggagaaattctccttttgtagcagaaaatgttttcaagtcagaactacatgaatcgtgaacgcagtatgaaactatgaatttgtgtgatctgatgctgcagtgaatcaagaacgcaatatgcttccaatggttgccgttcgtcatgacttggattgcattagtacatcgttatgctgcagtcaataacaatgcaatgtgtcacttgcagtggctagttttcctgatagaagtatgttttgcatcaaacggttttgcagtgaatctgaattgcttctgcgtcctgttttgagtttcttgctgacagtccaagatgaactgaggtaggctagtgccactcttcagaggatcgagaaatgcccaggggtcttccggctagctccacaaggtggtgggctagacgacctggattcaaagcctcacccctcctaattatttgatattaggtccttccctaatattctagttttttttttctcttcagaggatctgttcctatgttatgtgcataatgtaaaatgtggagtatatttcttcagtcaagaggtatttcttcagatcctaagttatcagcatttcttcagtaacacagatgataggcagcgtgttaatatgatcactagtactgatcagatgatgttatactatcagcatttcttcggtaacacagcctgatggctgatggtaggttggtaggcatcatatctgttaatctgtacgggtagttttaccatcatatctgtgttactaaagatgatgatcacattggaccaataaatctctccttttctttttcctctcttttttatttttggccgggaggaccaataaccatctgtccaactctacatgctcccatgtgtccatatgaatcaacctagtgaatccgcatgcttgaatatgaatgcattttcctcaaaatcacggcttggcgttcccagtaagtaattaagcaatgaactggttttaactgcaccattggacaggatgccacaaagttgagaaaagtaaacaatgaatgcagaatttctgaatttctgattagatcctcagaagagatttgaagcaaaccgaaagcaagctgcactgctgcagaagcagtttcgtcttccctgcaatctgagtcatgaacaccaacaatttctgcattagtctaacatggtgaaaaatagcagagagtactgaagagatgttattatggatcaagcaattgcaagcacacatggatctcgagaacgcatcatcaactgccctaactgggcaaatcaacaaccaccatatcaaatcaagacgcgaaggaagggccgtcggcgcgcgggacgaggatcgatgggagcggcctcgtctccggcagcggctgctgcggcgcgacggcgaggcgccagttgtggcagactcgtgccatgcggctgcggtcgacgaggcggaggacgtcggcgtcgaggtcgcgccatggcgcgtcgtccattggagaggcggaggcgcggcttgccggtggcaaggcgaggaggcgatgcgctattccgctgtgtgcgcgccctcgccgggattggttcctctgcttctcggcacaggaggacatggaagaagtgggtgggctaccgtgcgatccgactgggcttcatttaaaaggtccactctctcgggccccaagagtactccgtagcttcctcgtgtggcagataaatgggctaaaatgtatgaaggctttacttttttttaatcactagaaaaaggaataagttcactctggtccctctatttgtcaaccagtccgattttcgtcccttgaccgcaaaaccagatacgacccgtcccccaacttacggggcaaacgagatctcttgacagttttgatagcggttttggctgacatagcgtctacgtggctaatttgactcggtcttcatctgacgtggcggcaattcaatccgaaaaaataataaaaccgtgggactcacgtaaaacaataaaaaaatggtgggacccacgtgggctccacatgtccctcatcttcttcctcctccctctccctctcccctctctctaactctctctcctcctctctccagcctccaggcgccacggcccacggggtcacggggaggtccggcggtggcggccggcgacgcgacagccggcgtcgccggcgagctccacctctcggcgcagccgtgcagccgttcccggcgcctcctcggatgccgcgcgcgtttctgaccccgccgcggcggacgcggagcaggaaccttcttggcggtcaggatgccggacctggtcacgaactcgaccatggcggcgtgctgctgcttcgctaggacggtggtgaagaggaagtgggcggatgccagcgtcgcgtggccgcagagatccacctgaagacgacgacgcgtgcggatgaacacacagaacacgagtaacaggaaacctagggttgggggaaggggaggcaacctcggcggcgggggtgaaccagcggaggcgtccggttcctacttcctactagcagtctctgatctgcttgacgatctgtttcgcaggcgtgatttctgttcctggatctctctctgatgaatggattgttttgcgcagatcctgacactgtggtacagggctcccgaggttcttcttggcgcaacacactactccactccggttgacatctggtctgtgggctgcattttttggtatggtgaactgatattttagccactgtaaattattatttcttcaggattcatgccttgacagtgttgatatatcttgtgcatttcagctgagttggtcactactcaacctcttttcgctggagattccgaggttcagcagcttctgcacattttcaagtactgtgcctgtttcctcatcaattgttctttgtgttcgctggcaaacttaaggggcataatcgtgtattcatggtggtgatttatcttgattgtttggttccaggttgctgggcaccccaaatgagcaagtttggccaggagtgagcaagctaccgaactggcacgagtacccccagtggaatccctcgaaagtgtctgatcttgtccatggtctcgatgctgatgctgtactcaacgacgtgaacaaggagctctactgaacgtctgcacggctgcgccgagaggtggagctcgccgccggcggcggctgtcgcgtcgccggccgccaccgccggacctcccctgaccccgtgggccgtggtgcttggaggctggagagaggaggggagagagttggagagaggggagagggaaaggtaggaggaagatgagggggtgagtatgacatgtggggcctacgtgggtcccactattttttattgttttatgtgtgaaaatgacatgtgggtcccacagctttattatttttccagatcaaattgtcacgtaagcgccacgttagatgaagaccgagtcaaattagccacgtaggcgtcacgtcagccaaaaccgttgagggacctcgtttgcctggttttcataagttgggggacgggtcgtacctggttttgcggtcaagggacgaaaatcggactgaacaacgaatagagggacccaaagtgaacttattccctagaaaaatgtctgtgcgctgcaacgggtgaaatctattttaatcttatatatttggtttagttaaaatgaaatttaacgtgggagttcgcttggatatatatatttttagaaaatcatgagatgtacttgggagtccgatcgtcccaagttagcatgcgagtttttttaaacatatttcttatatgattccttatatattaccaaaagtgaacgatcttaaaaccgactcaaatatatggatatgtctacgccgccgatgcgagcgtagacgaccctggcgccgccccggaccgcgtcggcgatgcctcccagggctgacgacggcacgtgccctcgtagggtgccgatctcgtccacgaaagggacccagaagaagttgttaggaactcccaacgattatctctcaggaactggaattaatcacgaattgcgcatataagatttctcaaccccgaaggatcgagccgccgccgcctacgccaccgcgcatattccagttcttagcccccttctacttgttcttcgttgatgtttatattacatagcttcggctgatctctctctcagacagctcatgctagctggttgtttactggacccattggtcccccttgtagcgtggattgggcctccttgctcttggcccaagctggactggtacttgcttcttcttagtcttgaagtctggttttcctccttgctcctgggcatcagcttccttgtcgtcaggctccagcacctcttcctcctctgctcctccttgtatcatctcttctgtatcttctcttgctcttggtggagatggaggcctgacagaagtgctcgcaattctccgcagatagcttcggaacatacatcttcacggaggaggacgacgaggtcaattcaacacacagaactaacaagcaatggttgcaagcatttcgatgcgagttggtgtgtgcgcatacctgcaaaccgtcgccgtcgtcgccgccgccgccgccatctccaccggcataggcagccagaggggctacctcaagtagcaccagctgtccccggatgcgcgccaccacgcgacctccgccgaggccatcgacgacgtcggcgtacacgaccctggcgccgtcgcggaccgcctcagcgatgccgcgaacgtccggtaaacgcaggtctccgcggtggactcccttcgcgtcgaccaaaggcagccagaaatagaggtcgctgttgcagttgttgccgtggagaattgggacggggacgccggtgcggcgccggcggggcggagtctggggcggaggtggaggctcatggagaagaggagcgcctcccagctcgtcctccatgtcttcgagaggaggcccgaggtggacgatgtcctccgcgcgcgcgcgcgcggcggcaaagcagctcgacgaagaagagagaggcgttacggcttgggtgggcccaccgaatcggcctttcctgcttccagaagcttcgagagccaagtgcgctctgctcgctgtgcttgatcatggcggtctccatcctctgcatcagctgtcgatttgatgccgttgtactctgtcccgtctcctcttgctgcgatggattagtgcagtttcagtttcagtccagatttgatgtcataatcatggattggtagttgctataatgctggagaatttctccttttatagcagaaaatgttttcaagtcagaactacgtgaatcatgaacgcagtatgaaactatgaatttgtgtgatctgatgctgcagtgaatcaagaacgcaatatgcttcaaatggttgccgttcatcacgacttggattgcattaatatatgctatgccgcaataaaaaaacaattcaatgtttaactaacttgcagtggttagttttcctgatagaagtatgttttgcatcaaacggttttacagtgaatctgaattgcttctgcgtcctgttttgagttcctcgctgacagtccaacatgaactggggtaggatggtgccactctttagaggatcttagctgaattttcaatctctgctatatattttccttgattcatttataatcttcttccattgttcataatatagcatgccaagcttctgacattacttgtacacaccggtttcagacttttagctagctgtgaaagatgcagatcgtttactttttgtttcctgttgttgtacgatcatctggattttatttgatcttcttagggactacttgtttccgctacagaattttttttttgtgccaggatggcacgatttgttcctagattatgtgcataatgtaaaatgttgagtatatttctcttgtcaagaggtattccttcagatcccaagttatcagcatttcttcagtaacacagatgataggcatcgtgttaatctgatcactagtactgatcagatgatgttctgctatcagcatttcttcagtaacacagcctgatggctgatggtagattggtagtaggtctgtacactaatactgatcagatgattttctgctaaatgctctacttaagtgtagaaatgagaggataagttgggacacggagaggtggatgtttatctccgcattgcccatttatttttctgaatttgcagcatctgatgatgactgatggttggatactcgttactagtattaacttgattaaaattgggaagttaggtaataacttgtttaattactgttcaggccgtaactcgataaacaaaagtgatgaactgataagcactcgcatcagagactccagggtaagttcttaaccgaaaggaaattccacgtgaatgaagctattatttgagaatatgcataaggtttgcatatctttgtatgaggactttatacatcagctataagcagaaaaggagagaaaatgttgtgactagaaggatcctgctactccactccaggacctcaacttgcaaaaattagtcatgactcagcggttttctgtcgtttgacgtcgtttagacatcctcctgtcgaaaccactcgaacaattggtgcaagcacgctctaggatagagttgggctttgtgttgattgtaatggcatttttttgggcgttctcgtctgtgttcctttgttggcctagcggcggtcggtcacacttagcggcggccggtccggtgctagccttctcccgaacctgtgttttggcgctgtcggtgtgtgggtggtggtattttttttccttttttctggttacgaccttttagggttgtaatcttgtagtttttttctactctatcaaatgaacttcgcactgtcttacgtgagtcgttcaaaaaaattagtcatgactaaattaatagttatgaaactaatttgtgtcatctactgaggattctgattggatcccgagaagagaagcaactgaaaccagtctcaagaagcaattaatgcaatccaagtcatgaacaccagccattatgtaatccaagtacacacatcacacatggatctcagatgaaacattcctgtgtggataacattcactcttcacgcgacgctcaagggagagaacttgtggcccaagccaattggcccaatataaggcctagtctcatcgcttggtggcccacgcctcccacctctacttcttccaaaccaaaattctctccttccgcttctagaagtaagcagaggaatcaatccccacacacacagcgcgcctctgcctcctcgccgccggccagccgcgccaccgcctctcgccaccggcctctccaatggacgcgcgatggtgcgacctcaacgccgacgtcctccgcctcgtccacaagcgcctcccgtgcctcgtcgaccggcgcaacatgcgccgagcctgcaagtcctggcgcgcggccgtcgcggcgccggcgccgccgcagcagcgcccgctcccgtggatcctcgtgccgagctccggcggccctaccttctcgtgcgccgtcggcggctgccgcagacacgacttcggcgtcccggactacgcgcgcgaagcacgctacttcggcacgtacagcggcggctggctcttcctcgacttcggcaacacccgcggccacggccggcacggcctcctcaacctccgcaccaagtactgcatcagcatccccggaatcgtctgcctcgacctgaatcctagcatcatcagggacatggtcatgatagccgcgaccctctcctcgccgccggaagacgagcactgcatcggcgccgccatcagctcgtactggcccgggatgaatggtgcacgcatgcacgcgttctggtacatgcggcgtcaggtcgcggtgatgccgactgctagcgagggcgtcttcggaccatttctggaggatgtcatacaccacaaggaagccttctatttcctcaccgcgcaagagcgcctccatgctttcgcggtaccggagttccgagtaggccgccgcggctatctggatataccacccaggaagattcccagcttcccgcatgatgggcgtgattacgacggacgcgacgttgctcgctacctggtggagtcccgcgagaatctcctgatggtggtcaggttcgtctctgatcctccccaaatgccaccgaggacgtcggcgttcaaggtgttcgagatggtggagctggccatcaacaacggcgaggcccagtacgcgtggaacgagctgcaatcgctgggtgggaggatgctgttcgtcgcgcgaggctgctcaaaatcatacaatgtggccgattacccggggttgggttcagcgccggcgtctacttcctggacgacgacagaatctacgacgagttcacggtcctcctcgatggcaccggacggcgctacccctgcagagacagcggcaagtggctgctgggggcggcggaggcggacaacttcttgccggagcaagccccgtcgagctactcaccgccggcttggcttctcccctgagagcgtgctcatgttagtttgatcgtcgtggcacaggtaatgtttgctgccgatcttgttgagatctgcttagcttagagcgagttttaacagttgctattttcattagtgagctgatttggcggctgttgatttgtgcagtaactacaatctatgatgtttcattcgatttcgagccttcgaggcccatgcgttcttgcaattgctcggtcatgttttctgtaccttctgctaattttcagaattgcattagtgcatcattgtattacagtcgattctgcagtgtgagaatgcgtttagttaacaccagcacttggctttttcctaatctaagcatgctttggatcaactgaatttcaacgaagatgaattgcatttgcattgttaatccttacaacgggtgctacaaatttcatactatgcagtcattttcacctgttcataatttccaacaggttctgaatttactgataattaacaatgagatgacatatacaaggagtattaatattgttcttaaggcttgctattacaggtatgcttgctgttgtactctatagtccgtagcagaaaacgcttccaaatcagatttacatgaatgcaatttgatatctgatctgatgaatttttttttagataatgggttaaaaacccggcctctacatccaacgggatgtacacagccaaccaagttcagacataagcattgaagctccacccattacatgggtaacaaaaacaaaataacttggaccacaaaaagagtcaagaacaaccaacaaaacagtaaaaccaccatccaggcacaccacatcaaacagacacgaagtgccaacctaatcttgaattctccttctgaagttccagccatagttggagtagaactctaaaactctcatctctaacattttgcagtattctttcaccaaagtgccatcctcttccttaagcaacaaggatcaaagtcttgcccaatatgtccccctgaaaatcacctgcaaaaaggagtaagcatttgatccattaaagaccacatcatttctactcaaccacaccgcccagcacaacgccgctatgcctacaaaaactcgatattttagcctaggattaacaccatttagccaactaccaagaagatgagacatattgagcagtggacgaatgccaaaggtaaaatgcaccgcactccaaatatatcttatcataggacaatcaaaaaacaggtgttgtatctgatgaattacatgaagtcataaatttgctgttcatgacatgaattgcattagcgcatcattgtattgccgtcagttataatgcaatgtgaaaatgtggtcaattagcagtgcttaattttccacatagaagcatgttttgcatgaaatatatttgcattgaaggtgaattattgattgtgcttctacagcctgctttcagtctcttgttaactgtccaagatgggactctgttttgagggacatggattgtatatatttcataactcaactgctagtcttcttcatttgttcataattgccatgccaagcttctcagaatattcgtactgagatattttcagcatcggtttcagctggctgtgcaagatgcagatcatttatctttgctttcttgctactagctgtgccactcttcctgtgttatctgctcttgcgatggcactactattgatgttactgaatctatttttctgtgacacaatttgttcatagattatgtgtgtgatgtagaatattgagtatattgtagcagcagaggaactggttaagatagttattgatctaaagtgatcgaatttttttcagtaacgcactggtattggtatgagaatgatctgctctcttgtcgacaggagagataaaatgagagtaaatattgatccacgggagagttgtttaaatctgcatttctcattcattttctgaacttgcagttgccggatctgtctaatgaacgattttttttttattttagcggggaggtacgaatttgttaacttgtttcagatggttggttgcttcattactagtgttaggatgattataattagacagttaagtactactatctgggttgatcagctataatagtcctacaagtacaagatcgctaggcacaagtgtaaagccaaattgcctatgccgattctttttatgtaagaaaaaggaaaaggataacaacaacaacgataaaacgatttctgattctgttcatgcgccgagctgcatgatgcacagatacggcattttgttgccattcccgtacgggatacgtatctgatacagggatacggccgatactcgcgcgatacggtatcagagaagtattggcgaataaaaagcgaaaaaaataatattttttaaacataaaaaatattttttaaaaaaattaataaaaataattgcttcggcatcccggagacccggacgccgcgcacgaggcgcgctacttcggctgcgtacagcggcggctggctcttcctcgccttccgccagatcgagcgccacgcgctcctcagcctccgccccgagcagcgctaaaagcaagctgaatttctggctagatcctcagaagagaattgaggcaactgaaagcaagctgcacaagcagtttcgtcttcactgcaaatccgatccaaagcatgcatgtgcactaatgcaatcccccacacagaatcattgttcattgcaatataatgatgcactaattcatgcatgagcaccaacaatttctgcattactctaacatggtgaaaatggcagagggtactgaggagaagttatgatatgatggatcaagcagttgcaagcacacttggatctcgagaaaacatcatcgactgcactaactggacaaatcaacaaccaccacatcaaatcagacggtgaattcgctgtaagccaagcacaatgccatgccagatcggcagcaagcaagcaatacctgtaccacgacaatgtaaccaagaacatggcagtctctcacgggagaatccaaaccggcggcgtgtagtgcgacgggccttgctccggcaagaacttgtccacgcggccggtaaccgccgccggcggcgccaccggcggcagccacttgccgtgatctctgcaggggtattcccggtactgggcaaagggattcaggatttggaacgcctcatcgtagagtctcccgtcatccaggaagtagatgccctcgttgaactcgtcgcctggatagtcgcccgcgtcgtacgatctggagcagcctcgcgcgacgaacagcacccgcccacccagcgattccagctccttccagtcgtatggtgccccgtcgttgttgatgggcgtctccaccatctcgaacaccttgaacgcccatgtcgtcggcggaaagaggggaggatgaggaaggagcctgacgaccatgaggagactcttgccggactccaccaggtagcgaacagcgaagcatccgccgtaatctcgcccgcctcgcgagaatcggcgaacctccatgggcggtatcaccagattaccgtcgtcgtcttcgtggaagtccggtaccgaaaaaacatggaggttttcttctcttgtgaggaagtggaaggctttcttgtggtgtacgacatcctccagagcatggccggtgaagaactcagcaggatcatgagtcgcctcctccacacctcgatgcctcaggatcccgaatgcatggattcgtggattgttcatcatgcaggaatggctgatggcggcggcgacgcagcgttcgtcgcccggtggcgaagagagggtcgcggccaccatgtccgtgcccgtgtcggggaagtggaatcgcgtgccgttgcggaggctgagtagcgcgtagtccaggatttggccgaaggcgacgaagacccagccaccgtcgtaggcgccgaagtagcgcgcggcgagtgcgtcggccgggagcgggtggccgaaggcgtgggtggcgcagcctgcgagagcgcacgcgaagcaatgcccgtcgtcggcgcgcgggacgagtatcgacgggagcggcctcgtccccggcggcggctgcggctgcggcgcgacggcgacgcgccagtcgtggcagactcgggccatgcggcgccggtcgacgaggcacgggaggcgcttgtggacgaggcgggggacgtcgccgacgaggtcgcgccacagcgcgtccatctgagaggcggaggcgcggcttgccgatggcgaggaggcgatgcgctgtgtgtgcgcgcggcgggaatggtttggaatggttcctctgcttctcgaaacggaaggagatggtggaatggtttggaagaagtgggtgggccactgtgagatcggactcggcctcatttgtagggccagctttcttggggcccaaaagtagcttcctctggaggcagattaatgggctgtactgtagaaagtctactttttcatgaccacattctgcatctagctatccccatgcaactgatcacaaaacaactagtatgtcaggagaacaaagacaaggcatcagcatgttgactggttagctgacaccgatgcaccgtgttatgtcagtatgattgaattagttatgaaactaatttgtgtcatacactgaggattctaattggatcccgataagagaagcgactgaaaccagtctcaagaagcaatccatcgatcttcactgcaaattccgtttgatgcaactgatcaaagaactcttctatgatgaggaaaacgcattactaacaacacaatatgatggtgcactaatgcaatccaagtcatgaacaccagccattctgcattgggtacacacatggatctcagatgaaacattattcctgtgtggcgtggataacattttctcttaactcgtggcccaagccaattggcccaatatataaggcctacatcgtttggtggcccaagcaacccacctctgcttcttccaaaccaaatcccccctttctccttccgcttcgagaagcagaggaggaatcaatcaatccccaacacacagcagcgcgcctccgcctcgcctcctcgccaccggcaagccgcgcctccgcctctccaatggacgacgcttcatggtgcggtctcaccgccgacgtcctccgcctcgtccacaagcgcctcccgtgcctcgtcgaccggcgccgcatggcccgcgtatgccgcacctggcgcgccgccgtcaagggggagcagcacccgccggagagcccgctcccgtggatcctcgtcccgcgcgacgcagacgggccttccttctcgtgccccattgccggctgccgcgggcacggcttcggcatcccggacgacgcgcgcgccgcgcgctacttcggcacgtacggcggcggctggctcttcctcgccttcggccagatcaagcgccacgcgctcctcagcctccgcaccgagcagcggttctacctacccgacatcgcccgctgggacttcgcggggagaccagccttcgacacggacatcgtcatggtcgccgcgaccctctcttcgccaccggaggacaagggctgcgtcggcgccgccatcgtctttcaccgggccagcttgtatagtccacgcgttcatgcattctggcgcatggggaagcagattgcagtggcgacgacctgtactaacaccattgctgggcgacttctggaggatgtcatacaccacaagggagccttctatttcctcaccgcgcaagagcacctccatgtttttgaagtagaagagttctacgaagacggcgatggcaatctgaagatagcacccatggtgtttcgtcgcttctcgcgcggtgggcgagattacggcggagccatcgctgttcgctacctggtggagtccggcgagaatctcctcatggtcgtcaggctcgttcctcatcctccccgactgccgccaaggacgtcggcgttcaaggtgttcgagatggtggagccgccgctggaaactcccatcaacaacgacgaggcaccatacggttggaacgagctggagtcgctgggtgggcggatgctgttcgtcgcgcgaggctgctccagatcgtacgacgcgaacaagtatccgggcgccgagttcaacgagggagtctacttcctggacgacgggaggctgtactgcgaggcggcggtgttcgtggatcaggctgccgccgccgccgccgatgagccgcgatgcccctgctggccctgcacagacagcggaaagtggctggcggccgccggggaggttccccgcgtggacaagttcttgccggagcaaggcccgtcgaaccactactcaccgccggcttggtttctccagtaagatcgagctttctgccgatcgatctggatgagatgtgcttgcctcacatcgacgtgtccgtgtgatgttgttgtggtgctgatcagtgatcagtgaacagttgttgttttcattccagttctgaacttcttcggtttttctttcagccagttctgaacttcagatatggcagttgttgttgattgtccagttagtacaatctgtgatgttccattgtatacttgcaaggatcgacctatgtcacctatcataacatctcttcagtacgttctgagtttctggtatgtttaccattatatacttcatgattacagaatgcagaaaacagttggtgttcatgagttggattgcattagtgcaccatgctgcatatatagaatgtattttcaatgaagaggaattgtttctgcagctttctttcagttgcttcaattcatttctgaggagatctagtcagaaattctgaatccttggtggatgctataaattagtttcaacactcagcttcttaatttgtcatactgagataacatcgtcatcttgcaagaatttgatcgtttctttgctttcttgatagtactagctgctttgtgatcaattgcatggtgtttcactcaagttaattacctcgtagtagtaaataatatgtctgttatttgttcttctgcaattactattattgttaccactggatttatttttcctgtgacataatttattcctggactatgtacatgatgtaaaaagttgagtgttagtaacaggtgagatggttatttgttcaatgtggtcatcatcttttgaaacacagccatacaggtatgtgataggtgctttgttgctctgttcactgaatcacagctactgaacagaggatgttctactcatctgttcagaaaaaaaagttaagtgctacacaatgagtatggttttctcagcgttgcccattacatttctgatttctctgaaagtagtagcatctgtctgatgtctctgatggtacaaaatagttctgcacgttcatgccaggagacaattgcgttaatcctgaaaagttcatacaagaacaccgcattgcagtggagcaggcggcggccaccaatgcaatccaagtcatgaacaccaaccattctacattgagtcatcatgaagttcatggtaaaaatgccagaaaagtactgaagagatgttatgaaaaggtagtactcctgcatacatgacacatggatctcagatgatgatgagatgaaacattccctcagcacaacattcctctgtagctaacattcatttctcggcatatataattacgaaagaataaacgggccaattaacttcatcatacagatccaaagttctttaggcccatgaagaaatgctcaacaaagtgcagctatcaaaacttcaggcccaagcaaaccgtcacgataaactgggcccaagcccaacttcttgctcggctggcaaaaggctggccttctctgcttcttcttccaaaccaaaccaccccaagcttcccctgcttccagaagccaagttcaaacatggcgcacaacgacgaagcgtcctcgtcgcgttccaccacctcctccgccgcccaaccctcgccaccgccacctccacgcctcgcctccgcctcctcctctcccatggacgcggtagcgcccgcgcgcgatttcatggcggaatccctccgcctcgtccacaaccgcctcacgtgcctcgtcgaccgccgcaccatggcccgcgtctgccacgcctggcgcgccgccgtcaagccgctgcatcctccgccggaggagaggcctctcccgtacatcctcctcccgggagatggggagcgctccttctcgtgcgctctccgcggctgcgccacccaccgcttccacattccggacatcccgcgcgacgcgcgctgcttcggcgcccaccccggcggctggctcttcttcgccgtcgcccagacaaccaagaacgcgatcctccgcgacgagttcccctcgggcatccccgacgtcctccacctcgacgatcggccgccggacaaggacacggacgtggtcatgttcgcggcgaccatctcgtcgcatccggaggaccaacgctgcatcggcgcggccatcctctcccacttccccgacgtcaccaacccgtccatctacgcgttcttccgcatgggagtcttgcccgcgatggtggcgaacggcgatgacgccagcaacgcggggtcggcatcaggcctggaggatctcatacactacgacgatgccttctacttcctcaccggaga

SEQ ID NO: 62402 - DNA, 10243 bp, Oryza sativa
  unsure (1)..(10243): unsure at all n locations
gttggggnattagagaccactggtagtacagcgccactttaatttgcttaacctgacctcggtgaagagccgagtgagctgctctggggataaaaaaaacatatggaaaattctactttagtctccacaattattcttttgttctttccattgtagttaatatgcgtcaaaatcataaaagggtcgcaatgtttcacccccacgttccttagttttttatctgttcctcctatgtaatctctctgtataattagtttggcatatatatcaggaagaagctgtatgcttttaccggttggaaatctaaaaggacgtcaagttagcgcttttaggatgtttcatgatcgcagcatcaatcctaactttatagtacgaaaaaaaaaaccttttaaataaatcaaaggggaaacagctcaatatctagctctatactcacccctaatttttcacatggcaaaagagctggaatgcttggaaatcttcgatctacgtcacattctattctctgcttcggtggtgatggtatcaggtatgcctctgcaagtcatctccgcttgcatctgagaatcgcctttttatttttgaaaccgatgaatcattgagggtcctctgtagtagtactgctcactaacatgtgggctggattgtgaatcatttgggtaggagaaaaaaaagttaaaaaatgtactgatgaactgaaagaaaaaacagcgtattgggttctctgcttctcccaaaaaacctaagacttgttcactttaatgttatttctaaccatatcttttttggtaaagttgccagaaaaatatatatgtttagtttgttgccaaatttgctcagtacataagaaattctgccattttgtcaatattgctatcttgctaaaattttagcattgccaaaatttgataaggtttattttgactacaatctaaacaggtccccaatgtccacttttctagacttcaggctagatgcccagcttgttgaaggcccaagcgtgcaactaggggtggcgatttcccttgtggggccggggacccacccctataggggcggtggtaggtggaaattctaacccgcgggtgcggcggggcggggccccgctcattttcaggggtgggagcggggttgaaaaattacccgctggttactcgtgggcccctaaagtacacaatgcatagaaggtggcccattaaaacaaataatctggaggtagcttagtttcggtggggaataagttcactttgactcccttaactaatggccgaatctgattcgtatctctaaaccacaataccggatatctcgacaccctcaactattaaaaccggtgcaatttgactctctcgatggttttggaggatggttttgctaacgtgacgcctatgtggcgttgttgaccgaagtatttgttctttgtagtgttgacgtggcgcttaggtggcattcaaataaaaatatatttgtgggacccattgacatgtgggcccatatgccatctctctcgtttccttcctcctctctctccctttctcttcggtcttcacgttggcccgtatgcagggagcgggcgccgaataggcggcgggggctggaggggcggcggcgtgcaggatgaggcagcgaccggcgacgactgcaggtactgcgccggcaccttgccggtgagcgtatcgtctgtacacgtcggcctcctgtgaggctgtgacagccgcttgttgtcctcctgctccggcgccatgtagcctccgaggcgggcagtggcgtgcgcgggctaaagagtgccaggtagaagctggcgacacaggcggcgccgtccttgtcgagcaggacgttggtggggcacggtgacgacggcaacggcggctacggcggcgtggcgccggtgccgccgacatcgaggcggtgggacgccgccgacccgaacacgatcctccgcgtgctctgccaccgcgacgacgaggtcgccagccagtttctgaagcgcacgttccagctcgccgagcgacgatgacgcaaaaagcttcgcgtcgtctcgtctccaagctcataatctctgaattaaaacctcataatctctctcgaacgaactgtgaacccaacacaagtatgaatatctaaaactttctggcacggatctaaaattttcaatcttgatgtcattcctatagttgcattcgaaagttttctactgaaaaagcttacgatacttttttagcaattccctataactcccgcacgctcctcatccccagtccccgccctctcgctccgcctcctctcacacgccgctgccgctccagcgcccgccgccgccgccgattcggcgcccgctccccgcatacgggccaatgtaaagaccgaagagaaggggggagagagaggaggaagaaatggagagagatgatatgtaggccccataaattttttttttgtctgaatgacaaatgggtcccgcacatatatgtttgtttgaatgacacctaagcgccacgtcagcgtcacgtggaacagataccaggtcaacaacgccacatagacgccacgtcaacaaaaccgttcttcaaaaccaccgaggaagtcaaattacagcgattttaatagttaggggtgttgagatacccagtattgtggttcagggatacgaatcagattcggccactagttaagagagtcaaagtgaacttattcctttcggtggacaccaagcccttcataaagaaggccacatctagctcagttgcagcccaattcgatggatgcgtacaacaaagaaaaccgtagatgaagtcacgagcagccagatgatttgatcgatccccaaattatctctcagcaagaggccgtgcgccgcgccgccgccaacgtcgccaccagcatgaggccgtgatccgccaaacacctttcccaggtcacgccctcgctccacaaccctttcccaggctcaacactagcagccgccgctaagccaccatgccgccctgatgcttcgtcgtttgcgccatgctgtctcgtctcctcgtcggtcctctcccaggtgtcgcccagcagtgacttgacggcagccgtcgtcgtcccatccatcgccgccgctagccagtgtcggtggcctgccttcgcctccccaagccgacaccatcctagccactgccgctcctagctggtgttgcattgtcgtcgtccatcgctagcgccggtggccagcccgccatcgtctcccctagccggcacctagctggcgtcggtggccagtcccaactccatcgtcaccgactcaccgtccacacctgtccctagcctgatgctgtgggtccccggctccccgctcacctggcgagtcccttgcagggcctagggcgggtggggttcttcacccgacaagcaatgcggggcggggggcaaatgcggggagcggggccggggccgttcttgcccaactcggtcccgtcccaccccgttgccatccctacgcacaatgcaagcagcatccgccattcaggaaccggagaaaggagaggacgaagccgcgaaactgccaaaggccgaacacctgagtgagtacgtcagtaacctgaccgtgccgcggccgcacgaacgcacgcgcgcacgcacgggaataatcaaatcatctagatttttagagtcaaacacgtacgatcaccagggcgcaaggcgcgagctcatcgctactctcaagtcttcaccgagctccaccgagcttttcttcttcttcttcttcttctgtgtgcttccagtgcatcatctctcggatgaccacgacgactgccacgcagtacgacaaggatcatcatattcagaagaagcatgccgcgccatgtgacccgaaatctgaaaatgtaagccgctctctggttgtgatgtgattgatatctatccatatccgctgttgattacactctgccatgcctatgcctatgtcctcgacacgtcggtggcacgcatggaaagaaggtaaggttgcctatggtgtttagtttacggtgaagttagaagttggttgaaaattgaaacgatatgattgaaagtttacgtgtgtatgacaggttaatgtgataggaaaaattaaaagtttgaatataaactttaaatctaaacacagcttatgtacacttgcttgcacggcgagcggccacgcctagcatttgcctcgcatcgcatgtgcatcgcgccacattcctatgcccttgatgactcagccgggagcaataatttacgccggccttgtcacggattttaggccaagaatcttttggagcacgaacccctaccgagatctaggtggtcagcatatgtgaccaaagtctctgcagattaatagtagtaatgccatgttacaactttgatgtttcatgctgtcgctgatcaagtagtaaattaaaggttttaggcgcacaatttcacatgattctccggtaaaatcggagcgttaggacttaggcgttagccattagggcagtgacaacaatcagttaaaagatcagacggtactttctttactttgttatatgaggatacacgtgcgaagtataccggaccggaggctctctgctccagagcagagggaagtgaaaggtgtagatatctgaaagaggatttgctcaattgttctagtagtacaagataatttagtgttgttatctgaaaaagatgtgttcattgttgagaatggcacaagaagtttatagatacgacttgattgattaggtgacggtgcttaattgccctgcatgttgatttgggttcgttagtgaaaagggcatcacagaaagggtaaatcaacattattagatcctacgtaggacggtaggagaccatcatatgaggattaagtaggagaactttaacaagctcgttattaatatttgacggcgccccttttgatgaacttatatcacacccacgctacctatgcatgatcattgtttaaagttctaaagtcaccattaaactatacttaaaggcaatagtcctcgcatgctcaagctacgtacttgagttattgttttcccttttggaaaagggaagtacctgagttgttgtatatcacacctaaacgatcgaaccaaaaccaaaagtccataagcgtggtgctaagctagcaatcaacaacgcacaagcaagcatcatctgttgaggtatatacgttgattgtggtccaaattatgatgagccatcatgttttccagctttctttgctaagtttacatgatcgtcatccaatgttctttttttgaacaaaaatggctgtaccagtacccaaaaaactgaattttctaattattttcaaaacccttttaatttttaatgttagataaacccttatataatttatttttaaaatttgaaccctatcatgccacaacatttttaaaattttataattttaaacccttataaaatttgttttatcccgcaacgctaattagaccggtgtggccaaataacattgtcacactagccagatcggtgaggtagtgttattttgccatgtcagcagattaattaacaatttaaaagattaaaaaaaaactagccaagttaaacaaacacggacataaacgtccatccaagcatgggccggccagcactaacacagattgacgcgaattcagcacggacactaacccttctacttatcgcgagacgcgagctacagctcttctagttatattccgttccaaaccacaaaacgctatcctgacttcctgagacgtcccagatgaccccgacaccgactacgtacgtgctacacccaccatgcaccgggccaacaacacacacatcacatccactcccgaccaccgtggcggcaggtgcagcgcacacagcgccggggtgcgcatccccccatccaaacccaatccactccactccaacaccaccacaccagcaaccggtttggtgtcccactcccacctcgcacgggacgggagagagccgcccacccgcgcgtcgccacggcgcgcacgcgacgccgcccgtccgaaccgcggaaatccatcgttttctggccgtctttttttctcctctccccgggggagaaaagacgcggccgcggaaagcggaggcaggccgagcccagcgaggcggtgtcgggccatgttttgccccacgcgcccgcccgcccgcccgccggccgcggccgatcgacccgactacccgagcgaccgccctctttttcccaccgggtcgcgcctaaccgtggactgggacgtctcaccacatcacatgccgcgacccctgttctctgagctgtaagcctgtaactgtacacttttctttctcttctctgtacccgttttttccagctttcaatcaatgcttacgataacctcgaacgctgatcatgttactgtaaccatttgtggagttggcatcgctgcaatggtaggacatgatccgttgtttacgtgcgttgtagattacagcagttcgtcacgtaccatccaaaatccaatccaccacgggggtaaagatggccacgaagcacggattcaaagcaagagaccagagtagatgagcgatgccggttgctgagaatcgatcgaggtgtttgttcggcgaccagagctgcctttccgatgaagaaaaggtggatggggttggaggacagtgggcagcgcgcgggcgcgacacagcgagcatatgattcgcgttttcgttcggtgcagatccactgaaccaaatattgaataatggaattcgaaaccaaactgtaacctcaaagctagcatgatgcaatggcgacagctgagtaagctgaagaggtacacacgtaggaaaaaaaagatctttattagcagattcagaaaatgacagctcaaatcgatcgaatggtaccgtctttttcccgccgatttaattacaaggagatccttgggtggttgaagtagacgacctatgaattggggacaatacattaataacgacacactagccatttgtatctttaatatatcaatccatgaacagggaaaaggtacaagatgcctgggtaaaccttcgactgtgctcgaatctatttgtcacattgagcttaaaaaccggttattttcaccttcaactttaaaaaccggaaaaaatagcaccctaaaccatcttacatggtagtttctgaacttgtgatgatgatagtggaactatgaacttcaatcatgtactaaatgacatctacatcatcaacaaaagcatgtataacaaaattagagtataacctagaaaaagaacaccttaatttcaaacaaaacattaaagaaaatggtgcaagatgctacctatccagttacgaagnnnnnnnnnnnnnnnnnnnnnnnngtacttcaggttggaaaatggacttcaggtaaaatttaagtgcaaaaatagacttaaactagcaataaaaatagcccatgttgagaaaacttgtacttgccctttccaagatgcagtcgacaatatattagtagtacttgtattgtctatgcacagcctccacacctaacagctcaaaagtacccgcccttaatctgccacatcaggacgaaatcatgcagatctgcatctctgtacagaaattccatcctctcaattaaaacgcatatgccccaaatcgaacaaaagaaaaaaaaaaaaagaaaagaagaggggagaggagagggagcggcgaatcgaagcgaagcaagcagcagcagcagcaactcgcgctgttcatttattcgcaccaaaccgaaaggcgagacgaggcgaggcgaggcgcggtggcagaggcagccaaaccaactgacggacgcgagcgaagcgaagaagttcttgaagttgaagcagccgcctcgctcgcctcgcggccctcgcttgcctaatcaggaggggggctatctctttctctctcttttttcctttcctttcctgcgtccttgggatccgcccgtgcgatctcgccgtgggtggagcgccgccgtccatccgtccccatggatccccgcagtcgcgcggatcgcggcgagtagggagggaggaggggaggggagggggaagcggtttccgggaggagaggcgtcctgctcgagcaaggagcttgtggggggaggtagatggacgcgaacgcgggctcattcgtcgccgtccgccggctcgccggctccgagcgcgccgcgggagcggccgccttccaccactcgtcttcgggtactctactactactactacctcccttctccgatttggctgtctccatgcccgaattgtggctcgtggtagcgcggaagctcaccatggttttgtgctgctgctgctgctgttgctgcttcgcgcgcgctcgtcggtgcagcgaagttcgtgacggggtcgacggcgtggatcggaaaggggctgtcttgcgtgtgcgcccagagaagggacaagcgacgcgcgcctctccttcgatttgacgccagttcaggtgatgatggcttttcccttctgtgtgatttgatccccacagttctgcttccatggtgctaataatactgtgttgagttctgggttctgttcacaaattttgaaagttgcttttggtcatcgccgaattcatctccgaattactatccttactctgattctcgcgttttatcaggcatgtcctgcctacattttccatgctcgcttaaatggcttcaattctatttttaacataagtattccaaatattagtttactgttccgtaccatacatgtgcgccacaagataatgagtttttgcatgtgttagttgaaaaaaaaagtggaacagtggaagtaacaattttcattttctgtcccaggaagagtgcctacagaggttacagaaccggttagaagttcagtatgatagttcaaacagtgatcatcaggtacttgtttttggctgatacacgacacctaactgttggtacataggacttttgatgttccatatttttctcttttgatgaagcgggggtgccacaactttatattaacgtccagaacaagatatgagttggaaacattctctaaagttgaataaccagaattgattcaactgaaaaagtatgattaaaaaaaaggtccgtacatatgtggaatttatgaggaaatattagatgttagtaactgaatatatttgatttcagatatttgtagaggcaatagattttcaggatgtagacagtcttttgaggttacaatgcaacaactttggtcgtttattttgtattttttatttaggcctcttattctcagtgtggcttatccctggagaactaaatccttaactcttttgtgaagttatgcatggcaatacagaactccagatcatgtgtgattctccagtattgttcatttcttcttggagatgacacttgaaaaatgttggaatagctactcgatgtgacacctcacatttcttcaatcaggaagcattgaaggacctctggcgtgcttcttttcctggagctgagcttcggggactaatatcagaacaatggaaagagatgggctggcaagggaaagatccatctacagattttaggtattggcttttctccttcattccacccttttgtcagtatttcgtggctaaaatagataagaagaaatgtattgtcattacagaggtggaggcttcatctccttggagaacttagtgtacttctccaagaacttcccagtaagtttgaatccttgattccaaagatacttgtaccagcactgatgatgactaacgagttgagattcttatgtaccccagtacttatgtttcagtataacagctataatctactagatccgtttctggttatagagcatttaatgcttacctgaaattaattttcaccatttctggctgtacagaatctccttactatgaaaaagaaatgaggaccgtttcatgcatctggttggccaaacataaataatccacagtacatccgacaaaacagagtgctgaaaatggttctgttaaatacttcctctgacccaaaataagtaaccaccttaccacttattgtctaaattatgaggggaggtaaatgacttagatgccccttattaattgagggatgtatgtgcgtgagagggtagttgggggtaaaatgggaagaaatttgaattagaagtaattaatgacataagtggtactccaaagtgatcacttaatttgggacaaattttgaatccaaagtggtcatttattttgggatggagagagtagtatatatcgggtgatattaaatgttat

SEQ ID NO: 62403 - DNA, 17479 bp, Oryza sativa
atcttcaatcaggtttgttgaccaaaagttctttgcttatcagctattggatgattggatctatttattagacaatactagttcctgcagagttgttgaaacgtgctagaaattcatgttgaattgacacttcacttcgatttcctctgcagttaaaccaaggtcgttcatcggagcagtttttctaaagctactttctggtaaagcctatgtttcataatcccttaggatctacaggagatgcttattgtttgtttcttttttgaacctaaactgagtcatgcatttgttcctttgcactccattagtgacctgtgatcaggctttagggtgtatgattgtacagatgttgcagctacaagaatttgtgtttcagtatatttttgttatataaaccagctctattgattttgcaaatagatgactattgtgttatgactattgatagtctacgtttgctaaattcactttaatggtctaaggtataccacactagtcatacttcttgaaacagacaacatatattagattggtgaaggatttagtaataattccctgaatatttgtttcatattatagtgctactaaaattgattccaaattatagtgctcctaaaatctatttcagtatagtgttcctaaaattgatttcaccaatttttggtccagaaaatgatcaggcttttgacattctctactgcataaccttcaagttgatggatcagcaatggcttgacatgcgtgccacttacatggacttcaatggacgttgtctttctatcccaattctagtagcgtcacacccttacccctattgacccccttttttttgtaccaaaatcttcagagacagacaatggttgatgaaatcacccatccgtcttgacttaaaatgtgctactaaaattgcagacggtcatgaagtccacacgacgtcagctagaaagggagctcttgcttgaaaatattcaacggattgaggacatgccctcatacaaacttttggcccgctagctagtaactgaaccataacatggctacgtgctgcaaggcttgagttgcataagggttgcaactagtgcccacaaacagtgtgaatttcaaaacgcagatgcacttgtttcctctcaagtttaggtactctgttaacctgtctccaaattacaagatagaggtctcttggccatagcacgccacgtagggtaactgaagtgtccgatcagctgccagggcagagtgtttgtaggttgggtgttttgttgcagtttggttgatgcccgtcataccacgaaatgaagtgcttctaggttttcctttttcctttataaacaagaggctcttgtgaaagctaatctgagtgtcttctgtagtgtaccatatttgcataattgatagtgttcagttctccgagtgtgcagaaatcatgctagctgtttctgctagctccgcaatgatgcaaatctgttgtttccttagttgtcctggggcatgaagtttgttcctatatagtgcagaccatttttgtggtacagcacgcctttcttgattgaatggattctgagtgctcatttgctgcttgctactgctggattgaactgctctcctcaaacaaatgaatgcagagcgaaaagataaaagataagggattccaacaacaggaagtggacaaaccatactaatcaacgaagaacaaacttgatatgtgacttaattctgttctcaggggtcaggatatgatatcatatgaccctgcataaagctggagcgtgcctgtgcttcctaggggtggtggtgcttgcctctgctgccgggctcagccgttcaggacttcaggggtggctactctttggtcggtccagactccagacactgcaggtaaagcaacaggtcccccagcatccatgtaattgttgtagcataatgtatgagcgacagaatgcgtatacactaaagctggcagctgctaatactagctcatcgttaaaaaaaaaaacactctgaaaatgacttaaagaagccgtatctgttgtctggatgttgcgtttttctactaaacaaaatgcatagttagaagaggaacgctataaagaaaactgaaccctcgatggaagaaaaagaaacacagaagtgatgatcaagcagcttatagttgcactggtaaccgtaaacgcgctactagtagctttgtgccggctatgcttctacgattcttccaaccaaacctcatacgagcagttaactaattcctagcctggatattcggttcgctgtagataatccgggaacatgttctgcaaaaacgaggacttgatccagaatagctccaacagttacgacagtttccatgcattcttgttagccattccaatttccaagagattttttttaggacttccaagcaaaaaaagatcacttctttggcactcatatgccctacagtacaggcaaaattcacgatgtaacctccgtcaaacaacgatatccaaatatgcataatgtctaatgaggctgaataatttttgcttacaatgtccaaacaagcttcgataaaatttcaaagaaacaaaacaatcttaaaattttaaaattctctcccctatggggatcaaagaaagccggccggccggccggtagtggtgctctctgtcgtgtgccatcttatggtggatttgacatgtgtgcagtcgcgaaagatcgcaagagatctggtcgcctccgttcgtcgccgggagccatcgatggcacgaaaggcatcatcatggcgaggaatctctggcgagcgttagatttctgccgtctcctcctcagctgatctctggtagtgataccgtttgcctcaaataatcgatcgattttttgagtcttaccaaccctacaacgttgaaagagctgggcccattgtcctacctcagctaccagtaactatacacaacaaatgttcatgtctcgtgatgtcgatatgtacagaactagagaaatgatattagctggccgtgtgcatttacattagtccagcatgggccaatttactgtagcaaactagctctagctagctagctgggctcgaactatttagctaagcagaaagcttcttttttacacttaaagatgtacttacttttcattcttgtggtaatcagttgaagtaaggtgtgcgtgtctgtgagttgagatgctacaaagctgcgtgatcacttgctgcaaacttgccactctaggtcattgagcacccagctcactcaaaccatgttccaataattttccacctaaacgttgatataatcccctcaaaaataaactttgatataatccgtgcacgcactccgagttatttttgtgaagcaaatgaactagcttgtggagctcctctcctcctatgcagggagctctataagcaaggtgaagcaccgtggaggtgacgattgatcagctatgaaagacttgagctgtcaagatgacaccacgcgcccagttccgggttatccttgggcaagttcggtaaggaggctggtggacagcaggacggaggaggcctcagccaacacgtggggaatttgcagcgggatagagggttaattttggcgacgaggtgcagtggaggtcctgctggtgacaggattaaaagtgggccgacagagagacgttggtccgatgtggcataggccgcgtgcagccaacgtttggatggtggtaactaagatggtgggtgacaaaccatatgtagatagggttacagcggttctaggcgaaagcctagcccagccattcactaggacgacagtgaatataccctcgggtgttataacccctctggagatgctatcgaggtatctccttcctcacctttcttgacgagaatcttcgggtaaaaaccacatctaagtttcttagacgggtgacaacgacgtccttagcatcacaacctccgtggaagcatcattttgaagactcggctctgtggttgtctgaacctaaactccaatagcagggagtcatgtagcccccccttttggatttggccaaggagcaaatggcggatgctaaatttgggccgcgcgagacaaagtgaggcaaaatgattatacaggtttgagccgctcagaggcgtaacaccctactcctattgagtttgtttttttagaaacacagtacaaacgcaggtgctcacaacgcgcacacacaccctacccctatgagcacctccggaaaactgggtcggcatgtcttgagattgacgaagtcaccacaggcgcctcgctgtcgacgggtacgtcgcctaccactgaaagaataattagccgtaaaagcgagcacccatgtcaaatctatgatttgaacctgggtgggttggttccaccacaaggaaccaaaccagttgagctacactcactttgccctattgaatttatttcgttgcttggggttcaaatcttaaaggaaagagacttagcaaactagggctactttggtttgatcccctacttctgtgatcttggtcctccctttatagtctaatccacaattgctagtcacttacaagtgagtcccatatacacaggagttaggtagggttagtcgtatcacgtgctgacaggtggggccttctattttcagtgtcccgtcggaggagctggcatgatagtggacaattgccttctagctcactgcaccctcagcgccgatgctgtggatgacatgacatgccatgcatggcccgagtttggtgacgagactgtggatgacacctaccaagctcacttctcgctttgatagacatgcgcgccaagtcatggtatggctagccaatcgatgggttaaggacccacgtctcctaacagtccacacccccggatttttaggagtgatgatatgtcgcccgtcacctgccacgtgcgaccgccggatttgtattcggcgcattgattaataatgcaagatcgggcagacgatgtgcaggaatgatgagtcaagtccagtcatattaatggcaccctaagtccttgagcagcccatggatggtcaagctcagggcatgctccgtgctcaagctctgcttcgtgcttggggaacctctgtgttcggggcctgctcttcgcatgcgtcctgagcacggggcgcaactagccaaaccatgggggccaggtccttggctccactcgcggttgatactgttgagcgatcttggaggcccttggtgccctgagcaactggaggtggggactcgggtttccactttttcatcattggtgttattgtaggcccgatgacaattggccatgcactacggtgccggtttggtgctaagccattcttagtgatatgtgtttgtatggttagctgtggttattggtcatgtgtgcttcagtatacaacaaatcttgaaagccttctgttgacaatagtgtttttggtaactttttccccctcaaactcaataatatttgaatgtcctcttcttgggtcatcccggtaaaaaataaattattcgcaagtagagtacgaaagggaaaagtcttttgtctctagagggggtgtttccatttcttacatgtcatttaaacaattatattttttaaaaaataaaaagatacattaatacgtgatatatcattatacataggcatgtaaattcaaatttaacctctacgattgtaaaaaaggttttctaacatggctctaaatacatgctgtgtaggagttagagtttatttttcttacaacatgtgaaagtaaactctaaattgttggttataaaataatatatcatatattaatccatcttctcattttttatgtcaaagaaataaggatatctatcctgtctacgaagaataggcccaatgtacacatcaccaaatgaatctgccccagcagagcgacctactacttgtgtgtgcgtatgtgtgcaactgctcacgtgtctgctacgtagtagtacaagcaacattaatttccaacccgtattcccggtcggtgcgtgcacgtcaaaagagaatcacaggtacacacctccgagagagagacctggtatctggccgatcgagcagcagattcgatcgtccatgtcatttaatttgactcggaatcggatcgaaacgaaacgagaagcaggtgcaggtgccgagatgacacacatccacgcgcgcgggcacatgcgcaccgcacgggctcgtttcctcgcggaaatgatgcggttttcctctctccgcgtcggtctgatcaggcggcagcgatacggggctaagggccggggtgtgagcgcgcgcgccgaaagcctgttgccactctgcactgcatgccgcgcgcggcaccgcgtcagttcagggtttgtgcttaaccgcgtgctggtcctccacgggagaaaaagtttacgggttcggcaggggtttcaaccatcgatcgccgcgtgccttgttgccggggacctgtacatggcgaaccgcgcggcgactcgatcgatcgtgcaacgcatccagccgtattgatgtattgtatcgtgtcacaacgacacgagcccgcgcgcagaatcgaatcatcgatgtgtacaggagaacacacatgcatgcgtatactgaagctcgtgctgatcagcgcacgcgtttgccgaaacaacacatcgcggtcgcgttctcagcttgatcccaacctggcttcatgcatgatcgaaaaaggtagtaatctgggccgaagggccaaattatcatcattattctcatgacagagagaaagagatcagtggtgttgagacttgagagtcatgatgtctctgatcactaggccggttgtgtgcgtggagaagcaagggcgcaaagaccaccattttggagggattcgagtggcccattgtaccactcaaaagcaggaactaaatgccatcgaattgaacaaaccaggaatgctaattcacgtatacacactagcagacgaaatcgtacgcgctgggttagggtttcgagggtcgggtgtggggggtggctatggggagggagagtggggagttggggttagagggatgacctatgaggtggcggaccagcggtgggcaatggataaggcggggtcagcagcaggcaaaggttcggggtgggggagggggggatgaggccggctagccagggtcatgctagcacattgatgactttcggcaccagcgtggtcgagacgatgacattgtgtgcacgtggggtgggggaggtggcggtggaggaagaggggcaattcaccagaaggaggaagaaagggctcgcaggagagttgtcatcgtcgccatcgcttgctccgctccgcttgcgtgcactaaggttgagaaagagagaggaatagataaggtggagaggggggagatagtaggaggtcattgtgtatgacttgtccatctctctcacgcgcatcgaatagaattcccttgaatgaactgcggtctaataccaacggatcaacccgccgtggacctctatatgctggtgggtgcatgtgtttatgtatgtaatacatgaatggattttacaattttggagaaggtactaggaagtactaagataactggaggtgctaaatttacatatagatgagagaagtattttcatccttagaccccttcattttttgtgcgccattcaaataattataaaaaatttaacatgatagatattgtgatatatcacttcgcaaaaatgaatgtttaaattcgacctacaaaacttataacaaaataaacaaacaaatatgttgttttttacaacttgtatgtcaaaatttaaacgttaagagatatattacatattattgtatcttattaatttttttcacgatgatagatggggaaccaacacatttagacttctgtgagccaaaaaaagagagtcgtgcttgacttgatgaatcgagccaattctagcatcaagctaaatcctttagatgcacagctcggtcgacacatccagaactatcaaatacaaaagaacacatccaatcaataatttcatgttcctcgaatcaacacatgaagaacaaacaataacccctagatccccatttcaatagatggacgacatatcccattcccaaaatcaacgcatgaacaagaacagcattcaataatcccccaagttctacatacacctagatctagaggcggagggatgcaggcggcaaggtcagaggctaacagggacctccaggcagctggatccggtgacccccaacctccatgctgctagatccgctgccctagtcactagggagaagaggaggtcaccagtggtccatgatgaagtcttgctagcacccgtcatcgttactgccgatctcgtgacggttagatctagttgccaccaagcttgtggcggcaaatccattggcctggccaccggagtccagagagaaggagagggagaaagtgaggggttgtggcagcagtggtggaggcgaggagaggcactgaggcagtggcggtggcaacgagggtgaggatgagagaggaagagagaagtgaggggagaaggagagagaggtggaggacttgaaaaaccaaaacgggctcgctcggctccaatcccaacattgtcggttttctttaaaaaatacgttgatatcagtactgatgtacttacaaaaatgtcacatatattattggtgttaaatttttaattgagcaaaacttacaaaggagtatatataaatactgatctttaattttagaccccgcgaaggaccagagaagagagcaaaattaatgccttatataccggcgccacagataatatgttccctgtcagggattctgtggtagaggaactagggtatgtgtctattgattccctgctcctagacacataaaacaaacggagaagacgagatgacgagagcttgggacaacgtatctgcagccttccttgtcgctgcaccctagatcaggcaaaaaccgatcacgcaatagtagttatgcctataccatgctatctcccagctgcaaaatgacataaccatttccccccatcaacgcgacaggccgccggagaggccggccggagctgcgaatgattccgattggcgatggcaacaacactagctagctagctgctagctagtacgtacgtgcacagacacacacgcacgcgcacagaatagtacgtgttgtccatcataccgttcgcgtttcatcgatatcgtctctcgtctcgctttcatacgcgtcgatctcctcttgtcccctagcttttgcccctcttctccgtgtatatctccgtcgtcgtgatctctctgcatatgcacagtgctactatacccatgcatgcatcagggattgatcagggcgccgccactttggggtttctattcttttctcgcacgccgctgcatccgctgatgatgttttgggacggcagtagtaggctcgcgcgcggctgcttctgctactacgacatactattctgctactacatctcgtgcatgcttctgctgttctctgcagcgctgtatagtacaagctctttgtgtctcaccgtttctagggcacaccatgcgagtccttggggattctgtgcaagtacagcagggaggagtagtagtagtagtagtggcgatcacatgtctctgcctgatcacgtcttcatggaccaactatttggatatattcacgcatgtgtcaattgtcatgtgtactcatgtgtgtgctatactcaatttgatcattgcatgtttatgtgcatgccttgcaattgcatattcttttttgaattggagatcgctgctatgatggcagatgaatagtagtggcccaattggaggcccctgaagaagaggcttttgcagcagggtgcaatgataggaattcccctccatttcgcctgctgcaatccccgtggctaaggccgtgtttagttcttcggctaaaacttttttaagtatacaaacacacatttaaagtattaaatataaacgaataataaaataaattacagatttcacctgtaaaccacgagacgaatttattaagcctaattaactgtcattagcaaatgtttactgtagcatcacattgtcaaatcatggcgcaattagactcaaaagattcgtctcgtaatttacatacaaactgtgcaattggtttcttttttcgtctacatttaatgctttatgaatgtgtctaaatatttgatgtgacatttttgaccaaaaatttttggatctaaacacacccttaatctggatacatcaatgtgagtgcctgcagcagctagctagcagcaatttgttcggtttgccaacatcttttgcaaccccccacttttagtttttttttctcagtgaaaaatcatactcccatatttacccgatttttaagttctttttcttggaaaagatcagtacggcctcgtgaatcctgcatttctgcggaagccgcatcattgcactgcatgcataagcttatttgtgattatatccactttagagaaatgcatgttacttctgacattttcaattaaatcgccacccaaatatgtgttaatatagatatttgccaactgaatactccctgccgaagaatataataaggacatctaaagttcaaaattcgtttaataatattctatccgtttcaggttataagacgtttttttgactttggtcaaaattaaactactctaagtttgactaactctatagaaaaatatagtaatatttacaacactggcatagtttcattaaatccataattgaataaattttcataatatattagtcttgtgttaaaaatattatttcttttttctataaaatttgtcaaacttaaagtagtttgactttgaccaaagtcaaaacgtcttataacctgaaacggagtgagtacaagatatcctcacctaatatagttatcgttatcttaaccaattacaactttcacttatttaatttcctcaactattttctatcacaaccatttctcacctaaaccataatctcttaaaaaaaaactccatatgttcttatattcctgaacagactgagtaataaacgcagaccatgttggtttgaccctgctgagttatctgtataccttttctaatctgtttaagcttataagaactaattagtgcatgaaactcaataggctttcaagctaagatgcgttgagtttgagatcttgtggtagggtttcaaaatgcgatgataattgataagttatcatggttatcggtcttattgaaccgaccatttacgaaagcctctccgtaaactagccaagttaaagaaaatcaaacaaaaattcaatattttggcaaaaaaaaatccaaatttaaccgctcgattatcgatgaaaccgccaggggttattgactacgtaccggttgcattttaaaacctttcccggtgaatcatgtatgtaagtatgaggttcagatgctttcaaaaataaaaactagttatttgattgtttttttaaaaccttgctacataattttttttcagcagcaactagctacttcctcagtcccaaaaaaataaattaaccttatattggatgtgatttaatctagtaccacgaatctggataacctcatgtccaaatttattgtgctagattaagttcatgtccaaatttattgtgctagattaagtcgcattcaattttaggtttgttttcatgggttagagtgcgtagcccgacccatcaaccatgggccacccatgtcacattaggcctgctcccccacaggctaaacatgagccacaactttaggtcctggaccaacaaactcaaaagattagtctgatgggtgatgactgccccaccttttaagtcgtactccccatcattaattattgatatgggactaaatccaacaatctccccgtcacacatcgggaacaacaatcttccccgtcacatcaacccatgtgaccctgaagacttattacctggcctcgggcccaacaatctccccgtcacatcaacccatcacctatgtgacctcgaagacttgttacttggcctcctcaccatgtgacccatgaaaatcgttccgggttctaaacttgggctctgataccacttgttaatgtgcgcagcccggcccactgaccgtgggccacccaggtcacatgaggcctgctccaccacaagctcaaccggagtcacaactttaggtcctggacctacacaacccaaaagactagtctgatggatgaggaccgcccctaccttttaagtcgtgcttctccatcatcaattaccgttcattgggcatttgggctgagtactgtttcactgagtgagttgttcacgggaagcaactgtggacggcaaggacaagttacaacgatgcattttctgaagtattgggatggcttgtgcatggaacaagctgattgcatgctacgttagttatgcacagggatttggttagttgggaccatgctgtgtgtaatggttaatttgtacatgaggtaaagctgaggtgatatggcaagccaaagtattggttcggcaagattgcaagggtggcttaacttagttatgcagttgtacgagacagttagaaatcccgggaaacagtgggtgaaaatcgttgatggaatcaacgggccgtttggcagtacagggtatatccagaatctgcggggcttgcataatggggatatataaaatatgcgtcactaaagatgaagagcaatcgctatgttggtaatttcttcgggtgatttaaggcaatggtgaattttctcaaattatcggatattcagtctacggatgcggaaagcgtggatgttggatttattagctcggttcataagacaacaagaaagaaagggttcactacatgtctggtgagtttgatttatttatttggtgatgacgtcggttatctggccatggattagatcaagtcaactttaagacggtagatggagttgaacatggtcttcggggaagtctatgatgtgacagttaggaaggaattccattttgtttggcaagacgactgtggtaataggtgagaaggtggagcactgttgtaggtggagtcaagaagaagaaattacagggatagcaggagttgactcttgttatggtgagcctggtggagtcttatcggggcggctcggcgtgaacggcgaaaagggatcaactcaatttcaggtgcacggagtttcgtgcaaagaacaaattcaggttggcgtggcatattcatcaaggtggagtttgttagagtttgtgttgaatatgtgtacgcaatcggttacagtttaggacttggagttgtactaggtgttaggattagagtaagagtcggactctatcataggctctctcataaatagaggagcgtgcctgttgtaaccgatagggcgacatagcatgcaagagggagtggctcccggctatagtccgttggtaactttaatacactgtaatatgctggatcgggaagaagcgttcataattaatgccctggagatgtaggtctcggctgaactccgttatcaaatatcacgcctcggtgtcgtcaccatgtttagatctcctatggtgtttcttccgcgtttggtttccgatgtgatttcgggaccggctttataacacatgggatgggaggtaggtaggtgagaccaggcagtactgcagtcaaatgttttattattggtttaattgtggatattaatttgtgaataaacatcaaaaccagtccctttcggaagacacacgtaccctagatatacatacgcacccaataaagtaggatagtgatgattcaggaaaagactagagttgattcacataggtgcgcatcacagagaactatgagcaccagtatgatcttttgtgaggagcatctatccaaaagtcatataaatgatctggcaattgcagggaacaaaaggtacaatcagtgctatcctgtacgcggaacaatcgctgcaataatacatgcgcccagcctgaaaaagccctgctgatcacagattcaaagtagtggccaaaagtttctggcttacacaacactaaagttgcaattaactagctaatctggtatagaaacatgaaacatatatatcgactgaaacaggaagctcgtggcactgatgaaagttcaagaaccaaatatcatagcaacagcgtttctcatagaaaacatgattaacgattaatcagttgtgatccgacatctatataagtagtacacatatcagctacagaaggcagatccgacatcttgccaagagccgataaattagcatgcactatacctagctagctcaaggagagggcaacagctactgaagcaggcactgtacccacgacacaatttgagcaaaaagccctttaaagggcagcctagactccaaagtccagagagccatagcccaccacttagaccctgaaagcatcaaaccctatcaaaaattgacaccaaaaagacagggagaggagatctatcccaagaaatcctatgtcccaagagccactttgatcgattggcgatagatagagatcactactactgccacaaacgccacacacgatatagctatagccatatgcatacttgcatggaaggaggtggccaactggggacttgtcttccgaatttctatcttttgccagatcaccacggcatgcctcttcctcctccacttcaactaccgtgccatccgaagctactccagatgccattcgaccaagaagatcagcccggaatccatggcgtgatgctctcttctgaccactgcgggctgtaccctctgccggcgcttccgttaagcaactccgccgccgccgccgccgcaaccgtcgcattggggaagcacagtgcagccgccggttccatgcccaatattggcggcgctgaggaggtaaactggctgggctagattttattctgattatcaacaaggtctcttttcttgttccttactaattctcatagagtatgatcttgttcttcaggtggccaccactgtaaccaaagctggcaatgagagtactacttgcaatggctccactacatggtacgcgtgcatatagtgaaaacataagatagatgcaaacccatgctgagatctccagttgtgggagcttgcaggtggaggggctcgacgatggcggcggcgggggagaaggggaagatgaagatcaggaggaagatgagggagccgaggttctgcttccagaccagaagcgaagtggatgtgctggatgacgggtacaagtggaggaagtacggacagaaggttgtcaagaacagtctccatcccaggtacatatgctcaacttaaccaaaaccctacatatttgatttcttatatcatttatacatatgtgtagataatagattccccgtttcttatcaattaactaattataaacataaacagaagaatgtctcgatgcctatttaatttggttaattagtaatacgcaagtttatatataccagataaaatatcaattttatatgtacagaactgagcaatgttgatcttgttttttctcctaaagggcttcttcagaacatggaaaatttgtaggattttcacaggaaacatttcaatttctccaaaattctcgtgaaattcctccaaaccaaatataccaagggtactctctatggcagaagagaattaatgcatgcatggttaaactaacttgtcaacaaaggtcttgatatgaatagattagaagctgatttaagacaaggcaaaatatctacaaatataattatatatatgcaggctatattattacttttcctttttatatcaatatagttaaaagcgattttacagtacttaagagatgttaggaggtgccaccgtttttaatgtaaattctggtacctctgtaattagtatttaaggtactaccaagtctttacaatagaaaatgtggtatctcttaacaagggaaatgtaaaatttctcatttaatttggtatgtgcttatctattagctctgtacttatgatatatatgtttattttgcttctacctacaatcgaaataaacgcagctactcctataacatattgctgtcaaattatatgatccatatgtcaaaagtgttcgccagtatatggaaaagtttcacacacttgtcatcagatgacccttgcaaataatcttaattatgtactagttaattaaggtccaagaattaattggtattttaattaaattggggttcactttgttataacaatgaaattaatctattgagctgaatctgacaggctcaccttctgcacagttttattaaaaaaatatttttaatgcaaattgttacattttggtgaacaagcttaattagttactagttacatttcggtgacaagtttaacaaactcatcatacataactagccgtatcagttctttaatttatgataggtactgtcatccctgatgcagataaagggacgggtcataaatagattaaggatcgagttcttaccacaaatattctgaatatgcatgtatgaggagtcttggggtaattaattaaggtataacggatcataatattggcaccatgaaagagaggaccctacatttgcaaaactaaggacgatgcatgccattctacacacatacaacacaagtagtgtaagccttagctatttcatgcgataaaataaacggcaattagcagccaattaacataggcacaaaaggtacattaataagaaagatgcttcagttccaaattcatacatccgtttgtgagaagctgtgttaggagtatactgcactgtatctggcatcttatatatctatgtataatgttcatataatgatactatttctttatctcattaaaccatatcacctcaattgtctttgacacttagatgattaatttatggtccaaattatttttatcattttctttctcatacgaagttatatcaccttagttttgtctttagatgattaatctatattatttctccttttttttattttgtcgttgaggcatatcaccttagttttactttttaatgatcaatttatatatgatttaaattattaaaaatcacgccatctaaactatttttaacttttttcatggtcgatcaaagatgaaaattatataaaattacgtcatccgtcatctagctatttttacatgttatttgttctattattatacagaacttccgctgcgatgcgcgggcccaatctaactctcatctgcttgcagaactcgatcgataaaaattaattaatgttgtcaattagctaattacgtcgcatgcgggagtcatcgcactgccaaatatctaaaaaaacatgtaatagtcctttcatttcagtaaataaacacatttatatttttttaatctatatattaaattgagaaatggaaatttggtagtcaggacttccttcgtcccctaatataagggatagactagtactttattcctttcacaatgtgagtcattctaacatttcccacattcatattgaggggg

SEQ ID NO: 62404 - DNA, 13701 bp, Oryza sativa
  unsure (1)..(13701): unsure at all n locations
gtggcctcctggatgcgtccatgaacccctccacacncgcggcaggacgaaagcttgaactggatgcggtggccgcaagagggagggatgactaccactcctgccgctccgccgaggccgtgacctgggccagggccggcgccgccgcacaaccacactcgcgccgagcggccgccagccgcgcctagccgcatcggcgccgccgtcgctcggccgagcttggctgcatcggagccaccgccgccgcgcctgcgcagtagcagccagagcaggagcaggagcaggagcgcgctcgccggcgaccttctactccggccagcttccgccgtcgacgacacccttcccttttcttgggtcgctggccggccctgccggcagccgaacctctcgtgacccgtgggccgtggctccgtgctcgttcaccgtccgcttcgcccgcatcccgcccaccatgctctgtccgccgcccgctccacccgcagctggccgccgctccactgccgcgctcgcccaccgccgctccgccggtgaagagaaaagtgaagaggagaaaaaagatatgtgaagctgacatgtgggttccatggaaattttttttttgctgactaggatgccacgtcagtaaaatcgggcaaaaatactgccaagggacctccggtgaacggtttgaatgaatttaggggcgaacatttctgattttgtggttgagagatatcgaaaaatctcgctattaagttgagggatctccggtgaacttattccatcccaagtgaaagtgacaatagcactaaaagtgacgggtcggcccgtcctgcacctgaagtccacaatgtatgtcatacctttttttctcgaggataaccggagttgtgcacgtcattactactagtatagtaataataacgtatttcttccgtaaaaaaatatatacgaaattacccccttaactattgcgtcggtacgaattacgtccttaaagcataaaaccagacatttggcacctcaaactttctaaatcgaacgaataaacccccccccccctaacttgacccatagcagttttggatcatacgtggcgcacacgtggcggtccaatcacctttaaaaaaaatagaaaatagtgggacccatctgccagatcttccttttccttcctctccgctaactccggcaccaggagttacgagattccccgcagcggcaaacgacatcgagggcgaggtggcaaaggagtagatcgacgacgagggatgtcacccgccacccgtcggtgtctcctcttctcttttcttccacttcctcccccttatctctttcttctttctcttttttttcttcagatttgtgcatcctttgacgcaggacaagctagcgaaggatagggtgtgtgtgcgcggtaggtggggaggggccatcctcgccgctaacaaccagtagagagtggggggacctagcactacttcaccttggccagatgacgtgggcgtggggcttgggttgccatggcatttaggtagaggaggagacgacaagacagggaagcacgggagggagagtaatggcgtacttcggggtcgccatcaccatcaccaccgcgcccatgacagagacggagacggagacgaaggggagggcagcaaggtcgtcgccgaggaggaggtggtggcgtctagggtgcatgtgcaggccgcaacgctactcctctcggcgcccgttgttgcctcattggcgaaaagagaaagagagaagaggagagaagctgacatgtagtgctcacaaactttttttaataaaaattggttgactggagtgccatgtgtaggataaaacttttcgaattgagttagggggtaatatattcggtttacatagttaagggtgtaaaatatttggttttcgagcttaggggataaaccggactaacacaatagttcagaggtaatttgttctttctagtattataaatttgatataatcagtacaataaatctagatagaattaccaactgccgagctctgatttttttttctttttgccaaaggtggagtaccaactgccaaaggcattatttcctgcacattcccagtaacgagaggctgtgccgctgtacgcggtgcgccacggcaacactacacagtaccgtcattctatagtaagggtgtgtttggatgggaggatttgggttgataggacatgacgaccctttttttgggtgtttggttgctgggcgaagactggataggatggctcgaaggggaatattcccctcagattttggacagagggatctggccgaatcggtcagatgcggccacccgagcgacggacgagctggatgaggggtcgcgtcacctccatggagagagaaggggtgatgacgacgccgatgcgtgcccagcggcgacgacaaggaggaggcgttgcggccgacgagcgccgcgtcggcagtagaagggtgcagtggcgaacgtcgcggcggcggtcagcggcgagagtcacgtcggcgggaagagggaatggcggtgagctcagagatccggcgcgggagatgagcgccgctgtgatgacgattagaacgcggcaacggttacaacgacgatgagaacccggtgacgacgacgacgatgcgggcggcgagcgccgcgtcgacgggaggaggcggggcgggaggaagcagcggcgggaagaggcgagcggcggccgacaggaggaggcggtcggcgggaggagaaggcggcaacggtgagccccagatccggccctgttttttttttctatgtgtatttataatggaggtagtggtgtaaaattgtattatgtaatttgatggattatattcaccgtctcaagtgagaggtgaccacacctacaaatccaccctactctcttcgaccaaacaaaaaattggatcaccaaatccaccttcattgtccttataatcaaataaaaaactggatcgtcatattcacacaatcaaacaaaaaaactgaaccgcagtatctaacaaaatatagaccactatatcccatcaactttaacagtgaaccaaacacaccctagactgcagcaaactgcgcatgcccctgtggcctaggccctcgtccaaataatctactgtgatctttcagcctgcggcagatgatgatgtgccactactattatatcaaggcaccgagattccttctgcaaatcctgcgatttcgcaggcagtatccaaagaacaaatggggcacaacaaaatcctgtagattaaaccacgagaaaatcagcaggggaatgttgcaaacggaacatgcatcgtagattccttttccgaatgcatcagatcagttcgtcctttggccattgggctcgttgctcattattcaccatttgacccaagcattacctggaggactatagtagggctacctccgtcctaaaataagtacagtcatggagatccgtgtctaacgtttaaccgttcgtcttatttgaaaaatttataaaaaaactaaaaaaaagtcacccataaagtactattcgtgttttatcatctaataacaacaaaaaatactaattacaaaaaaatttttaaataagacaaacggtcaaacgttggagataaataatgcaaaactgtgtttattttgggatggaggaagtacttctttcatcctattataagatatcacacatcctaatataaataaccgtttgtttaaacctgtaatatgatgacacatccggtactagataaacttattttgaaatagaggtagtatctcgtaaatagttcatctctaattggttgatctactgctgataagtccactaaacactaaatgatacaactgaaataaattgttggcaattattttttattatactattaatagttcaaatgccaatggtggaaagtagaatatgattagagaaacacaattaagtactatgtctcgagtttaaattttaacagcaatgactgatagaaaaaaaaggcaaacaatgaaagccacatgaaacagcaaaacacaaaaacaacatgtgcgtgcacaagaaacgcacatcgcaacacgagatggtcgtttttctgccccgtcctattgtgcagagaggacacggcgccgcgttggagcgcacagcacatgatccaactccagttcggagtgagctgcgaagcagtagtacacagtacgaacgggacagggcaggcagaggcagtttcagcgccttctcccaattttttttcaagaaaatccaagaaatatcatcgacgagaaatactatcaacaaacctaacttagaaatgctatcatacaatatttttgtctcaaaaataccataaccgttaggtttttggtgagaacgttccgttaacgttgtaaaaagaccattttacccctataaactgttaaaagttttaaaactatctatccgttagtgtaggttgctctttacatatcgtaagttgaccgaaatgcaaaaaatttaatcaactttcaacaattcatgggagtaaaatggtattttcatatacagagagttgctaatagaaacctaacggcaatggtatttctggggcaataggaattttacaaaccttgaaaaaaataccttgaagtacccaaatttttacaataaattttttagtaccataagattaatacctagatgtactaaattttacactagaaaatatgatacctccagatatcttctaaaggatggtaaaattaactctaggacaaaaatgtttgtataatggtattttatgaaagattgattcgttaatgactcttggagttaatgatatctcttggattgggtgtttgtcaatggtattttatggatttttttttggttgatatggaatgaggaaatgtgaaaatccattgtcgcattttgatcggccttggatgcgactgggcatccaaagaacaaatcaacacggacatatccaagctcaggagaaagaagcagtaaactactctgatccactcgaccactcgtagacccacccccaacaactctgccggctggcctccaagagatctcatggaaaaagtgccgtcttttgtagcaagtgaacaaagaaaatatccttgctcctctaatttcaattacaggtcagcagttttggcactctcagattcttttctaaagaatttatttgcacccttttcacatttgttttttaccataggatttgaacctcttgttcttctatattttccccttttccagaatgaatcgttttcttaatccttatgtacaaatttaaaacaactcacattaagtatgagaagatgtggtatactccactttcaaactgctactcaaccaccaagagaatcagcacattctcactaggacactacaaacagaggatcagatcaaggaagcacatgctcagagcttcagattaccagacgaagtataaaactcctacaatgctactactactacctcatatgatttcacaagctaaatccttattgccggagaaaactactaactcaagaggaggcacctactaagctagcactagtaactagtagtaatacaggcatcaagagggtaattaaggacataaaaatgaagacaaagaaaagttttctttttttttttggttcaagaaagctcctttcttgcactgcatcatccccgccgtgaaaagtgccatggagatgtcaccaaacagggaaattttgaacctttcccttttccctcctttcactctcactctcactatcactcactcactcactcagctgtttcttggcctccgtctcctcgtcctgtccgtcctcgccgccgcctttcttggggctctccaatgccctcttctcctcctcctcctcctcctcctagttgtcgccgccgccggtcgcgttcccggccgccgccgacggcgggcgcttctcggcgcgcgccttgagcacctcgaggagctgttccatggcttgctcgcgcccgttcctgcggttcttgatcagcacctcgctcacgtccgccggcgtgatctccgccgcgtcgatccacgtctccagcccggccatggtggcggcggctgcagcggaggaggaggaggcggaggagtcgtcgtcgaggtagttccggaggaggatcttgagcgccgggaacgtgcagtagctcatgaagatgtgcatgtccatgcggccggagcggagcagcgccgggtcgagcttctcgatgtggttggtggtgaagacgaagatgcgctccgagccgcagcacgaccagaggccgtcggtgaagttgagcaggccggagagcgtgatcgaccgcgccgccgcgccggccggcgccgccgccgcgttctggtcgatcgcgccgccgtcgatgctcgcccgcggcttcggcggctgcgccacggccacggcggtggcgcggttggtgaggtcaacggagcagtccatgtcctcgatcacgatgatggacttggaggtcgtcttcatcagcagcttccggagctcggcgttgctgccgacctcggtgagctcgaggtcgtacacgtcgtagccgaggtggttcgccatggcggcgatcatgctcgacttgcccgtcccgggcgggccgtacagtaggtagccgcgcttccacgcgcggcccgtgcgctcgtagaacgcgctcccgtcggcgaagtcgcgaaggtcggccatgatggcggccttgcgctccgggtccatggcgagcgtgtcgaacgtgctggggtgcttgaacgggacggggtcccacggcaggccgcgcgcgtccatggcgccgccgcgcgcgttggtgtagagcagccggtcctggctgcggcgccgaatgtccgcggcgccggcgaggatgtggtcgaggtacgccgggagcagaacgccccggtcgccgcggcggatccggagcgtgaaccggcgcttctcctcggggagcgggcgccacaaaaagccttgcgcctggcgcggcgcgacgacgtgctcccacgtgacggcggcgccgcggaaggcgtcgagcacccggtcgctggcggcgagtccgaaggtgaaggacgacgcgttgtgggggcgcgacagggtgagcctggcccccgcggcgggcgccgccgagctgctgaggtagagctgcacggcgtcgtagatctcgttggtgcccatcccctccgtctccgtcacgtcgaagtagcagtagggcgagaaggcgcgcgtcgcccgccccagcagccgcgccaccgccgcccggagctccgccgggaacaccgcgtgcaccaccccctgcaagaacgccaccgcgcccatcagcgacgccagcgacgtccagtactccctcatctctcctcctcctctcccctccacaatgcaatgcaacaagaaaatctcgaggattttggaagcgaagaggaggaggaagacgatgatttataggcgaagaagccggagacaacgcaaggcaaggtcgctatcaacggagagagacgacagtttttttcttcttttttttcttgagaaattattggcagggagaaaggatggatggattcttgatgcagttgcagttgcagtgtgattgagtgcggcagagatggatggagacaaagatgcagattaacacatgatggagagatctcctggattgagttcagagttcacagttgagagagagagagaaacaggggagatcttgctcggtttggactgcgagggtggagaggagatacgctgatactcccccgtccctttatacaaggcattttaatttttaatattttgtttgcatttttttttgactgtttgtctcattcaaaaaatttatataaatataaaaaataaaaattgtgcttaagtattttggataataaagtagccacaaataaaataaataataattttaaatttttttaataagacgaatggttaaacaacgcaaacaaaatgttaaaataggaacggagggagtatgaactactagtacattgtaatgatgctactgtacaatccttttggcagagggttcaattggtgcaaggctcccgttgaaatagagtaggaaaaggttttttttttttttggaggattcaactttctaaggacttttattttgagccccttgattcagaataagaagatagagaattttctatagaattataatcctatgaccaattgcatagaaaaaataaccaaaaggttagatctcttggaagactttcctttgatttattttccctgaggtgtaatcaaaaggctcatctttctgttagctctgccttttaatttccgtagaattgaaagagcgtgctacttcaattcttaccttttttttgttttatgttcgttgcatttttttttcggtccagtgttttaatactcgttttttccctaggtggctgacaccgtgggcttggactcttggaccatggattcttgggagttcccttttttttttttttggtatcaagattcttgggagttggaaggcactcaaccatgaacagtttaggtgtcccaatgagatgcacaattgcacaatacacatactattcttaaggcctcctataggttggtcttcaaacgatcttaatggttttcatcagttcagttactgctaatagaaaaatgaacaaagcaataaaaaaaacttttgcatctgagttatgagggatttaaaaaccaaggctgaaaaccagagcacaattcataaaccaaaaataaactctaaatgtaagtttaaaaatcaaaattttgctgataaggcactgtttagttcccacgcaaaaacatttcaccatgtcacatcgaatgtttgagcacatgtatggagtattaaatatagtcaaaaaaaataaaaccaattacacagattgcgtgtaaattgcgagatgaattttttaatcctaattgctccatgatttaatattgtggtgctacaataatcatttgctaatgacggattaaataggcttaataaattcgtctcgtagtttacatgcggaatctgtaatttattttgttattagtctacgtttaatacttcaaatatgtgtacgtatatccgatgtgacacgctaaaacttctcaccctggaatcctatcttagtataaagttatcccccactaactccttaagcttaacattcaaagatgccacatcatcatccactaacaagataccacatcatcatctactaattaacaagatgccatatcatcatccactaacaatcatcacatttaaacatcgtgcaaacatgctatatctttatagtttttataatttaagagcttttcaaatacaaacatgttaaattatcatccaacataattcacataatgtttcaatgtatatctttattatgttttatgatatcctatatacttatatatagttcatcctcacttagttagtgcttaaatgattaatctatgatccaaattatatttctccttttttcctctaattaagtcatatcacatcaattttttttagcctttagatgattaatctacagtctaaactatctccctactttatctcttccataaagtcataccaccttactttttacgtttgaatcactattctacatcctatttaaatttaaattatcataaaccacattagtttatataatatgatgttatctagctatcttacccgttatttttttattattatcatactaaattcccgcagcaatgcgcggggtttcacctagttaaacagggcctaagccaacaagcagacggtgtaaaccgttaatagttttatataaaaaaaatgtacaaataacctcagttgtcaattccggtaagggagattgatatgtacagtggagtaccttgcttggggggatattgcaaaaattgctttactatataatattccttttctgaaactatttttttttacttttcattcaaccgctctgaacagaccagtacaacattggattctttttggaaagaaatgggagtttcttcaccatgaaagtaaaatggtcggtttaccttattttgagaaaatagtactactaatggctgaataacaggtcccaagttcacacgcatccacactgtatttcacaactcacaagccatgcatgtctccgtcaatctctctctggcattgtgtttaggggtgcgcagaaaaagaccgaaccaaaaaaccgaaccaaaaagaccgagatagagaccgaaaagactgagaccgagaaattcggtcatcaattcggtcctaggtagtgaaagaccgaattttgttcggtcaattcggttagtctcctcgtgtaaccgaatagaccgaaaagaccgaattatcaaaaatgtctagatgcaacctcaatccactatgtttaataggattaaactctaattttcacattcctacttcttctaggcatgcaacctaataagagtctttacttataagtgtttacggatcttttttgtgatttttgtgttgaaaatttccattatttctttgcatatatgaaaatgttgttgaatttcggtcaggaccgagaccgagaccgagaccgaatttgtcgggcctgacatttttgcgctgaaattcggtcttcacttttcaaagaccgaaaagaccaaaagagcgaagaccgagaccgaaattttcagttagaccgaatgcccacccataaatttgtgtttgcatgcgggggtgtttagatacatgggtgtaaagttttgacgtgtcacatcaggtattatatagggtgttgcatggggtgtttgggcactaataaaaaactaattatagaatccgtcagtaaaccgcgagaagaatttattaacctaattaattcgtcattagcaaatatttactgaagcaccacattgttaaatcatagagcaattaggcttaaaagatttgtctcgtaaattagtcgtaatctgtgcaattagtttttttaaatctatatttaatacttttattaaacgtttgatgtggcagggtgaaaaattttaggatgggatcttaagagcaagtttaatagtatagcccactactagctccaaatcatctataatcaatgtaatagccaattcatacaatagttagttattatactattaatacctagttacacctgtcatatatattacgtcttaaagttcgtgctgcagctggctatagatctgtaacccgctactcttctctctattttttttttttgcccgctattgtacctgctctaaacaggcctgcagtcaattcagctactgcatgtacgacaaaagataatatttggcgacaaagattgcaccgactcgttgtggactgtaaatgaaaggtactagtactaccttcctgcttcctgcaattttcaatgcctagttgtgccttggtagtttgccgttgtctcatttcgctaatattgctactaccatttcagagtttagtagtagtagtacattgcaactcgcacgagtggtaatcattccgtgggcacacgttagggcattagcaatgcagctaccgcacttgccgttcctgagctgccacctaacccaagtcctttgagagtcacacactccacagtagaggaggaggataaggctaggaccttccgtgtctctgttgctctttctcatcacttatcatctctcaacccctctctctctctcctctctacatgtaccggcggcggggcgtcccgaggagcggcggtggctctgggtggcatcggcgctaggtggcggggtggcccaagccacgacgacaccgggcggcggtggcagggcgtcccgagcggcggcggtggcaccggtcggcgttggcgctaggtggcggggcggcccaagccgcgatggcgccggacgccaggcggcgagcgggtcgagcggcggcggcggcgctaggtggcagggtggcccgggcggtggcgagcgggtcgagcggcgggacggccggagccgcggcggcactaggcggcggggcgggtcgagcggcggcggcgccaggtgcgggttgagcggcgatggcccgatgcctgcgccaagccactcgtgttttttggttccaagaacgagtatcgaagtttggctccgagtacctcgtttggctccgcgagttgccgatgtggcatcgaataatcggttcttggctgctaggctgaacgccacctcggtgcgttgtgaacgcccttatggccctttggaaacgtaccatagaagaaaacatggtataaataagtgaaacagaaggatcgaaatagcatgtttttcttaagagcgatgttccggtgttctctactgttagtattatattaccagtattattagggataaatcagtaatttactaatacaatgattaggttattttatcatttatgttttttcctggctaaatcgatctatgagcacccattgtgttggtatcgcttatattccattgaaaaaaccaaaaaaagggaaaaaggtttagtcatggctaaaagatgattatacctctcccatctttttttacaataattttcctccgtgttttactaccgctaactgtggtaatactataaatagatccgaaccgttcgattaaataacatcaatagttcagattgctttctactcactgcattggatcacgtcatctctaatgggctcatgcccttacctgtgatgggttaagcgttggtcacagatcagtggtcactgatgcctctaggtcacctgtgacgagtaaagacccatcagaggtaagagttacctttgacggactacaactaaaatccgtcacatgtaaccttcatatgtgacgggtaaatattttaactcgttgatggtaatccttatctgtgaggggtccgagttgggacctgccacaaacctcaaaaatggggaaaaatattataagcctagctagtcgcaaaccttcattaggcattcacaaatcacaaaaataatcacattcacaatcatttgtgcacaaaacagaatcaccaaaatcgtccacaatcacattcatctggccaaagaaaaaaatcacttcacattcacaatcatttgggcacaaaacaaaatcacaaaaatcatcacaatcatattcatctgggcacagaacagaaagtatcaactccatctagcggcaatggatctgaggggaagggatctagcggcggagctcgatctggaattcaccaccgccagatcccacgattggggcccggatccacccacaagctccagatccggccagcacctgcaagctccagaatggatctggcaaagacttgccatcaatatgaaacgcatcacaaaattaatgagaataaaatagatactttccattgatgatgaaatcctaaagccactgttggcggtcgtcgtcgtcgtcgcttgagcggatctggaggtggtggctgctgggaccttggggcagagggcgaaggaggaggtggctacagcttggggccgtccagatatagtggtcttcgaccaccttgagaccagatctggcgccaaggagctcgagacggcggagagacggtggccggtgaccttgggattgagggagaaggaggcgactgctggagcatggggggcatctagatcctgtggtccccaaccacctggagaacggatctggcagctaggagctcgtggcgacaaagagaccgtgaccaatgatcgaccttgggcattgcacaaaggaggcggcttgctcgagcttctagaggcccagggcgagcgaaaggaa

SEQ ID NO: 62405 - DNA, 20640 bp, Oryza sativa
agatcttcttgcagcttcctgcgcgattagaagatgagtttagaaaataacaagggaatggggcgctaagaataacgcagaaatgttggaattctattggccttttttgccattctatttgccttcaaatatcggcatgatgttaacttatatcctacacatgaaattaaaatataagccgcttttgttgtttgtacttcctccgtttcatattataagactttctagcattgtccacattcatatatatgttaatgaatctagacatgtatgtgtgcctagattcattaacatctatatgaatgtgggcaatgctagaaagtcttataacttgaaacggaggtagtaatttatatctattctctccagtattggaagatttgatctgatttcctatttctttcttactatactactctaagtgatcatgatggtataatatgggtttctatgctttttaatttttgttatatactaaaaagtaaaaacattagaaaagtatagttaatagttaaatgtaaatgtgtacatttttatctacctgtgccatatagcttttttggcatttagatggtcatacatcacgcatttggtgttttgactttgacaactggacagtaactgttcctattattgtgcttttccatcattcattcttttgtattctgaatgttgttcagttgtttatatcatgggtacgatgattacaggttcaaattctaattgatgaatcaagaaagatggagtctagtatatacaaaatgtggtcatttgcaaagcagacagagaaaagggttgaagatctatattcagatgtgaaaaaggtaagattatacttcctcagtcatctttgaattcctaactctttttcaaatataagtcataataacttgaggcaccttttactatctcttttttcctttgtcctttttgaatacatattatcactcatgaacatgtatcccactatgtataaatgaagggcaacgaactcatttgatcactttcttaatccttgtgcacaagtataaaaacagtttgtatatggaatcagagtctcagagaaagtatatattatcatttgttttgacattcatctgaacatatatctaatgcagaaatgctgtatttttgtgggtacgactgctgcataatccgaactacttattagctttatagtgggtggttaaatacatgtgcctgacaggaggtttctgctggtggtcatccttacttttttttttaaaaaaaaatgttccagatgagatataatttttggagacaccagggtaaagagaactgtgtgggaaattctagaataatatacccaaaactaaaataccttatttttctcaaaaacacaggaggactgcgccttattttattaataagaagaagaagaagaagaagaagaagaagaaatatgtacaaacgagggatccaaaaggacccctcaagaccccaaaaagtcatcacaaaaagcgacgcgcaactaaaataccttatgagagggataataaatgcaatataaaataggccccgtttagattccaacttttttcttcaaacttccaacttttccgtcacatcgaactttcctacacacacaaacttccaacttttccgtcacatcgttccaatttcttcaaacttccaattttagtgtggaactaaacacaaccatagtattggccaaatggagtgctttcacgttggtcttctttcctatatccaattcagcactcactggaaattctgtgtgcccctacttcacttcagcttggtagtttcccccacctttccaggaagcctgggtatataactgcagacttgaatagccacctatgaatgctttatgcccaattattccaactaactatttcatcctatctttgcgtagcttttgccacagaattagctgatgattattcgccagataatattcctctgaaaacatgaaaacattccaactaaactatttcatggatggtcgcagtccttttgtatttctttggcaagccgttttgtactaaaatctgccctaatgggcttgtttgagtccttttggactcttttccttcttaatataacgatgctcagctctcctgtatgttcgagaaaaaaaatgaaaacattgttgggtttgaccaatgattaaggactgccatgatcttcaactgctgcagttaactagttaagaatttccaagatatgcaattgccaagtgctattgttctgttaagtgttctgaaatgttcaacaactcacattcaaagtctctacatatttctatatgtactggcatggtgtagtgtattcattcatactatggaagctaaatatagaactgtgtgactgaacaattacctgcagataacagtgtcctattgcttgcacatgagagtagtaaataatttgagtttgcttgcatatgtgtttgttaggttgatatcacccttatacaatgttccagataagataattgttcgatgcaccacagtagaaaattttcctggcagcttctttaattaatgatatggtaaaataaaaacattacaagtaaataaaatgctttattcattaaagaacatgaaatattaatatgggtttgagtagggaagttttatgatgattcctgcagatattaaaatttcaaaatttatattgtttatttttctgtgcaatttaccctgtttcagtaccgttgcactaataacatctacacagggcttcaagcagaagggaataaaagttccatcctggatggattggtgatgttgtcgactcggtgaactatcattaaccttggcggagtatagtgcaccccttgatattgtaagttgcaacactacttatttagcagctgatcatgcattatctatgtttttttgtgatatagatatatgtcacaataggttcttggcgtaagttcatcatgtagttatcagttatgtggtctgctctgaatgcgactgtttgatgtcactacgccgccatggtactgtacatatgtcgccattcggtaacacgtgacctcaaagacttgagtgcttgtaaataagtttgtgttaatcttgttttgaagagttcaaggataatgatcgctcataactttaagtgtggaatttcgctcttgctttggcgcaatcgaagtgtcttgtggagtagacacaagtgagagttcctgtctgtccgtgccaagttgtgctgtgaaaacctagttcttgtcagcaatgaattggctgtatgattctgacgtataagtgcttgcgtggtgcctgccagatgagcaaggtcaagtgcaacgatgagcacaccatgtctccacggagaaacgtgtagcagaggtacaaagacactgttgatagatactcatactacacaaatgatcctgagatgtttccagaaaatgcatcagcacatgatctctacatctcctgtttataccagtaattgcagtctataaacatgaattatactccctccgtattttgttaatgtatgacgccattgacattttgactaacgtttaaccattcgttttatttaaattttttttttgcaaatatgaaaatatttatgtcatgcttaaagaacatttgatgatgatcaagtcacaatgaaataaatgataattatataaatttttaaataaaacgaatggtcaaatgttagataaaaagtcaacggcgtcatatattaaaatatggagggagtacgatttatcatcatataaagagtttttcttcctttgtgtcttcaccgtcgatagttttttttttctaaaatatccaaagcacccgaatttatctctgtccattccactagagtagagttggataaaataacgccatagacacccttcgccaccatggtgcctgtcagggtgatggagaggaattaggggaaccatcacagtagataaatttatctaaatgtctctcttggtttccagcttacaattttccagcttacaattttgccactctaaagaggttttttgcctacgtggcacgtcagcgtggcttacaaatgggaaaaaaacagcgtgggactcagccgtgagcttctcccactctccccttccttttcttctttggcgtgtttgtacagtcacggcgagcttgagccacgacccccagcccatccctagtcgctacgacccccaataccactcccttcccgtgccacccctctctcatcttgctgttgccaccccaacaaccaccgttgtagtgagtagctttcgagcactagccccaccgattaggggtggacatttggtctaaccgaaaattttggtctcggttttcggtctttcggttatttcggtctttaaaaagtgaagaccaaatttcaacgtaaaaatgtcaggaccgacaaattcggtctcggtctataagcaaagactcttattaggttttattaggttgcatgcctagaagaagtagaaatgtaaaaaatagagtttaatcctattgaacttagtggattgtaggttgcatttagacatttttttgttaattcagtcttttcaatctattcggttaaccgatgagactaatcgaattgaccaaacaaaattctgtctttcactacttaggaacgaattgatgaccaaatttctcgatctcagtctttttctgctcacccctaccaccgacgatgaggggtaggccctccacgccgccgatgacgctcgccactctatccccaggagtctgtgtttccccttctctccatccccccctccgacacacaccgacgggatggacctactccaacgacgacggcgttgtcgtgacgctaggatagagcatcgtgctgcgcatgaggttctacggcttccaacgtgccttcctcctcctcgctgccatttgtcaacatgcatcgtggcgcacatgtagggcttccaccttggtggcgcggtcgccacctgctcatcattgagaggttcttcgttgttgtgtaagagtcttgggtgtgtgtccgcctcaagtacctcgcgtcaggttggccaagcacccggtcgcccatgatgtcatgcccgcgtgcatcggagagggagatggacacaaggaagaggctggcgggtgggtcccatgttgtttttcatgtttgtaaaccacgtagataaaggtgacaaatagttaagaagtcacctatgtagagtgataaatttgtaagctgaaaactaagagggtatttttataattgccaaatgcaatagtggcaaatagttaaattcacccgtgtaaatcaccattgctagatggaaatgtccctaaccagtaacagagcttgagagaaatttgaggggctaatatgtaaaatttattggccatgggggctagctactgatgtcataaaaaaaatgatttcattgattttcaggaaagttggggaccataggagcatggcccatgatggtgtctatgaagctccgcccttggcccagtggactggagccccttctacttgacgggtacacgatggtggtgaccttagcacggcttatcaatttttttttaccatcttcctattttagtccccttttgattataaggaaattcaaaattcacagaaattttagagagctttatttctacagtaatgaaccctgtgaaatcttataaaatttctatggaatgtctctttccatgtaaattttggaggaaatttaacatgaggtagaatctaatggaaaaaatcatttgagtgtttatctctcctcaaattcttgtatttttcctacggtccaattaaatggtcattcctatgtttattatgtgttttgcaaacctatgcatatttgtattcctgtcagaattctatatttttcttatttatctgtttttttatttatgtgattcaaaggatgccttagattattcctaatattttacaagtatgagcagatatcagcttatcaactccgttttagcattgactactccctccgtttcatattatagtcttttgaatttttttcctagtcaaatgtttaaccaaatttataaaaaaatttagtaacagctaaaatattaaattagttctattaaatctaacatttaatatattttgataatatgcttcttttgggttgaaaatatcactatatatttttataaatttggttaaacttaaagaagtttgattaggaaaaagataaacgacttgtaatatgaaacggagggagtagatgacatatatgcaccattcaaccacctagaatgatttgcaatgagtggcatatccattctggtctatatgctgttaattcctactccatcgttttggtcaaattctggccaatattaattgatcgaaattaacatgccacttgttataccgtttcaagcatgagttcttcttccatcgaatttggcttagttgataattaaattatgtataggtaaaaacttatttatctacgtcatactttctttcgttactactccctccttcctaaaatatttaacgccgttgatttttttaaacatgtttgaccgttcatcttattcaaaaactattgtgaaatgtgtaaaactatatgtatacataaaagtatatttaacaataaatcaaataattggaaaagaattaataattaaatttaaataagacgaacggtcaaacatttttaaaaaggtcaacgtcgtcaaacattttgggatggagggagtaccacttttaaatatagttacatgataatctctcaaaataagtaggtttttccctgtgcaccagtaataaagatggtgcctgcctctgtgccactaaaaacttatgagcctccctctatgccatcgtcgaactttatcgcgccctccacaacattccgtcgctattctgtttaggtttaaccgtttggtatctctggcatgtgggcccgggcaagaaaaatatcgttcttgccatttcaatcgctggcatcaacgtctgcctcgtcttcccttgtcgccatcgtctccgccgagccgagcggacagcgccgctggccacccctccaaccggcgcccgacctcctcctttgcccggcgccgctccggctcctccagcctgacggcctccatcaccgccgcgctggccttcccccatcctccttgccgccctgacctccttccccgatgccgcagggccaccttcaggccacggtgttcatcagtgtcagcgctactaccggagacggacgccggcgcgtcgttgtcttccgcggggaggcggtggaacatgggactggtgaacgcgatggccatgatgacgatggtggtggcggcaacgagcgggcccgccacggcgcctctgacgatctggccgtgtggcccccgcgagagatatcgagaggtcaccgccacgcagggccgaccggcgcctgggcgccgcgccgccgtcgccttggcccgatcgccggccttcccccatcctcctcattgtcccggccttcttccccgatgctgcagggccaccttcaggccgccgccgccgtgcagggctcgccgccgcccgccgtcacccagccgggacaccgcgccgccgtcgccacggctcacgccatcgttgccttggcccggtcgctggccgcgccgccgcacctagcctcgccgctgcaccggccgcgtagggctgactgccgcccagccgccgcccagccgggacaccgggccgcccgtcgcctcggcccgatcgccggccgcgccgttgcacctagcctcgccgcgccaagcaacgcaaggcgcgagggagagaaacgaagaaagcaaagagagaaagagagagcaggtttttccctgtgtgccgtctcaagtctaaggacaactaagtcatttggctgtgcagttacccaccgttacgaccaaaaacagacggaatggtgtgaagagcgcaataaagtttgacgatggcatagagggaggctcgaactttttagtggcacagaagcaggcaccatctttcttaatggcacagagggaaaaacctccaaaataagtgtacttaagtaaggatgtaacatatgaactacgaatctgaatagcctgtacagattcataggtctagtgtatcacatccttacctaggtgtaagggtgcaagcgggcaggcttgcaaacccgcttatataccttttacctaggtgcacttattttgaggtgaacgatccattttataataatataattattgtatttttttattataaacccaaaaggttacaattgtattggccgaaatgtcctaatacattataatttaatatgattatttaatagttgataaggatgagttaattccaaaaaggaatattccaaggtttggatgagcttcacacctcaaaatttggcagaccagtccaacataatttctctctcactgacaagtggactacatcctcccatctataagaaaagacgagaccagtctaaccctcatgccaaacagataatggaatcatccaattctaaataatacggatgggtctaacccatcctttcttatcctcaaactaaacacaccctacgaggcctcatattttagggtggctttgatggagattttcagacgcaaatgaaacaagaaaactcaataatacatgattagttaagtattagctattataaatttaaaatttagattcattttatttttctaaagaaaacttttttatattttttccacaaaaaattttgtttagtcgtttaaaagcgtgttaaccaaaaataagaaagttgttggttgaagttaccgcctaaaactcagtcttactcagaaactatcaagtagtttccaactttccatacttaccatatcatttagacagtatatatataaactatatatccaatggattgtgtctttaaattaaattttcatccaatcatcttcattctctctcattttatcaaccaatctctttatttttattcttggttcttgtgtagagatggtttcttgaatgagaaatagtttcttcatctttttatctctctacttattaactctcttgccacatcagatttttactcatgtgacaatatatttaatgttatggatactagatgatatgaaggattggggatagccttagtgcaatggtcacataattcttttccataaagaatagcagcaagcattcgtcactcagctcaggggagaaccaccgcatagcatgcatggatcatgctttgccgcatcctccgtgacgatatacggtccacaagagtccgaaacggtccccaaaaataagccaaaatgttgccggggcttgcgtctgaccaacattgatcgatcaggtcgcaatgggcctctatctttatctcacttcccattaacacgtttattaaatatatgtttcgtgcgaaaacctttttaaaaaatatataaaaatactaaataaatttatttattaaatttataaataaatttataataattatctcgtttggcgtgctccgaaaaatctcgcattcgtatctaattcgagtcgaacggggcttatatactcctcgtgcaccaccaccaagcaccaggcgcgcatgcatgcttcatgctgctgtgccccacccgagtccgtgtcccacacccgtagaatctcctacaaatatagcggcactagctatccgacgcgcaccaccaccacctcctcctttgcaccggaattcaccaacaaaaaacagagcacggccatggcaccgacgacggcggcggcggcggcgagcagcaacggcggcggcgagagcgacggcagcagcaaggagtggaggctgacggcgccgacgaggggcggcgcgatggcggcggcgggggacaagatgagcatccgggcggtgcggtacaagatcagcgccagcgtcgacgaccgcggcccgcgccccgtcctgccgctcgcccacggcgacccctccgtgttccccgagttccgcaccgccgccgaggccgaggacgccgtcgccgacgcgctccgctccggcgacttcaactgctaccccgccggcgtcggcctccccgccgcgcgacggtaccacccacgccatccacttccgttttttttttgttttcattattttccggcgagttcaaatattcggttttggttttatgttttttttccgcttccgtttctttgccgattaattgttcgctacgtgtgcatggttcatgtttgccttttatggcctttattaaaattagtttattaaattttctcaactatttgtttgttaacgagaactagcaagctgagccgaggcgagccatatatagtgaggccagttttcgttcaaaattgaatagtttagtttaaaaaatttatcaactagagtactttcgaatcgagccagtgataacacgtatttactaatagtgcttattttattcattaatgataattataatacgaattatacgaatagtgtttagggactggttggttcatttgcttattttgtgtgccaaacagcatatatcaccaatttagcaagctatagtttttcgacactcgacaaaaagctcgccacacttatggccaaaataaatcagcttgcaaattgagtctataagcaaatctaaaaacgctacaattgcagttataagccaaacgttttgccagaagaaccggagctgcctactttagacgtgataaagtttggcaataaactaaaacagtcccctagtctgcgtaccattctttgtttactaacaaaagcgtgctactttacccaccagttatataatttgttcactttgatccgattcctattttgcaacatgtacgggtgatatatatttcatatacacatcatcaggcacctataattaagctgcatgggtcttctctgttgtagtgagcacactttggtcataattttaaggactgtagcactgaaaaatagatttatttgaattttttaaacaacttgcacatataatttttttatgaaaatatataattttacagtttgaaaagtgtgctaatgaaaaatgagaaatttggagttcagagttgaaaaaaagaaccggcaaaacaacaaccccatatgcaacacgaggtcagtagggtcacaactcacaacctccctgtaatgtaatcccggggaagatttgtttcgattcaaacccatatagaaccatggatttaattgaatttaaactggatgaagaaaacaattattgaagtagtgttattacacatgtcacatgtgcgcgaatactgtattggcgtcgatctcgaggcgtactactcccgtggtcggcgagagctagtaggggaggagaactgaagtggaaccaacggctggcgatggacgggacgtacggcccgagcggcgcacgcgcccgcggcgggggagcacgagccccgcgtcgtccacgcccgcccccaccgcgtgctggcacgccccccggctgctgcggctcgtccgacgtggcgggcgcacagcctggatggagccttcattgtgcatctgtgctagctgtaggactgaaggctgtagctgctggatttctgggggaaaaaacaaaagaaagaggaggaaaagaaaggaaggaaaatgtgctctcttttgaattgagaacaatcgtgccttttgtggactagaagcaggggagaagaatatatagtccaataattcggtttttctgggttgatgatgcatttcttctttagaaaggattttacatgctgttttttttaataatggcatgttgttcattatgttttttttttcatgtatgattattaattaaatgttttatttgcgccgaggatgcagttcttcctgaaagaggcatttacgtgatgttggttcatgcttgcttatgtgattgttaattatatcataatatatcttgattaatcttgtgcctttcttttgaatatagtgctgtggcagatcatttgtcacgcgacctcccatacaagctatcttctgatgacatcttcctaaccgctggaggaactcaggccatcgaggtcgtaatctcaatccttgcccaacctggcacaaacatattgcttcctagaccaggctacccaaactatgaagctcgagccgcgttcaacaaccttgaagttcgtcactttgatcttattcctgagaagggctgggagattgaccttaactccctagaatctattgcggacaagaacactactgcgatagtcatcataaatcccaataatccatgcgggaatgtgtacacttacgagcatttatccaaggttcagctggtttatttaaatttgataaaagtttaaataatattatgggcaacttattaatgtgcatatgtattattgttatttaggtggcagaggtagcaaggaagcttgggatattggtaattactgatgaggtgtatggtaatttggtttttgggagttccccatttgtcccaatgggttgctttgggcacatcgtaccaatattaaccataggatcgctatcaaagaggtggatagtgccgggatggcgacttggttgggtagcaatatgtgaccccaagaagactctacaagaaaccaaggtaaaatatatatttaatactgttttgatactttttttgtgaattgatatttgaaatatatatttttctaagtgtatactactttctttgtagattgcaacattaattactaatttccttaatgtttcaactgatccagcaactttcattcaggttagtgtttttttccttaacaagccaatgtttgggttataattttggtcatttatctgctttatgtaatgtttggtggactatgtgttgtggtcgctcttcggaaattggatggctgttcaaaatgcacagtgtggtgtctagcattgtttgtagctgagaaaaactactggtttaaaatatactatcgaatacttaccaaataaatagtacttatgaatcagagttataatcaaacataagttcatcaaagtaacaaaaaaagtttaattcagttttttatgttcatttcatcctatttctgttaaaacataataatatgttttaaaaattaattgagaagatgaggtttgtattttgtgttcactctgaggtgcgtagttatttaagtgataatgtgaagttcaatgttacgttaaagtaagcatacaattcttatactgagattatttattggtatcttgctttaaaaatattatattggcctcgtgtattcattttatctcaaataattgaattgtgcatgttttgttgttgaatttcttagggagctctaccgaatattcttaagaataccaaggaagaattctttaagaggataattgatttgcttacggaaacatcagatatttgctatagaggaataaaggatattaaatgcatcacttgtcctcacaagcccgaaggatccatgtttgtgatggtaagatttcctcttaaatcattttatcattagagctgtactagcatcaatttatcacactcaaaaaataattatgctatatttaatttagttggcacctaaaacacttaattcagagtcatgagaaatttttggtgtattgtgttgaagaataatgctataattaggaagttgtagtttgccatgttaacatcaattttcttttgttgctacaacatacttgtcacttaagcttcacttccagtaatcttacattgaaatcctataaacaggtgaaattgaacctatatcttttggagggaatccatgatgatgttgatttttgttgccaacttgcgaaagaagagtcggtgattctttgcccaggtacatctaacatttttgttaataaatggatatgtatgtgcctatttaattaaagaaagttaaaaatttaatattatattattcaattcacttgttatgttcttgtaattctctaacgctataccatgacatataagtgatgctaccttatttagtttctcacaaatctaatgattactttttggctaaacatttatgcttattaattaattttgttatgaaactttgaaaattattctatgattttgttgcttaaaaaaagttaatagttaattacttttagttttgcatctctaatcactaatagataatagtttagttagaatatttaaatatatgtggttatgagttttttattgattgcatgtaaactttttatatgtgatatatgaatatgacgacattattttatttctatatatgaaagaaaatttagcaaagtgatgcaatgatattcagacaggcacattatatccctacctgttgtttttgtcttatggatgaacaaatgaaagatcatctgctttttttataatatttgagaatacaaacggatattgactatctaaaagataaaagttgttttaaaatacaagaaacttatatgtagaaaacattttgcaaaaaccgcaccatccatgagcttggaaagtgtgcttgtaagaatccataatctgtaagaggaaaagaacagggccaatcacatgtaaataaaaattgcgtatgccttaattatatgagaaaatataattcaatgtccaacaatatttgggtacacgtactttgtccttttagtttatggatgttgattactttaagtactgaaggaaaaactaacaaagagatctaatattatgctaccactttaaatattagttaactctgtagtagtaaattaagctagagatttaatataatatcttaaataaagtaaatgttatagccttgttaatgtttctattttacgaataatgtatttatacatatactttacgtatcctaatttaactatgttgcctaaatgcagggagtgtgctgggaatgaagaattgggttcgcattacttttgctattgattcatcttctctcctggatggtcttgagaggatcaaatccttctgccaaaggcacaagaagaaaaaccctttaaattatatctagattgtactaggattggaatgatcagtactaattgtgatgtttgtgctttatacctgttgtcaccaaaatggaactattaatttgctatgaataaagcttacaaattcatatgtgtcaatgaactcatctataaaagttgcacatgtagtttacatagacttgacggttacttctcatcaaggacttttatttacctttgttacattttgaaggcccattatatgttatgggacctctaattagtcttatgatttgccaatggtaacatacttttcttaaaactccaataaataaataaaatattggcatataccacatgaaccagagattaaaataacagcatattggtgaaatagtcccttatatttgccaaattatctcacaaccccacatgtatactctcacttaagccatttattgcaatgatttagtttgtgttgatggcacacaaattaggaatttcggtactttgccattccacaaaattagcatcaattatttgacatcttgggccacatgcttggtctcacatgtctacatttcccaagtagtaaaatgtgccttcgtatttgcaaaacaggaggcactcatagtgcacgcgtgggagctatagtacactggtggagaaactgaaagggtcaattaggcctagagggggggtgaataggctaatttaaaacttaagaaatacggaagcagtaatttttggagctaggctgggaattttcggaacttccgaaaatgcacagagcagcgcacacaaaatgaaaactctagatctataagactataacagggaatacaaggcacaatcagcaactagaccaatagcggcacaagcaagcaaagctagaggagagggatgaagaaatatcaccaagatgtagctcccaaagttgttccctggagttcaaatccttaaggggattctactctctgttgaggaactcactaagagccgggtcttagctaacccttttctcaagaggttgcactaagcactcctcctttcactaagaggtatctcttcccttgcggaggcgagatccggccttcacaaacttctcctggccaaccacaagtagatcggtggctcgggagtgacatctagccgtctaggagtcctcaacctccaagagtaaaagatgatgcaaagaactcccggagatgatgcaattgctcacaaatcttcacaaagaccacaagaagcacccacacaagctcgaatccacactctcacacacacaccaaatccaaatcaaacacgggtggagagatgaatcgaggaagcaaggctcaaatgaactagagagagagagagcaagccaagggcacaaataattggaatggaaccagcaaccctcacaagtgaggggaggtgggtatttatacccacagcacaaatctgcccgttagagtgcaataaaagggattttcggaacttccgaaacaattatcggaacttccgaaaattccagatctgagaaaaatcgaagtcaacgcaattttcggaacttccgaaaaaaattttcggaacttctgaaaatttccagaacgcttctgtgtattttcggaacttccgaaaatttccagagagctctcaaacggttctgtgtattttcggaacttctgaaaattattttcggaacttccgaaaatttccagaacgcccaaacgcggttctgtgtattttcggaacatccgaaaatttccagaacgctccaaaagagaaatgcttcgaagtaaaattgattttgagcacacgcatcactccttatatgtctatgcatcatccccttaatagtacggctttcctacgacacaatgcgaggaaaaagatacaatataccatttgatcattgccgcattgcatcgcgatgtcgcattcacgggatatgcattgtattacaacacgttgagaacttaacaaccttcacatttgcttgaataaaaatgttagtcctctctaatcgcatagtaatcaatcatcaaaatcattaggggcctagatgcattttcagaaaccatctttggtcggtcgaccagattttacaatagtccctgttatattaaaaatcgggactaaaaatatctttagtcccggtttaaaagctacatggtacttttcaatctttagtaccagttggtgttagcaaccgggactaaagatctatttgtagtcctggttgataacaccaaccgggaaaaaagatcgccatacgctttactcccggttggtgactaaagatctatttatagtcctggttggtaaaaccaaccgggagtaaagatcgacgctgagatcggagaggtgtgcacgatcggatcgaggtacctcctcctctcctctgaatgtgcagagatgtagcctagaggggggggggtgaataggctttcctgaaattttctcaacaatcgcagcggttaaattgacagggcccggaacctcctggtgatgaacaccggaacttccgggtaggatgagtagcccggaacttccgaagttcttgagccaggaacttccggacagcagagaaaaacgaaattaggggaagtataacaggtcctagctagagatgatcaggcacagagttgcacaagatgtaattctcaagataccagcagattcaaacacagatcatgcacaagggagacaaaggcgattttttcccgaagttcggatcacacagatcctactctccgttgaggtgctcaaagagccgggtctcgattaaccccttgcctcacttatgaaaagatctcagaagaagtccacagccttcaactcaacacttctaggtcgttttctagaattgagtgaccaccaagatccaactcacaattccttctagaaaagaccacaagtgcaagttgctctacctaggataacctctgaaaactcagcacaagaatctttactcacttacctcgtttccttgcggaggtgaggaaaatcttcacaaactttcccgggacatccacaagatctttggaagctcacgggcgacacctaaccgtctaggagaagatctccaagagtaataagcccaagtgacagcccacaaggtatccaaagtgctcaatcaaacctaatcttcaagccatctccaaaacactcctacactctaatctaatctctcaatctcacaagataggctctagattagagtggaggaagcaaaggaagcttgggagtggctagaaaaccctagaacatgaaagagctgaagtggaatggctaaagggtgacctggggacgaaatccatatatataacggctaggtgacgtcatctagccgttactcacaagattgaactagaaacctgccaggaggttccgggcaaaagtgcgaagaacttccgggtagcacttagaaaaaatctagctaaacttcggtgcctggaagttccggccagaacctccgggtagccctctctgtctcggggagaaaataaactttggtgtccggaggttccggccagaacctccgggtaggcctctctgtctcggggaaaatcatttccaaaaatgattccaaaaacctttagactcatggatatgactaagagcactttgtataccttggaaccacacttgaaacccctcttaatagtacggtttttcctaaactcaatttcgaaagtgaaaaacctagtctaatcaccttcgatgttttttgcacttaggaacattcaaattgggggggtctccttacattcttagccatcacaacttgctttgggactaaactcctgtgaataaacttgataaacacgttagtcccctttaaccaccttgtcattaatcaccaaaacccactagggggtttaagtgcatcttcaatctccccctttttggtgattgatgacaacatggttaaagcacacaaaaagataatagaatttaaatttggaatgatgagagaagtatgaagctccccctaaagatatgcatataatgaaatgagatgaatacaatatgcataagatgaaggaaacctcaaaagaaacttcacactaccctcatcaaataagatgcagatgtgagtgcttaaaagatgtgtgatacgcaagaagaaagactagatgacatggcaatcactcaaaaagatgaaaagaacactacatcacatcaaaatgcaacattcatatggactaacttactgacataaaggataataaagcatctaacagtcattacatccaatcataaaagaatatgattacatgtccatagagagagagataaaagggagggaatctgcctggtcggaacctccagatcataggacccggaacgcaaaatgatttaaataacccccttcaattcacaatttctccccctttggcatcaaggcaccaaaaagcaagaaaccatgaagagaagaagaggatcactcatctccatctccatcggagggaacaatctcggtatcaccggagagatgagactcatcggactgtgcagcggtgtcaacatcagtgggagcatcctcagcagctgcctcggcgtcatcctcctcctcatcatcatctgatcgggaagactcttcattgaaataggtggatggaccttcaccggcaacattgcgggctgcctcataagcctcaaaaggatccacatagacctcatctttacaatcatcttacacttctttcccagcctctcttctatcttccttctgacgcctttcgatcttcttcactttctttgcagtcttagcacacatacagaagatcgcctgaagtgccttcttgatgggagaagagctcgaggattgcggtggggcactagaagaaggaccagctgaggtagaagggatggatctaggtatcactggataagaggaaggtggaacacgaggatgaaaaggattgtggcgcccatctttgatgtagaacactccggtgactgtctcaatcatcttcataatgaaaggagcataaatgcaacctcgcttaggctcaagaatggtgttggcaatctcataccaaataaacttcatcacactgaaaggaggctgattgtagcgcatgcgactgagaagatgagcatgcttggatggcaaagcagtagcatctccaacctttggaagcagagaccaacgaaagatggagtacagcaccttgtagtttgaatgcaaaccatgagtagttcccatacaagtccgaggagcatccttagtatacatgaacttagtcttgatcatggggaggggtgcttcactatgaatattagggctattgagatcctcatcctctaagcccaatatcttagcaaactgtgctatggaaattttgtgcctaacaccctcagtcatccactttacataaggagttcccttcctagtagtaccaaacaatgctgtcgcatagaattgtgcaatgacctcctcattccaatcatactccaaggcaagaatatctccaagattcttgttgtgacaaacttgcattgcttggttgaacacttcattgttcttcttccttatgtaagtccaatcaatccacttcatctcaaccattggattgtctctagctataatcactgagttataccaatccaattgggtgaacgtcctaaaacgaggatcctgtgactcctcaggctgtgtctctggatcaagcaaacggtcccttctgcacttggcaagctgatgaaggtagttggaattgggtcttccaatgtggtgcataagaagggtgtcaaatccaagaatcttgtagagctgaacg

SEQ ID NO: 62406 - DNA, 1362 bp, Oryza sativa
  unsure (1)..(1362): unsure at all n locations
tggtgtcnnnaggtaagactcgtnggtcgnaaccannnnnnnnnnnnnnnnnnnnnnnnnnnggagtccggaagtccatgttcgacgaacagcaccaccttgtgcgatagcgagagttcactgtatgcgggaaatttgatgagaggagaggggcttcagtgagcaccgcccaaactactgaggatctttcaggatgctgctgagatatgaagtaaaattgatttttttttgcaaactggtcgtctaccgtggtatgttgagtagtagttccatttgttcattgatcaatgtacagtgaggattggacagatgctgattcgtacaccagcatcacaaaatgggtgagggtgttgtagtttaggagagccttttggggcttgtagattcagtagattaggatcatggggcattaacccaaaaaaaatactgcatatattctgtgcccgttctgttgaaaccatgcttggaattcgttgactttgatagtactcatacccttgcaatggtgcaatattcatcatctttctctaaatgaccatcaagatccatagctcatcttatttcctgaagtctttgatgcaactatccaactcaggccgttcttcatttcttggggctgcaattagaggttaaaaaaagactaatggtttttattaaatactaatggatagtttgattcgggatgatgattggcagtagagtatgggggaatttgaattggaagtgattgatatgataagtagtactacaaagtgataaatagtactctcttcttccctaaatataagagattttgattggatgtgacacatcttagtataagaaagttgtccacattcattgtactaggatatgtcacataaccaaaatatcttgtatttagagacggacaaaatatcttgtatttagagacggagggagtgtagtgtaaacattcttctttagatgcactatattatactcagtgcagtaaaaaaattgtatacttgatgtagaattgtggatacaagcatatataaggataaatatacccgagctggcaactgacgagttggcccaggagccacagtagtagtagtacaatacattgcatatgtgactattcctacgtgggcccacttgcaagagaccagtctggctttggcacgcacgggtgattagcttagtgcttaatcaccatgtactttgtgctaatcaaaagggattaaaactagcttcgattaagcacgcgcgtgaggcggggagcaccacgtccacgcggacaccgcgtagagcggggtgcccttccatccagccggaccgtgccgcgttgtttccgccaccgtgtagccaagccgcccggacacgctcgggccaccaatg

SEQ ID NO: 62407 - DNA, 1936 bp, Oryza sativa
  unsure (1)..(1936): unsure at all n locations
ttgccgccctcccgccgggcggcaggcctcgctgcctataaaaggcctgctgcccagcccccagccctcattcttctctcctcaattccagtgaaaaaaaaaaagagaggggagaaaaagagaagaaggggcgaagccctgccggattcagacgccgatttcaggtaatattcatagatcctatatgtgactattgagttaaatagtgtgtattctttaaaaatttgtttgaataaatgcattatatttttagggttttagttgtactaatctagaagtgcgtattgtagatatcggtaactacgtagatctgctagtttggaattaatacattaccgttgcattggcttacacaagaagatattacgttgtagatgtttattgcatgaaagagtaatatgatctagttatttcgttgacagatatgtcgaacaaacaaatattccaagtttaccatggaccaggaaacgtccgttacgggccaactggggtagatctgtcagattttattgtatcagaaaggggaattgagagaccggctgagaggagtgtaccttctataaaaggatggttaatgaggggcttgagagttgatccacagacaagtgacataacaatcaatgttatagtaagtcgggcaactgagggtttttattgggaactaatgccagttcaaaactctcgagtgtggagatggtatttggaaaatgcattgcaacgcgggtggcctctagctttggttccgtttgttcacccgaaggatccaggtgtgcagacgaacatggatgatggcgagggaccaagtgctgaagtaaacgagacttctgtggaggaggtcaacgcacgagaggacgggggcgtagtagctccagtgggcattcaaccaggtggagtggctgacgagggggagactgtcggtgccattgtggatgaaatggagagggaggattctgacaacgagcgtgtagaggaagttgattcgtcagatgatgagacggatattaatccagcagaatgggctagtgaggatttttctaggctgatcgtctctgaagaggatagtgtgagatgggagtacaaagaaaatgaggttattcagggagcgatttatagtagagcagaagatatgaaggaggcggtaaaacattttgcagtgtcacttcatagagagttttgggttgccaagtcgaaccggtcgcaatatgaagttcggtgtgttaaggaaaaagatggttgtccctggagagtgcacgcgtataaggggaaatggaaggattattggacagtgtcagttgttaccaagcatacatgttttctacctagtgttcagaaataccacatgaacattacatgtgcatttgttgcatctgagatgtatgcgcatgtcatcgataatctcacatatgaaccaaggtcaataatccgacacattgaagagacatacaagtatactattagctatgccaaggcctggagggccaaacagaaaataatagagatgagatttggaacttacgaagcctcgtatgataatttgccacgcctgcttggtgttatcgaggaaagaaaccctgggagctcttacgaagtgaagaaattcccctcaattgaacatcctggcaagagtgtgctgcaaagggcgttcttagctctacatgcatgcaagatggcattcgtgaactgtcgtcctgttctctgcattgatgggacattcttgacaggaaagtatcggggccagatactaacagcaataggggtagatgggaacaatcaggtattgcctttggcatttgcttttgttgagagtgagccctcacaatctttcagaactcagtcacattcagtactctcttccccacttgcttcattacannnnnnnnnnnnnnnnnnnnnnnnnnnnnnnttgggagtcagcagtcatcaaatnnnnncacca

SEQ ID NO: 62408 - DNA, 3788 bp, Oryza sativa
  unsure (1)..(3788): unsure at all n locations
aagaagaaaaagggccgaattgatgggtggtgggcccccctgggggtatatataggggtgtatcttgtggacgagtgatatctcgactagggtatttagatggtatgtggatcgtcggtacagggtatatgcaagattgaagtaaaagagatggagacaaggatttttatacagattcggaccccttatctcacaggtaatagccctacatcctgttggccgaagccggtgtttctctaattcatctgaaatacacaagtacaatatttaggataacctatctagctgtcgtcgacttggcgacatggataaccaactcgtagtcgacgacagggtagtcttcctcctcgaatatgagctcgtcgagatcagagatggcactagatccctcttgccagcctctgtaggcactagattgggtatgtctaggctaatctctgatgtcgatatctggtggcttgtcttggcgtgtgttggcttgtattgatctatgttgatcttgtggcttggcccctctcctcctatgggggcttgtatttatacccatatatgtccccttgtccaagtagaactagggacatcaatatggatacaatccgagtagttcttatcatttccatatagaactctattcatcatttcttatccggaactccttttatataagaggtatgatcccgtataagacttggtacatggtgagccctgccgagtttagtcaactactattagctatgtggtatctatcaacgtttgatgtcgcgattccagtatttgcatagtatgaggatagttggtactaggatatatgcgagactgaggtaaaagagatggagacagtgatttttataaaggttcgggcccctgaattgtcaggtaataaccctactcctgttggccgaagctggtcgttgctcttattcaccataatcacaccagtacaatatttggggtatcctatctatctgttgtcgacatggtggcttgaagtatcatcacgtagtcgataacagggtagtcttcctcctcgaatctgtgtccagcgacatcagagacaacgctagaaccctacggccggcctccgtaggtaccggatagggtccgtccaggcatatctctgacgtcgatatccggcgacttgtcttggcgtatgttggcttttgttgttccgtgtatgttgattgtgtcccctcttctcctaggggaccttgtatttatacatataggtgtccccttgtccaagtaaaactagggaaaccaatatggatacaatccgagtagtccttgtcgtttccatgtagaactctattcatccttccttatgcggaactccttctaaatccgaaggttgtttccgtataagacatgttatgtggtgggtcttgttgagatttagtcgactactattagatatgtggtatccataacgctgacagtatccataaccatgacacacctcacctcaaacgggttagggcttaaacctgtcagaggtgactaaacctcacctctaacgggccgggaagttgcggcccatcacaggtatctagtcacctgtgacgggccacaaccggatggctcaccgatgacggcatcccgtaatacctgtcaaaggtgatggtcttcagtgaccagcacttcggcctgccacaactatgccgtcagagatgtgaggatctggcgtagtgactattagtagagagcaacgtagtaagactctttttaaaaaaaaaaatccggtgaaaacaaaaggagagaagccctttaattgtaacacgggaaagattgaaccaaagaaaagtttttaagatgttttatcttaggggaaatatcctgtgaatattagttaagtgttgaaaactcgtaaaaatcatacctaaaagtttgtaaatccatgaaaaatttttactagagataggtgtatatatgaaataaattctcactaaatcttaaatccaaactcaacttcatttgagagaaaaaaatgacaaatttcaagtaaatggtgtctcctgtccctattcattcgaaatttgtcttttgttacttccaaataaaataaagtgcctatttttctttggaattgatcgtaggaatataatcttataaaaaaaatatcttctttctacgaatcaaaggagcctctagggaaaaaaatcctataagaattattttctctaaaatcctttgtcaatcatgaatcatccaattcaaaggagcgcacgcttgcactctcaacagcggtgagaaaaacaaagggacgtggctgcgtgtagtaacacataaagccatatttacttttgagaccaacttcgacaaatggtagtaagccaaaaataatcatggtggtgatttcgttttcacgcttgcagttcaaaattgcagactgaccgtatctcaataatgtaaagatacaaacataccggtcgatcggtatcagtcagcaaccatggacatcaacaagttgcgagtgcgagacatttttgtcaattttagtaccaagtagttcatgtagcaacatcaatagaagaccactcaggacacacaccaagtgtgtgtttgtggtgtagatagcatggtagagtacttttgaacagtggcctaaacaattttgcacatcagtcctctgctgttctctcttaaacccttaaaatatgtatctccaactatttaacttgatggagtagcttttttttttttcattaggaacctatggtaaaagataaaaccacataaactcgccttgagagaaaaaaaaagaattggacaatcaaaggatgaactaagaaggaagtgaaaaacaaaaatcaaggccatcgataacattaagtcgagaaaaagacttcatgtaagactacttttcactttttcactttccgctcggggttggctacagcctctggtgtggattagtaagaccacttttcacttgagcatcaacttaagacttaacatagtggaacatcagtgtgtttagtggtggatttaccataagcgtggcagggggctcgagcctccattatcggcactaagagtacataagcctccaccgagttttcttaaaatttcctgccatagaactatagaagaagatctcctattggtaaaggggctgaaatttttgtctagtttatttagtttttgtacaatttctttttggatttggctgtgattgttttaagctagactgtgcattgctaaatggttgaactggcaccgacacaaacgacaacttggctcacacttatccgttcctggccggtgcaagcatgggtacaaaaacgaagtgcacaagtacattcagggcacacgcaatgcaatgtccggatatactcttttcgttcctaaaaatcaaatatagtacgatatattttaatattataaataaatctgaatagaaacatgtacatattcagtattataatgtattatgtctcatattaaatttgatttttatggaccaaagaagtacagcttagctggatgacagggattagtcgtatatggtcctcggtagtacttaggggctgtttggcaggactcctctccaagaaaatagctccatctccaagttttttttgccaaacacgagtagtggagtagctccggctcttgaatcgcagctccatctccaggaatattctggagctcctcaaggggtactccaccaaaacctggagtcatatgtcctcatggagatggtaaaaaattacccaccattgccattggttacaaaaaaacgattcgcttctattcctattanctatggcngacacatatggactcct

SEQ ID NO: 62409 - DNA, 1107 bp, Oryza sativa
ccatgggggggtttccctcctcccgcaacgggcaaggggcgcgtctgcccgcctcatgttgccggtcagtggcgcggcaaggggccgggctgcccgcctcccgctgccggagccgccttgcacccgcctcccgctgccggagcagccttggggcacggctgcccgcctcccgctgtcggagccgtcctggggcacggcagccctgccgccggagccgccgtggggcgcggctgctcacccgccggcgccgcactggggcgcgggtcccagccgaccggcgctgcccagcagcaagctcgtcccccgcgtactggatgatagaagagcttttccccatttcaaaggttgtattggtgctcttgatgaaactcatatccgtgtgtcattgtcacctgatgagcaaattagatatattggaaaaactggaattcccactcaaaatgtgcttgccgtttgtgactttgacatgcattttacttatgttgcaacgggtcaaccgggagctatgcatgacacaagtgttttatacaatgcattaagagtggatgaaaaattcttccctcatcctccacaaggtaccacacttgtattatgctctctatttgtgctaactgtgcatgtgttactaaaatgtatcaataatcatactatgctatcttttgtaggcaaatactatgttgttgacgcaggatatcctaatcgtcctggttatcttgctccatacaagggtgagagataccatttaccagagtggcacagaggtatggaacccaatactccaatggaaaaattcaatcgtgtgcactcttccatccgcaatgttattgagcgatcatttggattactaaaaatgaagtggcaaattctgtacaagatgccgtgctaccccatgtacaagcaaaaaatgattgttgaggctgctatggtccttcataattacattcgtgagcatggaggtgaggatcctgattttgctaggtttgatcgtgaccctaattttattccaacaataccagaacggtacaacaaatacgcagtttctcgaacggcatgtgatgagtcaactcccgaaagaagtgcacgaactatgtatccttttcgtgatgg

SEQ ID NO: 62410 - DNA, 25542 bp, Oryza sativa
  unsure (1)..(25542): unsure at all n locations
gcgttcatgataactatcactgctgcctgcaggtcgactctagaggatccccataataaagtaagtcaaaaaaaaataataatttcaaaaaattttgaataagacgagtggtcaaacgttacaaacaaaaactcaaaatcccttatattatgggacggagggagtacatggttaatctcatggttgaaaattagatgtaaacgaacaaatttatttttcacttgaatgtaacgtagatatataatttactaaccattatccaaaactttggttttgttcaccgaaatttctgtgcataggatttgttgagagatacgtatggtattgtgtggcacagtcttatcacaaacagtcagcttataaaaaaaaacaaccttgtactcatatcctagcaccacgaatctgaacatactctaatctgaacatactctatgttcagatttattgtactaggatgtatagtacgatgttagtttttttaatggtaggatgtatagtacgatgttggtttttttaatggagggagtacgctgagtacctacgtactgtcacttattgaaatatactctctctgtcccataaaaaaccaaactagtactggatgtgacacgtcctaatacaataaatctggacatagtccctccatctcaaaaaaatgaatctagaactagatatgatatattctagtacaatgaatatggatatagatatgtctagattcgtagtactaggatatgtcacatctagtactaggttggttttttatgggacggagggagtacatctgtctagattcgttgtactagaatatgtcacatccaatcatagattcactttttttgggacgaagggagtacatgtttttaaaggaaagagttgtatcctatcttactataaagttatccctcactaactccttaagcttaacatgcaaagatgccacatcatcatccactaacaagatgccacatcatcatccactaattaacaagatgccacatcatcatccactaacaatcatcatatttaaacaattaaacatcatgcaaacatactatatctttatagtttttataatttaagagcttttcaaatacaaacatgttaaattatcatccaacataattcacataatgtttcaatgtatatctttattaagttttatgatatcctatatacttatatagtttatcctcacttagtgcttaaatgattaatctatggtctaaattatctttctccttttttctctaattaagtcatatcacatctattgtttttagcctttagatgattaatctacggtccaaactatctccctacttttcttcttccataaagtcataccaccttactttttatgtttaaatcaccattctacatactatttaaatttaaattatcataaaccacattagtttacttaagctgatattatctagctatcttacacgttattttttttattgttatcatactaaattcccgcagcaatgcgtggggtttcacctagttgttttaaaattttaccccatgagctgctgtgcgtttaagcggactggggtcaattagctagcttggtggccgggtccctgcctacaaaatgttgaggatatgttgttatatggtcggatgactcgggtcatctgaccctggtggtagtaatgtggatcctccttgtccaaatatctttgtttcaaaatataaatattttaaaatcttttagcaatgatttagattattttaaaaaatgcacagtgcctttcactacataaaatgttatgcgtaagatgaagacaaatttaaattagtgagatgttactataggacacgtaagcttttatttttgaacttttcatattgtcggcttttgaaatcctttttttaaaaaaaaatggtcacctcttccatggagcatcctaaacattttttataagcaaaataaagtgtaatttcgccacagaaaacggtgcataaacctgatgaaataataataacctaagagaaaatataattaaacttatgtaagattggccggctgctcggtgtggggatgttatatttcacatgtagcaggggtacgttcatcacctgcacattgtctggacgccgccacgtacgtacgggccagctgccacaccagctagccggccggccgtgtatgaatgtgacgtcgaatccgacgatcgaggggaccgtctcgatcgacctgatgacaaaccggacgaacgatgcagcaatccgacccatcgaacaggggatcgatatcatgcatatcggagtatcttgcatgtcatgacggcgcgcgcgcacacacacatacatacatacatacatacatacatacatacatacatacatatatatatatatatatatatatatatatatatatatatatatatatatatatatatatatatatatatatatatatatatatatatatgtgtgtgtgtgtgtgtgtgtgtgtgtgtggttacgtggctacaatatgtaactccctccgtttcatatatatataccttttggactaacatagatttatctattgatcaatgtatatgtttttttatatatgtctagtttcattaacatctatatgaatttgagtaatgctaaaaagtcttacatcgtaaaacgaaggaagtatgtcttagtacgcagttagtacattcgttttttatatacactctccatttttatatatgacgtttgttgattttttacatcaccacaactccagaaaagcacatcggtaccagttgggaatccccttgggtgccggttttcccaaccggcaccatggaggcggcacggatgacttcggtcatcggtgccggtttcaaaaccctgtatctatatgtgtgtaatagatgccggtttgtaggttttaaaatcggcacctttgagacgtacgcgatccaaaaaaaggctcgatgcactggattgaatagagccgatacatcgagcgcatccaccccgcatcactgaactcccaaatcattgtaagcaaatcacctactgataaagtggacacagtgacttcaaaaccgctgatacaatgggtccccaccaaagaaggacaaccacaaggacccactggtgggacaaccacaaggacccactgtcataataggactctaatgatgatgactactacgagaacggtgacaaggaggagggcatggaggccaaggccgaggctgagaggaggcctcggtcaccatgatgtggtgatggcagtgtcttgcatggccgaggcgcaggaggagggcctagcacggttgtggcacaggtggcgggcgcctgcgatgtggaggtgttgctggatgaggcgaaggctagggtgccagccagatggtactgaaaacggtcacggaaactctcgatgcaaccgagcatcgtttctgtataaggggtaccatttcctaccgtactgtttatagctatttataaattttgtttttttaatttctttatgcgtcgtattaatgtcgacactgagtagcttaaatgataaatatggtcaattatcggccgatccatcgtcgtttttgaagagatcctgccgattccgactattttcacccctggtagaaagcactagcagaaggggagacggaggagaacgcgtggcaccagactcatctcctttcgattgaacaatttattcccatcgagaaataggcttatatatttcccaattttgcatagggtactctgctctaggtaggtagcctaggtgaggacacaggtgagggctgtctgaactaacggttggcaaatgagctaacagccaacaattgtgaagtactcctacctgtgctaattgcatgaattaagaattttgtatagaagtgcagaacagtagtgaaatacgaagtagtaacatagattgtacatgaaaaattaaggattttttattaactatagtggttggtccatgattatatataatgaaactgtgtgaaaaaccaaccaaaagttacaccccaccatcaccagcttagactcattcaagctctactatccaacatcactcgaggttcttttggagagattacgaaagaagaaaaagaccatgatgctctcattaaatagggtgtgagtagtggtagatgggtgatcgacggtaagatggtaaaaaatattaaatactaattaattaatggaataaatatactataggatttcttatattttgagataaagtttgaattttggatcatatattatatattataagacagaggactccatccgtccaaaaaaatatttgtcctcattgtcataagatatataggtcacatcctattttaaggctgtgtgttcatgttgctccttgttgggaactaatgccttgcgcacggaaaacggagcagtccattaatacgtgattaattaagaattagctaattgtttttttaaaaaaatagatcaatatgatttttttaattaactttcgtatagaaattttttataaaaaaacacactgtttagcaatttgaaaagtgtgcgtgttaaaaatgagggatatgcgttgggaacctaactaactaacgcagcctaagttggctctaagtaataagcttacagcttttttttaacctctctctgcccaacattaacccgcttcactccaaagcacccacacccatccaccagctcacaatgtcatgtcactatgcatctcacacttctctctccatccccaccttcacgttcctcgccacaacaacacgtacaaaacaaaaattcccactcacatgcaatatgtgcatatgcaaacctctcctacctcacactccaccctagctagcccactacacctcctacaccctcaccatccaatagcgcagtgacagtgccaatggcctctcacaccaccctcatcctcctcctccctctcctcgccgccgcggccgtcgccgccgcggacgtcgcccctgcgccggcgccacctgcggcgcagacgatcaacctcacgggcatcctcgagaagggcgggcagtacaacacgctgctccgcctcctcaacgccacccgcgtcggcgagcagctgggcagccagctgaagaccacctacgacggcctcaccttcttcgcgccgacggacgccgccttcgccgcgctgaggccgggcacgctcaacggcctgagcgaccaggagcaggtgcagctggtgctctaccacgtcctcccgcgctactacaccctcgccacgttccagacggccagcaacccgctgcgcacgcaggccacgggccccgccggcgtgtacaccgtcaacgtcaccaccaccacggggcagagcctcgtcaacgtgtccaccggcgtcgccgccgtccccctcggcaccacgctctccgccgacttcccgctcgccgtctactccgtcgacggcgtgctcctgccggagcagatgttcgggaaggccaaggctcccgcgccggccgccgcgcccgcgtccgccgccgggaagggcgccaataaggagcacaagaagggcggcgccatgcccaagaatgaggtcgcggccaccgcgccgacggccggagctggaggagaagattcagatgacagcgccaccaccaatgcggtggccgttgcaggcgcggccggtgtggtgtggactgctgctctcgtggggattgccaatcttgtcatcgcgtagaaagtgtgtgcttgtctttttctccttcgccgttttctttcgttttcgtcgttgcatatgtttcattgcacgtgtcctattttgtatgtatgcaagagtatttatatatgttgatgatgattcactcagtgaaatttactggcttcttttggtctttccattgcatgtgccctactttgtctgtatctgagaatagttatatagatgattcactcagtgaattaaattcactcttttatatttctttcctacggcatgtatgtataagagttcaaggtggcctttctgggaacacataacctatattaacaaggatgatagcccacgcagggcatgtatattatagtctgcatttgagaaacttctaacaattgaatatcaaccatatgggaccatatcctatatgaacaaaagcttcccgtgcacaatcagtgcacaccaactatagacatttactcctaatagtattacatgtatctataaagtctcatattcaaattcattatattttagcgataacaaaaaagtgaaaaaaattgacagatttaagggtaaaaatctgttagaattttgtctttttctttatgactaaaatataatgaatttaaagataagatttcacaggtaggtgtaatactattggaagtatgtgtccaatttttttaaaaaaaatttgtgacatttgctagttgatgtgtacggagtgtgcacaggaagcttgtgtacatagtatatattccccaaccatatagcacttgccaaactttagaagtatgttttcttcataaatttatttgtcatcttttcttaaataacttttcttacataggagtatttttcacccatatactatctaatatttaattcatctatataagctatttttttcttcatcatttaaaaaggaggtagaatagtttgtttaggaaacatgtctaacaaattaagtttaaattaaaactaaggtgttttttcttttttaattgaatgttttggggctcttttttgaacaaatcttggaaaactattattgctaataatgtaccatcaagctagccctctttttaattggttcacattgatgcaatttgttatatatatttacatatgaatcaataaagagagagtagatatacatatcctagatcttgcttccgagaaacgtacacatgtcatacgacaagagggggggggagttatgtttcctttgagatagatccaatggtttcaacagtttgatttataaatataataatgacccaaagtaatgtatttgttttatacttgttaaatatctattttctaatcaaattgtgtattatcataatattatttataaattttatgtgtatttataacattaattttatgtgttgcatattgttctattaaaagctttgtgtttttaaatagatcattaaaatatctatatgattttacctataaatgtgtttttatctcttttacttattaaatatatagttagtttggataatctaataatgtatgtggataaaatattagctatatgatttagagcatataattgttcggaatttattatcacaaaatatgttttctatctaatatagaatgagggaggaggtatggcgtacgtacgtgtgctggtgcacgtgcacgacacggacggcccgtgtggatcctttttttttaactctttttattaactagcaaaatacccgtgctttgttacgggtaaaagacaaataaattttttattatgctaagtattgatcacaaatttaaatgataattaggatggatgaaaaccagtattgcatattgatatactcatattctcatcataataaagatgggcatcggtgctcgggcaacgaagaaaaccagaacaacaggaacatggccggcaacgacgtggccctgatagagagagaaatggcattggcgagctctggtggtgaacacgagcagatgagtgtgttaaaacatgttcccagacgaggggttccattttccttgaatgcgtagaaagaacgaagatgaataaaaacaaccaacactattcatcatcttccctagccgaagcaagaaacaaaaaagagggaatatgggcgttggtgctctggtgatcatatggcggtgaggaaggtggtcggacatgtaccacgatgtgacttgtccatagatggtggcggttggttataaagaaaatcaaaacagcgggaacacaaccagcgacgatgtggtccccacagaaagagaaacggcaacaacgagctctagtggtgaacacggtcgagtgagcatgtcaaaacgtgttcctggacgagggggttccgttttacttgagcgcgcaagagggagggaacacagaggagaagaggggtgctgggaggagaggtgccagggaggagaggggctacggggagagggggatcacgaggcaaagatgggaggcgttgagagggagggagggagggaggcgaaagcggaggcacgtgggagggagagagggaggcggaagcaaagacatacgggatcgagacagggagagaggcggaaacggaggccatgcgtgatggggaggtggatggacaaaaatttgtccgaaggccttacatatttttttaattaggtatagaggtgcacccaacggtagaaaatagtgatttcaccgtatttaaagtaaaatcgatggttagatatttttatttctttagaattgtttggattttactctactttattagagcaccacgaggcagcttacgagagtttgtaggaagagcgttttaggaaatatataatagatagatagatttcatacaaaaataaatatacccttgtaagttgaaaaccataaatctgtgcgatggggctttaacacccatcagtaatgcatatatggtacgcacgtataagaattgaacatagttttacactaatattattaattacaacaaattgatactgcagtgtcaattttccaataactaagctatattcttatttacaagaaatgtaatatatattataaatatatatccaaaggaattaatcgtcaaagtatatatgtatttacatgtttattacatatatatctcacctctttgtgatgaaaatttggctcagtccgtggttacccactgatgttttctcgtgacttttatatctcacctctttaattaacacattctgtatcctttatagtcctgtttgaagagaccatgttttgatttaattgagtgtgtgttttaaatatttgttttcacttttatgcgtattcctgttattttaatgcagtttaatcgtaaaacaagtaattcctgttagtttaatacacagtttaatcgtaaaacaagtactacctatgtttagagtatatgaccggcttttgtacgtacgtctggccttacaacttattaaaagatagtgcaaatatcatttattttgttataacttatatgtgtactatattttgtaataagacaaataaaagatgaatgataagacaatgtgtccaaaagccaactgcttcttatatttaaaaatggtggaagtaccaaactatgggttaatttgtgcagtagtattttccagtgtgaaggtggtaaaatacacagggcaagtacagtagaattcatattgatttagagatgcaaactaatataaatcattccacactgaaggacaataaatttgctatatataaaaatgatatgtcatataagtactacatccagttcggattgaattacaaattgttacaacgcaataacaacatatgaagattcataatgacaacgctacattcagcagaaaatttcactccagataatcacgatgtccccaagaactatttttgagcttttttcgcagagggcctaccaacgtttttctttttgctgccagaagatccaccaacggttttctttttgccgccagaagatccaccaacgtttttcctattgctgccagaagatccatcattctctctcttcctcctaggatttttcaagatttttataatttcttcaaacactcttgccttctcttctttgatagtatcaatttcatcaataaatctcgccatccgcctacttgacattgcagtgaccggtttgttgatgatcctccctatcttcttctttatacttcttatctgtgacaggttaaagaaccaaattaatatcacataaaatgaaatcaacttcattttatatgcaatgaactatgtacaacatatattactactccctccgtcccaaaataagtgcaattttagcactgttcatgttcaacgtttgaccgttcgtcttattttgaaaaagattatgattagtatttttattattattagatgataaaacatgaatagtattttatgtgtgactaatttttttaatacttttcataaatttttcaaataagacggatggtcaaagcgctaagcacggatatctatagctgcacttattttgggacggaggtaatactcaacaactagaggcatgtagatgatcgttttccatgcacatgcatacctgctccaccgagaaggttattagagctttgtcttccccatcacaaaccttgaagaaattgttcagagtctccagttccttgtcagtttccaccgctgtggcgcgcagatactgtatcacctcgtgtggagccattcttgatggcgtcgcctgcgccctcttcctcttcctgtctaccatgctcgggtacatggtagcagtagcagcagagctacctccagcttgctgggtcacttgagatgattccagtatcttcacgtctgcccttttcgctgctggacgactgtttgcagcggcatagaattcttcaactttgaacagtaaggtagcaacaacagcattctgctcatgggctgctggcggcgccggcgccggcaccggcgctggaagctctgctgctggaggagctccgatgaactgtgccgccggcggggacgctgcatctgtagttactgcgcacataatatcaatttgtatgaattaatacacaatgtacaaattaaaatggttcaaatgaaaacatccatgccttatcactcgctccactgtttcagtatcgaaaatttgacgacggctcgatcatttaccgttctcaaatggggctgacacgatcgtatggagcatgttcatttccatcgccgtgtgactgttggccatgtcggtgcggaccgctccggagaagttgtagccagtgtccagaaaatgatgcccagtcgtatcatttttcagcttctcaacgttgcttgcgatgaagtcgctcgcggactcaatggtatgattggtaaggctgaaaacatttgaaaaagaaaattacgatatagaaactgttctgatcccttgagaggttgtctcctcgcttgtttaaatccatccaaaaagatatgagaaaaagtctcaaaaatttcgacaatattcatacaacatatatatatacaagtacacaacatcatgcaaactccactcacactaagatataaaaaaaaacaatgcaacaacgaatggaggtgaaggtgaaaaacaatcaaagtatttatatggtttcacaagaaggtaatcctaacaatataacatttttaaaaataattgggggaggggggataagcaatgttgtttttcatgcacaagagacaattcaacgtcttctttttgaaagtcacatagcacgatttgtttgacaaagtgttttctttgcatccaatattcccactcctcatagtgctcaaaatatatttgaaaattggcttgtcaagatacccaagtccaaaaaaaaaattatgatctgagccaatgcactatgttgttcaatttggcgttgcccaaatggtaaatctttttgtaataaaatttcgctaatcctatagagtaggttatctttatgtgaaccagctctacacttggtattagaagtaggaaactatgcgtagttatatatactgcagttggaattagtagccaaatggtattttgttctgttttatatgtctttgtacctatagaattacttactggaatttgtgtgatttgtcttagcttttaattcaaatggttatcgttttagaggagttggggacttgtcccatcactctatatttttttctttttctttctcaatactaaaatttatttgttgtatccgagttggtagagaccgggagatataaaccacttctattaactaaaaaatatataaaaaaagtactattcatatgatgaatttatcttttatttactgtgcaggacaaacatgaacgtgatttttggagtgatagacgtcattatactcactattgtcaattttttttacactatttgtattgaatttgaaaaaaaaaaggtacacgaggagagacgtacatctcctcaagggattataatctgttttctcggtaacagcgtgtgattgttgggaattttatgaacagccggtgttggggaaaaaacattggatacaacaaaacaaagttaatttaatttgagtcgatcccttactcgaagtatagcagttgtctcccggggaagtgtagtccttcagcaccagtagcagtgtatctgcgatccacaatcgcatgttgaaatgatccaaccccggttgcatgaaccaagaagtatattgtccggctagctgcgcggcacaaagggcaacaatttcacaaaatcacacgccggacatctattcataattcattatcaaagcaataatcacagtcgacattgccaagtaattctcattttgatgcgtattaatctgcacataattaaacacatgaaagcatatgaaatattgatagaacttatttaccgtttgcatgcatcatctccctgacaaggtggcagttggagcagtccagatctccggcctgaaatgggacgaagtcggcgtactcatcgacgacgacgggcggagcagtgtcgccgccggcggcggcgccgtgtgtgtcttggtcagcccacatcaggacatcatccatgtcgacgtcgcccatgtcgacgttgaagtccatgaaattgaacatcacgggggagcatggagcgtcccgtgatggggcggccaagaacaaaccgtcgtcaccgcctgagggcgccatcgtcgtcgccggcgccggctggccggcgaagccgtgcgccgccggcaacggagccagcggttgctgttgctgttgctggtgatgcatcaccggcggcgacgcctgaacctgatgagtgtatccaccggcattcatcgccggcggcggcggcggagactgaaaattcaactcgggaaagaagtcgagatcgacatcgaagccgagatctgcaagcaccgggttcccgagaccgaaatccgccgccggagcgggctcgacgtgagccgtcgccgccggcgccggcgccgtaggaagcggctcgacgtcggggaggacgggcaggggcaatgtggtagccgcttctgcctcaccgaacaagggaagaaactccatgtcgtcgagcatgtagcggctcacatctccattggagtcgtagaaacggtgctcgccggccatggagatggtgatggtgatggaaataaatcgcaaaggcggcgcggtggggagcaaggagagagatcgagtgagagagagatcgagagagtgtggtaagttagggaatgagttggggaatatatatatatatatatatctcgcgagcgggagggggtggtttcgaacggatcgaggcagcggttggcgatttcccctcgcgtgcgcgtttctttcttttttgaggtttcttttcggccgtcggatgcgtatcgggcggcgcttggcgatggctgcgggggcaagtggtgattagagcaaaggcggcgcaccttcttggattttcaatttagccattttgggcaagtttcgggatgtgaacatgtccttgtcataacgtgtggatggtagaagagtgagacttatataccagtgactgtcataacatgtggatgatagaagagtgagactcatatactagtgattgtcataacatgtggatgatagaagggtgagactcatataccagtgactgtaatgacagtaatattattgtcgaggattctcatccaactattatttgcctgatctgcgttagaataccaattatagatggagcaaatatatggattctcgttcacacatatataaggatgaccatccactccttaccagtataagctaatcaatacttcaacatataaatctgaaagagcataaagtcagaggttgtaagcctaaggccatgaggtaaccggtagtagttgcagaaaaaaagtccaaatctgaaataaaagtttgaaatgaaaatctttaattagataagaatgaaaaaagaagctgaaaatcagagaaaaaaactttaatattggaaaatagtgataaaattagggaaaatcagaaaagtaaacaaattgaaagtactacgaagaaataaaaattactgagcatacaaaaattatgagaacttatcaaaacgatccaaaacctaagtaattgttttactagtttgaaaataaaaacatctcaaaaaaaaccaccacgttcattataaagtctagtaattcctacattaatcaaagggaaaagtatgcttttagctagaaatataatttagaaataacttaaatttggaataacgaaaactgaaagaagtgtctaccaagaagacaacacgatattaattaaaatttaaaataaaaataattgcaaaattatattttaatgtgaatttaagtaggaatatataatatagaaataactgaaattacaattaaaaataaataatattgaaatataagtccatctggaacacaatacatgattagttaaatatctgaaaaatataaaataaattacaaaattggattttactaatttcaaataaacttaaaaatcacaggttcacctctgacagggtgtttcagtgcccattatgcatgatcatcggtgacggggtggagtttagaaccgacaaagatgtatgtcatcagttacaggtgtttgttgcgacccgacaccgatgaggcttttcattaaaaaaacaaatcggttttattggctagcctcaaatgctagccacgcccgctataaaattcgcagtattcctgcaacacataacttcccccatagtcccatatatttgacattcacatacaaaaataagattcagaaacgaccacaacacataaattcaaaacctcagatgcatgcaagtctcaatagttggattacctcaattttttcaattctctcaacgaccaatacctttgatttcttaccttacaaaatcaccgaagcatcttcaaatgagaaccatcaatcacaacatgtgaatgcagttataatttaaattaaccaagtgatgaatatattagttaatatgaatattaccaatgtacatacatataaacagaagccaagaaaaatcgttttccaatagagaatgtcacttaatcatccatttaacacatatacgtgtagctatcctatgataattcagctactactttgcacaaaaactgccctttggagagacaatttttgctaggatgaaggcagccaattcatttctaatatcctcgaaattatgctctagaatgtttgtaacaactgttggtatttaatacggtcacagataaaatccgcaagcgtacggatataccgatgtagcacttcccctacggagtatttcaagggtatcgaatccaagaacgtgtgtggtcaaatcttcctccggttcatccaaggacaccaaccaaatgataggccaggatagagaggatttactagtgagaaacagtgtctagggaaagcttaactttaatcctaacgcaatacttcaggcacaggcaacccgctgttcccagatgtcgctctactacgtacccggacagggaggacttaactaatctcgagggctgtcaccacctctacacctacctcaacacactgtgggatacgcaacaattactggataacaattacctaaacaccacgtctaagcaattaatatctactttagtgtttataactcaccaaagcaatcactatattttaattaattatagtgaacaataatcccgtatgctatttacgaactaaccaagagataattctcacaagataaatctaaattactcaagaagaatattatattgaattcagagtaataaatagaaaaaaaaataggagaagattaccgacaactccggaattcttccgactccttctactctacacttttcctattctagtatacaatataggacaatagagcatcttgtaattcagctcaagcttggaagtgtgtgtgagagtgaatgaagtgaggtccttttatagggcagttatgacggttgtgagaagggaaaatgtccgaactgccctgcaaccgtcattgggagaacatctggagcgtccacgccaaaccccaggatcaacggtgatcaggggggttcggccgaacctgggctgggccctcttggcctggccttcggtcggtggactccctgagacgtcctctatccatttctcggagttttgggttgatttactaatgtttcgatgaagttcacaatccctccttgtatggatacataattctcctcactcgagtctgattttcctcccaacactggggtttattatctgcatacaaatatataccaacacttgtgtaatatttgagatgaaacacctatcactatgttggatgttttattatccaaactttatgcagatgttggcggtatagagtcggcatttaacagccgccaacaacaacctcctgaaagagaggcgttaagttagtacagatcctaggtgcaaccataccaacgtactaatttgttttcccaaatcaatataccacaaacctcgggatctagcgcagtcacctgtcctgtgaggaccttcatggtatggcacacgtggaaaccacaggtctcgctggattgttgcttgcatttgaagtcgtcatggtgatagaggttggatttttccttcttgatgcatgcccatttttgcacgtattagtcccatgctgtgttcaatgcctctttgagagcgttaaagtcatatttgtcgcttatgcggcagttaagatagtaaaacctactccattttggcactatgcacaatagaatccaatggaacccgcaaagttaatatagtgtaagttaaaaaccacacttttagatgtaactagatgatgccccgcgctttgttgtgggatatatgttagatattggagaaacgatgaaatgatttggattgaaatattacgaaaatgatttgagaatgatgatttagcatgtgtatgtctagttttagaatgaaataaattatatatataaataattattactgcctccgtttcaggttataaggggctgtttggttgctatcctgaggagaactagcctgacacggttttggtcctatttggttgctggcctgagactgttttcccctcgcctggcctaatgcatatctccgcgcgtgattagcctgagtcaggcgacttatttcggtcgcgtgagctccaggcacagcagctagcgagattaccgtcgtataattttcctccgtcctccgggcaagccatcgctaccgtcacgcaagactccgccgccgctgggcccgatgtcctcacccgccatcgttgtcgcatgcacatgaaaagcttgcctcttcctccgccaccgccattacgcgcatgcagtgaaaagcttgcctcttccaccgccgccgccgtcgcgcgcatgcagtaaccttgcctccgccgtgggaagccaccactagcttgccagatccggcgtcacacaaatctgcggtgaagtatctcaattcgtcggttccatctgcgacccatctgatctcccacacgcagcagcaactgtcgctgatctgccgaaacaattgaagcactttacacgcagttggagtcttgaagaaatcgttgtaggtttgggcatttatgttttttcttttttttcctcttctttacgtacgtgaagccggcaaaaattattaggcaataaattgatttgttacagttagcacttagcaatacccatctaaactgtagattctttttcctctcagacaactgtccacaaccaaacaagcaaaatgtcaggctgcctggccaggcaagtttcatcaacttctcctatgcctttcaggcacacaaattcctcaggcatgatacttagggcaccaaccaaacagcctctaagactttttagcattgtccacattcatatagatgttaatgaatctaggcacatatatatgtctagattcattaacatatatatgaatgtgggcaatgctagaaagtcttataatgtaaaacggaggaagtatacgcttgcatgttgagctttgtgtgcttaatgggttgatctggcatgcttacatgtaggttttaggagtgctaataaatactatgcttgcatgttgagctttaggtgtttagtgggcattagctttatagaaagaagggattattaattatttagcatactcactattgattgtgtgctaatatgatgaagcctttgtcctagtgggccctcaagttgttcatgatgtaaccgaccacatcatccaatcaagacttaagttgtgtctcattgacttgacgtggatctaggaatctaacttgacttctggtcttccgtgcttccatccaacataaccttcaaggttgatctgtatggctagaagcattctacatggattgttattagctaagtttagtgttattagtacttacaatgagtagcactttgggagatcggtgtccaccgctcgtagcctaaagaggttgaaaagatcagagaagcccactatgatataactgggtggccccaggaagggcgcttggtcatgatgacccagtatggacatatcactattcttcctcttggagttcaatttatccacgtagtaccgacgcagctctcgagtaatagtgcccattctggctaattcattgtcttgatccaacggcatccctggccagaatgtgtcgtgatctaggatcttgagagcaacgtacacctccttatctagatctagccgtttgggaggtaaggacgaccctcctacctttccttttcctttcaattttccccttccatgatttggcctgctagacaccatcggtggagatgaattggccttttcttttctttgaaggaggacgatctatggccattccaccaaaatccaagacgtgggacccaaaaggagcttcaatggccatctgaggtgcatgagctttagctgaccgagctagatgagttgggcctgctgcaacatttgaccttggaataatctttgtggtgatgaggtcttttggccattggataaacattccacgtgcatgagcgagtgtaagtatctcgtcctttggtgggattggtagttgccaattcagcaattgtctttgaccatgtcaacttggactttggcatgtccagctaccaaatccacgccgtacactcttgtttctggagtagatgttgacggtcgttacagaccaattttgaccgtcaatataactaaaataaaggagaactagctatgcttgcaatacatatttattttagaataatatatttccacttgtacttggagtattatttgtttgcagagattagcacatgaataaagaagaaattaatgaaaacttcactcctaagcaagcttaagaatacaagggcccacatgtcaggtgtaaccgtcctggaaaccgtcataactgccacaactgccatgaggacccatctgtcaaccccctgaccaaatctagaggcctgctgggccggcccaggttcggtcgaaccctggtagcaccggctcagctcagccctccacatggacgctccagatgcactcctaatgacggttgcagggcatttctgacaattccaactgccataaccatcattgggaggctatataaaggggtcactttcttcattccaacacacactcaagcaagaagctttgatatctctctctctctctctctctctctctctctctcaagtttagttaatgctctagtgctaagtggagtagaataggatagttctcgaagtcctcgagtattcagaagatttcagtatggctctagtagcttttctttcttctttcgtaagactctcggaattaatagaatattcttctttatataccttcggtactttactctgtctgagtactggatttactttatatttgtgccgacatagttgtatgactagcctaccagagaggtgcagtggtgtgggtttaatgttcatggaaatgattgatctatgttattctagaggatatagagtaatatttgataatgtaagcatggtgcttagattattagatatcattaattgggcatatatgctgcaggacagtagaggtgggccgctgatggtgacaacttagtacgggtattcctccacgttagtatatattcctaagccaatttctggggagggtactcctccgtatttagctccggttggacggccatgacaggttgttataagaaactcagcaacccgaggtggtctctggaagctaaccaattgttataagatactaacaattgtaaacttttactttgcaagagctaacatgtgatctattactaggtttgtactgaatttatattttcgtttgtatcttaaaagaagttcagaagtggcgttgtacagattctttctttgtatctattgtggggttcataccgtatttacgtttcctgttacacaagcatggcttttttcaattgttcaaatcctattaagaaccatgcaaaaaaaaactattaggaaggtacagccatgcatctatggaactaagagttctcatgatttggtttctctttccaggtgctttctcacttccaatctttcatggaatggcatccatattgtgtattattaatcatgtcataagaaatggatcatttcaccaatcatatcattttattgtatacctctttgatatactaacattttggtgtcatttagatactggggtttgtcttcctgcttataaatactttgggatctatcaatcttattgtagactgcaaagcataatagaagatctaagaagatttaaaggtgacaactgacaaagtaagcatcatgatctgcaaaagatattcaggtttctcaggggatgtttatgcagtcatagcttcatcagtattcagagcgcacttcttaacctgtagatcttggatctctaatttccatttgtatcagctacgttgtgtgtttcaactacatactatcttattttctgagattttgtgggagtaagggtgtgtctctaaggtaatatttatcttgactttctgttcaattctagaattggttgattacactgccaatagaatttactaaaatcaagagtaaacatctagagacagaaaaaatctatatggaaaacagaattttattgaaagaaagagtcaaaatccaatgactaccctattgcattcttacctcttgcctattttgctttaatttttatctcagaccagaccattgattttattccaatgcaatctcttcaatttttgatggtttctcattgttaatgtggttcattttcttttgagttgattcgctctcaatgtaaggcattcattatcatgtaggtactgagtgttatacttgatttatcctgctaaaatatcagctcatgtgataagatggctaaataggctccttttcttccaaactcaatcttaatatgaacagatgtgctcagggccagtcctatgattttgagggccctaggcgaactcatcgtgatgggccctctaagctatatataaaatttattgatatatatatacgctaattttacttacaaaacggaaacaagtacatccatatattaaatttaatatgcttggtaattatcaagaaataaagtcgaccaaaataacaatatatttgtaacttggaactaatatcattattcattaacttaatgaagaatagaaccctattccattgcttcctatgaaaagatacttcttctgacatttcttgatgtaaaatcatcaagaatggtattaagatcaatattgtccaagatatcattctcgattgagtacatagccaagccatttaacatttcttgcgacatagttgatctcaaatagttcttcaacaacttcaattttgagaaacttctttcagctgaagctaccgtcacaggtacggttaagagaattcgataggcaactgaaacatttgaatagaaatctgcatccataacaaacttcagaatctcaggtgcggacattgaagaatctagcaaactcacttgcaacacctttaattctaaataaaaatcattgatctcaatatcggatgacgtactagattactagtattaggtgttggcccctcaccattatgggtccccggccgtcgcctcggctgcatagggccagggccggccctggatatgcttcatttatatgctagccttgaggttttcagaccgtcatcggcattaagatcatcaaactgcttgtcataatagtatagatttaagtatcaatatgctctgtcatagccatattatcaagttgacctgacttttttagttaatgaaaactttattgaactcagacaattaaagttgaccaaactatgtgaggtccacctttaatatacatctagatccttctttgatagcaaggtaccacgcttcatgtaacaactctgcaagctatatgacaaattggtcagatttaggtataattttgcatgcttatgcatgatactttcaacgtgatgcttgataatagttggattatcaagtttgaagttaaattcatgtcaaatatgcatcatttattgactcaggtatccctgtatgcagtgtcctccccgattggattttgagcagcgtgagtgtctcctggcacagccattatatgctctgctagctccacttgatatccctgccctggcagtgagcggcaaatacaccaacattttgcttagatgttacaactggtgtaaaagaaattatgattccacagcaactgggtacagatattattccctgatatattttgggttgttgctgtggaatgaagattactcacagccgtgtccagtcgagccagcctcttccggggtaccagaactactttggcaaggggcagcagccaccttcccactaccagccatcacaagatcaccaccccaactccacgaggatgatgacccaggcaatccgacaagcttctaaggtgctgattggatgctggtttccaaagattagttatgctgtgcatcatggacaaattatgttcatgtagttataaaaattttttagcccaagaattagatggatccgaacatatagaagttgtgatgatatcgtgtggctatgtatttaataacaaaataaaaaataagtaatggttacaagagtctcagtagcaccttagttcttgggtttgacttcccatggaaacgatttttttaggttttaacggtattgtgctttcagtgataggcgatgtacccgtcaacagcgaggcacctgtggtgacttcgtcaatattcaggatttgccgcccatgggaacgatttttttacatgcattttaaatttatctaattatatgcttgattgcgataatatatgatctctttagtttatttatatgcattatcaaatattacggtagtgttagcacagacaaattactagttttataaattacactataacttacaagatattacactgtgaatttgataagttcacagtgtaatttcaaaattccattataagttttaaagtacaatgtaagatccataagtattaactttgaatttcataagaaatcaccataatttaaactttcaattttaacatcccagatagtcaccgttgtacaatcatagcacaggacacacattaaaaactaacaggcatattcttttagcctatgtaggccagccaacaaacttccgttggcccatattgcttgcatgttaacccatcaactgtaggcccatgtccgaaggacagttggcccatgaaaacacacagatctagggatggcaacgaggctgcacccgtcgggttctactaccccatccccagagtgagaaaaatattccgtcaccatccccatccctgcacacggggaagatttctcctcgtcccgtccccacttgggtaagaagcacccgctgggtgcccatccccgaaaattatcagcaacatcaatgctatacggaagatagaaagcagcaagaagcataccaatgctatactccctccagtttcattttaattgatattttagacaatgacacggtttacaaaatatacctttgatcttatttttctattataatatatataataaataaatgcatgtttatttttattatagtgtatcttattctagtttatgtaaactaaatattttaaaagttattgatggttaaaattataaaagtttgaccttaaccttgtccaaaacgtcaattattatagaacatgcagcaataatgatttcatttagccatcggcaacaacaatacatggctaaacactaatgtacacagagttgctagaaatatggcgccactttttgtgtaaaaaaatagtcaatttttagaccctaggatatgtttcaagattcgtgcgagtgctctccaagagaaaacacgatcgataagttacagcaaaaggcttttgaccaactgagcacaaagatggtactcgttctttactcaaagtaattataattaataaaaattacactatagtaacttacatgccacttacattgtaattacatactaattacatatataattttaggacttacatatgtaattttgaaacttacagtgaaaatatattaaaattatatatgtaaattttagggacttataatgtaaatacatatcgataaaaaatacggtgccatgtatatagatagtcccataagaaaagttatggtgagaaattgtgtttaatactataattacactgcacttacaccttacttacattgtaatttatattaaaattacactgcacttaagtgtaaattttgtgatcgctagttttctatcttaatttaatttatattgtgtattataatcaagttacttatttgctatattgccacggctcgttaatggtcaactttgtgtttgaaatggcggtaatcagtgtgaagtccaatccgagactaaattttgtggcgtcatatatatagatggacccgatgaaaatcgtactttagcgtcaacaataactaacggggctgtctatatatcatgtgacggaaaatctcacctcctatcattcaaattttaaaccattggatgtgctttaagattcatgcagccccttaaccctcactcctcctcctcctcccccggtttctagatcacgccgccaccctccttctcccgtcccacgcgcgatccgccgccgtcaccactggcaccggcccaccgcgccgccgnctgccttgtcggctggccggaaaaggtcaacggcgccggggagggccccccggcgagccccctccctcttcctcttctttttcctttctcttttccttctcttctcccttcttcttttcttttcttttctccttctccccttttctccctcctccttctcttcttctcttccctccctcttccttctttcctctttttctcttctntcctccttcccccttctttccttcctctctctcttttcccttttcctccnctttcttctcctttcccttccccctcccc

SEQ ID NO: 62411 - DNA, 14092 bp, Oryza sativa
  unsure (1)..(14092): unsure at all n locations
gagcgtcttttgatgctgtgcgatgcccnagcncancacgctagatttgtaagacataagatgataatgtatctttgttggacttcaattatgaacctttgattaaaatgtggtaccttgtgcggattttgctatgtgcggattttgctcccaactcgtttctcaattgtggcagatttgcatgtgttccattaagatgtaaaataaatattacgataaaaaaattagctactcggaggtgcaattccctagtacagtagcagcattgccatgcgtgttgctttgcactctgactgtgcgctctccagtctactgtgtagctcgatcgtggccgttttggcgttttgctgcaacattacctctcgcagcaggattgaaataggtgcttgcatcgtcttgaaaaaagtctattttataatttttttattttttattataaaaaaattagctattcgagctaattttgtaccgttcttgaaatagctacttgcatcatcttgcaacaagtctattttgtaatatattttattttttattattgttatggctgtgagaaatattaaacatcactatatattagtaatcaacatccatacaagatccatgggcaaaacagtcctttcactcatcctcctaccaaatctggagctggaccatatgtattattacccaaacaggtgctagctccaggagctccacggtggagaagatttcctggagaggagctcattttttttagaggagctctcccaaacagccccttagcactgcacacttggtgcgtacgtgtgcagcggcaaactggcaaaggtgcagccaacaaatgcacatgcttgcctgcctctctagctaatgctgtgtttggatccaaactttcaacttttttcatcacatcaatctgtcataggcacataacttttcagtcacatcgtaccaatttcaacccaaactttcaactttgaaaggaactaaacacagcctaagagcctgtttgggggagcttttagatgctccacttctcctagaatcagaagctccccccaaacaacctagcttttggtgcagattctaaaaagctgtaattgtagaagtcataaactgaaaaactcagcttttctagattattaaaaactggctttcaactgcttctgaaaattttgagctctctcaaacaggccctaagcaagtagttgcagttcattgtccgtcgtcaacgtagaggttggatatacggcaggcttgtcaggaaagggttttagtggaattggaagtgtagttcctgttttttcctacgcaaaactttgtatcgttggattgcttttagaaaataccctatgattcactctgctccacttttatagctccactgaaatgcagtaacagtaaatgaaaaatagagaattcaagctcatagggattttaggtaccgtagctccatttggatgaaaggaataagtcaaaggaaaaaaaacattaggattagtcccatattaataattaatgatggaggagtacaacttaaaatgtgcgagcggttctaacttttgggttgtgtttctagttgcataggcctatggtgggacatgcccattgcaacgtgagtatccgatagttgacgggtcgagctatgcattccgttaagtggtacttaaggtctgaaggcttgaaagaacttttagagcttcatggttgagggtgtgtccataagagcatccacaatgtattagtaccccttaggtattaaggtaggtcccacataaaagcataagaccaaacatcgatttgtgcaatgtataacctacttcaacaatacaatgggatccacatctaataaaatttgtatttctattggtcctcttcatggcttgggtaaaagagtaatgcttgtttatatgaatagcctggcctcatgggaagacccggcttgttctttgatagcctaaaacttgttttttgcaatgtatagtacccttgctatagtagaaagattcccttagtgctccccttagttcccacaccatggatactctaataagttttcggaggttgttaggcacggttgaggtcaggtgtacgaaataagtctttgcaaattattggacacgatatatgacagtgaagattgttgggtttactcgtacatcagatattgatgttaggcaacacagctgaaatggtgggggatgagacgaggcttttgggtaatgtaggcttagcatctagagttgtagttttgattggctttgtgggtttatagttggtgggctaggctatatattataactagtggtatcagagcacaagagtaataagtgtcattatagtcgatttttttcttaaaagagctagtgtttaaaaatataatgtgatgaaataattctaaaatcaactctaaaattagttttaaaattcaattattaactgcagctgataaagataataagagtaaaggggtatccatcattttcttcctatttttttctttagggttttgttatttcttggtctgcgcatatattgggtcaccggcaaatactttatatattatgaaatggagagaatagctgggaacttttgtttccgctaaaagattttgtttttggtacatcaaccattcacccactttggttggtttagttcttgttgttccatcctacatgcacaatcgaattgagctttgttccatcatattatgtcttttcttcagttttatgacaacttcacttttttttatttttttagttttttattggttatacgtcttagagcaaatgccagaaatgtgaatccttttcatcagtgttaaaaaaaaaacacaatcgaatcgaggagcgatattgtgcagtcaatttgcctactcctagatcagtcaaaacggaaggacgtcgtgtactgctactacaagcttacaagggccagcaatgacagtgtggtacagtaaatgctgaaacggctgctttgtcgctcgtcatccacagaccgggataatgcatccactgccactttgaacaacgtgaggatgcagacagttcgcaataaaacaaaggatacaaacgctgtcacattttctcacagtactcctacactcgacgcgacgagcatcgtggtagagtagcagccgccaccaccacggattgagatcctatgtagttcgactgaaccgtttcttttatcactgatatatgatttgatgatctttaaaaccacatatcctgatcccaggcgtggtgcagtgaaatatcctgatcccaccactactgtagcaatatgccaaagaactgaacggcagatcgttctcaattcgtggtggtgccactggccagcttgctatgaaccactcactgctagagatagcagcagcagtagacgcatgtgtcgcagcaggcagagatagagagacagctactctggactggagccaaggcagctagccctactagtatcccgtaggagtggaagtggtaaagaaaacaagacggcatccaaaccaacagggccactgcagtgcagacgaccgaatctctcagagcagagcagagctgcactgtgctgctagctgcttggtgcgtcgagacataggatccctttaggcattgatggacggcagcaggctggcccctgcacggcgcgacgccggcggctttcccggccacgagttcgtacgcctgcctagctttgccagccgccgcgcgcgttggggccgtggccgaggaagaagacgtgctagctcgcctacacacgcccgtcgtcctcttcttgccgacaatgtgcgtcgcagtagtagcagtagtagacatcggttgcgactggatcggaattcaccggtcgaagagcgtatagctgtgctggtaattctgtgggaatctccgatcgaggtgcgtgtgcatgcatgccacaccgtggcccatccctggcggctcgctcaggcacatctcgggcgcctgcattagagcaagtttaatagtttagccagctaccggctccaaatcatctatagctaatctaatagcccattcatacaatagttaactataaaaatatactacaccattaatacccggtcccatctcttatatacacataacgtcttagagtcagtgttgcagctagctacaaatctgtagcccgatttcttctctctcttctcttttctttctcgatatgtgtttataactggtttatagcctgctattgtacttactcttatgcaggaggacaaggataatagtaaactactacatccctcttaaaatataactttttttctataaatataaacacatttcattctctggtctagttgttgttttttttttcattaggaaccgcagattttttagtccatcacattcacgcatttacaatccatgtgactgtattaatacttttaaatggtattttattaatagcaatttatgcttcacaataatatatattttgtatatcgaagtctacagctaaaattatttatattttaggacggagagagtataagttagctataaacttatacggagaagagagacgataaaaaaaatcaatggtgttgactctcataaacagctaactcggcacgtgctacaagacaaatattaccttcattccaaattagtggtcgctttgattttttttcttacaacgtttgaccattcgtttaatttaaaaaatagtgtaaatataaaaaaatgataagtcatatttaaagtattttttataataaagcaagtcacaaataaaataaataataatttcataattttttaaataaaacgaatgatcaagaattacaaacaaaaacttaaagcaacgagtattttgggacggaggtagtacattaaatacataagtaaaaggaagagagaagagaataaaaataaagataatcttataactaatcgattatatactccctccatcctaaaaatattcaatctatgagagaatttgacccctcatagtacaacgaatctggacatagagatataagtttatccagatttgtgatattaggaggaaatgcgccctcttctaaggtttagtttttttttcgacggagggagcatgttggttttaattaagataaactaaaatagctggcagtgcgatcgattggtccttgggtgcttcaaccaagtgtataatcatgatcctacatataacccatacctagctagccgggcacgacgcaggcaggaccagccatagacctcgcttgatcagttgctctcgttcacagtgtcagtgtgcatcatcaggacatggcagggcatggaggcgcatctcacacaatgattggctcttctgcaacatcctccccctcccatttggcccattttctcccttgttcgcatctgcgcagtgccgcagaatgccagaatcatgaaaggccaccactggggatcattgggacgcatatctatctatccgcccggtgttgtgttgggactgtgatgaatcgagcgactgcctggctcgtgtcggcgggatgccggctgatggatttcatcggccgtgtttagaccctgtaaaaatttgactattttttttaagtatacggacacacatttaaaatattaaacgtatactaataacaaattacaaattccgactgtaaactacgagacgaatcttttgagcctaattaatccgtcattagcacatgtgggttactgtagcactatggctaatcatgacgtaattaggctcaaaagattcatctcgcgatttacagtcggactgtgcaattagttttttttatccacatttgatgctccatagatatgtcaaaacatttaatgtgatagaaaaattgaaagtttaaaaaataagttggaatctaaaaacacagccatattcaccatcgatcgatggagcggagtagggggctaggggccccgcgggggaataattctgcccatgattaagctgcctgccggcacgaagcgagattgtgcgcccggaaatgattcgcctgcatttgcatgcatgcccccctccccgggctgagcagagcagtgagctgagcgggaggaggaggagcagagcagcactagccaatggagcggggaaaaaggcagccgagatccaaggctttttgtggttttgagaccggggataatcgggagagagaacggcttgcccgggcagccagggtgggtcagccctggggcatcttgctgagcgcatgagcctttaccatggtgtgagtgtgatcggatccgaggatgaacgccggcgtcgctgggtttgccggaccgctgtcgatgccgcggctgatcgagagagctcgagattgggtcagtttgcaagagtttcagcaccaattttatttctgttgaagctgaagtctagctaaactttaaaagaaaaaaaaatagagcgggggctacgacactcatgaaatgaaataaagagggagagtttggtttaaattgatccataaggccattcctaacccaatgactaggatggtgtccatagtattaaataagctgtcacatatgatgaaaaatgatgtggcaagtgaataaataaggaaagagaaagaaaccatgtcttgcatgagacatggtttctacacaacatccaagtcatcatatgagataagtggcattaaatttatgtttggaatagtggtgtttgcattagaaaaatagtgtctagtactagtttcttaatgatgtgaagtttataaaaactatgtctagtcttgggttggaaatggcctaactctacttagagttaaaataaatttaggagctggggtgctactaatcaggcctgacacgtagcgtgaatcgtgatcgggtccgtgacgtacgcccgccgtgtttctgggccagatcatgttgggttgggtagaaagggttagcttggtttgggccggacattttagctgggctaggttgtttagctaaggaaaaagtacactgaaggtccctcaacttgtcatcgaattacaaaatcatcttgaaccgtaaaaccagatataaagcatccctcaacttataaaaccagtacaaatctctggcggttttaactccggttttgtctgatgtgacagctgactcagcatgggacccacgtgtgccccacgcgtcagcctcttcttccccctcccctctccacctctcttcctctctctcctcttttcttcacggacgccggtgggggagcagctgcacggccggcaggcggcggggtgaggagccgcgcgcgtccttctccggcgcggtgttcaacctgtccaccaccatcatcggcgcgggcatcatggcgctcccggccaccatgaaggtgctcagtctcgtgccgggcctcatcctggtgatgctcgccgcagtgctcacggacgcctccatcgagctcctcgtctggttcagccgcgctgtgggcgccacctcgtacggcgaggccatgggcgacgccttcggtgctttcggcagggggatcctctagctctgcgtcatcgtcaacaacgtcggcgtgatggtcagcttcactgaacatttcgttgtgactctaatggcttgtgttctttttccctgggatgagttcagatccactgaaatacacgccggccgtgtcggttgctctggccgtcgtgttcgtggtgatcactgtcggaatcgccaccatcaagctgatgaaagggcagattccgatgcctaagctgttccctgatgttcatgactggagctccacctggagacttcccactgcagctccagttcttgtgagttgtgactgcctacattttccattacaacggtacattttaattaccagctaagtttgcatttttctgtgggaatgtgattaacttgccactgcattcagtgcacacaattcacaacgagctcaaggaccactccctgatcaggccaatagtgcgggcgtcactgctactcggcttggtcgtgtacaccaccaccagcttcttcggcttcctcctcttcggcgaggcgacgctggacgacatgctcgtcttccccatcgtgttccgcgcgctgcgattcaacatggacggcctcctcttcccctcagcgaggcccttctcctgcgacaaccggaggttcggcgcgatcacggcggagctcctcacggtcatcttcctcgccgccaacttcgtccccaacatctgggacgcgttccagttcactgggagtagctgcacgggcgacgacgtcgactgcggaggcggtggcgacagctgcctcacggccgtaatccttgtggcggcagccgtgtctccgatgaggccgcgctcctccagcgcgagctcgacgccggtggcggggaagaaggagaaaacggcgacgcggtggtgctcgcaatccaccgcgccccgatgtgaaaaggctgcggcgggtcacggaatgccgccgccagcgccgccagcccgccaccaccaacgcccaactctgtctgggccatcgctggcgacgtgacccccctagccccaccaccagtggctcttgcccctgcttcggccggccggcatgaccggcgaattagaagagaattggagagagagagagagagagaggacgggagagagatgacgtgtcatcatgtcatgtggggcccacgtgggtcccacgctgactcagccgtcacgtaggataaaaccggtctcaaaaccaccgaaagctctattataactagttttgattagttaagagacgtcatatatctgattttgcagttgagagatgattttgtaactcgatgacaagttgagggaccttctgtgtactttttcctttagctaacacacacgcacggaagatggaacggtgggaaaacacaagtaccagtactccctccgtctcaaaaaaaaataaacgctgggtttccatatctaatgtttgactgtccatattatttgaaaaattatgaaaaaaaattaaaaagataagtcacgtataaagtattaatcatgttttatcatctaacaataataaaaatactaattataaaaaaatttcataaaacacggatagtcaaacattaaacacgaaaatctaggatttgttttttttttggacggaagaagtattgggccagtcgctttccatccgcttttcacaaccggcaaagacggtgagatgcgaccgcaaactgactacaggacgacaaagttgtgtgttcagttgttcaccacgggtgtcttcacagccgtactgctaagtcaatcccgaaagcttcggttgtgattcagaaatatgacgtgtttaaatccaaccagaatagttcgtatcaaaatttgaatttgcggcggcggtggccagcgagtgcgtggtcagtgagcacgcggctggcgaagcggagcggagcgccggcagaggccggcggagtggagcagagcggtggcgacggcgataggctagagcatggccaacggagcagagcggagcgtcggtggcggcgggctgcgtgtcgataagattggaaaggaaagcaaaggagaagaaagaaaagaaaagagaaaaataaaaaaagaaataagatatgtgggctctatattttttttatctcacttatatgtagaccttatattttttttctgactagaatgaaatcagcgaaaccatctatatatactatcatgggacccttgattgcatggttttgaacatttgaagggtgaagaattttggaattagggattagggctgtcatacagactcgacgaatagttaaggaatggtaggtgaacttattccaagaaggaacgagtgggaaaactgtaagtgttggggcagtcgctttccatccgcttttaactggagtacgtgcaaagacggtgaaatgcgacagcaaactgtctacaggacgacaaaattatgtgctcggttgttcgccacgggtgtcttcacagccgtactgctaagcttgctgacgccccgaaagcttcggttgtgattccgaaataggacgtgtttaaatccaaccagaatagttcgtaccaaaatttgaatttgcgtcttagtaatttgaaagttttcaattagctgttgtgaagaagcggaattaactgacggagtgaaatcatcaggagaagcaaatggctgcattcccccgctacatattgcgacctgtgtgcaatgattgtactattaattcgctttggctcagccacgctgtcagctcgcaatcagataatgtaaccaattgctaaataacaaattccagagaaagaatgtgaatggcgtacgctaccatggcggaatcaaccaacgtcgcctcaacaacattaaataaaaacaatcagaatatacaaaacaaaaattgatcgatcatgggaagtggtacaggttggacggctggagcccggcggtgacgttgaagtacctgaacgccgccgcccaccggcggttgtccttgagcatgtgcacgaggacggtgtccggccggaagttgtccatgtcccagttgaggtcgtacatccgcggcctgaggctgtaccggttcttgccccggcggccgatgttgagccatttcccgacgaggaggtcctcggggccgtgcgtgtcgttgtaccgcaggatgtcctcgttggtcgacacccacgtcgcgacgtcccaggacacgacgtagcccatcccgtgcatgaactgcatcgggtcgtcgccgacggcgaagccgtagccgaggtagacgtcgtcgcggggcttgtgccggagctcgtcgaccagcgcggccacgcggaggtacgtgtcgtcgtcggtcttcatcacgtagtcgtagggcgacgacgcgaacatccgcggcacggaggagaggtactcgtgcgtcttgccgtcgttcatgttctccgtgcagttgagcaccaggatgtcgccgtgccgcgcggcctccagcaccaccagctgcgcgtccaccgggtcggccacgcggcagaacacgaagcggacgtccacctgcgcgacgccggggggcaccgccggctgcagcgcgtacgccaggcgcacgatgttgcgacgctcgtaccgcttcggcgtcgtcagcacccccaccagcagacggagctccggccgcacgacggccttcgtctcagcagcagcagcagcagcggaagctgcatctccacccggcgtgacgaggtagccgtcggcggtggatgggccggcgtggcagaggacgccgaggccgtcggagcggacgtgggaggagccgaggctggggacgacgagcaccacggcgaggaggccgagcggcaccagcaggagatacggggtgcagagcgaggcggtggccgggaacccgtgcgacgacgacgacgacgacgatgcggtcttcatcgtaaaaatctcgcggggaaatgcaagtgcccctcgcacgatcgcggcccgcgcgttactcgagctatagccgtactcgacttataaccaggcacgaacgcgcgctggtttagcgatgtgggactaaaatttcagcattttccccctctctctctatctcgtgtcaaaagcgtcggtggaaacgaacggttcttcgcggaagaagtcgtcgtggcaatggcaatgtggcatcacccacgggagtacgcgacacgggctcgatcgatcgatcgtcgtcgaggctgccgtcatcaacggcgacaaggaaccttactcgataagtttactggataattttgggttgtctcgtgccacatgacaggggatgtttcaacggccaacgccatatggtaggtggcagacggccggggatataccccagccctccagagctctagttttatcgccaatgtatggaaggacagctcaggggtacatcgaaaattcgaaagggatttgattaaaataacaagtacacagtgagcaatcattcaatcattcatgctgagattcgaggcatccagcttccagcatgcattgttggcgacttggcgtgatcgttttgagttcgggggcggctggaacagaagaaggtcgctgggaacaggcaagcttgtcggctactactacttgcgcgatagatatgcccggtgtgtgttcaattgttcatgacatgcctgatgccttggctggaggacgatcgaaaccgagatctcaccaacttatacaaatgatggtagattaataggcagggaaattgacaattcttgcggatgcttttgcctgtatgatcgccttaatttgagatcgtgatttttcagtgaaaaaatcgatttcgtgcaacttcgaaacgttgagggttaattggctaatgcagctggtcttctgttgagtaattcaacataagaattctactagcagatcgatatagtgttgacctgttctctctattttgtaaatataaagtttagaccttttctgggtatatggcatgtgttatggcaaagtcggtcagactgatcatacagtgaaaccaacttggtctggtctttctttctcagaatacaacctgaatgtacgcgtacccatgcatgtctacttcaattgattaattaagttttgtactttctagtaatatacggcattgtttacttttggatatgatatttgaccattgattttattaaaaaaaacctaagtaatatttatttagttgtgatttgttttattattaaaggttccttaagcatgactatatatattgttttatgtatttatactatacgaataatcaaacatcatgtctaagagtcggctatgttatatattaaaatcagagagaaatagagaatatatactagctagtaaaatgttggatagcaacataattgcgacggaggtagtatatctattatattattaaaggaattgaaaaaggagcctccacattcgctctcatggtctagaaattctcacattaatcggacaaaaagaaaaaacagagttcatatagaaatacaatttagaaatagctgaaattcggaattaaaaaataaggaatattagaagagttgactagagtccatatagaaatacaatttagaaatagttgaaattcggaattaaaaataaggaatattagaacaggagactagagtccatatagaaatacaaattaggaaataactgaaattcggaattaaaaataagaaatattagaagtagagtatagagtccatatagaaatacaaattaggaaataactgaaattcggaattaaaaataagaaatattagaagtagagtatagagtccatatagaaatacaattaggaaataactgacattcaaaattaaaaataaagaatattagaagtagagtatagagtccatatagagatacaattaagaaaaaaacagaaattcggaattaaaaaaaggaatattagaagtagagtataaagtccatataggaatttaaaactaactaaaattcggaaaaaaaaagagtctccatgttcactctcatgacctagaaattctcatattaatcggagaaaaagaaaaagcaaagtccatatagaaatacaatttagaaatagctgaaattcggaattaagaaataaggaatattagaagaggagactagagtccatatagaaatacaattaggaaataactgaaattcgaaattaaaaataaggaatattagaagaagagtatatagtccatatagaaatacaattaggaaataacaaaaattcggaattaaaaataagaaatattagaagtagagtatagagtccatatagaaatacaattaagaaaaaaaatagaaatttggaaataaaaaaaaagaaatattagaagtagagtatagagtccatattggaatttaaaactaactaaaattcggaacaaaaaggagcctccatacaattaagaaaaaaaatagaaatttggaaataaaaaaataagaaatattagaagtagagtatagagtccatattggaatttaaaactaactaaaattcggaacaaaaaggagcctccatacaattaagaaaaaaaatagaaatttggaaataaaaaaataagaaatattagaagtagagtatagagtccatattggaatttaaaactaacttaaattccggacaaaaaaggagcctcacgttcgctctcatgggctaggaattcttcacatttatattagaaaangaaaaagccgagtccctattgaaatct

SEQ ID NO: 62412 - DNA, 1615 bp, Oryza sativa
ctcgttttgggtgaccggtgccggacccatcattccggggcacggttgggcttatcggtccggggccgccacgtggcgctttcgtcccgctcccgcatttccagcgtgtgggagagatatatttctgtaaatccttctcgcccacgtatataaacgcaaaatgcgaaaaaacaagatattttttcaaatttttttcccgaaaggacgaggttagcttacgaagttagtagtcaacccaaacgctaaccaaccaacacgcggaattttttttttattttttttattaaaagttttacaaaaataatttttcattttgaaaattgacagaagtggtcgcctaccgccctctaggagggcgatttttaaaaatcgccatcccagagggcggcgaaagtgatgtggcagacggccgttcgctctcgggcgacggccgtcaacgaaatttgcaggcggcccccttgccgccctccgctagggcgattttgtactgtgcggtacctatatggtaaaacgccaagcaatgcttttgccgagaatgacacattgacacccatctccctgcttgagttttgaaattttgattctgaataatttgtgttcacccggttgatgcagaatagcaatggtcaccctatttcagtatttctgtttcgttttactccgaaaaaatgcgtgttgaatttgagagattatgatacgagtacattggaatatgggttttgaaatatcgagcaggctggccctattggcccagtgaaaaagtaaaaccgtggggcccacgaaaactggcccaataaataatgcccagtctgatagcttcgttccccagcccaaccccctgcctcttccaaaccaaagccacccatctcccacctcccgcttcgagaaacagagcaatcaatcccacgcagccacatcgtcgcaatcgatcgcctcgcctcacctcgcttcgctttctctccaatggagtcgctccaccacgacgtgatccgcctcatccacagccgcctgccgtgcctcgtcgaccgccgccgcatgggccgggtctgccacagttggcacctcgccgtcgcggagaggcagcgcagcaagctcccgtcgatcctcgtgccgcgcgcggacggcccgtccttcgcgtgcgccctcgccggctgctgcgccacccacggcttcgcccacccgctcaaggacgacgcgcgcgccgcgcgctacttcggcgcctacgacggcggctgggcgttcgtcgccttcggccacaccgtgggctacgcgctcctcagcctccgcgacggcgaccggctccacatccccgacatcggcatggccgtggtggccgccaccctctcctcaccgccggacgacgaacgctgcctcgccgccgccatcaacctctccttcctgattgacgatctacgcactcacgcgttctggcccatgcggcgtcaatctgcggctgcgccggagaaggcggcgaaacctgcaaaggtcatcagcggccacgctctggaggatgtcgtacaccacgacgacgccttccatttcctcacgagagaagaaaacctccatgtttttccggtagcgggcttccgcgaagacgacgagggcaatctggaga

SEQ ID NO: 62413 - DNA, 9305 bp, Oryza sativa
cgttgtccgctacctggtggagtcccgcgggcgcctcctcatggtggccaggatcgctgctggcgctggtcctctccgcccctcgccgccgtcgccgacgacgacgtcggagttcagggtgttcgagatggcgaggcgatcgacggcattcgccgccaccaacaacgatggcgccgagtacgactgggtggagctggactcgctgggaggccgcatgctgttcgtcgcacgaggctgctcgacatcgtacgaggtggcgaggcatccggggttcgaggagggcgtctacttcctggacgacgggaggctctacggcgaggtggcaatgttcagggatccaaatctgcggcaatacccctgcagagacagcggcaggtggctggcgtcggcgccggaggcggttccacgcgtggacaacttcttgccggagcaagccccgtcgaactactcaccgccggcttggtttcttccctgagatttcccgtgttgagtttgatcgtcgtggtacaggtttgctttgctgttgatttgtctgagatgtgcttagtctccgatctgatggattacattagtgcagaaattatctgtttccatggctttgattgcattaatgctgcattatattgaagtcgattataatgtaatgtgaaaattatatgctcaattattcgtgcttttgttttcctgataaaatcgtgtgcattgcctgaaatggatttgcaatgaagctgaattgcttctggggactgatttcagttaatcagtttcaggcttttcagctagatgtgaaagatgcagatcgtttgtgttttatttgttcttctataggtactactgtagtactgtaccagtactacttttgatgctaccaattctactttctgtgccacgatttattcttatattatatgcatgatgtaatgttgagtacaatttagtagctgtggaattggctaaacagttaagagttggtatttatctgatgatatctgaagctttcagtaacacctgaatggcaaatttgagaatcatggagaggatgcttatctctgcattccccacgcatttttcttaacgtgtagcatctgtctaacagtacattttgtgattttgtcagactgcacattctcttgaaaagagagagaaccttttcgatgttccaaaactatgaatcaaccagatgtcggaaggggttttcagaaacgaataaaaaaactaatttcataactcgcctaaaaaccgcgagacgaatcttttgagcctaattaatccatcattagcacatgtgggttactgtagcacttatggctaatcatggactaattaggctcaaaagatttgtctcgcgatttcccccctaactgtgcaattagttttttaatttatctatatttaatactccatatatgtgtcaaagattcgatgtgatgtttttggaactaaacaggccctagttaactcgtatgggtgcatattcatgtattttcctcagcacggcctggcgttccaaataagtaattaagcagcgaacactccaatgaactgtttttactgcaccattggccaggatgcctcaaagttaagaaatgtaaacgaggaaattcagagaaagcatcctttcctctatgtgtatcagcttttctccttgtgtcgaagcagagcaggacattctctgttcagtagtagtgagatgatcacagtggaacaataacccatctcaaacgttaacccatccctatgtgttagtgcttactgacgtactcaacattctgcatcatgtatatgaatgaatcatagaacggacaaaaacaaattcagtgactaattacttgctacgaccgagtaacttgtgtatccatgaaatcgatcagaaatagtatcatcaagacagcaaagattttgggattttcatatatatttcataacatgggatatacgggtggatgcaactcttctcatatcctaactcatatttctttatagactcagatttgaaattggacagtatcagccatcccattttaatttctgtcgcatatttttcccataaacctctcgtcggacgtgcagtcggaaaatacctgtacccctacatatatggacacggcggttggccggtcagaaactctaagagtgtcaagagccaagactacgtacgaacgcacgaaacgcatcccatccgggaacatatcgcaccaacaaacacaatatacgatcgaaaagggtaaccgatcgatatatagtaagttccaatcagtctcgcgtcgcggcccccttaaaccttacgcacgccggcctccgcgttgcgccgtcgccgtcgccgtcgccgcggcggttgccgcgggagccctggtcatgcggcccggacgacggtggggatacaggcgcgtcgcggtcgcattggcggtgtgcgtccacgcggcggtgcttctctcggccgtcgtctacttgtcctccgtcctctctgcagctgggcctggggctagctcctcgtccctgcaggaaacggagatgatgagactgaccgccaagctggagcagatcatcggtaagttcatctctgtaattaattatcatacgcgatcacggcatcacgcgattgatcgatatcgattaaagctagccgctagctgcagcctgcatgcaacaacggctaatcaaattagttaccattgccattacgtgttgataattcatcgcgtccctatatactccttccgtttctaaatattttaggagtataatataagatgtttatgcagaaaaccaagacaaatacaactctgggatgatgcatggcttcgcaagtatgctgtccaaaaaccccggaatcattaaggagatgacttacagaatcaccaaccccgacgacacggtgagagttcaactggcggtgacaatgagagacgacgtccaggtccagcctctaagaattaatacttcaatttatttccgtgtgtatatatacttttattagcaaacgcactacttacgactccctcaattttatatataagatgttttgaatttttttaaaattaaaatttgaaaaatatagtaatatctataacaccgaactagcttattaaacccatcattgaatatattttaatactatatttgttttttaaaagtatttaagaattatattttgtctatgacatattatatagttttcgtttatcttcattataactgtgtgcattttattagcctctctatcccttgtttagattcactaatattcatataaattagactataaaacacataatagatgtatctgttgtttagattcgccaaacatgcatgcagtgagtataatgtaaaacagaggtagtagtattttaaaattgcataaggcatattgtaagttggcctccccagcatgtcgtgctgtgtggaccagggttttcatgtatgtttgtctttattccaaaagccatatcattttagctgacctctaaaaaaacttatattttaaagtataaagtaaatttatgagaaaacaactatgcggaaactgatattaatgagtagctttacctttctgccttttgtataattaagatttcattaattgaattcattttgttgttgaaattttgcgaccgctgatatatagaacacgtcttctccccagatatcaatcaatataatgttaattatgagagtgtttcaaatatccgataaacatgtcccttcatacgtattttcgaaaattagcctattgatttcactgaaactatacaaataaatatttaattgtttgcgtctttttcgatcactcacagaaggagacccaagagaagtgaagagaaggaaattggggcaacccttaatagcgaatagtcgtaggggagagaaatgacgagagagcgagagcctggggagctcgtcaacctgagcgtcggcggggcaaccgttaccggcgcccacagccctgcgcctctggtcactccgaccagggcggccaccgcacaaccgcgctcacctccccagtcacgccttcgccccaagcaagtcaggcctcgccactgctatccaagcccttgactggggaacggatgccgaggaggatgaggacgacgtcattgctccggagctacaccaacgttcagcggagacattcaatccgcaaaccgccaaagcacgcaaagcagcttctccatctccggcgtccaaggctttccatcaggaaatcaatgcccgaagccaggaagaggagctcgacattactgcagagagaggagagggacagagcgccattacgccccctccggaaaaggcacaagaggaagatgcagagaagaaggccagagaaaaagcaacattaaagtcgataatagtagccccggcaagagctacaagcaagtctcaaatcgaggcagaagaacaagatctttcatcaaaatggcaagcggtaaaaccaaagttttggtggcggaagcgccaaaatccttcttcatcaacctctcaggtcgtcttcaatcgcccagctacctccttcaatccactaaatctcagagaaaagttcaaggagatcttgcacggcaagtgcttccgctgcttcgcttcagatcaccaggcagcagcttgcagggatcccatccgctgctatacttgtagacgcagtggacacatctccttccgctgcccaaacaaatcaaagcaacccattcactcccgcctcaccttccccaagcaagccccctccattcaatcccgactcatcttcccaccacttcccagcaagaaccaacagcaaccaacaacaacccgccctggttcggttttccatcgtttgcacaaaccagcggtgaccatggatcacatacctggtctgccgaatcaacggccggcagtcggctatgcaacggtgccgatgacggagctcatgcagcacgagctggagcgccttcactatcatggcgcactcatctcggctgaggtcgagggacaggagacgtcccccagggaggtggcgcgtgcactgacccagcaggttgggatccccatctcggacctgcgagtcacgcgccatcacccggaagatttcttcgtcttcttcgatttcccagaggggcaggccgcggcagcgcggagaggcttcatcactctggatggaggaaggttcaccatcacgccatggagcgccgacaggcatgtgcaccacccgaactggtggtttcgtgtgcggctctgcctggagggattgccgcagtacgcatggaatagggcgggattggagggcgtcatgggtcccatctgcctcttcgatcgcatcgagcataagtcggttcagtggcagaacacggccatcttctcatgctggatgtggatgcggaatcctgatctcctgccatgaacagtgctctccaccttcttcccgccgggagctgggcgtgtcacctccggcatcacaccgccgcttccggacgagatcgcgctgccgccgagggggaggctgccgcatgtcatagtccatctggacgagatggaggactggactccaggaccgccccgctcgccttctttcggggtgagcggactgccctcctcggacttgtctgattcgggaggcccgatacccacggtgcgcaccttccagtggtacctgggctgcgccgacggaacccagcctcctcggcgacgggcggcagcgaggcggggatgcagggcaccgccacagagaagagaagacccggaggatgatgaggatgatgacgggcggcggcgccacgctgaggatattccaccacgccgccgctcgctgcgcgatgtcatcattggaaggggccggtcggttgagtcgcgggcggcggaaggggtgcgacaccggagccgcacgccgcatccttccggccgccagcgagcgcacggcgatggccgccaaggccgctcacagaccaggcacagctcccgatgctcctgccgctacagatcccgtcgcacgcgctccccaagctccttgactcctcgcgatcaggatggcacgggcgatgcaggctgcgcgacaaccaaggtggtcgctgtcagtggccaggctgatggcgaccagcagtgtagcgcccgttccgtcgtggcgcctagcgggaaaactatctcttaaaaaccctaattgcgaaatctgtttctttgcttgttgtctagtgtccgtgccatctcagatctcaaatccccgatcaatcgtcgagttcaatcccgaatccaaatccttcccgaaagtccctccgcaaaagtctattttgcctctctcgggttcgatgggccgaatctctctcggcccatcttcccctccctccccggctatctctctctctctctctctctcgctctcgctctccctcttctccgctctgcccgcgcgccacgcgcgcgtgcgcgtgagccgcgccgagccgagccctccctctccgctccctcgctgccgcttcccgcacgccgttgtccgcgtgcgcgcgcccacgtggtcgccgcccgtgccgcgcctgcgccgtctgcgccgtgagtcagcacgcgtgcccgagccgcgccgctcaaatcgccgcgccgcccgttgcttcccgcgcgcgcgtgccgtggtggccgaccgccgggtcgctgccgccgtcagcgcctgccgcgcctgcccgcgcctgtcacccgtgtcgccgcttcgctccacaccgcccccgccgtcatcgccgtcgtcatcgcccggcccccgccactccacgcgctagcctccaggggacggaggcagagctcctcctccctctgccgcgtcgcccccgctcccctcctccttttcccaaagaggcaaggggcaagccccctttctctccctccttttcccctttttcctcccgccggcccgcgtggcagccacgtaggcgccacgtcggcgccagctcggccaagaccgggtcgagccgaccccggtcagccgctccctccggccccgctcgcgggcgcggtccaccgcgagccgtgaggctgcgcgtgggcccgccgcatccgcgtccaccgcgaaccacgcgcatgcaccgtgccccgctccacaccctagcgccgcgccgcgtgctccctccgcacggtgagccgagccgctgacaagcgggtcccaccccggaccacgcgagatggactcggtccaccggcgccctctctctcccctccccgcgccctattgggccgtgtcctcttgggccggccggcccatttagctcggccgagccgccccttttctctcgggccgcgccctagccgcccgagggaagtctacttcccctccctcttccttttctttccaaaagggtttaattaaatcctttttcctttagaccaaaaatccaataatcttagaaattcaatatcttcccaaccgtaaatccgtttgactccgttcaacttccaaaattcctcaaatctcgagatctatctaatggcacgcttagggggtcattaatagggctttatttttgccgtttgttgagtcgtcccgttttgcgtgtagtttcggagcccgaagacccgcagtgcgaggatttcgaggatcaagctcaagatctcgagcaaggcaagccacctttgaacatcttgagcctatatttaaacttaattatgttgcttaaaaaatattatgcattgataggatcgcacttaattttcttgtcccgtctgcaaggcagattggcagacctacctagtttgctgcatttgatccctcatttgttaattgttataccatgttcccttgtaaccacccagttgcgcctcgaaaatcgtgcactctgcacgagtatcgacggacgccttcaaacttaaaatctgaaaaacatcttgggtaaaacgtgggttttacaaaagacttggaaaacccgacacctgggtcggtgcttgcgaactaaatgaatttccaaaaccgcggaccggggaacgtaccgggggtacggtttcccgctcttgcacttaaggaccgtttccttggaatttcatccgatcataagtcaagtacgaccacatggatggaatgggacacccctggctgagtaactagcttatcaggggagccttgatgccgagagacatgtggattcgctagggtggtgtcggggaggacccctgggcttcctggcacagtatggtctgggacctaacgtgttgttggtctgggacccctctcgtcggcatatggtaaacctgtgtcggctttcgaaatgccttgtcatgaaagcttggaggtctcccgacgtggctgatccccacgggctgggtgatccgggttagtaatgtcgtgtgggtaaagtgtaccccctctgcagaggttaataaactgtttgaacagccgtgcccacggtcatgggcggatgtgaggtgattcctagcgtagttttgtttgactactgccttgtgaaattgctgttgtgaaaaggggatcgatgtttggaaaaatctgcagctgatgggatcagctaggcccgggtggccgtttgaaagttgttggcccgggtggccgtttgaaagttgttggccgggtgccaatcttgaacaattctaaagactgatacattacacatactccgaccggacgagacgcactgtctcatccgtgtcgtttgagaagcactcacttagttgttttcagaaaagagttcaaataaaatcaattgcaaaaacaacagtctttccttgaagcctgcattaaacacttatttcccatggcttgctgagtactcccgtactcacccttgctctatataaataactcccccccagttgctgaagaagatgaagcggatcccgctgacgaggagttcttccaggagcaagccggctacgatgagttttagggtttcggcctagttcccaagtcgcgcctgtgatgtttggtccaagtctggcttccgtttcccttttgtaatgcagttgtgagctcgggatctatccgcagcccaacatgactgtactcctactctataataaagagacctctgttgctgtgatattctgtcttcctgtgatactagcactatttcctgggactggtatcggttaataggttaatttggagcgtcacgggctagttccgctcgggactagttcggggcgtgacaagagatggtatcagagcacaggcttggccctagggcgaaacccgatgcttaggacgaccctaaggatactcggttcaaaactacttgcgaaaagctaaggcttcttttggtttccttattttcaatagtttgtttctaaaatggttactgatcttttctccctctttcaaaattgtagatggcagtgaacgccagcttcagttccca

SEQ ID NO: 62414 - DNA, 11834 bp, Oryza sativa
  unsure (1)..(11834): unsure at all n locations
gtaaaaaaaaactgttgctgacantcnnnnnnnnnnnnnnnnnnnnnnnncacattagtagtttcgtaaagttattgcaaaatttaaaattatgttgtcattgtaatatattttaataataaaatgagaaaacatatatgctattatacgtgagaaaatataatgatgctaaccgcgtaatctgcgcgggccaccatgctagtttttttttttgaatgccaaaagaggtagtatatgacatggtacatacggagtaccttctattagtatcttctcaagcaccgtgatagaacaaatgtccatctatctcgaggcaacaaattgctcaccttaggagccaaactaccgaatgtataataagatcgtaggttgtgatatacaggtttaatgcttgagaatgcaacggacattgctccagtcaaggttaagtacatcttgcactattgttatgcacttttcttttgagtgagaccaccaaaaacaacataggaaatccccaaaattgatatggcaaagctatctgaaatatacagccttgacaaattacgttttgcaagaggagtacaagcaaattacagagctaataacaagcagagcaagcacattccactttggaggctacaagtctactacagcttcaccctgcggaccacttgcatcaaccctaatcgtatgaagaagatggatacaaactttgagttatcatatccatcagccggcgacccccccatcttgaatgctttcatttcctccacacgcggacacaccgtgctgtttctcatcaatccgccaattacaaccacacctatcgttgtcacgaggcgatcaatgacgaatcgatcgaacaggatcaacccgatgatcaccaagaaatcgagcagccgaaatcgaatttgagcgagtcaaaccgaggcacagctcgcgcatccgtgttcgtgcaccgcacaaccaatgcacgaatcgaattaaacccgttaaagaatgtgtcgaacgattagttaattagaattaatcaaacggggaagaaattaacaaacaacaattatggatcatcgaagaggtgatcgatcgatcgatcgatcatggtgagaggtggtgcaggttgatcccggcggtgacgttgaagtagctgaacgccgccgcccaccggcggttgtccttgagcatgtgcacggcgacggtgtccggccggaagttgtccatgtcccagctgaggtcgtacatccgcggcttgaggtcgtagcgattccggccgcgtccggcgaggttgagccacttcccgaccatgaggtcctcgggcccctccgtgtcgttgcgcgcgaggatctcctccgccgtggacacccacgtcgcgacgtcccacgacacgacgtaccccatgccgtgcatgaacggcatcggctggccgcccatggcgtagccgtagccgaggtagacgtcgtcgcggggcttgccgcggagctcgtcggcgagcgccgccacgcggaggtacgtgtcgtcgtcggtcttcatgacgtagtcgtagggggacgacgcgaacaggcgcggcacggaggagaggtacgcgtgcgtcttgccgtggttcatgttctcctcgcagccgccgagcaccacgacgtcgccgtggcgcgcggcctccagcgccaccagctgcgcgtccaccgggtcggccacgcggcagaacacgaagcggacgtccacccgcgcccgcgccgccgccggctgcagcgcgtacgccagccgcacgatgtcgcggcgctcgtaccgcttcggcatcgtcaggacgccgacgagcaggctcagctcgggcttctcctcctccttcggcgccgccggcgccgcgacggtgtagtcctcggcgccagcgctgcggcgggcgcagaggacgccgaggccgccatcggagccgacgcgggcgccgttgagagaagggagcaggaagacgacggcggcgaggaggagcagcgcgagcggggcgaggaggaggtaggagttggacgacgccggcgccttcatcgccatggccgcatgcaaatgcaacgggagacaacgtggttggtaggtgcaatgcagaacgagctgtagtagctgttatacgcgcactaatcaagctcacgtaatcaagaattccattaagaaattccactgcctaacttggtttttttgtaaacaaatcgtcgaacagaacagctgacaagacaagagttctttctagcttgacgcgatgcgctggccagttagaactcgccacgtgcagtaataacaacacccatcgcttaccttttaacttatctacaaataaaacttaatattgaatttaattttagagttttcaattatgatttattttttacattgatcttttaatcgccaaggacgatatatatatgagtgtgtgtaatagttttatagctttcgaacgattaaacagaaaacatcttctctttttcttttgacagagacggttgctctgtctcgttattgacacaaaggttaagttaatcacgaaacgagtccatatcccatagaggttcagaaatggcacgttgagctgtcgccgttcaataatagcagccgagtcaaaggagagcgtgaagtgccgttcacgacgacggcttccccgctgcgaaatgcctagccttaccggtgaatgatcggatcaaactctgaacaggaataataataataacaataatgcagagaagtttctgaatatgaggcagaaaagaaagccatatggtccctagtagtagggtcgaagcctgtagtatacagataccagtattaatcaaattttagtccctgagttgccgtgccgtgctgtgctatgctcgcacatgctgatggcattgttgtttgtgttcatggctctgaaagtaacgggctaccaagaactgattccaatcaaatcgcacatcgctgtttcatgtgacgaatcctggtcatgggctggtgtcatctccagtcgtgtttcgtccagaatttgtaccgcgttttcttcctgttgctcgtcatctttgtgcttctcggctaagtaattactagcctgtacgagcagaattgttccacggcgaggagcccccgttttcaagccgtgctccccgcgtttctggagacaaagaaaacttgtcgatacccaacagtcctacctgattagctcgaaatcaatcgacaaaaaccggtgaaatccgaacaaattttgcagatatatacactgaacctttcccgtatttagccggcttactgcacggtttctcaattcgaaccgacttgataagattgataaccgcgaccgattacttaccgtcataggagtatctttgagaccctggtcaggtcaaaggtcatcggaaacgactcggaaaattaaacctccaaattcacaagtctccatcccactggtccctggacatggaagaggaggggaccggccgtgtgtacttgtacacggaaggaaccaagcaacagcactgtcgccggatggagtttggtcccggaggaaactgatcgatgaagctccaagactccaagcgccggcgacatcacacagctcgatcgatcggcagcagcagcagctacagaatatagatgcgtcgcgtagcaagctgagctatgccgatgggccctgtggcactaacggttgccaagagaggggattctaatcactcgagatgataatgtagtgatcgataggtcgcaataggcgccaaagccacccgtatagcctagtgatctttaaaaaaaaaaaatctgaattacccttcttactatcgtggtgaatagcagatattcaggtcccgtttgatagagctctaaactccaactcccaattctaactccaactccagtaagagctggctcctatacgagctgagacgggtatagaaagtatttggctagattactcagatccacgccaccacatccctcgtcgccattttgtcgaacaccttgtagacgtcaccctactgttgctgccgccaggcagcccgcgagccgccgctgctggtcagcccccgcatctcctccgccgccccgggccaccacctatcgccaccgccgccaacgcctgccgccgccaacgcaaacgccgctatcacagccacagcaagacgccggaggaggatggggaggaagatggagaggagagacaacgggaggagaagggtaggaaagggtagtttagtggtatttttacgtaaatacactaaaaaggtagtggttcttttgaggtggagtggagttgtggagcagcaaaaacccaactccatcccgtagtataattttgtggagcagctctgctacctctgctctaaaaaaataaagaatatgtatctatcgatgggggatacccgtagaccggataaatagggtattggggtacgttggtatgaggatctacatgatacgacatcaaaacaaacaaggagacaaagattatactggttcaagcccctcgttacgtaatagccctaatctagtttgtatgagattgatatgaaaaatcacagagtacaaagagaacaaaagaatccggcgttactggcgagatccttctctagatgattcgatgagatctcccggcaagtgggcttcgcgtcctcccgctccgtaaactatggtgggggtgttggtgttgtgatacaatgatctgaaccctcaggcggccttttataccgtgagttgccttagtctccaagtagaactcagagacaacaaaccctgcacgatatagaataaacctaatcctctctgaataggactctgataatcacttgcccataaggatattttccataatatcttgtaaattcccttatcgcatacggaaacatatcgtatacatgaaggtataccgtatccgtatattccataaggcgtgggatatgaggtatgccttatccgtaaccatgacagtaccgtttggcacagttctccagataagctggagttgggaggtagagctgtgccaaacggggccaataccatcaacttttcatactagacaattaaccccctaactcctgttttagatggttttgaactggggaggttaacgtggcattccaaggtgtcaaaaaaataaaaaaaaaagtaagtcaacaatggctgttagcaatatttaataaaactagcatagtgacccgcgcagattacgcagctagcatcattatattttctctcatataatagcatatatgttttccccttatattattcaaatatattaaaatgacaacataattttaaattttgcaataactttacaaaactactaattactaatttgtaatattcatattgtattttatatacgtgttagttattaattatttttaatatcaaatttcagttatttgtaaattatatatattcctatatatactctagactcgtcttttaatatttctttttttagtttcaaattttttttgtaaattgtatttctatatagactctatgctcttcttccaatattatttatttttatttctgaatttttattatttctaattgtatttctacgtggattctaaactcatcttttaatattatttaatttttaatttcgaatttcagttacttctaaactatattcctatattgactttaaactcttcatcccatatttttcttaatttcaaattttagttatttgtaaattatatttttatacggactctaaactctacttttaattttattatgtttattctaaattttagttagttttaaattcctatatgtactctatactctacttctaatattccttattttttaattccgaatttctatttttttcttaattgtatttctatatggactctatactctacttctaatattccttatttttaattctgaatttcagttatttcctaattgtatttctatatggactctgtactctacttctaatatttcttatttttaattccgaatttcagttatttcctaattatatttctatatgggctctagtcttctcttctaatattccttattttttaattccgaatttcagctatttctaaattgtatttctatatggactctgttttttctttttctccgattaatgtgagaatttctaggctatgagagtgaatgtggaggctcctttttctattcctttaataatataactagctaggtggcctgcgcaattacacggctagcacccaaacaaaatcatatatttttttagtatgatttttacttaaaatttattaaatagttatctcattgtcttaagactttgaaagacgaaaccttatcatccttatgtttctaattatatagtttttaaaagtcacaccaattgctaccccttatgtcatctccttctttatttgcttgctcgatctaccattatttctattcattctttttggaacctttaaaaattggattttatagtttttagagtttattgtcacattggatttcatttttataatatcaaaatgtcccgtcaaacgttgccattatactcctctacggcccgtccattgtctcttctctttattgtcattgagattttaaaaatcgaacataattattgtttgggttcatttttactttctaaaagtcccgccaaaccgtcaacggctttgccattgtactcctctacggctaacccgctaccttacttctttattgtcattgaaattttaaaatcgaacatgattatcattggttcttttttactttttggaagtttcaaacctttaaaaattggacttgtagttttattttttataacttttagaagtcccatcaaacgatgccactatgcccctctacagcccgtccgccgccaactctttattgttattatgattctaaaaatcgaacataactatcatttgaattcattttttattttctagaagtcccgtcaaccgtcagcggctctgcaactatactcttatataccccgcccactgcttctcctttttattgtcattgagattttaaaaattgaatatgattatcaatggggttatttttttttactttctagaagtcccagcaaccgtcttactcgtttgcttcacggcatgcctgacgtccctccttttaattgtcattaggattctatttggtgttttattaacaatttttatatctcgtatcaaccgccaccactctactcctttataggcatgtttcttaatttatctcgtcatgtgttttagatggtcttttctttcaataatctttatttttatcacaaattttagttatttataaattgtattcctaattgaaatcttacttttctttttcaaatttcagaatttttttaaaaaaaattagttaatatcgtattgtgttcttttaatgtttttattttttattttcaatttcagttgttttaaaattgtatttctacttgaattttcttttaattttttctaattttagatattattttatttttattctcaattttaattaatctcgtattgggttcttatatggattcttctttcaatattgcttatttttaattctgaatttcagctaattttaaattgtttccttcatgaactcttcttttattttcttttgctaattttggatttatttatttttatttcgaattttaattaatctcgtattgggttcttatatggactcttcttttattattccttatttttaattctgaatttctgctatttttatattgtattcctacttggactctcatttgcttttctaattttggattttatattatttttgtttttaattttgattaatctcgtattagattcttatatggaaacttatttcaatatttcttatttttaattccgaatttcagctattttaaattgtacttctacttgggctctccttttctttttttcttttctttttctctgaataatgtaggaatttctagcttccacagcgaacatggtgcctccttttaaagctgttttaataatataatagatagataatgaatggtcccacatgttaccttcttctcttttcttcccccattttcttcatccccagccgggtagatacggaggaggcagcgagccagcaagcgccctccttggcccgtggaggaaggcgacgatgatagcagtggcagccagccgacggagaggtgagctcatgcagggtgggtcatgtcttccctgtcacgccccgaactagtcccgaccggaactagcccgtgacgcttcaaattaacctgttaatcgataccagtcccaggaaacagtgctggtatcacagggagacagaatatcacagcaacagaggtctctttattatagagtagatgtacagtcatgttgggctgcggacagatcccgagctcacaactgcattacaaaaggaaagcggaagccaggacttggaccaatcaacacaggcgcgacttgggaactaggccgaaaccctaaaactcatcgtagccggcttgctcctggaaaaactcctcatcagcaggatccgcttcatcttcttcagcaactgggggggaattatttatatagagcaagggtgagtacgggagtactcagcaagccatgggaaataagtgtttaatgcaggcttcaaggaaaggctgatgtttttgcaattaatttttatttgaactcttttctgaaacaactaagtgagtgcttctcaaacgacacggatgagacagtgcgtctcgtccggtcggagtatgtgcaatgtatcagtctttagaatttaaacaaggttagcacccggccaacagctttttcaacggccacccgggccaacaacttttcaaacggccacccgggcctagctgatcccatcagctgcagatttttcaaacaccgaaccccttttcacacagcaatttcacaagcagtagtcaaaccaaactacgctaggaatcacctcacatccgcccatgaccgtgggcacggctgttcgaacagtttgttaacctctgcagagggggtacactttacccgcatgacattactaacccggatcacccagcccgtggggatcagccacgtcgggagacctccaagctttcatgacaaggcatttccaaagccgacacaggtttaccatacgccgacgagaggggtcccagaccaacaacaggttagctcccagaccatactgtgccaggaagcccaggggtcctccccgacaccaccccggcgaatccacatgtctctcggcatcaaggctcccctgataagctagttactcagccaggggtgtcccattccacccatgtggttgtacttgtcttatgtttggatgaaattccaaggaatcggtccttaagtgcgagagcgggaaaccgtacacccggtacgtttcccggtccgcggttttggaaattcatttagttcgcaagcaccgacccaggtgtcgggttttccaagtcttttgtaaaactccagttttacccaagttattactcagattttaagtttgaaggcgaccgtcgatactggcacagggtgcacgaatatcgaggcgcaactggatggttacaaggggacatagtatagcaattaacaatggaaggatcaaatgcaacaagttaggtaggtctgccaatctgccttgcagacggaacaacagattaagtgcaatcctatcaatgcataatattttacaagcaatataattagatttcaaatataggctcaagatgttcaaaggtggcttgccttgctcgagatctggagcttgatcctcgaaatcctcgcaatgcgggtcttcgggctccgaaactacacgcgaaacgggacaactcaacaaacggcgaaaatgaaaccctaataatgacctctaagcgtgccattagatagatctcgagatttgaggaattttggaagttgaacggagtcaaacggatctaaggttaggaagatattgaatttctaagattattggattttttggtcaaaaagaaaaggatttaattaaatccttttttggaaaagaaaagaaaagaaaagagggagggattatagacttttcctcgggcggctaaggcgcggcccaagggaattggagcggaccggccgagttaaatgggtcggccggcccaaggcggcccaagtgcgcgcgcgcgggagggaagagagagagagcgccggtggaccgggctcaccatgcgcgatcccgggtgggacccgcttgtcagcggcttggctcaccgtgcggagggagtacgcggctcatgcgcgcgggcgggggagggacgcggtgcacgtgcgcggttcgcggtggatgcggatgcggcgggcccacgcgcagcctcacggctcgcggtggaacgcgcgcacggggagggactgaccggggtcggctcgacccggtctaggctgagctggcgccgacgtggcgcctacgtggctgccacgcgggccggcgggaggtagacgacgacccggccgcgaatggacggcgggcagcggcagcgagcggcggagcgaaccacggcgatacggacaaaagcgagcacaccgggcggttgctcgtgatgaggggagacgagccaacggctcggatttgccggaggaagcttgacggcggcgaatcgcggcggcgacaaccggcggggagggaagagggaaacggcggcgaggccacgaggggtcgattcccggcggtgagagcatctacgcggtttcgggaactcgatgctagcgtcggattggacggagctacgccgagcaaggctggtgacgtgtgagtgctacggagctcgagcggcgacggcggcgagcacgcggcgagcgacgacaacggtcggggtggcgccggctaactacggggagtctactcgagctactaccgaaagctagggggaggagatggagcgaggaggaagaacagagggaggcatcaccgagatgaggaggggcgctgtgacgagaggccgacggcgcgggagtaatctctccggcctcgggccggggaagaggaaggagagggcgcggccgaagtccccttccgcgtccttactcgtgccgactccttcgacacgcgcaacaacgaacggcgacggcgaacagagcacgggggcggcagctatggcgaggaggcgaaaacgagggagattggaggggaaggagctggggtttaaagggggcggcaatgtcggtttgggaaccgacttagggcggtcaaggcgcgagctggcactcggcggtcgcggccagagcggcgacagggaggatgacgccggcggggggaaaaggggaaaaaggagggggagaaaggggcttgcccttttgccgattcgggaaaaaggaggaggggagcgggggcgacgcggcagagggaggaggggcgctgcctccatcccttggcggcttgcgcgcggagtggcggggccgggcggtgacgacagcgatgacggcgggcggtttggagcggcgcgacgacacgggcgacagacgcgtgaagaggctaacggcggcggcgaccgggcggtcggccactcggcacgcgcgtgcggcttgcaacgggcggcgtccgcgcgggcgtgcgcacgcgaacacggcgcgcgggaagtggcagtgagggagcggagagggaggacttcgctcggcgcgggcggctcacgcgcacgcacgcgggcggagcggaggaggaggagcactcggcgcggctcttcgcgcacgcgcgcgcggcgcgcgggcgaggtggagcggagctgagcgggggggggagcggagcgcgccggggaggggagagggccgggggagagggggagattttttttttttttctttttttattaaataatattcattcttaaaatttggtactctcagtctcctcgc

SEQ ID NO: 62415 - DNA, 3744 bp, Oryza sativa
gtgtgttcaccttcttggcggcgattaaacgttgccaaaaacacgtatattgcatgacctctgccggggcttttgcttccgcctttccaatggaagagggggggcagagggaattttaagggcgaaagccgtccgcttggccacaaccacttcaggtgcatcgtcgacagccgcccattggcctgcgtctgccacgactggcgcgcgcccgtcaagccgctacacaacgcaccgcatctccgcccgctccggtggatcctcgtcccgcgcgcagccggcccttccttctagtgcgccctccgcggttgcggcgggcacggcctcggcgtcccggacggcgcgcgcaccgcgcgctgattcggcgcctacgacggcggctggatcttcctcggcaagacctgccgcaacacgctcctcagcctccgcgaccatcagctgcgcttcaacctccccttttttgtccgcccggacaagacggctgctgaattggggcggccagacggccctgtccctaacagtggtgtgatcatgctcgccgcgacgctctcttcgccaccggaggacgaggattgcgtcgccgccgccatcatcacttactggcccttccaggctgctcgacgcactcacgcattctggcgcgttcagtcagaaaatgcttcccaggatcaggttgcggcgatggggcatggccctagtgccatcgacgagccagctctggaggatgtcatacaccacaagggagccttccttttcctcaccgcagaagaagacctccatgttttcacagcacgggatttccatgaagacggcgacggcaacatgaagatggcgcccagggtgattcttcgcttctggcgtggccggcgcgattatggcggagacgtcgttgctcgctacctggtggagtcccgcggcaatctcctcatggtggtcaggcgcgttcctgctcctcttgccgcgccgccgacgacatcggcgttcaaggtgttcgagatggtgcagccgccgccgaggaagcggaacaaggccctgcacggctggaaggagctggagtcgctgggtgagcggatgctgttcgtcgcgcgaggctgctccagatcgtacgacgcgggtgactatccgggcgacgagttcggcgagggcgtctacttcctggatgacgggaggctctaccgcgagtcgacagtgttcgcttctcgcgccgtcgcggggaaatacccctgcagagacaccggcaagtggctaccggcggcggatgcggcgggggttccgcgtgtggacaagttcttgccggagcaaggcccgtcggactactcaccgccggcgtggcttctcccctgagattgctcatgttagttttgatcgtcctggtacaggtatgattcgctattgatttgttcgagatgtccttctcctcttgtttgggtggatgatgtagtcttcctgatccggtatgataattctcgatcaatcagtataattctccttgctgagtcagacttgcatgaacgcaatgcatgtgatgtgatctctggactctggtctgatgatttgtatgaatgcagcaacgttttggctttcagtacttggattgagtctatgcatcattgtttatgcagttaataataatgcaatgagaaaatgtgcccaattatccgtgcttaattttcttgatagaagaattctttgcatgaaatggatttgcaatgtagctgaatttcttctccgaagccaaatttcagtttgttaactgttcacagatcagtttcaggctttcagctagatgtgaaagatgcaggtcgtttatgttttctttcatcatgcgatgttgtatgatcgtctgaatgtcatttgttcttctatagattgctactactgatggtgctgaatttactttctgtgccacgatttattcctagattgtgtgcatgatgtagaatgttgagtacaatttagtagcagagggcttcttggtcgccaaaatcatttagagataacaggcttttgttaatatgttcactagtactgattagaggacaatttgtacaaactaaggattgattagaggatattctgctctgcaaacagggcagaatgagtggtaaatttgttaaattcacggagaggatgtttctctgcatattcatttttctgaacttgtagcaccattttgtctaatagttggtcaattgttcatgagatggttcatggttggtcgcttgattactagtgttaactcggttagaatcggactgttaagcatctggaacagttagtttgataagcctacgagatcacaagacccatgagccatgatttggattgcattagtgcataatgtgcttaattagcagtaagaattaagtattctctgcatcaaatggatttaagaatgacagtgaattgtcaacaagcaactgaatgttgtctgcttcagttgcttgttgactgtccaagatggggctggggtaagctactgcatctcttctgacgatctaagcaggattctagttgctgctacatagtatcataactgatttctagtattcttcgcattttcataatctggcatgtcaagctctcggtttatttaaacttagatgagataacactgcgcatcattttcaggcttttcagctagctgtgaaagatgcacatgattttttatttctttcttcatacttgttattgtctgatcggttgaaaggtgacaaaaaagtttaaacgtacagtaaataattcgtcctgtgttgtttgttcttctgtaggactactattgatgccacttaatttattctgccctgattttcccctattatgtgcatggtgtagaatattgagtatatttcagtagcagatgaaccggctaaacggtcaagatatggttattagttactaatctgaagtgctcagcaattttcagtagcacagccttttgacaagcaccatgttaacctgttcactagtaatcagatggttttctgctctaaagaaagggggaaatgagagtaaatgttgagacacgaagaggatgtttatccgggaacgctgagatttggagggagagacgtccctccaaacattgtttatctgcaatctgcattcgccatccattttcctgaacttgtagcatcagcggatctgcctatttggtatgaaatgttttttaagggtacgaaattgttttctaacggtacgaaattgttattagatggaattacgagtgctatcgcgaatagaatttataggctattaaggtcacaattctagcaatcgcagaacagggtatttgggactagaaaagcgaagcctttactgtattttcgaccgacagttctctgcctaaacaattcttcaggcccgttcttctatgggtcctgtaggcccatttagatcagcccatgaaacattatcatgtcggcccgcttactctcctaaactaggcccatgcgtgacaagaaattgctgacgccaagttcaagtctgaaacttgtagatcttgaactaatttctaatgcttcaaaattgtagcagcattttggtggtagagtgatgggacttggggacgatatcgccaccaagctagattctgaaccacagtgcaggaagacgtaaaccattaattatcctgccgcagactgcaataattcagcaagcagaagtgattaatagttgatcatagattcataggagtgaaaatgaacacatgcatctcaaaaaaccgtaggaattccatatgaaatt

SEQ ID NO: 62416 - DNA, 3801 bp, Oryza sativa
  unsure (1)..(3801): unsure at all n locations
ccaatgtgaaaaagtatgcccgcaagctttgaatggccggcaaaaattccattaagccccttgccgcctttgttatggccgccaaggccctaatcccaatttggnccgacgccgcaagacggcgcggtcgacccaccgtttgttacgtcagcttgccgcccaccatttgggcggcaggggctatttctgcaatttttttggtcgatagattatttctgtaaatattaaaaaaaaatctaaaacggaaaaaattctttttgaaagcgggtgaagatgacggcttggtttgaaagaaaagggtgggtgggccagcatgcgatcagattgggcctcatttatagggctagctttcttgggccccaagcccccaagtgcatcttccccgtgaggaagattaatgggctcaaatgtagaaagacattttaccttcggaaaaaaatccactttaacttccttaactggtcatcaaatctaattcgtgacccttaactaaaatatcgggtaagaccgaactattgaaaccagtgtaatttgaattctctagcaattttgaagggtggttttgttgtcgtgggggtgttgatctggtcttcatgccacgtgacgcttatatagcattaaaattttaaaaaaatatatgtgagacctactgacatgtggggcccacatatcatcctttattcctccccctctctctctctctcccttctctcacttttctcttccccaccggatcggcggcggcggcgtgcaggcaatcccctccagctccgcgccatctccatgtcgtcgtcgtcgtccgcgtcccttccccccccccccccttttttcgctacaccgcctcttccttttcggacggggggggcgcttcggcagtacgggacggtgcataaggtagaacgttgtgaagaatggttaaacagttaacagatggttattcacccaaagttatcagcatttaggcattacttcagtaacacagcctgatgttaggcgtcatggtattctgttcactagtactgaactactgatcagattatgatgttcttctgccctccctgctctacagaagagtggatcaaatgagagaaaaagttgacacgcggagaggaggataattatctctgcattgcccgttcatttttctgaatttgcactcaggatcttgtgaatgatggtaagaaaatgttggtaaaatttagatggttggttggttaatcaccagcaataaccacgagaaaattttggcagttcactacgacttcgatgtatcacttgcagattctttactgttcagtctggaactcaataaacaaaaagtgataagaactcacagactccagaaaattaaaataatacgagtctcaagttattgacccatgggaaattcgacatgaatcaagctgattcagcataactgtcactgtggatgctgattaagcgactttcggcgagggaagaggaggattagcctgaaaaattggcatgaacaggatcccccacactgaatcattgttcgttgcaatataatgattcactaattaatgcaatctgagtcatgagaaccaacaatttctgcattagtctaacatggtgaaaatagcagagtactgaagagatgctatgatggatcaagcaattgcaagcacacatggatctcgagaacacatcatcgattgcacaaatcaacaaaccatatcaacacgacaacaagtcatcagacaatctaactaagaacatggcagtctcacggcagaatccaaaccggcggcgtgtagtacgacgggccttgctccggcaagagcttgtccacgcggccggtaaccgcctccgccgccgccgccgccgccggcggcagccacttgccgttgtcgctgcaggggaactgggcaaagggattcaagatttggaacgcctcatcgtagagtctcccgtcatccaggaagtagacgccctcgttgaactcggcgcccggatacttgtccgcgtcgtacgatctggagcagcctcgcgcgacgaacaacatccgcccacccagcgattccagctccttccaagcgtatggtgccccgtcgttgttgatgggcgtctcatgcaccatctcgaacaccttgaacgcccatgtccccggcggcagttggggaggatgaggaacgagcctgacgaccatgaggagattctcgccggactccaccaggtaacgaacagcgatggctccgccgtaatctcgcccaccacgcgagaagcggcgaaccaccatgggcggtatctccagattgccgtcgtcgtcttcgtggaagcccgctacaggaaaaacatggaggttttcttccctggtgaggaaatggaagcttcccttgtggtgtatgacatcctccagaactgacgtggtgacgaactcaacagcagtcgccttctccacaacttgatgctccatgcgccagaacacatgaacgcgtggatcgtacatcacgcgtggatcgtacatgaacgcgtggatcgtacatccggtggcgaagagagggtcgcggccaccatgtccgtgcccgtgtcggggaagtggaatcgcgtgccgttgcggaggctgagtagcgcgtagtccaggatttggccgaaggcgacgaagacccagccaccgtcgtaggcgccgaagtagcgcgcggtgcgtgcgtcggccgggagcggggggcggaaggcgtgggtggcgcagccggcgagggcgcacgcgaaggaaggcccgtcggcgcgcgggacgaggatcgatgggagcggcctcgtccccggccgcggctgctcaggcttgacggcgacgcgccagttgcggcagactcgggccatgcggcgccggtcgacgaggcacgggagacgcttgaggatgaatccgagcacgtcggcgtcgaggtcgcgccatggcgagtccattggagaggcggaggcgcggcttgccggtggcgaggcgaggaggaggaatggaaccgatggattcctctgcttctggaagaaggaggagatgtgcttggtttggaagggggatgggggactgggcctcatttatagggccagctttcttgggccccaaatcttgaggcggataaatgggctaaaatttatgaaggctttactttttctttttcataagtgaccttccgggaatttaaaattcaaactgggagttcgtttgtgatgccagctctgccatgcatatttttgttttgaggtcggatgggtgccatgtctgtatattttcggcaaaagcacggcttggcgagcgtctaatctagtgtttttgttgtaccatcagactgatgcacaagttcagaaaaagtgaacaaggaattcagagataagcatcctgtgtatgtatcaacatttcctcatccccttctctctgtaaaggacgagctgtgaactgagcatccttcagttcagcactaatgaaaagattaaccatatcgcctacagaaaacatgtgtgcctatgttactaaagatgatgacctcattggaccaataactttttctatcttttttttctctttttttttcctgtaggataataaccatctgtccatctgaactgttaacctgcttgaatgccttttctcaaaaaaaaaaaaaagggttaaccttccctgctcccatttggttctcctgtctgctagacacgattttgcaccatatgtacatccgaactttacgttctcaaaaaaaaaaaacatttaaggccccaaaaaaacgcttagcaaaaagcagcgatccaaactttaggcccaaggaaacccgggcctattaattgggcccc

SEQ ID NO: 62417 - DNA, 1739 bp, Oryza sativa
  unsure (1)..(1739): unsure at all n locations
ctatgtgnnnggtgangctgcnnnnnnnnnnnnnnnnnnnnnnnnnnnnnnnnnnnnnnnnnnnnnncatacatcgagtgggtcgatacagaaaatcccgttctcgacctaaccacttgtttacaagaaggtcgctggtatttcgcatccgaaagtactgagcaatacttacagagaaaagcggcttatgaacgacaatgtcgtgaacaacagagcgactggcgggtgctaactacggcactccctccatgggaagcccgtccaagatacaggtgtggtgatcgttgtcaggttcttcgttccataaatcctacaacattgggtcgaaggttctttgtttgtccaaatattcttgacgacgatttcatggtaagaatattttgattacatgattccttattttctcacaacatttactaactttgcttgctttacatctattctttcctcccaggaaccaccaaggagatgtcaatacagagaatggatagacaccagaagggttctaactccacctagccgtgttgtgcagcttgaactaccagagcaatacagggttactaaagcgcggtttgagagaggagagggatcctcacgtaggggttagctattatcggacaacttggcatattgaaatttctactgtcatgcttccttgtcccattattacatcgtcgttgtgttcaactattgcactacctccctcctagttcgaatctaatatcatctatgtaactgcaatgcaaatagttgtatcatgttcaaattgtactactatttcttcatgttacataattctccttgtttaagtccatataatgtttctatgacctagactgcgatatgcctatataaattatccgagtactaatacgtcgaataaggtacaaaataatacctcacttaacatatgaaattgcgcaacaaccaacttcaatacatttttataacaatattaacaagttttaccaataaatacttctttatttattattaacataacatagaaaaatcttttggccgtacttttttcatctgttgatataagaaacaaacatttaagtacaaaccagagtacatgttctggaatattacagaaacttatggaatatgtctatttccattgtattcaagtaaacctctctctatttggaggcattttcatttctattcttttgtgccacccctttttgatgaagatgaatttctcttctttttgccttctaattcatccccagaattatgcttctcctgtgatatatcttgttgcaaatcttttcttttgtttgaaacatctttctttttctgctctacaccatcctgcaacaaaaaatatctttctttattactttttttaaaaaaatcaattcatatggatttgtaatttttggtacctgttctcttggatttttaacctttccttgtttgcctttagaacaatacacaaaagaagtcattataaaaaaaattttcttttaaaaaaaaaaacatgttatttgggtgtaactttttggagctgaaagaactggcatgaatataggtctttttgctggatttcttccctaattggctctgatctttgagctggcctgcctttggattttgcaatatctggatccaacaatatttcctctgtatttcctcagatggtgatggcctggtcatgtgaggtcaaattgtcttctgcatttggatctgaatcattgatcttcttgctttgcatctttatttgacacatt

SEQ ID NO: 62418 - DNA, 3859 bp, Oryza sativa
  unsure (1)..(3859): unsure at all n locations
cgcgccttgattgcctatcagtatggnacagnacntcatcaattgatgttaatgaatctagtctagattcattaacatcaatatgaatgtgggaaatgttagaatgacttatattgtgaaatggaggaagtatataggaggacaccatgaatataatctcttgttttgcggagcttctgatctgttggagatcagaactacaaacaggcatttttgtgtgatttggatgtacacatgccaaaactgatcgacgatatatatatgaatgcgcatatgcatgcatgcaggagctacttcaggtgcacgcacagcaactgccgcgtgaagaagcgggtggagcggctgtcgacggactgccgcatggtgatcaccacctacgagggccgccacacgcactccccctgcgacgacaactcctccggcgagcacaccaactgcttcagctccttctgaagattttagcactttgcattttcgtcgttgatccatccatcaatatatataccgtcgtatacctatatgtccaccgtttgatcgattaactgtggctagctctagctctctttcattttgatggttgagatatataggcgacgtaatatcgagccatgcctgcgcaatgtaccagtactgctagctatacgtgagatgtattgcgtgcatgcacgtacaatttacaagcagcagtcaataaattaagctatgtatttcttctataaacacatcagcacatgcaaagtttgtgttacacataaaaaactccaatattggaccaatatagtactagatgttacacatcctagcactacgaatctggacatacctctatccagattcattatactagaatatatcacattcagtacaagattcgttttttttaagacggagggagtatatagtactggggaaagtgttttcatgaacgcagttcactttacgactataactagctattgccgtgtttagttcatcgtccaaattttttttaagtatatggacacacatttaaagtattaaacgtagattaataataaaacaaattacagattccacctgtagactgcaagacgaatttactgtaagtctaattaatccgtcattagcaaatgtttactatagcaccacattgtcaaatcatggcgcaattaggctcaaaagatccatctcgcaatttacatgcaaactatacaaaaaaaatttcgaccacatttaatgctccatgcgtgtgttcaaacatcaagacttttttgaccaaatttttttggaatctaaacacatcctatatactcactttgagatcagttcatggatgcagtactacactgcaagtccggtgatatgcaattctgcatgcatgcgcatacaggtattcccttcctacgataaaaaataaatctagtacgttatctcatattttatacgatgtctcgtaaagagtatactcccctccgtccgataaagagtgcattttttttatttttatagaacatttgactcttcgtcttatttaatttttttatgattagtattattattattagatgataaaacataaatattattttatgtgtaactatttttttatttgttccataaatatttcaaataagatggacaggaaactagatacagaaatccaaaaatgcgttctttatgggacagatggagtaggtttattttttggttggaggtagtatccgtgagtcctaagttactccctccgtcccaaaacaactgcaattctgtactattcatatctaacgtttgaccgttcgtcttatttaattttttttatgattagtatttttattgttgttagatgataaaatataaataatacttatgtatgactattttttttttaattttttcataaattttttaaataagacggacggtcaaacattggacacggatacctattgctacacttattttaggacagaggtagtagatcatactgtacacctttattttttttttccactttggtgtactaagtttgatcatatactacgtactgatgagcgcaggcctgacagaacacacaacacaggaactaaaaggaggagaaaaaacaacacaggctcatcagcgcggcgctcctttgcgtacttgtatgtactcctacgtatatgtgcatcgatgcacatatatgcttcgatcgatgcgcgctaatgattgttgcaacagagaacctgcagttccggcgaaaacgaacaggggctcgcaaacaaaaccgccatcaacactcgcgtgctcgcatctcctcggcgtctttcagctggtgtgtgtattcagaagctagccatgcatagggagggcatgcaggcatgcagctgcacgcgaatcgatcggtctggtattgtggtcatccatcggggagggcctcaaaatgtggtcgctgaagaaaaaattaacactgtgagatcgatcgagcttgccatgaaatcgaggtgagtgggtgtgtcaccttcgaatctttgatcatgagctccacctacacgcgctggcccatcatgatggcctaggaaacacggcccggtcactgcgtgcgcagggatcccgtcccggcccaacttgaggaggcaggacgcacgttcgcgggcatcctggttgggcccagaggagaagagggtgacacggtccaatgcgccccaaattgcgttgatttcctccagcgccgtgcggagcacccgtcccggcggatgcggcgagcccgctatttttatctccgcggtcgcgactcctcacctgctgtctgctgcggtggtgcctgcgtggctgcgtcccatgtatcgcctctgtttgaagggagcatatctatgcacacatgtcctcgcgtgtacacaccatgtacaccaactaaaaatttttacaaaaaattctagaaaaatttatacatgtacttttaatagtattatatctacgtgcaaagtcgcatattcaaattcattctacatagagaataacaaaaaagataaaattctgacaaaattgcaaccttaaaactgtcagattttttgttttttggtatggctaaaatataatgaatttgacgttaagattttaaccctaggtgtaatacaattgatagtatgtgtatgattttttttagattttttggtgatattttttagttggtgtgaacgtgtgtatacgtgagggcctgtgtgcataggatatgttgccgtgtttgaagactattttttgctgaaatgtcatgcaaagaccttaacagaaccggcggcacatctcggggatatcattttccctcttgcttccgttccatataacggattccgtgctctctcccgaacttcagctgctccccaccagctctgaggccgggtcagcacatcacgtgcgccgccaacgcgtgcctgcggagcgaggcaagggaagccatggcccagggcgcatagctggtgggggagagcgcccaccaggacatgccgcgggtggtcgccgcgctcgccggcatcctggagcgcgtcgcggggcgcaacgacgcggccgcgacgcccgcggagctcgccgcggcgccggcgtcgccgttccgggcgacggccaagccgggcatctccgtccgcgcgtacgcggcgcgcatcgcgcggttcgccgggtgcagcccggcgtgatacgtcgtcgcctacatctacctcgaccggctcctgcgccgcggccggcggtgcctcgccctcgccctcgccgtcgactcntacagcgtgcatcggctcctcatcaccgccgtgctctccgcagtcaagttcatggatgacatgtgagttttctctgcaaactctgctgccactcttcagatggactacacacagagaagcgntcacccactccg

SEQ ID NO: 62419 - DNA, 21463 bp, Oryza sativa
  unsure (1)..(21463): unsure at all n locations
gcgcccatgaaggtangacaatcgctccnacccngcnncatattgggttcaacttatagttggataatttcaatcactttgtttcttattcctactcgacatagttttgttctattcacaaacttcccttgttcgagacactgccagctaggaataaactgggagtgtcttcgaagtaactccagaatcatttcggtccctagttcaggaatttttctgtttttacaattccaaaatgagtttttccttacagtcttgaaacggaaggcaaagagaacctccgaaatagttacatctgaatatcacagcaaccaccagctattaattgtcggtaatcatgctccaaagaagccactgggaaaggtttccacctcaactttgctgtcaaaactaggctttgcaccgggtacccaaagtgatttgtccacgcaaacaaacgcagtacatggacagaattatgcttgtccagcaaagcaaaaaaaaatgaggtggtttcatttcactattccttgcgtccaaccacacacatccaccgtggacccaagaacacaaaccagaattccaccctgcacaaggaccccctcgcctttttgtttggaatttaattcagtgccagttgtgggggattgggactggcaacttgcccttgctgctgatgtttgcagctcaatttccccgtgtcagggcctcatcgggagcatctcttttttctagctttttcttaagagtaagagcgacactactgtgacaatacttaattgccaacttggcgtactgaatgagcccgtttggtgccaattcggtgatttgtggttgcgattttgttcggtcgcttgatcgatcccttcgatgctactggtgattgtgccgtcaatcattggagagcaatcataaacgatctgaaagaatggacggagcatacaggcaatatacaataatactgtcattaatttctttttgtctgaaaagattaacagccgaattgttttgacttttgacatgatcgatcgatctgtatatatatatattcagatgctacaacaacgcctacttcgccaaggtcgggggcatcagcctggcggagatgaactacctcgaggtggacttcctgttcggcgtagggttcgacctgaacgtgacgccggagacgttcgccgactactgcgccgtgctccagtccgagatgctctgcgcggcgccgccgacgaggctgcactactgctgcctgtccgaggacgatgccggcagcagcagcagcagctcgctgcgtgaagcggccatggaagcaagctagcatgtcacactgcgtacatacatgtgatctgtcctacgtgctggagtattagttagtgtggcagttgctttgattagtttagttagcctgctagctatagtagctaataggtggtcgatcgccctctcctcctgcatgatgcgtacagcagtgcattcttgctgtgcactcctttgttctttttctttttttctttttttgtttcggtgtgtactaatggtgtagatcagtgaaacatttatgcaatttgatcctatgtaaattttgatggaaaaagtaattttcaatcttggaagtgaagtatgtagtcgaccatatagctcagactggcgttctcacacacggtggatgcgccaaccactactgaaaggcaagagatgtgaccgtaagcaatgggcgggaggggggctcaccaagctcctatgactatcacaataattacaggcaccgaaatcttgggtactggagggaaatgaaatactatgccagtagtatctacggccgctccgttccaaattagatgtcgttttgatttattgcttttaacgtttgaccattcatcttatttaaaaagttagtacatatataaaaaagataggccatacttatagtacttttgataataaagtaagccacaaacaaaataaataataattcaataatcttttgaataagacaaattgtaaaacgttataaacaaaaactcaaaacgacaagtaattttgacagaggtagtactacagtataggaaactattctaattttttaggagatattctctcgttatttgtatgtcattcaaatgattatgaaaaaaaataatagattaatatgtgagaaatcactccacaaacatataaaatcaaatttaatttctacgagttgcaatgaaaaaacaatttggctacgaacatatgttaactacccatagcttatgagcttacttgtcagctaattaattatcattcttttaggtaataagatagaagtacggtatctatatccataagtagatatacacaactaaatattacacgagttcattaagatacatagaaaaacaagcaaactaaaagaaaatattagaagagactagcttcaaattttccctcatcacttcaaactttaggggaatgcggagctagcccgctctttcacctccacaccctctcgttgttgttacaaccataaaagttcctctgctccgtcatgaacaaaggaaggggacagaactagtccacccaaccgccttgtcatcgataagcaccggtttagtgatgtccgaacaaactgtgctccctgaacgtgaatatgttcatcgctgtcatgtcgtcgtcggcatagactaacacctcccctgagctgccacagcttatcttgccaaaattcaatggcgctatgatgtccccctcccccccaaaaaaaaatcattgccgcataacctcacctctgcaaagccgtctaagcttatctcaccggagaacatccgccgctacgtcttctttgtccgaaaccatgacctccactaagttgccgtagcttatctcgtcagtgatatgctactaccacgacattgtcatcgtagaccacaacctaagccgagctaccgtcacaacctatctcctcgaggagtcgtcgtcttcactgctgacttccgccaccacgaataatcatattgtttatcacaacttctctctccttttaagaattgaaacacaagagcatatagaagaataggagaattctgtaaccttcataagaaaatatgtgtagtggattagttagtgattgagccattacttaaaaaagagaggcccaaatattatttttcatttatacagttaccagaatccccacaaaactgcagtaggccgaatactaatgaaggccctgggcatggcccaattagtagtgaccactgtactctgaatatgctgaaaagtttagcccataatgaatattggcccatggtttatattatagctttgtacactagggcataaattatatgtttaattggatccatactattataaattttcgactttagaaacatgttattattattcatttatttggaatcatgctattacaatttcttgattatttgatatgtatcactacttacccttcagtgtatttattttatgatttctagaccaatggagcccgagatagggtgctagagctcacggttggatgtggaggatgagagagcggcgcaatcggtgagggagagatggatggcagaggctgcagacggtgaaagggatgaggatggggatggggagcaagccgtggttggaggtgccacccttctatattataagttgttttaacttttttttaagttaaacgttgttaggtttgaccaagtttacagaaaaatgtaataaaattttaaacataaaacaaagaaactaccaaaatatgttaaatgttacatatattaattgttattctaggttgtttagcatatattgagatttgagaaaaaaagactataataccccttgtcaaacggtttataggtaagagtggagagtagttgagggcaaaataggaagaaatttggatgagaagtgattaataggatcattagtactctattgtgataattattttgggacaaattcaaaccctataaatacaattattatgggatagaggtaatagatgtagtgaaattaatttggtgttatataagtgttgttatatttttctataaacttgattaaactttcaagaatttaacttaaaagaaaatcaaaattgccgtatttcacatttggtaatccatagcagctccgctatacatcagacaatagtagcagactagcagagaatttatgttttcatgccatccaatacgttatgccgaatagccttcggttacatctagctttgcttcagaaatctgacatgcaggtcgattattcaggaagttggaaacgcaagccagacggaattccgccacgaacacagcgcagaagcaactagctagcatggcgtatcaccaattcacaagtcgagtactatattggcatttggggcatgaaccatcgtagtagaaggtactaccagttacaaagcctgaagaacacagcacgtacggtaccgctatgctcaaattgaagctcgtacatcagcgttccccagttgataacgtagcatggatgacatgacactatatatatcttaggagattcctatacattgctctagttatgaagctcatggttcgtctcatggccagaggaggaagacgaggacgggcggcttcagttgttaccgccaccgtccttctgctgtgtcttgccgccgccgccgcggaagctcccgcgcttgctccagtttgcaccgacatcgccgccgccataatccccgccatatccaccaccttctccggctccgccaccaccccctccaggttccccattatagccaccaccatagttgccatatcctccaatgccgccgctgccgccaccatagttgcggccgccgccgccgccgccaccgccaccgccacctccaaagcctccggggtggccaccgtatcctccaccgaaaccatatgctcgaccgcttcctccgccgccgccgccaccgccgccgccaccttcgcctctgctgccaccgtacccaaacccgaacccggagcccttgccgccagggctagcggcccagccccagccatacctccaagcaccgtcggggctggacccctggccggaccccgagccgcccttccacccgggcggcagcggcggccccgtctttcccggctcggccgcgccggcgccgtccccctcgccgtcggcgtcgcccctgcaccgcacgaacgcggacgcgaagacgaggaggagcaccgcaagagccgccgccgccaccgccgccgctcaccgcttctttccattgcaagctctctctcactcactcttgctctgtttcttggctctgcgtacttgtgttgcacttgcagtggatgtcccgtgccatgcccctatttatagcgtccacaggcaaccgatcgcgctcacgcaccaccggcccattgccacgatttgatcgatcgatttgctgctgctgccttttgccattctgctttgccatgcatgtcctcttcgtcgcgtcgatcgccaagctttgctttgcgcagctgcgctgccgaccgagcgttacaaaagtctctcgccaaagccgctttcacctttatcccgtccgtgccgcgtcgcactgtaatggcatgagaaggaatgatctctgttttcttttgttccttcatgtgcgtgcatttttcttcgtcgagagcgaggccccgtgagctagagaatccggttcgctgatggctagtgtcgaggtgtgcaaatgtgctagcaacagctggacaaaaaattttgatgttgccactatgcagctggccctgcgtcgttcgtctgttcccagaggttcgtgttgatgacaatgagagatctctcggcggctagcggctagcgcgcccgtgaccgcacgcatggcaaagaggagaaaacgatatgggcgtgacgtcgatagtgatttcgtgaacacgagtacacacactcaatcgggagtccgtttatttacactcatagctagctagtgctgtacattactggagtggtagtactagttatctagcggtttgatccaaagatgggcgcaataatatttgatactcgatcgtgccaatgcggcgtgcttgaacgtcgtaatcaagtagccaagccgcggcctaagatatccaaggccataatcacgggcatcaagatagtggtaagcaagcactgaccacatacgtagccgttaaatttgaccctcggggttaacaaggatatatgaagccttttgtgataccgtcggcactgtgcccatggtaggacacacttaataatagtacaatactacaattacagcatccttcctttaatggcacccacaatggtaatggcacccacaatggtaaagtaaggtgttctctgtaaaacatatacatctcaacaatagattagattaatagtaaatcacctcaatagtatgtctatatgggtatctatagctctctaatctattgccttgtttttctctatagactatctctagactagtagatagctttgctttctctctcttcatttaatctcttccatgtagaaaaatatggtgacatggatctcttatacatagcctatagataacaattcaactctagtctcgcgtctcgccgcctcacaaccaatgcatgcggtgcggtgcgtgcgtgcgtgcgtgcaatcgtgcgtggtcggccgggggaaaaggggcacgacgcagacatgcggtgggatcgatcggtgggagtaattcaacgagacaacgaacccatcccgtctccgcgcgtagctttcgactgggctagctttctcgtgcgattcgatggcgatggtcacctcgcccccatgtacagtgaggtgtgtgcacagtgcatgctgcagctcgtcctgggccgccgggagcgcgcggaacggcgcggtggccagggcaatttccggtcgacgggggcgcgccgccgaggggatgggacggaaacgattgccggcagctgggtggctcgttacaccggcggagcccagcagccacgtgcaccgtgcatatatggtgcggcgtatcgtgccggtgcaacgacgcgtgtaggcgcaggatgcgggcagagcccaccgcgaagcggttaggcacaaaaaaaggagaacttttacaggatttgcattccaaaaaaatgtaaaaacccaacgctagttacttagataccagataaaaacataagtgcactagttggtagaaaatggtagaattgtccctaattttaatcggtaccgtataggtaccagttagtcatttacgggaactagcttagtgtttcttatttgtatggtttcctctatatttacgttatgtactttgctattcttatttgcatgattttctctaaatttatgttttgtttcagaaaacacgttagtagagtaaaagttattgatcatgtttttttttctagatttatgttatgttctaaagaacatgtcaaaacttatccctttaattcatttgagacttatatttattttacgcggagagattatattgtgttttaaaaacataacctgttaaaatataatcgaaggtttgcatcgttttaagttatacattttattgatttatccgtataaaacatgaaggataattcgtcattttaagttatacattttattaatttatctgtataaaacatgaaggattgagcttcttccacgctatctctccttgtgggtgtacccattcaaacccttgaagaacatataggaggagatctcgattcaatttcttattcaaggaatttgtaaactacataaatagctaatcaagtgcgcacatatgtcctagatatcttaccgatgcgcttgcatctagccgtcgaccggccgatctcgtctcttcttcaacccttaaccatgtcggtgcttatccctttgtctcctttggtgaaccatttaaagtcctagaacaataatgaagtgaaggtagagaagaaaggatacatgatcttttctttttttttcctcattacagatcgaatcgatcgctaaatcaatggagtatccatgattcacgtttttttatctacagcaataccaatctatacaacaataccgatcaatagagccaagtattcaattcatatgaaatgtccatattttactaattaattactctactgccgtcatattataataattttgttccatactttgcccctctcttgatcaatggttcatattgctccacctctaagtacctcgcaaacaccgtgctttatggttatgggcccaaaagttagtgcacggcatgttgagttgaaggtgggtacccacttcgtgtgcggttatggttccctgcttaagagcatcttcaataacctctccaaatgtctatttgtctaactctccatctaatttagctagtcaaactcgttgtttactccaacagcttctccatctactatctccattataagtctatgacaaataggacccatatgtaaatctcttctgcccttcaacggcggacggcggcggcgactcgtgggcgcgaaggcgacagacgtgggaggcaggccgggggacagtagcgagcggtgagtggagacgacgctgagctggcgggctgcagcgagcggatccgctcctcactggcctccctcgctcctccctcaccgtcgtcgccgctcgggccgcgtccccatccgccggcgccgccactcgggccgagcttgggctccatccccatccgccctctgctgccgctcgggctcctcctgctggtgctgctctggccgagctcgccgtcaagccacatcgccaccaccaccgacctcactgtcgagcaaagccgcatctgctactccctccatcctcgcccccatctcgtccttccacgagttgatgcggggcagaggcggcgctaggagaccggcacccaccaccatgtcgtcccgccctcgtcgtgccctcgccgtgccgccggcgcgccctcccgctcttgccctcgccgtgccaccgtcaccgtcatcgtggtctcgtggtggattcggctagaaccttttcatggtagagagagagttgtggggcctacttttggcaagtgagtttggatggccaaatttgaccaatgagtggagagatttggccagccggatggcttagccatccagttggagaggctgttggagcatgttattttttgctagagttgtcaaattttaacttggagagatagttagagaggttgttggagatcctctaacacaaccaaaccaacgtatcgtactccggctccggtttcgcgtagtcgcgtttggttaatttcgagctttggactagtcggtaatctctacaccctccctcgtttccatgagttgagacaggtggttactcttttctccgccgatacagccaatagtgacaatcttgcgataagatggatacgtcgagcgtgttcctcttcttcttccctgcctcgcccttaaggacggtgtagattcaaacaagccggtgatataattcagcatccctgagaagaagaccacctgtgacaacatggttgagcacttgaggtgttgaagaacaatagcaacagggttggattctgtgcataatgtcaccacctccatcttccatgtcctttggaccaagattcaactgcctgccacgcctaccaaatactccctccgtcccataatataatagattttgactttttacttacactgtttgaccattcttctcattcaaaacaaattttggaattattatttattttatttgtgacttactttattatccaaagtactttaagcacaactttttatttttttatattacacaaattttttaaataagagaagtggtaaaacagtataagaaaaaaaattaaaatctcttatattacgagggagagaagtactgacttcagcagttgcctcctctccggcacgccttctcatctccggtgctttgtgcttctcgatgagcctgtctcccctgtgcttttgtactgttgtgtcgacgaggagtggacgaggtacaagtacgatatttgggacgcaggccgtcaaagaaaaactgcccatttgcccgatagcagcttgtcaggggaagtttttactttaacggcctggccggctagctaggcgtgctcgagttctgccctgcgcctgtgttcagcaagatcacaacaactgacgtgattgacggatatttttttttcgggtatataaattacgctcatatttatatctcgtcaaatctgacgacgaactctacatggcccgcaccctgtttggatacgacctgaagacaatttatgaagtctacaagatggatttttggctacagcggtgcagcagaattcaggagatcgaagggacatcgaaggttgagaatgtcgacgaacctccagtgtcagatcgattattgtgggatcctgcacactgaaccatatgatatgatactggtttagtggtttgtattgtcttctctcatcgtgtgttcttttgccgtggcttgtaatttgtaaagagcttttaggttcttttggtttatatgtaattagttattttccaggaactaaaagaacctaatgagaagtaatgagaatgctgatgacctaaaaattaatgagaatcgtctgacagttgcttggttatccgaagagtaaggtgaaaaacgaaaagaaaggggaaaaaaagctatacatactcattttcttttaccaacaaaattcttactaacactaatttatcatgttatgagtgtatatagattttttataatttttatctatctaaatcaaatgtttgagatgattgttagtaaatttagaaaataagttattccgtgtagcagtattcaattctcattaattttgacacttgttacacaacaaatgaccaagcaactgttacacgagggggtaatgaaggtggttttcagcgaattacacactgacaataccaccttcatccaaaagttccatttttttttcttccaaaagttattactattttatttttatcaccaaaccttcccaaatataacaatgttatctgagcagccgtgttagtttgattagtttgaaaatcggttttgaggacacactgaagaaaaacccaatctcacgttccaccatctcacaccatgcagcaacaaattatcggcagtactgaactgagcgttatgcaaatctgataagatggggcgatagtgattggaataactgtaattaacggtatggaaagctgaacaatgtacatatattgtgaattgagttgacaaatttagaacagaattcaggagaaggaaatttctgccgaagaattgtccgcagaacatctacgaatcagttagatcctcttctcagcttagccgccaagtagctttcacactaaatctccatgcataaacataatagaaacatagtagaggaacagactgttaaataaagacaaaatactacagaccctcacagtatgacaatgcaagatgaataataaaatataatcagctgcttgttatgcaaaaatcacaacggatattgcatactacaaatacatctcatagtccgcatattgtcattacagccaatagtacaaaataagattttacaggttggaagtgttcttgtctagttctgatcttgtggaataactgctcttttcactgtctcaatagctggatcttgtggaataactgctcttttcactgtctcaatagctgaattcacaactcgaacagacaagtttcacatgaaatcaacatttcatcgaacttttagaatttatatttattaaaaacacaggttgatcaaaatagtgagcttgggtatgcattcaacgaaggatttaacagcactagctctcaagcctggcagggcgaaagctattaggcagtaactgcagatgctatgagaaattttagcatcattaggcgtccatcaacagctcacttacattcagtaaacattaattatagaagtggcaaaacaataatttaaagagaatacagttggtgttgcattgcatcagacatccaaggaaggaattagcagcattagctctcaaacctggcaaggcgaaagctcttaggcggcaactgcgaatgttatgagaaacaagccttgcttttagcatcatttgccatgcagatcaccaatttacagaagaacaacaaataaacttgcatgaagaaaatggctcagacatccaaggaaggaattaacagcattagctctcaagcctggcagggcgaaagctcttaggcggcaactgcgaatgttatgagaaacaagccttaaatttatcatcattgccatataatcaagggaccaaaaaaataaaagcaaaacaaaaaaggttgttaattcaaataaatcaaatgtaatgacagatacgggctctgtagaccgatggagatgcagtcccaggttcctatcaacatgtgaaacgtaggaaaccaactctgttttggcctaatcaaagcatcaccggtcaaagccgtagctacaggtgacgtggcatcaggcccaaactatcacaaaataacagatacaaattctatattattatgagacagcttcgcataatccctcaagagacccgtttaaaatcacacacacagctgaattaaccaattgcaaatgggtactccatcccagaccaaaccacaaaggttatggtcgaaggatggacacttgcaaatgaaaaaagcagctgctgtttaaagtgtcatacggcacttcctatggtcatagaatcctcactgggactagattgcaactcataatacatgaacaaaatctagatctttatacactacaatattactggattataaagcctcaggatgccagacaaatgtcgtcatttgataatctgacggtaattccaacaatatgctaatcatcataggcttaaaatcgtagatataggaaggagaaaaaattatagaacacgcaagatttaaagaaaagaatataaaaatgatctttaaagcatcatcagaaagaaaagccttctcattcacagtgttatagcactgtgtcagaaggtgtcctaagattgttataaggtttcatcctctgatactgtaaaaaatccacataaaaccataaacgataagatctgttctgtgattggattcagatgcaaagatgtgtaacgtcacatggacgacagaagccgtcctctgatcaagtgttggattatgcatcaattacctcctcacaatccaaacagatctaagaaaaacaacagaaaaaacatagcagaacaaattgaaggaggatttcaagttactcagtggtggctttgttaattggttcgattctgccagcgagtgtcctcaatgccttcagaagagggagcttaatatcctcatcgcaatagactcctccagtgcaaagaacacgaatataaaccaataaggaatcgagaaagatagcaatttttaacagaaaaacaattaaaccagataagaaaaaagagcaaaatcagatggctcggttcagcggaaaaatcggcatacaaatcaatccctgaggagtagatccagagagaaagacctgtgatttggtctgttgagcttgaatattaccaggtcgtcactgccatcgcatcgcttgcataataaaacaacaaaacaaccgtgaaaaaaaagatcaaaacgaaacaaaataaatcgcaggatgcagaaaaaagtgcgcaagaataagcggatctggctgtggctgtggtagggagggactggagggagattagggatggcaacggggctgcccccgtcgggtttgtgcaccccgtacccatccccacagcataaaaaacagaacgttccccttccccatccccgcacagggggtagatttcccccgtccccgtccccgcagcgggtacggggcacccgccgggtctcagcacccgaaagaaacagaaaaacagcaagcaagcaacaacaggattacaggaagaagaaaacatagtaaacttactccaacaaacattaaacttaacaagttcatcacataaacttaagcagtacatcggtgcatgcatagcatcatagcagcacatcacatgcagtacataacaagctcacatgttttggagttcaacagagtacacatcacatgcgacggcggctccacacacacggcagcggcagcggcacgctactaacctacgacggcggcgcagggagcttcgaggcggcgacggcggcgcgcggcctggaggcacgtcgctgcctcgctggctccctggcgtcgcctcgcctcaccaatcggacttctattcagagaaaagagaggaatggggaattagggatcggtagatgggagaaagaaaaaacgcgatgtgttttctgtgcgcacgtggttgtgagcggcggcggagtgggggtgggacggcatcacgggattagggtttttctatatatattatctctaagtgggcctcatagttgggctgttattttttagaatggactgacaccctagggatttgctcatgggctgatatatcttgggccccatggggatacgggccggggagtggtggaacgaccccgtccccagcccacccgatggggcctaatttcaggggttaattagatccataccattaaaaatttactggttttaaaatgtcattactatttgcatatttgtaacgatgccattgctatttgtttgtaatcttaacggtgccaccgaaatacgtattttgcatatattagacgaaaatgtcctcatcttctacatctctctcttccacatcttctacccctacgccgcctgctccaccaccattgctgccgccacgtcgctcactccgctgctcctgctgcttgcgctgctcgccgcgccgtgtgccgctgctgctgccatcgcggctgctgccgccgccgggctgcgcgtgcgccgctgttgctgccgccgctcgccgctgcgctgctgttgccgccgccgggccgagccacgccactgctgcagccgggccgctaagacctgagaaggaagagaggaggaaggagaaaggggaagaaggaagaagatgggaaaaggggtattttggtctttttttttaatgtatccaagggataagaagtggtatcttttgaatatgtgtgaaattataatggtatatttccaaatacgcaaatagtaatggtatatttcaaaaccaacaaatttttaatggcatgtatccaattaaccctaatttcagccgttttctacccccgtgggggatgatttcaccccgttaactcaccctaatagaggaattctccgtcggagaccggggaacggggccccattgccatccctaagggagatgcggcgtacaacgatggggaaaagatgaggaggagatttgctgcggcgggggtggaggcagcgatgggaataacagctgcgaaggctgtggttatatatgggacgggatggatgatgaattagggtttagggttcgaggggtggagcttctggattcttcagtcgtggcggctagttgggccgtggccagtggattaggctaggccgtggcggcgggttgaagctgtagaattgggctccgacttgcgagacaacctcaggccggctgctaggatggctttctccaataagatgggagtatggcttgcaatatgtgagagatatcagaagtgtggtttcatcccacttggcatcaccttttttatgaggctataccttgcgttggccatgcccttagcccaaacaagcatccatagtggacctaacttggatggtttttgcaaagatgagaagaagatttctggtattatagtttagggatgtcaagtaaattcgaggtaaagctgagggacgacgagtggacttattccttcttgtgctgataggggatttttttttaaaaaaaaaggttaagtctgttttacaacaaccccttcaactacaaaagttcgatttacccctctcaaccacaaaaacagacaacatacacccttcaactgttgaatatggacacttaacccccttatgccctctttctattaagaaggaaccattgtgggggtagattgagctccctttcagatagggatggcaacggggcggggcgggccgggttgggctggaacaaccccgcccccaacccccgaccccgactcgagatgtagggccaaatcaggccccatccccgtccccctccggggccccgcattaggtagcgggaggctggaggggagagggagagggcgaccgggacggcgagaccagagtgcgtggttctggttcatgggactcggagtccggaggagaagggagggagcgaacgactgggaatggcgaggggatgcgtcatgcgtggtgccggtgcgctgcccctagcgtcctgccgcctccctatatgtgatatgggtgcgcgcacgggagatgagatggggagaccagagactgaagagataaggctagggtttcgtgtatatataagtattttattggattgggctcttttagaccttatatgggctacattgtgagggttaacgtacacccgcggggggcccgcgggtgaaatgtcccccgtcccctccccacctaaatgcagggccccggacccgactcccccgtgggtcaaaaaatgaacccacccccgctccctagggtctggtccctgcaggggacctggctccatggagaaattaccatttctactttaagatatgtatatggtgttattgttggcacaacggagcttcacaaacatgacgccagtgagcgaaagggcctgtagcctagtggttacaagagcctcagtagcacctgaggtcctaggttcgactccccatgggagcgaattttacaggatttaacggcgttgtgctttcagtagtaggcgatgtacccgtcgacaacgaggtgcctgtggtgactttgtcaatctctccagaatttgccggcccagtcttcgaagatgctcataggggtagggtttgcgtgcgtgtgttcatagggatgagtgcgcgtgcgttgtgagtgtttgcgttgtactgtgtaatttaaaaaaaaatgacgccagtgacagctgccagtgacgccagtaaactaagctagcccaccaaaaagctagtcgagcttcacaaacagagcttcacatatttattatgacctttttacacattaaactaaggaaatacatagcaaaacgacaaaggcaaaaacatcaagagcagtgctcaaatttagaccacatatcattgttttctgctcgctagcttaaagtagagccaaccgaggctatggatgatggatctgtttggtgcctcattttgccacactttttttttgcgaggaattttgccacacttaagttatattagtttgaccaaatgtttcttaaaagagaaaagtttgatcaaatgtggcaagtgtttgattcatttccacaactttgacaataccatactttctattttttaaatcccactgtaaactcttttttaaccaaagcttattagaagtgagatcatcaatttttgagccacaccttttgacataaaattgtggcaaattaaggatttaaggtggacatccaaagtccaaacagacccatatcctatcttactttaaagttataacccactaactcctaaagcttaaaatacaaatatgccacatcatcatccactaacaagttgacacatcatcatccactaacaatcaatgcatttagtatcatacaaacatgctatattatctataatttaaaatttattacattttagagcttttaaaatgaaagcatgttaaatcatcattccacataatttacataatatttcggaaaaagtacgaattaccccccccccgaactatcgcggtcgtccgcattacccccctaaaccacaaaaccggacattcttcacccccaactatgcaaaccggacgaattacccccctcgatccaatccgtggtggttttgatctacgtggcgtacgcgtggcagtccagtcagcattctatttataaaaaaatgtgggactcacctgttatatccttttccactcttcccctctgtaggatcgagatgtcgactggagggggggtgaataggcaatttaaaattaaatgacacctaatcaaaactaaactaagttgctaggctcggtgagggacaagactaactaagcaactaagttatgttttgcaatcctagggtgaaagtggctcaagtatatcactaggaaagtaaatcacactcatatgtcaatgtttagcaatcctagggtgatatgatctcaagtatgtctctagaaatgtaaattgcacaaatgtaaatgcgacaatcaaatgagacaatgagataagagatttttcaccgaggttcggaaacacgccggtttcctactccctgttgaggcgagcccaactctaccgctcaaccacgaagccaccgcacgcccccttcgtcaaggggtgggcaaggcgggagccggcccatggagaggactacccaagcctcgatcactcggggtagttcttccttcactccgaaggtagtgaactccaaaccactcacaaaccggcaccgggcctcctccacaatcttctcggagaggtcactaggcaactcctccacaagccgtctaggaggcggcaacctccaagagtaacaagcaatgacccggcgtggagatgatcaagtgccacactagctctacaatggaagcaaatgcacttgactcttggctaaaacaacctcaaccactacaatggatgaacactaagctcaaaggtgtgtgagagagatgcaagggattatgcaattgaattgggtgccaagaaagtccccttgctgctggagggggagtatttatactcccatcaaccaaaactagacgttgggggcggaatcccccaactcagtgctctgccgatctgaccggaggtatgtggccggtcagaccgtgctactgtgcaacggttagttttctagccgttgcagggctgacactaggccctactgccctggccggtcagaccggcctcggctcggtcagaccgccatcagctcggtctgaccgaatacggctccagcggctcgagatcggcacaccgagacggcaccatcgccatatggccggccggtcagactggcccgcacctgccggtcagaccagccttgaggcggcggtcagaccagctctgactctgcggtcagaccggctgccctggccggttagaccggcactaggtccacggtcagactggtccttgtcaggctgaactcaaacagagaaaaatgtttgtgtgtgtgtgatgaaatgagagcacaagtctaaatgcataatgacctaatgtggcaattaaaatcatctctttgctaggtcattaccccacttaatagtacggcaaggctttaaataaactagcacaattttgatcgcccaacgcctcgatcaatttaaaatgaaaacactagtttaccgtcttctcttccttttgctttgcgccgtcaattttaatccatcaatgatcatccatgtgcacacaaataagtgaacctaactcaaataaatagctcaaacacaacggttagtccacaattagtgcttgtcattaattaccaaaattaacaccgggggcctagatgcttcatcctttctctctctcttcccctctcttctctctctctgtctcactcttcccctctctctcgcgcacggtagcaggcgggggcggcggcggcggcgagcacgtacgcgaacgggtgccggaggtggcggcgaggacggcttcgtggccaagacgcacacggcagcgaggaccgcggcatgcacagcacaacggggcagggcgcgaggaggcgacgcgacggcggcgacacacaggcacgcgggcgcagagtgacagcgtgcggacggggctccaggtgacgacggcgatgggcgacgaacgatggcgcgcggcgtgggcggggctcgaggggagataacgacggcgcgcggcgcgagcgatgatgacaggcgaagcgacagcgcgtggcacgagcgacgacgataggtgtcacgcccagaaattcccgaatagaattccaagcagaatgtgcattaaaacccccgtccaggacaggccggggtacacaaacgacaaagttgacatatagatccacgtcttacaaacattataaaagtcttacataaatgcagcggaaaattaaaagataactggagctaacccttgacttggaccgcaacgggaacaccactccacaggcatcctcgacggcacgaacggagcctactcctcggagaaaccgccatctgacacgtactcaaactctggtgttttggggaaaatagagcaagcctgagtacaaccaccgtactcagcaagtcataccggaataggggtatgatgcagggtattaccaatggatagctagagaggttcttttgcataaagtgagcatttataaacagtagttgaaagcagtataaaaattgtattaattacccaatattatccatccactgtccaacgctacaccatgttgcaacaggcccaaccatccacctgaactaatcaattccattagactagactagggtgagactaatcacagtgaatctggttgaccgcccataaccgcgggcatagctattcgaatagttttactctgatcagatgtgtacaactgtacccacaagacacagccccacgacgcgttctcgtgcgccgacatgccaccacgacataccggatagaggccgtgacaggacccttcgcattaccccctctaaccaagcacaccacacctcaggtttcacccccactcctcgcaaggcagcgggcagtcccctttcgtgcctaggtgaatccggaagccgcataggccgtcgtagggcccatccaaactccatcacgcccacccttgcctggatgcgtcagctagaggaaagctacactacaagcccagccgttgcccacgctggcttgtggcaagtacgaggaattcttccagggtttcccacaaaccggtccttaagtgccatgggcgcgaccatcaaaaccatgcacccacagcccagcaattagtatattttaattgactaacaccaagacggtggctttactccaccaccaacactagaacctgaagtctaagcattaatgtgatttcccccattgtgtgctagttgaactaagcaaggctaagcaatccctagtccaatctctagtcatgttatatcccaagctaacaaaggagcatggtacaaaatagcatggctgtaacagtaggtaaacatcccgtagtaacattataaaacaatgcagtatttaagggaaaatagtagagcatttgcaatataggattaacatgttcaagtgacaagcatgacttaccttgctctgctgctggaggaacctcggcgactatttcaaagtacaccagagcgtcgggagagccggaatctaagcgacatacaaagcaaacaatacaaacaggctataagactactgaaacagaaaatgatgaactnctgtaccatcggttgtcgcacnngtgccac

SEQ ID NO: 62420 - DNA, 12188 bp, Oryza sativa
  unsure (1)..(12188): unsure at all n locations
cccacgcacgtgtcaattgccgnanactacgtgctcttctctctccccgccgaccctgttattgctgnttttctttncccctcccccccccccccccnnaaggagatgatgccatcgctggnacanancncatcaggcctcaccgacgacgattgacgacggcgagcgacggagggcgatggcgacggcgggacgagctccaggatcacctaaggaatcaaaaggggggagttagagagggagagggaaaccatggatggttagggcgccgaccgaaggcgccggccatggcgaagctcaccggcgcgcggtgcgaacggggttcccgcggcggaaaacagcggcggagaggcggacggcgtggccctcgggcttgtgaactcgacgacggcaacggcgcggctcggcgtggcggctagcggctaccagagcggcggcggcggcggcggtgaagaggagggcgacggcgctagggcgatagagggcacgagagagctcggcgaaatggagaaaaagagagagggggagagcggggatgcttaaataggggagagggggctcggacgtggctgggagcagcccgatttcaccggagtagtggggagggggagagagggcgtggccgatgggattcaaaattgaatcccggccgtttcggcgcgggcgcgggcgcgggcgggagagagagagggagtgggcgcggggtcgcggggaaagtgggcgcgggcggcgacgtgggcaacgtggcccgagaggcgcgggcgcaaggaggcggcgacggttgcgggatgcgcggcggcagctggaggttgggggaggacccgacaggtgggccccacttatcggcgaccccgggagagaggagggggctcgggcggccggcccagcggggagggggaggaggaagagaatgggccggcggcccattcggaaaaaaaaagggggaaaaagaaaaagaaaaagaaggaaatggattttcctgggattaaatattgcttgtgctcatttttaattggttgcaattagttctagagctctgaaaattgcactaaaaatcttgttagcatatttcgatatgtagaactcaagaaaaattccacatgccaattccgattattatttgcattaatttattagggtttctctcttgcttttacaccgatattttctctaggtgatttataaattcaatttaagcttgggaaagaactttagggtgtgacaaacgcgacgcgacggcacgcggtggcacggggtgcgaagaggcacgacggcggtgattgcgactgtccctcctcgagttcctccacgggatcgatgagctgccgagcaagctcgagctcctgcatgcgggatcgacgagccaccaccggcgatgccgccgccgccgtgtccttcctcgtcgacaagtcagcgaaggtcttcatcgccggccaccgcatcatggtcggctcggtggtgcaccgcaagctggactcgctggggttcaccaacatcgtggtccggactcgtgccgagctcgacctggcgtgtcttcttcgccgccgagctgccgcgctacgtgatcctggcggcggcgaacatcggcggcgtccacgccggctccgctgcaccagcggagtacctaacggagaacctccgcatcactgtcaacgtcgtggacgccgcccgccgctgcggctccgcacgcaatctgcttgtcctcgctagctcgaccatctaccccgcggatgcgccgcagccgacgcctgagtcggtgctgctcacggggccaccggcggacggaggtcgaggcctcgagcctgcggccggtgcgtgccgccgtcctcgccgccgcctgtggcccccgtccgcgtgcgtgcgcgtcagagagagaagagagagcctgctgccgtgcgcgtcaaagagagtgagatgggggaatagtggaagaggatatgacaggtgggtcccacattttttaataaatagaatgctgactgggttgccacgcgtacgtcacgtagaccaaaactaccgtggattgggtcgaggggtgtaattcgtccggtttacatagttggggggtgaagaatgtctggttttgtggttcaggggggtaattcggacgaccgtaatagtttggggtaattcgtactttttcctaataatatttcaatatatatcttcattattttttataatatcttatatacctttataatatcttatcacttggtttatgttatttctctcttctttaattaagccatatcacatcaactgattctagtgtttatgtaagtttatattgtttagctatcttatatattattttattattatcatactaaactcatgcagcaacacggggggtttcacctagtatctgtaagttttgcacaccacccacattaactccattcttaggtggtcaatgcgtatgtttcggtggtgtttggatcagcgactaagtccatgtcacatcagatatttaacactaattagaaatattaaacatagtataataataaaactaatggcataaatgagagctaattcacgagacaatttttttaagcctaattaatccataattagcacatgtttactatagcatcacataggctaattatggattaattaggctcaatagattcgtctcgcaaattagttcggagttatggaatgaattttatcaatatactacgtttaatatttttaattagtgtctaaacatatgatttgatggcaactaagggcttgttcactttgctaccattttcaaccttacgaagttttggcattgccaaatttttgttaagattgctaaaattttggcaaggttgacaaaatttggtaagatttcatatgtacttactaaaatttagcaacaaactaaatgtagctattttttttaattttttaaaaaatataaggttgaaaatggtagcaaagtgaaacagacatgcatccaaacagaccctagtggcgcgccgcctgccggtggtaggcgcgtacgtgtccctgtgcagcgcaccgcgcggcatcagaaatccactagtatcggatatttttcctctgtgcccatcagcaatttcttgaaaagaaaaaaaaactagtactcctagaaaacatcagctccactacttgctgtcttgctgccgccacgctgctcctccccgctccaccgatcggaggaactcaggcagccaccacttcctcccttccttccttgctcagctccgattttatccaacctatccatctatattttatccatccttcctccgtcaccatcagctccccgcgcgcgcgtgcatatccgcagggcgcaggcgatgctctgctcggcccgcatgctggcctgcagcggcctcggcggccccggggggcggctccggccgtcgccgcggccgggggcctacgctgaccggctgcggccgccgctgccggcgcgcaggtggcgggtcgcgtcctccgccgccgcgtcgggcggatcccccgacctgccgtcgtcgtcgtcgtcgtcctcgccgcctccgacgcctgcagcagcgtcgttcggctctggtgatgagcaggccgccggctccccggggtaaatgctttttctacgatcagtaggtgtttttttttggggggttggtcgtgggtcaatcacgctggatggctgagtgttcttgagcttgaccccccaatatacgctcagtactgtgttgaccagcatacaggggattgaggggagaaataattcgaatagatttagcatatgcttcatggttgggacgaattctctgttgatagagtttgtctgaatatggtggatcttgctgataaaaaaccgagtaccagggtagctatatatatatatgatatgcttgcctcagcttcgctgttgatggaggatgtctgaacatgccggatctagacgataaaaattcaagtagtttttgtagcctttgcttggctccttccgtgttggtgctggagtacgactgaacacgttaggtggatctagctgacaaaacgttggtcccgaactctgtcgttttggacctttagagatgataacattttggtttggtgttgtattgcacggagctcatgttgagtcatgcccggcttgttctcaggttttgtatcattgaagggcctgagacagtccaggattttgaaaagctggacttgcaggagattcaggataatattaggagccgccggaacaagatcttcttgcatatggaggaggtatgtcgactttgttttttctatgttactgtttttcattaaatggcaatagtgtaagcttggtatgatctgattatccctcacaaatagttaaaatacagaagataatgtgtagtccttgcttggtaatcagcatatgagttcaactaacgtggagatggcaatcctctgagctattacatagtacttttagattgtttacgcaatgatttcacagcttgcgccgttgttagttaatctttattctagatattgtgatattaaacaggtgtgttgcaaatcatcagagaactggaaacacccgttaatccttttgaataaatctggcacatcttctttctgcatgtactttagattgctttcagtttgttataccttctaaagttcttctgtgcagtgtcagatgtgttttgtgctgtatccttatttttctattttcgtgtacgtagattcgcaggttgagaatacaacaaagaataaagaatgttgaacttgggatctcagttgatgtgcctgaaggggaacttcctgattttccatcattcattccattcttgcctcccctggtaagtatatatacttctacatccagcaccatctcacatggttcatatttaaggagtgtatatatgctattgatattacttgttgaatttgaagttccaaatcagctcattactaatggttctcttgctttaaacagagtgcagctaatctcaaaatctactatgctacgtgtttcactttgattgctgggataatggttttcggtggatttcttgcaccaattgtaagttacactgtctagtccttgtcaccatttttatcattattgattccatcaatatccagtggatgtttaacaatttattgtacttttcttgcagctggaacttaaactcggtgtgggaggaacatcttatgcagacttcatccgcagtgtccatttgccgatgcaactgaggtattacaactattccatgttctattggtgtagtgaacatcttttaaccagttcttgataccagggaagttctgagataccgtgtgctgatccttttcatgatttttctatctgtacagtcaggtagatcctattgtggcatcgttctcaggtggagcagttggagttatctccgctctaatggttgttgagatcaacaatgtcaaacagcaggagcataagcggtgcaaatattgtttaggaactggtacttatttcttccaatgctgcttcaatcctcgtacccataaaatatgaataaatatctaagatttgcacttgctgttgtgttttggacttttggcagcgcagttcagtacttcaatgcagtacaatttgtgctttagtaaaatctctccattatgtaaagaaaaagtttagtacttcaatgtaagaatgctatactagtgttagctcagtccaaagatgctcacaagaatcaaaaaatctcagaatgaattcaaaggtctgatagcttgtaatgctgtataatgcgtctaatttgttagtgcctagttattaagcttgtttttatggacctgttaccaaaaaatctatcccctctaagaaaattttcttatagttgctcaattgctataggtttaattgtttaaactacagctttgctagggtactgacagttgtggcttgtaggatacctggcctgtgctcgctgttcaagtaccggaactctggtgcttactgaaccggtttcaacattcagcgatggtgatcagcctttatctacgccaagaacagagaggtgcccaaattgttcaggcgcaggaaaggtaaatcagccttttgcacaatgattcccaacaacaatgtcattcaaataatatacgcatatttccacttgctattttggattgaaaaacagccctgatttcaaacaaaatgtttgcaggtgatgtgtccaacatgtctctgcacggggatggcaatggcaagtgagcacgaccctcgaattgatccgtttgattaaaatgcacgtcatagttcagaaattcttgtaccactatataaactgtttgtagataatagtattgacaggcgcgcctggggttccaggcttacgaatagggcaacacttcacatcttagtgatgtgcggagcgaatcgcttgaattgaacagtggacaattcagaggtgtatgttgtcaaagctgtatcactgtatctgtatagtatgtttatggcacccaacactaacagttcaattccacgaattatttatctgcgttttgcttgcttttcaatggtcttttgtagaccttcgaatgtgttggcttggtgcacattttttatgatttagcctagctgcccatgatgctctaaatgtagttacagtttatgcgcgaccggagaaaacaagattataagccgctacttaaaaaatatgggtaaaacttttatatgctcttttcatcccgtttgagcatcacctaagattttttgtcttttcaaaatgatcagtgtctgtttatttggtgcaagtgccttcttatttatttgtgcaaagagtaaataaatgaatattattgaatacgatgcatgtaaccaattaaaattaatttatattggtgcaattccgtgcaatatttaaaatttgatgtatttcacgggacatgaagcgacgtagcactttgatcgcgagtattaatttaagaatgatgaatgttgcgttgttcacttgtatgctgtttgtttagtgatgatcaaactgggaatatttcttcagcgatctaacgatgaaaaataaactatgatttaaaagccaatgatgaaaaataagctatgatagaaaaactttaaaatcagctttaaatttcaaaattcaaattgcagtagcggctgataagccaagaagactaatcatgggagttcttcgttaacttctagttgggccgtcgaggcaacagtcgagtatccaataggaaaaagtacaccgaaggtccctgaacttgtcatcggcattaaaaaatgtcctcgaaccgcaaaatcagatatacaggttcctgaactgtacgaaaccggtcgcccgaggtctttttggtggtttttaccccggtttttgtctacgtggcagctgagtcaacatgggccccacatgtcagcgtgccacgtcaacttcccctttcccctcttctctctcccttcctcccctctctgctctctctctctctcgcaggctgggccgacgggtagggagcagacggccaggcggcgagcggggctgagcggcggcgcacacctcgcggatcctcgcttcgagcctcttgacctgcaggcaaacagtaaggagcagcagcagcaccatcagccggaactagcagggacggcgggatccgcgaggacgccggattggtggggacgcgatgccacaccgactccaccttgatggtgtcgatgccgcaggcaagctcccccacgacgcccatgaactgcgccgcccacggctcgttactcgcaatcgatctcgcctacacttcccatgttctctgcatcgatcaatctgaccttgtgactgcatgcatttctagctcccagctacctgtgtcaaacattccatttgcatgataatagcatgctagagccagataacaagaacaaattaaccgatacttgaagaactgagacaaatcatcgcgtgcaagttcaactgggcctctttaatctacccatgacaatactgtcagccagggtcaactagtgcttgggttctcctccgctcaggccccgtcgttcactgagctgctcatcactggggtggtggcgtcggcgggcggtgacgccattggcaaccgcgagcagagtccagtcttcccaatctctgctccgaaggatctgcatgctcgagctcttcagcgcacaccgcgtctagtcgctccaccacgtccgcgaggaagaggcggcgcgcctcgtccgcgtcgtcgccaacaagtgtgccatgggtggcgtcggcgtccttcttatactgccgctgcataatgtcaccgctggggccatcagttgcaggaggaggcggcgtcttctccagctccttcgcggccggggaacccatcgccttctctggctccgccatggtgttgcgtaccgtgaggccataggcgatttgggaggaggggttgtcgggggcggtggatgtgtcgagaacgaaggaggggtcgccggcggcggatgcggcttctccgccatcccgcccgccacctcaccgcaccgcggctgctactcccgcgcccgccgccgttcctgctccctcctcttctccacggccgacgacctcctcagcctcctcgacaacgacaacgatgccaacccgttccccgccgacgaccccggccgcacgcgccctagcgccggcatcccgatgccctgcgagagcagagagcgagagggagggaggaagcagagaaacagagaaagagaagaggggaaaggggaagttgacgcggcaagttgacatgtggggctcacgtggatctcatgctgactcagccgtataccaaaaccgaagtcaaaaccaataaaagatctcgggtgatcggttttgtatagttaagggacgcatatctagttttgtggttcggggacgtttttctatcccgataacaagttcagggacctttggtgtactttttccgtatccaataagaaccagcccaccaacgccaagtatccatgcccactcatcttcttcctccaggctcccgcagcctttcgcaccagcgcagcgcgcctcctcgccgcccccggccaccctgcgccgccggccgccgcccgccggcgccatactaagagggaagagtgggtaactgagttccgacggccggaggcggggccagcggtggatccgattggccccttctggcctctgactcgatccggttgagatagtggtgaggcgatggatgcgctcgtggcgaactacgcgtccgactccgactccgacggcgatgctccggcggctaccgcgggcgaagccgccccggtgcctccggaaccttccgcgttgctccctcccccgcccctcgacctcctccagcccccaaacttcgtaggcatgattgatacttctttaccgtactgagcctttcctcaattcttattctgaggccccccggtgatgtgttcttactgaagttttgcagattgctcgacaatggcgcaggggagtcgcgtccggagcttcccacatgtggaaggcaactatgcgctacatgtttacatccctggtctgttttctctctttcttttctcttgatctttctatatctgtttgtgcttaggtgaatgtaaattattggtcgtttatcgctggttgcatgttaccgcaaggttagttgcttttccatgtgaataggcatgcttatattgcttaacaccacgatcagatgtgtaggagtaggatctattgcctagccctacctatctggtttcatgggttttccttaggaaacaggatgcattctgaggacattactgcatgtttgcacagtacatatactgatataccgaaataagcatgcaccttgccaacattaagcgacgaagggcactttctatatgttgctgttgctgaactgatttttcagcatgttcatcatcctaagttgtagaattagtaacatagcaaaattttagtaacatcattttcccttattctgtcatttatatagtgtaagggggaaatgccgttgattcagttcagtatcatggtttctttttttattgtattgaattgaacagaaaacgggtagaaggattcactttctcactgttggacatgtaaaattttacgtcctgaaaggcccttgctcttacatatagatctctctcgtgcagttgtcataccttctgatgcaaagaaacacctggtccttgttatgagaagagccgcgtcttttgtgccggatctctatgccatcgatgcagattatgcactttccgagttgtgcaaggatgaacaaaagcttgagaaagtgcttctgagcagggagtttcatgtaagtttaggaagaactgttgcaattcaggtgcatcaaattgagtcccttgtcgcaatgcttcggcaaaagttccgctcacagcaacggttagtcatctcttatacctttattgctgagttcttactatttaactcctttcagtggacagactatgtgtacttgtctacagattatacttgctttatgtacctatttgggtataataattttttgcactgatagaattgactatatattaatcaggtattggatggacttcaacaaatgggagcattttgtcaatgatgattgtacacggtcatttctttcgctagaagttacaagtactgggttgccagaggtgcttaatactatctacctagtgtcctagcatctttaggcattgtatggatctttttactaagtctgataataaaaataccatataatatatgttcttatatgtcattaatgaaatgcactattaacttactgtttgttaaacttttgcagattagtaaacagataacgatggtagatgatgtatatcgattacatgggcttcctgaattctataaggtaatatattctttagcaatgtttgtgctggtgttctgcatattttacttgatgggtaccacatcacacatattttatggtttaatttcaaaacatgcgagcaacataattgcaacctaaaacagaaatctaatacactgctgcaatataaggggagggcggtagtgtactataattttgtttggtttggaacatctgtctgacagaatcagtcactggctgattagaatgattatagtgtcccacccagagtatcactaattcattatcatctgtagcatcaccacatttgtgcaaaattatttaactagtgtcttgaacttatggcagaatccacggccacatatatcactggcgtgggcattgggtgatgttagctgcaaactgaaacaagcaattaaggagatcgaaaaatctcagagcagtctgggcacatctcaaatatctaatctgagatgcaagtttagtcatgtagtgtgtaaaataggcaagaaggtgtatgatatctgtaaacttgcagactgagagataaatttcttgtgcacttgaccgttgagttctggggttgcaacagagatatacaaatgagcatgaaaacagagtggaagtaacttggaaaaactacaatattattcatttggttgagagttaaaacttcttgccagcatgcttctgatcaatggttgtatatcttttgatgtacagcaagatagtgtgcaggctttccattccaagaaaggaatgatggccaaaatgatcacaaattcacaatgattaaatgactgcatgaggtaaaacaaaatctagaacaaaaaggaagtctctctaagagcaactttaatagtatagcccactactagctccaattcatctatagccaatctaatagccagttcatacaatagtcgtcccccctgtactattaacacacggccccactctttcatatgcacatttcatcttgttctccgccctttctctccttccccactctatcgccgcacctcattctcatcactcttacccattctcacgtctttatcctacctacccctccccccctcgctactcactcgggcctcccatgtcttctacacaaccctccctcgaccccgctacccccattcattccccccttctccccccttcttcctacgacactcccatctaatccctccttctcgcgttatcgactacccttcctactactcgtactcccgactacctgcaattaatagtcactgcgtttatacttcaacggaagcccacactcccaaatctggggatcaacccaacactcctatctcccaagcctttttcttaccgcccctcattccaccccccccccaagcatttcctctatcacacctccctccactaactcg

SEQ ID NO: 62421 - DNA, 22479 bp, Oryza sativa
  unsure (1)..(22479): unsure at all n locations
cccttgtttagattcaaactttggccgagtttagttctaaactttttcttcaaacttccaacttttccatcacatcaaaactttcctacacacataaacttccaacttttccgtcacatcgttccaatttcaaccaaacttccaattttggcgtgaactaaatacacatttttcttcaaactttcaacttttccgtcacatcaaatgtttagatacatgtatggagtattaaatgtggacaaaaaaaaaccaattgcagagtctgtatgtgaatcacgagacgaatcttttgagcctaattacgccataatttgacaatgtggtgctatagtaaacatttgctaatgacagattaattaggcttaatagattcgtctcgcattttacaggtgaaatctgtaatttgttttgttattagtctacgttttcaaatgtgtgtccgtatactttaaaaaattttggcacacgaactaaacacgccacaggccgtgtttagattcaaacttttttccttcaagcttccaacttttcagcacataaaatgtttggacacatgcatggagcattaaatgtggaccaaaaaaacaattgcaagtttgcatgtaaatcacgagacgaatcttttgagcctaattacaccatgatttggtaatgtggtgctacagtaaacatttgccaatgacggattaattaggcttaatagattcgtctcacagtttacccgtggaatctgtaatttgttttgttattagtctatgtttaatacatcaaatgtgtgtccgtatacttaaaaaaattttagcacaaaaactaaacacagcccttataggaaagttagatgtgatgaaaaagcaaaaagtttaaagaaaaaaattggattctaaacaggcccaaaccaaatatcctaccatgaacacagcgtcaaattttgaaaagggaggaaagttaatatgcaacttttgcatggctgcatgtcaaacccgtaacagtccccttccttatttaaaataaaagagaaaaaagaaaaagaaaatgtgaataaatctgcaacgttcacctgtggagtccgatccaatccaagccgtaaatacgaacgagtcttccatcggaaggaaacccgccagagagagagagagagagagagagagagcgcaacggcctcctcgcaccaaatccgccgtctctgcggctcctctccttctcctcctgcaatccaaccgccctcaaaaatacttgcaacccccactcatcgtctcccctccccgtctccacgccatgtcgtcgtcgtggttccactcctcctcctcctcctcctcctgctacttcacccaccaccaccaccgccacgtcgtccaccacgcgtcgacctacttcgacggcgacgacgacgagggcgacgtcaagccggcggtgacgcagcactggcgttacgacgcccgcgctgcggcctcctacggcggcggcgaggatgtgaagccggcggtggtggtgaagcagccgccgctgcctcgcccgagagtgggaaggggtgtccacgaccgcgcggaggagaccacggcgctctcgtggccggtggtggagcccttcaggtccacgctccgcacgcaggagtcgctcgccgggatccgcgccaggtacagcgtccccgaggggttcggcctgcaccccgccggggccaaccagaccgcgtgcgcgccgcctccggtgactccgcgtggcgggcgcgggggtggcgcggcggcggcggcggtgccgatctgcgtgtacgcgcaggcgttcgcggcggggatgcgcctgccgctgcacccgttcgtcagcgacgcgctggcccacttcggcatcgcgccgtcgcagctggcgcccaacgggtggcgcgtcctggccgggttcgccgtgctctgccacttccgcggcgtcggcgcgccgtcgctcccggtgttccgccacttcttcaccctggcgccgctgcccaaggggaaggggtggtactccttccgcgccagggagagcgtccccgcgctgttcacgggcctcccgtcctccgtcaaggcgtggaaggaggagttcctcttcgtctcgccgccgcccgccgcgccgtggcgctgccccgtgcgctggggaaccccgtccaaggaggccacgagcgacccggcgctcaccgagagggaggccgccgtggcgcggcggctcacgcagggccaaggcgtcgtcgacctcaagacctacctctcggagagcaacctcgtcgccgccaagatcagcagcgccccggcatgtctgggaggtacggacggacgatcaaatgccaccaacaaaacgtacatcggatggtgcagattcctcaattgctcgattgttttcttctttcttgcttccagggacggaagcttcacggggttcgtcggtggcggccgggaagaagaggaaggtgctgggcgatggcgtcagcaccggcggtggcgtgcttcggtcagagctgcaggcgaaggacaaggctctggccaaggcgcagggagagatcagccgcctgaaggcgcagctggggagcgccaaggcgagggagctggaggaggcgaggcaggcgttggagtacgagcggaagctggggacgcaggtgctcaagtctgatggcgccgccgccggggccagcaagcgtcgccgtggcggccagtgatccacgttccgccgctgaacgccgccggccagcgattcggtgatgtgctaggtatttactagtactactactacttgccaggataatgagtagctttgcggagtagtgttttagcaaggacctttcatgtttcttcataatcagcatcagctgtgacagacagtgctgatcttggttggtatcatttcgcaacaaactgctaatggaaaatctgttcacagacaccaggtgatgttatgaatcgcaatctgcttagtttatctaccatgttaattagcagcagaaattgctagctactggaatgatcatgggtatgagggtatcccactagttgagcgaaatgaactaaatacatagataatatgcatcagaaagaacacattttatagctgatcttgtaaaacaagagcaaggtcaagttgggtaaccacaagtgaaccgcgcccatactatcgccaaatatccctgcaatctgccatcttccatgaacacaacacgagcatcaggcttctaaaagatggtattttcacagcaaagggtcattataatgttattccacaagtacaagggtagattctgccaaaaatattcatccagttgcaatcagaaagtgtccccaaaaaaactgcttgctaccttttttctttgtacatgttcagccgaaatgttactacagtaattgcaattcaattggtccatatttgcgctatacaatgacactacagctcaagatgagaaaactaaatgcccacaaagattatccaattgtatgtactccaagatttggctagtgcatttgcacggtccactccagctaccctttactcttatcattgctagttgattcgttgtcacttgttgaatctgtggagctattagatgatgccattgtgttggactgctcactgattttctctgcagcgctgctggaattgtcatcgcccatgatagaagcaaaagtgagctggagaccatagagtactaatccaattgagttgattccaaacacaaatgttgctaggtagcatatcccatttataattgttctgcagagaaaacgtggttcattcattagataaaaggattacaatatataacaaacaagagaacagtgaatgaatggagttgtaccttattgttattgttatttgacgaacctgcagaaaacaaaaggaggattccattagatgaattgtgctagttacaaaaaatatgacgaagactgaaattcagttcctctgtaagtatatggaaagttggtagcacgaaatagcacattttacggtgcataaatgtgttaaccgacccacgggaggacaacaagaaataatttttgttgcagctctcttagtatttgttccctgcatcattgttgaatttgtatgtgttggtaaaacacaacaataatttgcattttccatgccttattctccatttgtgaaataatattgaaatgggattcaattccttgctgtaaacttcaaggcacattggcgacaaaaaaatggatggtgattacagcagacaattactcaaagcattgcatagcagtagcgctaacttctactagaccattaacgaaggataacaagaaaatggcaggtaataatacaaatgaagcaaacttcaagttggaaaattcatttgaaaccaaaaaaatgtcaaaaacagcataaggtagaggggttcaaattgctcaaaactaatctgcaatccttacaagaatatagaattattcccacaaaataagtgttaccacactgaattatggtccacactccacacttcatcagagctgctacgaaaattgaagtgtcgacctagggctgtgttttgttcaccacaccaaaattggaagtttggttgaaattggaatgatgtgatggaaaagttggaagtttatgtgtgtagaaaagttttgatgtgatggaaaagttggaagttcgaagaattattttggaactaaacacggcctagataacatagccgcacaagtttcatcggcaaacttggcctgcaataaactatttttgttgaagtctttatcacttacactttcagcctttgaccagaaaactgcatagctctaacacaacttcacttgtgccgtgtttagttgttttggcaaaaaaatttgacgcatacggacacacatttgaagtattaaacgtagactaataaaaaacaaattacagattctgcctgtaaactacgagacgaatctattaagcctaattaatccatcattagcaaatgtttactgtagcgccacattgtcaaatcatggcgtaattaggctcataagattcgtcttgcaatttacatgcaagctgtgtttttttgtccacatttaatgttccatgcatgtgtccaaacatttgatgtgacgaaaaagttgaaagtttgaagggaactaaacacagccttaatggtttatgtaaaccagcattcattgtccactatgatatattgaattatcatccatgtggttagttcacaacctttattaaattgtccacgactccataaaatttatttgtagctattcacataggttcaatggcgcatagacatggcaaactagttccaaacaatggcgtatatacaattatacatttatttgtcggaacaacaaaaggattaaccgataaagtgaagtctgacaaaaatcaaagcaacacagatacttgtcatcacagacacaatcggacacatacagcacagcctcaagatccctgttactcatgctagatttcctccaaaacttatatgaatttggcaattccaatggaagttcaaagggttcggtcctttgttccaaaggagaacataggcaaatcttcctaaaaggatattcatattctaaaaaatttctcaaagaaaccttagtttgaaaggagccctaaacagcctaaatcaatttaatgtgctgtaaaaaaaacatgtatattgttgcaacaagaaaaatactaaaatattgtggagggggaagagagctgaccgagaagctgtcggagatggtctggcggttgagcgcggcctcgatggtggtggtgaacttgtagaggatgagcgcgatgacccccgcggcgatcccgccgagcagcgcctgcacgggcgacggcggcttgtcgacctcgatcggcgacgcgctcaccagcctcagcccctccagggcctccttgctcaggttgttgggcttctccaccccgccggaccgaaccctctgtgtcacggaagcaaaaaggatttttagaccatttttctccagtcgagaaagcgcagcgcaggtggatgaggagggaggggattacgagctccttggcgcggcggacgcggcggcggatggagcggaagaggaagacggagatggcgccggtgaggaggacgctggtggcggtctgcagcggggtggggttctcgtcgatggagaagagcgtcggggtgcggagctccacggggccatctccctcgccgtcgtcgcccgggggaggctcggctgccgaggtggacagctccggctcggcgcggacggcgacggagcggcggaggcggagggcggaggcggaggcggcggggaggaggtcgcgggacggggggaggaggaggcggtggcggaggaggaggcgcggagaggagtggagcagcagcatggtgggagtggagagctgcttggcggtgctcggggagagagttcagtggataacgaacgggtcgggcgagaaagggtgtgatgaattattttcatttctaaatttttattttttaatatttacagaaatattataccatttaaaatatttacagaaatggcccccctgccgccaaagtggagagcggcaaggtgtgcacatttttcattgaggtctcttgccgccctcgtacaaggggctaaatgcaattttcgccatgttaaaaatgcattttgctaatttttcttttgcatctcggctgtctctcacgtcaccctgggtctatttttgtaaatatttttgccggtataatatttctgtaaatattaaaaataaaaatttaaaaatgaaaaaaattcaggtgtgatcggtagatgggctactttgatggaccgaggccttctccatcgtttcttggtggtggcctggtgtgcgtacggtgggggtgggtgctaagggacggggaactgacggaaagttggagaaataagtttatattgactccctcaactcatgcccctcattgaatcgcatccctcaacagtaaaatcgggtataacccattgcaaatcgactccccgagcagtttcgaaggtggttttatcccacgtggcatctttgcctccgagcaacgaggtaaggaataaaactgcagacgcagttgaacggtggtcaggctagctcctgcaacaaattggtattacaatgtcctaaccactttcatttcgtaccaaggaatctaattaaatattataaaatctatgtgcaaccttacaaactatagtccaaattggtggaagaagccttatgattctattttctccgtttcataatgtaagtctttctagcattgtacatattcatatagatatcaataaatctagacatatatgtgtgtctagattcattaacatctatatgaatatgggtaatgctagaaaatcttacattatgaaacggatggagtatctctcaagcagattgctagggtggacatctagtcaaactatagtgaggataggctcaaagtttaagtctaagagcctgttcactttgatttgatgttattttcaaccttaccaagttttggtaaagttgctaaaaaattggctacatttagtttactgtcaaatttttaaattttggtaattatataagaaatgctgtcaaaattttgacaagttgtcaaaatttcggcaactatgccaaagtgaacaggccctaagtcaataaaagcaaagtaaagtacgtacctttacctacatcgaattcaatgttaacataatcaaatagaaaagaaaacggaggagtgcattgccaacataaaagtgcattcttgattagcaagatactagagaaaaatacagaatcctcattggttagcacaaggccattagctaattagcacaaggttattagctaaggagcgaacgagatgagcagagtagcaataatagactagaaccagttgacttgcccatgccagtgacttgcgcctgcattctgctggtagcctaatgcctcgggcactctcccctgtgtggtcgcatcgccacctcacaccatctgcctcgtagatttcaggcatatagcctccatcccaaccctagcccccaaataccaaatgaatgaggggggttcctgttacacgcttaagcgctagcatcagaggcagcgcgcactttcacggccctaagagcgcttagcgctgttttttttttataagaatgcgtatgtttcttccctttgtttaattaactgaaacaaactttcaactttgatttattcaagatttggaaacttttcaactaatatttgaaaactttcaagtctagatttgaacttagatttcaaaattttcaagccaagattttaatactttcaacttaaatctaaaagttttcaactcttattttaaaactttcaaatctttatttgaaaaatttcaagtcaatatttgaaaactttaaactcaaatttaaaaactttcaactaaagatttgaaaacttttaactcagatttaaaaactttcatctcagattcaaaaacattcaactcaaatttgaacactttcatctaaaaacttaaaaacattcttctcaaatcttaaaaactttcaactatttaagttaagatttgaaaactttcaactctgatttaaaaactttcatctaaggttcaaaaacattcaactcaaatttgaaaactttcatctcaaaacttaaaaactttcaactcaaattttaaaaactttcaactcaaattcaaaactttcagcagcaattaaagatgaaagattcaatttctaaaataaaaagatcacaaaaaaaatcggcaaaaaaacatttcacggcgcggcggaaaaaaaaagaagcgagaaaaaaaggaaaaaaaaggaagagatgggacgcgcgtgggggtgggccagaaactcgcgccgcttgtgctaatagcgcatacgcgctaattagcaatttcgaagaatgaggcctggtttagttggggaaaaaaattttgggtttggttgtcacatcggatatacggaaacatatttgaagtattaaacatagtctaataacaaaacaaattacagactccgccagaaaactgcgggacgaatttattaagcctaattaatccgtcattagcaaatgtttactgtagaaccacattgtcaaatcatggcgcaattaggcttaaaagatttgtctcgcattttacatacaatctatgtaattgtttttttcctacatttaatactccatatatgtatccaaacattcgatgtgatagcgtgaaaatttttgttttgggaacaaaacaaggccgaatcacgcctcgctgctacctctaacctcctacccccttcagttcctaatttgttgacgttttagacaggattacacataccaatgagtgattaattagtgttcctacttcctgttttacccctaacaaatacggtttcgaggtacaccaaaccacaacctgctcttggtttgagtggccatcgcatgcaaaactaaagctactagtcctaagttcgattcttggtgtccacttatttttgcactcatgcacaacgccggcagcgtcaaccacaacggcggcgccgtccacctgttgtgcgagcttcaccaccatggcgccagcgtcgacctactccacggcagcggtggcgtcctgcacgacctgctccatggcgaaaagtagtgcaaggaggcgaatagaaggcagcgccccgcgcagcatgcatgacgttggaaataatgggagtaatggccggctgcatgcatgcagggcaagcaggtccaagatgcaaaaaaaaaaaaaaaaagctaaaacgtcaagaaatatcacacaatacaatggttcaagagctaaaacgccaacaaatttcaaaccggagagagtagtccaaaagtacccaagtgacctatgggcccgcactatgtaacgccaaatcaaccaatttgaccgagcgcgtaccactttatcttctccctaatacagatcatcctcttcatcttcttcgataagcccaatatagatagaaagctctcatgaatctcaaaattaggatatacgggtctacctgctggcttcatccctgcttatttgtaataaataaatacgaaaacggttcttctcattttcctcggtaattttcattttcatttttcaatgggcatagcatctaaagtattaaaacctccccccgctgctcgctcgtccgagttttgcgctggcgtggatgctgccggagcacggcacgtcagcgcgcgtgggacggcgagtagatttcacggcctctcgtgagtccgcgatgattctgtgaactttgcagaaaagccctctccgttatagctattttgatatatgtcctcgccgtacttgttcctgtttaaatatattacgtttagacccttctatttctacgaaatctaatacgaacgtgacaaaaatgagaaaaaaggaccgcgccctgaatcgtggaaactgaggggtcttttcgtagaatttccttttcttacacgccatctctccccctccggaaacccccagccgcgtcaaaaaagaaaacgaaaaagaaaacgaaaaaactcccggccgctagggttccatcgccgcactcatctctctcgctctctcttgcgcgatgcgtcgcgccgcctagatctcacggagccgtggccgccgcccactcttctcccgttcaatacgcttacatttaagaatttaccacttaattcgtaagccattaagattttaccactaggatagcgaatttcttcatttcataccactcccgtcaaatttacagctcatccatctccttcgttcacactagtgtagggcgccaccgtcaccatcgccgggccctcccttgccaccatggcgcgtttctttcgccttcgtttgtcatccccgccatcgtgctcgaaggccggagctgcactccatgccattgcgctcgggtgagcataccagcgagtgatgatggcggtggccaagttcgagtactgcacgggtgcaacgacaatggcgtggtcggggatggcttcacgccgctgcatctcccctcctcctcgctcctctcccctctctcctctagcacgtgtgggtcctaccacttgagacgaagaactcatagccaaaacttgcttcgcgttcttgaggaggccatgtggatggatgacgtggcaacgaatatttggtttggggaggaggctgaacgccacatcggcgcaatgtgaatgccctaagggtgttcttagcttttcatgtcagcttttgccatcttctatttttgtcctcacatgtttttaaactacataacgtataaaatttagcactaaacaccctaaaattcagaaacaaggatacaatttctccccttccatcattctctctattccccaactaccacaactcaacagcggctggcagcacagcgagctccaacagaggacagcggctccccaacctcctcccaaacagcggctcgaagggcgacagcggcggcgcgagagctcgctgggacccctcctctcctggccggcaacgagcgctcagcgagcgacggcagcagcgtgggagctcgccggggcccctcctctcctggttggcaacgagggctcggagggcaacggcatcaacgtgagagcttccggggcccctccattcccggccagcgacgagggctcagaggacgacggtggcagcgaggatccgaagcggcgtgagagctcgtcggtgccctccacttcctgccggtgatgaggagacagagcgccgagggtgacagtggcggcgcagatccagagcgacagtgactccgacggtggagagagaggtttgtttcgatggtggggaggtggggatgatggtctacagcctggattccatgcttttatctgctttttccgttgagcttctcgtgtctcaagttaggatgtgtttagttccaggggtgtaacgtttttgaagtatacggacacacatttgaagtattaaacgtagactaataacaaaacaaattacagattccgcatgtacattgcgagacgaatttattaagcctaattaatccgtcattagccaatgtttattgtagcatcacattatcaaatcatgtcgcaattaggctcaaaagattcgtctcgtaatttacatgcaaactgtgtaattggttttctttttccacatttaatgcgccgtgcatgtgtccaaacatccgatgtgacgttttggcccaaaatttttgggatctcaacaaggcctagtcccgtattcctcacaaagaaatggtccccactgccacattagcagctgtcctacgtggcgagctgtgccaactcgccacattcctgcactgtgaagggacaacatcacaaaagtcagtcaacttgagaatcatatgaatcattgaatatggtgacagccaaaaatatcatcttgacttgtctagatctgtaggtagcagagagagtagcagatagcctgtgaaagagagcaattgcagagggaggcttgcagctaagaactagtccccatggagcatggcggaatcgctgcttctccccgtggtgtgcggggtgatcggcaaggcgaccgacgtgcttgtccagaaagtcacccgcatgtatggcgtcgacggcgaccgccctaagctagagcggcagctgctggcggacgccgagttgaagagcgagaccaaccccgccatcaagcgttggatgaaagacctcaacgccgccgccgacgaggccgatgacatgctcaacgagttccagtacgaggcgctgcgccgcgaggccatgagcctcgagtcactgggacacaaggtacgaagctgcatgaccccactcgagttccgttttaccatgagcaggaagcttgccaaagtgctcaagaacatcaacgagctggttgaagagatgaacatgtttggcctgttgctgcaagatgagccagtacatcaacttccttactggcagacgtactcagtgctgccatcaaatgaattagatgatatctttggcagagacgacgacaaggaggcggtggtgatcaaactgttgctcgatcagcgagatcagcacaagtgggagaacctcccatcgtggggatgggtggtttaagcaagacaacgctcgccaagatggtctacaatgactacagggttcagaatcacttcgagctaaagatgtggcactgtgtgtcagacaactttgaagttgtttcccttctgaaatccatcattgaattggctacaaataaagcatgccaactgcttgacaacgtcgagttgttgtgaaagaccaagaacagctatagaggggggggtgaatatagcaattcaaatcttgcccccgaaaatactcatcaagccggatttctcaaaatccttactagaatcgcggctattagagaagccggatctagaaaagaagagagaaaaagaagagagaaggaattcccgaaactagaggaggaagagaaaaggaattcccgaaactagaagagaggtgagaaagagagagcaaaactcatcatcgcaaagttcaaattgcaagcggaatttaaattgcggaatttaaatggacaaggcaaaaatgaaatccttcaaatcatttcatttataggtgatgcaaaataaccgctcaactaggagcaaacatacaccttcagaggaacattaacacaaacttaaaatctctcggacaaacacactccaaactaatcctaatacaaaagcctctcgggcaaacacactccaaactcacatggaaactctctcaccgagcatctcaaaatgattaccaaaaggagcaacctccacccttgcatccatctctctatttatagcctaagacccctaagacattgtctcaaatacccctagggcgaaaccctaactcagaacagatctggtccatccattgttccttctactcaaaggaaaagctccagatgattgccacctcatcgatccgaaccttcacatggtcttcttgctgatgaatccgcgtgctctccgtcttgacgaatccaaacttgccacgttgcctagccgcgtcgtgcgcgttccgtctccttttcctcagcgcgcgctcgccagcgcccaaccagcccgaagccgccacgcgtcccgctgagccgctcccgcgcgcgcttgcaaaatcgcgtgtgggtcccgcgctcctgcacccgcctccgatcgagtcacgcgaaacggaggttgccgcgtacggttttcccgcgcgcgtccttgcgcatgcaagctgcctgcacctcctgagcccatgcgccatgggccgccgtcttgggccgtcgctgcttggacgatgcaggcctgccgagccgagccattcaccatcttgggccacgtggaacggctagattggcttggcctccctgccaaccaatcacagcgcacatgcacagctagctagcttgacttttccaccgagccatgctagtagcaaccagtacaatgcaagctcctccttgcacaagtacagtacgtgtacatgcatgtatgctacctacagcaagtactgtagcagcaatgcacttgcacagtcccttctgatttcttcgcgaatccgatgcttgcacacttgaccttgtgaagcctgttgcaaagacctcctcacacggtgttcgtccaccgtgtgcaaccttgtgtccaatcttgtcacccggcatccttgatcgctttggacctcaactcctccctgagtctagtcccgatccgccgttgaccaagatcgaccccgatcacctgcacacacatgaaccaaacaaccgttgtcttggcacagatgtcgcaacctgaccaacgttagtccacacacacacttcttgcacatccggtacttgtcaatttcccatcacaaaagaactataaccacacatggtttcacatccggtacttgtcaatttcccatcacaaaagaactataaccacacatggtttcacaatctcccccttgatgggaacattgacaatctcaagcaaaattttgaaaatttgatttttgattcacaaagcaaaccattttgcaaaagcgaactttggtcattttgaaatcgcgaaaaatcaagaccaagtgacaagaagaaaaagggatgcaaatgcaaaactccccctatgtgccaaactccccctttcaccaagatttaaagcaagttttaattttcaataagtgcaaatttctctccccctttgtcaatgatgctatcaagatcaaaagagacaaaaatgcaagataaaaatgagatgaaacttgcaaattttaggttttgagagctttgagagttatctaaaggcatcaaaaggtagacatggatcacacagatacaagcatgtgctcaagcctagctaagcatgtgcataagaagtatgaaacaagtcatgaatatcaagttagtatcgccagcaagcaaaaagctttcaagtgaattagtgatttagtgtgcaaagctatttctagaagaagcttaaaaggaagcaaaccagctcataatcatgcaagatttacataatcaaagcaatgaacccatgctaatgtgctaatgcccagttcataaagagtatcaacatgataacaaagcatagaacatgagcttttaatcttttctcatgacttttatttttatgattttttttaatttctttaaagacaatagcacaatcacgacggtccacctgatcttatcagtcagcaagtgatggttgtgccaaacactgccgtctgacctcaatcaagttttccagctagagttcccattacaggctgtctcagtgctatcttcggcactactcatgcgtaaacgcactcagtagcccggacaaaacagagataaatcttgtaaagcatgattgatacaaagtatggacgcataagcatgagcattcataagcatgtactgacagttattgcgaaaagaatgtaaacatggcatgagtatgagatggatacttcaatttaaacaaacttctagagcaagcattgcacattgattgagttcaaatgaatagttaatttaagcaggtttcaacacgcttgaacagcataacatgatcacacaagctacttaagcaaatgaaagctagacaagagatcaaactagcataagagtgatacatccatagcatagtgatgaccaagagataacaagcaaagctcaattgaagagtgtataatacaatgcataaagtaaacatgatgcaatatgttacaaatgcatgcaaaagaaaaacaactccccctcaaatcaagccataggggtggatcactcctaactcactccgcaagaactcaaaacgagagcgatcaagtggttttgtaaaaatgtctgccaattgtttttcagattcaacaaattctagcacaatggtacctttctcaacattgtctcggagaaagtggtaccgtatctcaatgtgcttggtcctggagtgttgaactggattttttgcaatattgattgcacttgtattatcacaaagcagaggaacaccagagaaagacagaccataatctttcagagttgaaatcatccaaagaacttgactacaagcactagcagcagctacgtactcagcctcagctgttgattgagcaacagaagactgcttacgagaggaccaagagaccaaagaagtgccaagaaaatgacaagtgctagaagtacttttgcgatcaatcttacacccagcaaaatcagcatctgaaaaagctcgaactgaaagggcagaagagcaggagtaccaaataccgtactcaagtgtagacttgatgtagcggaagatgcgcttgactgcttggcgatgtgatgttcttggagaagcctgaaacctcgcgcacaggcacacggagaagtggatgtccggccttgacgcagtcaagtagaggagggagccgatcatgcttctgtactcgcgctggtcaacttcttcatcgtcctcatcaggaccaagcgatgaagtagttgccatgggagtagcgattggcttgcagtcggccatgtcgaacttcttcaggagctctttggagtacttggtctgatgtacaaagattccttccttggtttgcttgatttgaagtccaaggaagaaagtcagctctcccatcatgctcatttcaaattccctgctcatcacatcagaaaactgggcaacaagtgcatgagaggagccaccaaatatgatgtcatcaacatatatctggacaagaagaaaatcaataccactatgaagagtaaaaagagttttatcaacagcccccatttcaaaaccattttgaagcaaaaaggttttcaatctttcataccaggctctgggagcttgttttaaaccataaagagctttttcaagtttgaacacatgatttgaaaattttggattttcaaaaccaggaggttgtttgacatagacctcttcctcaataactccattcagaaaagcacttttcacatccatttgaaaaagcttgaaaccttttgaagcagcaaaagccaaaagaattcgaatagcttctaatctagcaactggtgcaaaagtttcttcaaagtccaagccctcaacttgggtgaaaccctgtgcaaccagtctggctttgtttcgaacaattgaaccatcttcacctagtttgtttttgaaaacccattttgttccaatcacattaaaacccaagggaggttctaccaaagaccaaactttgtttctttcaaaattttctaactcttcatgcatggcattaacccaattctcatcagataaagcatgacaaacatttttgggctcaaaagaggcaacaaaagctgaattgacaagttcataagaccgatttctagttaccctttcacccaggcctccgatcatcgagtcaggcggatgtcggttctggatgtgtcggggagctgtcggtcctaatgtgccaccatcaatctcctcagctgctgaagatgatgtagttggtgcatctcctgaaggtgatgtagtcgaaggagaaccggtttcttgcactggtggtgtactgtctagaggtggaggaatagaatcatcatcatcatcatctgaatccacatccacaaagatgctttcatctggaacacctgaaatttctggtctagctcctgggctagcctcatcaaaagtgacttcacaagtctccacaattttgttagttgaaagaacataaactcgataagcccgagaatgagtagcatagccaaggaaaatgccatccaatgatcgagattcaaacttgtccaaatttccagatttaagaacaaagcatttgcaaccgaagaccctgagatgtgaaacttttggtcgacgaccaaatctgagctcatatggcgtcttgtgcaagatagttctcaaaaacacacgattggagataaaacaagcagcagaaatagcttcagtccagaattttcttggagtcgtaaactcatcaagcatagttcgtgccatctccacaagggtgcggttcttcctctcaaccaccccattctgttgtgggacatatggcgaagaaaactggtgttcaactccagaagaatcacagaaagattcaaatgcagaatttttgaattcagagccattatcactgcgaatggctcgaagagcaccaggaaactccaaagccaaactacgagcaagagactgaaagaagccaaatgtttcctcctttgattcaagaaaatagacccaagagtagcgagagaaatcatccacaacaaccaagacataccacttccccccaactgactggacccgagcaggaccaaccgtatccatgtgaagcagttgtcccggtccatctgtcataaccattgtaacaggcttgtgggaggaagatgtcattttcccatgacgacatggtgcacacacaagatctttcggaactttcaacttaggcaaaccccgaatcaaatccataccactaatgcgagacaagtggtcaaagccaatatgaccaagacgtcgatgccagaaaaacaaatccctattctctgtggcaatgagacaacgagaaggaccaggagcagaagagtcgaagttagcaaagaaaactcgaccaactcgagaaatgtcaaaaacaggagattcagaagcatcaagaactcgagacctgtcctttttgaaacgaacttccagattttcatcacagagttgtgaaacagagagcaaattgtacttaagcttacttactagtgccacatctttcagcatgaatttgtcattgaccttgattgttcctttagccatcatgcgtccactgctcgcatccccaaaagtgatggtctcatcaccggatgcacgagtgagagaagtaaaccacttggcttcaccggtcatgtggcgtgagcaaccggagtccacaagccaagaattacttctccctactccaaaatcctacaagaaggacacagcagatctcgatgattcagtactggggttagtgaaaaatgacttaggaatccagtactgaaccatgcgagaagtacaagcatctttagtgttatgagcagaattatatgcaagatgaccatgtctgttttgccccaaccctgctaggtcacgtcgagggtgcacatctcggcgaggaaagcgagatacacaacttgaacgacaatgacacgcacactcgaacctctcagggactctagtagctcttctagtcctaagacgttcttgtcgctcttttctagcctttctaaagcagaaacctaccaaatgaccagctttcccacaataggtgcactcatacttggttttctctacaggcttggtttgtctctggttttgcttgtgctcaacttgttttggatttttgggtctaggtaactctacaggcttagacttgctagtcataggtaccatctttggttctgaggttttgggtgtactagaactagtgtttccaatgaaacctgcagacttgaaggttataggtttttgagctagttctatcatcccatctgtgacacctaaaatctcatgggtacctatcctcaaagactcagcaaaatcatagcctataccttgattgtttatggacactttggattggtctaggatcatgttcaactttttctttccttgagcaaacctctctaaagattgttataggtatgagttctctttcttagcagactcaagatcaactttcagagaaatgcatgaagaacaagaatcaatagatttgatagaatcaatgacagttttagcatcttttagttcagtttccaggatagcacaattagcacatgaagaatgaataggttccttagtagcaaaagattctaacaaattattcttggtcctaagcatggcaacttgttgtcttaattcatcattgtcactagtgagaatgggacaattttcacacctaccaatcctatcatgaacaaatttttcttttagttctttcaattccatctcaagcaaacccatatcaactttcatttcatagcaagtagagcaagcagcactagcactagaaggattcctagctcctaaagcacatgatttcaacttatccttgaggagattaatttcagaaagatatgaagcacaagtagaacaggtatcctcctcaggaatcatggatcgaagcctagcaatttctagcgccattccatcattttcagattttagtttctcaattttatacttagaagacctatacttatcactaatttcaatcatcaagtgtgccattctttctttgcttagttcatcatcaacagagtcattatctgagcaagaatcatcacaaagagaaccatccaaggaagggatatcatcaagacatacctcaggatgctccgatgagtcatccttatcctcaagcgccatgagacacaggttgatgaagtcctcgttgttggcgagacagcacatcccggagaagtccttgtcccccttttcttgatcatcgtcgtcggagtcgatgtcgctaagctgcacctcctcaagagccgccaagaccttgtggatcgccttcttcatcaaatccttcttcccctttcgcccttgtccctcgggcttcttggtcgtcttgtcactcttcttcttcaacttgggacaattcactcttttgtggttaggctctccacactcaaaacacacaaatggttcattggtttttcctctttttttatctctcacatttttgtaagctcttgagaattttctagcaaaaagagcaagatcatcttcagggatcttctctaattgctcctcagtgactgagtgtaaagcggcaagagagaagccaccatacacaaaagctgagtcattagaagaagtactaccagagggatcagctaccaaagccatcgagtgtttgaggcctttccgatggaaaacatccatctcatgggtttttagctttgagtaaagcttgtccatggtaaggtcactcagaggtgcactctctgtgatggaagtaactttcatttcccaaacaccataatcaagacaattcaaaagatggcgagcattatcattatcagaaaattcttttccaacagatctcaacttcgaaataatttctccaaaacgtttgaaataagaatcaatggactctcctgagtgcatctcaaatctttgatattctttatgaaattgattctgacgaaccaattgaatatcattgtttccctcatggaaattgcacagagcagtccacatgtcatgagcggacttgtggtgttgaacacgattaaattcaccagaagaaattccaccaatgattgcatttcttgcacgataattaaaatcaacctgagccatatttgcaggcgtgatgtcagcatcatcgggcacagtgtaaccttattccacacattatgcccttgcgactggaggtaggcctccattcgtgccttccaaatgacaaaattgtgtccatcgaaaacaaatggtttcgcagagtatttttcctccatagctgcgttcgttgccatggttaggttacaacgaacttaaccgggctctgataccaattgaaagaccaagaacagctatagaggggggtgaatatagcaattcaaatcttgcccccgaaaatactcatcaagccggatttctcaaaatccttactagaatcgcggctattagagaagccggatctagaaaagaagagagaaaaagaagagagaaggaattcccgaaactagaggaggaagagaaaaggaattcccgaaactagaagagaggtgagaaagagagagcaaaactcatcatcgcaaagttcaaattgcaagcggaatttaaattgcggaatttaaatggacaaggcaaaaatgaaatccttcaaatcatttcatttataggtgatgcaaaataaccgctcaactaggagcaaacatacaccttcagaggaacattaacacaaacttaaaatctcttggacaaacacactccaaactaattctaatacaaaagccttttgggcaaacacactccaaactcacacagaaactctcttaccgagcatcttaaaatgattaccaaaaggagcaacctncacccttgcattcatctttctatttatagcctaagacccctaagacattgtcta

SEQ ID NO: 62422 - DNA, 24761 bp, Oryza sativa
  unsure (1)..(24761): unsure at all n locations
gggaaaggagggacttaggtgagacctgggcttttcacatataggcgacaagagtgatctaccaaagaaaagcggaagcgtccacacccagccagtaagaaaaccgggtggcgagttaagtgtggtcagacaatctaaagacttaccatgggagttagagcggccattggggaatcaaacggtggtttttcctcagcgactcgggggaaaagagtcagccaagtgggttaccgccagttgggtcaaataaagccggcacgtcctaatcacgcatcgccgataaatcgagaattttctcttaaaatggttagctttcttatccgacgcaccaatccatggaagagatcccgtgtatagggggagatgggccgggaggaaatcggcccatcgacccccgggggaggcaaaatagacttttgtggaggaatttgatttggaaggattggattcgggattggactcgacgatagatcggggattgagatcttgagatggcacgaacactagacaacaagcaaagaaacaaatttcgcaattagggtttttaagagataattttcccgctaggcgccacgacggaacgggcgctacattccctcctcttccatggaggccgatagctaccgagctagaggactccaacaacacaggtgtttgctagctgcggttgcctccagtcttctcccttcttccttcttccctcctcccctcttcacccctgccctcaatctccaatcaagccagcaaccaagccgattgccaaatccacatcccgttgttcgttgaggttccctcctattccttctcctccggccgacaagagaggagatggaaggagaagcgtgggcatcactggattcaccacctcgaccctcgcgtcgtccacttcctccctcacctctctttcttccatcccccatctgtctgggctccatcgagctcacagctaccaaactgcctactgcttccagccctcctcaccgccgtccgccgcgccacaactggccccttcctcgcgcagcccaccatctccagcgccttcctcgccaccgttcaccatgccctccttgccgccgcatactcccgccttcctcaccattactaggctcccactgcgttgcaaccccttcctcacctcgacccgccacctccaacgtcctccttgctagcgtgcgcagcaccctttctgctgttcccgccatccccgcagcgcctacatcgccgatagagagataaccgaaacaaatgaaaaacaaactcgtaactgaaaaacgatgtgtggtcatgtgaagtggtcttttaaccgaaacaaatgttagcttggtgattataagcataattaggaacaaaagaagggatggaaagctattgcaacagttcgcgaaattctcacgcacccgaacacccgcgagggcactacgcgtcgagtgcccgatctggggtgcaaaaaatcgggcgcccacgtcagctgaccgtcagcatgcatgcatgcaaaactattttaaactattttttctcttaagttatttatccaaatcatgatccgattgcaccattaaattcattgcaattaaatttttaaaataagaccacacatagatatattacgatgacaaaaatttagcttattattgaattgtttttaaatgttgcacactgttacaccaaatatatcggaattgtttcactaagtagatcgaaaatgtttcaatcgtttaaattggatgttgtttcaccttatataaaaacaaagtttcagcaaatagcgaaagaatgtttcaattcactgcaacatttaatctatacatagtgaaacatcacgagtacactaggtgatacatttttggtggaacaaaaaataaaacggattcacttaatagagggttttcataatatgtgtgtgatttgttgtaaaagaatgtttcaattcactgcaacatttgattcatacacattgaaacattgtgagtgcattaggtgaaacatttttggtggaacaaaaaataaaacgaattcccttaatagaggttatgtgggtggattgttgcaatagagtatgtggtggagatacatggcaggtgggggcaggggcacgtggtggggcctaggaggcagcacgcgtcacgtggggagggagcgtctgatttttctccttcccctgagcgaccgacgcgaaggattttggacaagactttacccggaattatactctgttttaaaacagagtaagaaatgagggagacaaaatagacatatttccaactgattgctgatgactcgttgttcggttgggccattctgatcccagaaggatggcaaggcccagaaatacataaaccgtcggcgttgaggcacttgtcccaccgggcctggtttaatttcgatgtaactacacattcgtagtcggtgagactaaggctctgttcgttatgaggagataggggagattgattctcgttttccgcgtgcacgcttttcaaactactaaacggtgcgttttttgcaaaaaaatttctataggaaagttgctttaaaaatcatattaatccatttttgaaatttaaaatagttaatactcaattaatcatgagttaatggctcacctcgttttgcgtatctccccaatctcctcaatccccttctcctcaaacacaccttaatagaagtgagtgatagcggagtacattgttgtgtccagccaatatatatagtgtacatccatttctagcgattatgccgtttgtcactggattctagttgtgtggccttgccgctgtggatggctttatgccgacggtgacgttgaagtgccggaacacggcggcccaccggcggttgttcttgagcctgtgcacggcgatggtgttgggccggaactcgtccatgtcccagttgatgtcgtacatccgcggcttgaggttgtaccggttccgtcccctgccgccggcgttgagccacctgccgacgaggcggtcctcgtgcccgcgcgtgccgctgcgacgcacgatgtcctcgttggcggacacccagcgcgcgacgtcccaggacacgacgtagcccatgccgtgcatgaacggcatcgggtcgtcgccgacggcgtagccccggccgaggtagacgtcctccgcggcttgccgcggagctcgtcggcgagcgccgccacgcggaggtacgtgtcgtcgtcggccttcatgacgtagtcgtaggggcacggcgcgaacaggcgcggcacggaggagaggtacgcgtgcgtcttgccgtcgttcatgttctcggtactgcagccgtcgagcaccaggatgtcgccgtgccgcgccgcctccgccgccaccagcaccgcgtccgcggcgtccgtcacgtcgcacagcacgaaccgcacgtccacctgcgcccccggcgcgggctgcagcgcgtacgccaggcgcaggatgccgcgccgctcgtaccggctcggcgtggtcagcacccccacgaggagtcggaactccggctccctcgcggccgtcgtctcagcacctagaccgccgtcgttgttagtgttgtcgacgacgggacgggagcgcggagcactgaggcagccggagacggagaggacaacaaggctcgacagcgccatggctacgagtccgaggggtaggaggaggcggaggcacagcgagcaaaacgaggtggccggaaagcgcgacgacgtggcctgcttcatggctcccgaatcccaaccggcgaaacgagacgacgagacgaacgaaatggcctggttacggggtgttgcattgcgcagttatccagcttatgaagcagcggaagatgacgggtggacgtcacactcattcattacatgtcaattataacgaaaaaaaataacaagatagatcaacatctaatatatcaattcacaaacatgtgtttttacaagttgtaacaaagataacaaatttaattgcaaatatacctatactaattttgagttttatttattattcttgttacaattcgtaaaggttgaattttaacttgcatctatattgcatattgatgtatcttatcatatttttttatttttttcgtaattatttaaatggcatacaataaacgggagaacatccacccatgtgattaaaagagtttcctggcatgatgatggaggtggattttaaactctcgagagaatacctcctcattaatcgtatgttattcaaataattatgatgtttttttaaaaaaataaaagtttgtattaacacgtgatatatcagttaattaaaattcaacttttaccagcaagaaaaaacattaaactacagctagttaacgtatattcataacgtatattcatagttgaatttgttttttgcattgcaatatgtactagttaaattttaccttgcatgtttatgaagtaatttatcatatattaatttatctttttttattttaaaaataaatcataactatttgagtggcatgcaagttcttaaatgtttataatagttccgtgataatgtccatacaatttgatgataggagaaggctaagtcggacagagctcctctaacgtaaaatcagagagacgtgggtcgctgataggtgggtctcacctttatgggcccacacgtaagtgaccacgtccctctgactttctgactttatgataggagatgcttctagcttccggctcagtcacagtcacacagtaccacgaacgaaagtggtttgactatatactaattgcaaaagcaacaaacaacgatttgttatgatgtatacgtaccacatagtagtactacatctgaaaaaatctgcccaaaaagttatgaagatggagattaagtaaggacatctaaaacaagaaaatcatttgaaaatgataaattaaatttaaattactacaaacctgaaaaaatagatttatttaaatattttagagcaacaactatacataaagtttttttttacgaaatcacggtttaaccgtttgaaaaatatgctaataaaaattgagataaattttgtattttaatatgaaacggattatgaagcttaggacgagatatgcggcccgtgcaactgcaagcgaaaaggaaaaatcgtgaaaaaaataaaaattccaaaagtcgaaaaatacacccactaccggttcgccgtcgtccttaagccttcgcagccactgtcgacgtcgtcctcctcctgtcacggtgaggaggcaccgggagggccacagccgacggatcagggtgggggagggcaccggcctgcggatccaggcgggggagggccgccgccagcggatcggagcaggggagggcaaccaccggcggatccaggcgggagagggccgccgccgtcgcccatgccccccagtgccgccgccgtagtctgtgtcgtggggtggtgcctgctcccagcgcctgctcgtcggccgcaccgcccgttgcccagtgcctcccgctcggtgagagaaagagagagagaggagccgaagagaaagagagggagaggagaaaatgagagaaagatagaggtgaaggaagagagagggggaaatattagagaggagaaagaggagaggataagaggtgaaaattttgaagtggtgaggagggaaaaactgtaataaagagaagataattttgcatgcgaatctttaagagatccgcatgcagatctttaagaggcccgcatgtgaatagacttatttttacatgcgaccccttaagagacccgtctgtaaaaatagaattttacatgcgggtctcttagggagtcgtacgttaaaatggaggtcgatttttgcagacgccgttagttacggttcatctgcaatctaaaggggtcctcgtacagaaagattgttttcctaccagtgttatttaggagtttgagaataaatgcgtgtgcgcggaaaacaagaaaggtgagttgggaaaaaagagggaagaacacagcctacaacaataaatttcccatttgaaagaagaggtagcagagagatagaaacatgaacggagagatagtaatcacaaaataactcaaatcaagaaaaaaaatactcctatatgacaacatatttttttaagtagaactgttacgattcgacgtgagcgcgctgagcaagagaagggtgttgcagtggagtggaatgtccggttggccaagcttgtaacacaattaaacaagcctggcctctgcatgtgcatgtgctcgcttttaatttgcttgatatcgactcgctcgtactagttttacactattcatcctatttcgtcttatttaaaatttttttataattactatttttattattattagatgataaaaacatgaataatattttatgtatgactaatttttttaaaatttttcataaattttttaaataaaatgaaaagttaaacattggacacggattttcacggctacatttattttgggatagaggtagtatacgcttgggatcgatgaacaatcgaacatgttacgtacactggtcacctcaccgcccgttcctacggatcgagaaatgtttaatttgcagctttacgtatacaacaatcaaaagaatacaaatctcacgaaccgaagttgactcggctcaacaaaaaaaattcaattgcggtaaaaactcacgagatcgatatatcgatcaacctaaatcaccgggtagaacggcttgagcgcggcggtgaagttgaagtactggagcgtcctcgcccaccggcggttgtccttgagctggtgcacggcgatggtgtccggtatgaactcgtgcgagcacgggtgcctcccggggaagttgtacatggccggcttcacgtccacccggttcctgcccctgccgccgcgtcggagccacgagtagagcgtccggtcctccggcccgcccgtcctcccctcgatctccgccgccgccgccacgatccactccacgaggtcccacgacagcaggtaccccatgccggacatgtactcgttcgagccgcggacgtagtcgcacggcaccatgcacccgtagtagaggtcgcgccgcggcgctcgcgacagcgactcggcgagctccggcagccggaagaaggtgtcgtcgtcggccttcatgacgaagtcgtaggcggcttcgccgccgccgaagaggcgcggcacgctggagaagtaggcgtgggtcttgccgttgtccatgttctccgggcagtcgagctccaccacgtcgccgtacgccatcgcctccagggacaccaggacgcggtcctccggcgagccgacgcggcagaagacgaaccggacgtccacgcgcgccctcgacgccaccgccggctgctggagggcgtacaccatccggagcaggtgccgccgctcgtaccgcgccgggagggtcagcacgccgatcagcagccggaactccggggccgcctgcacgccaccgccgccgccgccgccttgatgatcgccgcatgcggcggcgccggccagcgaggcctgcagggcgaactcgttggggtagacgaccaagagaagggcggcgaggagtgcgacggggagcaggaggagcgccgcggcggggacgggcggcagcggcagcctctgcggcttcatggcagaatgcgtgcgtacacggtgtgtggctgtggcccaaacgaagttggttttggcagaggcagaaatggtggtttttctggggatttttgcagcaggttcacgcggtgcggagggaacacacgatcgagtacaggctgctgcatatttgcagcggagtagagagcacatacgctgtgaagaagtatagtgcaagcatatactcccttagtctcataatattaaaaccttagactggatggaacgtttcatagtacaacgaatatggacagatgcatgtccagatttgttgtactatgaaacatcacatccaattctagattgtaatattatgggacgaagagagtaacaagtcttcttcgcctttgcgtggaatatagttgtggacttgtggagctgtggtggactggtggtggcagaggaaccttggtagtagtatttggtttctcagaagtccattggccgggccatgcttcgattcctggatggcaggccatatcatttgcatgaaaaagggtccaggttttaacgattcacaagtaatcaaagacggcatgacacgtagctttctagactttttaccgaggaaacctgcacatgctcatcgcctcatccgtagcacattgccatttgccagtgcgcccagcgcagcccagcccagagctccaaaaataccaaaccaaccaggcaaggctgtgccgactgccgaaatccatcacggcgcaaaactcgcaaagctcgcgccgcgcatagtccaaaccgcgaaaatttcgctctcccaccacgaaatccccaaatttccccgcgcggtctccactctacactccccgaaaccaacctcgccgatccgcgcctccctcaatccaacggcccacgctgcactcctcaccactcacgcggatcgctccccatccgacggctccccactccccactcccccacccaaatcctatataacatcgccctcacctatctccccaatacagatcaaccaaaaatcgccaccaaaaatccccaattccatcgtcgtcgatgtcggggcgcggcaagggagggaagggtctcggcaagggcggggcgaagcggcaccggaaggtgctccgcgacaacatccaggggatcacgaagccggcgatccggaggctggcgaggaggggcggggtgaagcgcatctcggggctcatctacgaggagacccgcggggtgctcaagatcttcctcgagaacgtcatccgcgacgccgtcacctacaccgagcacgcccgccgcaagaccgtcaccgccatggacgtcgtctacgccctcaagcgccagggccgcaccctctacggcttcggcggctaggagccttttgcattgtgtttgtcttgttaggaatctgcttgtttcggatgtagccctgtatcctgtaatgaagaaaatgctagcagtaaaacttgtttgaattcacctatgaatctagtgcgaaattctgcaatcacaaattcttcagattaattttgctgggacatgtattgaattacgaacaaactgctaatttgaccggtagtttgagacataaaccaaggaaaatctgaagaactttgaacttgctgtagttcagttctcccattcgagagcgaaggctgactcgaacgacgcacggtcgaacaccgcagggccgaccccggtgtcgccgaccagcagccgcatgagctcgccgacggtgtcgaagtaccagtcgcacgggccgtggctggcgtccttcaccgccacctgcatcatggcacgctgcgcggccaccagcgctggccccagcggcgggaggtcggcgcagacgaacagcttcccctccggaaaccgcgcccccgacgcgaacggtgccgccgccgcaccgacggcgaagaacgcgccgctcagcgagcgcgacaggccgtgaacgcggagccggaggtcctcgtgggacgcgccgagcagggcgcggacggcggacaccgccgccgcgtgagggacccagcggagcgcggacgcggcggccacggcgggggccgggttgtagccgcggaagcgagactggaactcgacgttggagaagaacacccagtgggacgagaaggccgacctgaacagcccggcgtcgccgaccagcagccgcatgacgtcgcggacggcgtcgtagtagcagtcgcacgcggcgtggtccgcttcctccgccgcgacacgcaccatcgtgcgctgcgcgtcccgcagcgccggcccgagcggcggcacgtcggcgcagacgagcaccgccccctcgttccccgcgccagcgaagaagacggcgctgagcgagcgcgagagctggtgcgcgcgaaggcggaggtcgtggtgggaggcgccgagcagggcgcggacggcggagaccgccgcggcgtaagggacccagcggagcccggaggacgccgggccgtggggctcgacgtcgtcgtcgtcgtcgtcgtcatcggtggtggaggtggagtacccatcatcctcctcgctggcggcggcgagttcgctcccccggtccaccccgtgagccaccacaaccatgctggtatcgaacgtaatggcgtggcgtcgtgcggttactcttgtgcgtagagggagctgtgactcctgggctgttgatcactccatggaccatgttccatcccgttgcgacttgcgacccaggggcggagctataacgtggtccgtgtggtccatggaccaccatagaattctggtccatggcccattacctctatgcgctacttaaaaatatagatggcactttgacgctttgttttttcgccaattcaaccaccgcgtcgggcatcgggcgtcggcgcgtcgcttcgtttccatcgcaattgtcgtttccaattttcgagcgcgcaagtcgacgagtcacgacgaccactgtccattgaggcactaacgagtgagttgtgacgtcgccacgtcggcggccggcgactgcgccaccgcgggcagcgaccgcaccagcgcgcagtgccacaggccagcagcaaccagcagggagaaagcaatcagcagcactccattcatcaggaggcacgcaacaccaaagcacagcaaacagcacgttagcaaacagcactatagtaggttctcaacttctcatctgcttctctctttctcctccctaacagtagggtttttttttctttaggtttaaatgttcaatctcatttcaattttaggatatccggtcgattggaattggaatggtaaattcaaattaaaccttacaatcctatataatctatggtagatttgctgaacaagttgagttagaccaccatatcttaaaaacctgggtacgccactgttgcgaccgttggtcccgagacgacgcgcgagcctcgaggcagagagagagtgcaggactctcatctgtcatttccatttcatgtgcagaagtcagcttttacaggtactttctcggtttctccttctggttgggttggcatcgtctgtctcggggtgatacggcaaacttcgccgttttttcatctcgagcatccaaacgtgaccgataactggatgagcaaatgttcgatggttgtgtttagttcacgctaaaagttaaaagtttgattgaaattaaaattgagcaaattgtttagtttcaacttttctgtcacaccaaatgtttggacacatgtatggagtattaaatgtggacgaaaaaaaaccaattgcacagttcgactgtaaattgctagacgaatcttttaagcctaattacactatgatttgacaatgtgatgctacagtaaacatttgctaatgacggattaattaggcttaataaattcgtctcgcagtttacaggcggaacctgtaatttgttttgttattagtctacgtttaatacatgaaatgtgtctccgtatacttaaaaaattttggcacacgaactaaacacagccttggacgttaccaggtttacgattcctagatgatctttcgttttgggctctgacggaatgacagttttcacgaaattcggtggaaagccaaaattccgaacaaaactccggcgattccgaacaaattttataaaccaaaatttaaatacaaatttcttaagtttaccgataagcttgcgaaaaccgataggctttggtgaaattctgagcgaaatcatcaaaatttcaatcgataactagaaaaagaggtaaacagattttttttccttttttaattctttattattttctttcctattgtaaatttcagtaaatacacggaatacatcaattttttcgaaaatttatatcccaataagttctatgaatatcatactatttataagattttatttgatttttttcttttttatcaattcaaatttaaatttggataaaactcatcgaaatctcagacggcttctactttgagccttgtcgaaacctcaaaaattcgcgggattcgaccggttttcgtcggaattgtaatccctggacgttactaatctacgcatcagttgaatggagaatctaataattaataagaagaagaaatgtgcaagtatgagcatgttagaaataacaacagaacaacactgaggtggtgatagaatctcctaaaagataaagattaacaatttcacgtaaaacgaggtggtaataacatgtgattaattgagttttaattattacaaaattaaaaaatggattaataacaactttcatatagaaagttttcgcacgaaatataccgtttagcaattcaaaaagcatgccacgagtacctaaaaatttatctaatttatttttacagaaaagaataggcctgaagtcatacaactaactgaacaaattatggaataaaaaagaaagctggctaggatcaatgtcaaggaaggccctaagcgtcggatgcccgatgctttgggaaaaaatcgggcgctgacgctagcatgacgtcagcgcccgatttacgtgtaaaaactactttaaactgatttttctcttaaattacttatctaaatcatgatccgattgcaccattaaattcgttgcaattaaatcttcaaaacaagaccatacatggatatattccgatgaaaaaaaattttagcttattattgaattttttttaaatgttgcacgatgttccactggatatatcggaattgtttcactaattagataaaaaatgtttcactcgtttaaattgggtgttgtttcaccttatataaaaataatgttttactacctccgtcccaaaatgtaactatttctagcatagcactttgtcccaaaataaagctatttttctacctaccttctcctctcaaccaatcacaaccattctttttcacctactttctctttttaaccaatcacacatcttcttcaatcattctcacctactttcttaatacccgtgccaaccttaaaaatgcttacattttgggacggagaaagtagcaaatagcgaaacaatgttttagttcactgcaacatttgatccatacatagtgaaacattataaatacactaggtgaaacatttttcgttggaacaaaaaataaaacgaattcccttaatagggggtttccaaaatctgtgagttttttttgttgcaatggagtatttcagttcactgcaacattagatttatacatagtgaaacattgtgggtacattaggtgaaacatttttggtggaataaaaaataaaccgaattcccttaatagggggtttccaaaatatgtgatttttttttcaatagagtatatggtgaagatatgtagcaagtagtagggacatatggtggggtcccagtagaagcacatggacacgttgtggaggggggaggaggggagcgcccgattttctccccctcccctgggcgaccgagcggcagcattttcgcaatgtcaacgcacgtagaattaaatcttaacctttttttacattcggacaaaaatcttaacctttttctaattgaagtaaatcttaatttaagccagtaggaattgaaaggatgtcatggttgtaattggtgctgattttctgaattcatttgatcccgaaataggtactgcaggatgatgttaggtgcttgtcagatacggtggttggaatccagccataggtcatgtatggatgctctgatgaagcaacggcaaagtttgccgtatcagcccaaaggccgacgatgcctggttagaaattcatgatgagtgtttggatgactttcataagtgtgataagatttctttttttaaaaatattggtaaatccaatattttttttataaatattggcaaatccaatatttctctttagtgactctaaatagtatagcatgattttatttagattatggcttggattttgatgaccttacctttgacaagtttgacgaagaaaacatgataaaccttggcaattatagattgtgaaccaaacaaccactcattgtttcatgctttattttgttttgccacttaggagtaggctttttatgaaaattcagtatcccatactttattttgtttcccatttaggagtaggccttttctactactccctctcccaaaacataaaagattttgattggatgggacatattctagtgctgtaaatctgaacctctgtattcatgatctgctatactctccatggaaaaaaaaatgatctgctatactcaaatataatcatgatcgagaaaaaaaaatcatgtacagttacataaacacatacgtacagccagtatacaaacgcaaatgaaaactaaggcacacagcacgcgttcaactctgatcaatatctgatcaacaagcgagttcatgcgtacacctcgcaacatttccactcgtgtatagtgacagccgaaactctttcgccatccaagatatatccaacgaaacccccctacctgtcctctcgacttcctccgatccgctacgggtagctagggtcgttcggattcaagtgaagaagtcgtacttgaccggcgtgccggtgggatcgatccatggctttgcgtgcaggaagttgtcgacggtgaacttggtcgcgtccgccttgctgatcaccttcttgtaccccggccacgcgacgcgccccgccgtgtcggcgccgggccccttgttggcgtactcggcgtagtagagcgtcttgagcgcgaactcgccgttccacggcatgtacccggccttgtcgatgatcgccgggatgtcggactccatgatgacggtgcgggagaactcgcgccacggccggccgaggtagttgcggatggggggaagcttggcgtcggtgagcgccggctcggcgttgaactcgcacttctggagcacgaaccccgtggcctcgcggccgtcggcgcggccctgcgccgtggcgatgttctgctggttgtccatggggcggcggagcgtgaggacgcagttctggaacacggcggcggcgtcgccgaagacgaagtcgatggtgcccgtgatgacgcagttgcggtagaactgcgccttggagtgcgcgtacagcgtgtcctggaacccgtccatccagcagttgaggaacaccgacttgtccgactgcaccagcagcgccaccgcctggtgcttcgccgcccccgccgtgttctggaaccccatcccgatcgccatgaacccgtccccttgcgccgctgcaaaaatcgccatcgatcacattgcgcgtcaatggcggaagctctgatattggtttataccgaaggttgctgtcttgaaggtggtgaggccgtcggcgaagttcttgctgccggtgacgatggacttcctggagccgtcgccgtacatggtgacactcgccatcttcttggtgatggtcacgtactcggcgtacacgccctccttcacgtagatcacgtaccttccactgtaggtcttgggcatggcggcgagagcttcgttgatggtcttgaacttgccgctgccgtccttggcgacgatgacgttcggcgtgaggttgttcttgaacccgccgcccttgagcaccctccggtcgccgtcgggcacccactccgggatgccgtcctcggcgagggccaggtgggggtccgctgctcctcctccgttgtcttcttccccggcgagcagccggcgttgggagcccttgagggcggagaggaacgaggaggccttctcgatgagcgccagggcgttgctggtgaactccctgccgttgttgaacgactccttgaccttgtccctgaactcgccgtcggggaagccgtcgatgcaggtctccatgttggcgatcaccgcgctcagccagacgcggagctggaagccctgtttgaggccgtccttgccgtcgatgcccttgagcgtgcagttgaggtcgtccttggcgtcgtcgaagagctccttgcagtcggcgacggcggccttcacgcgcgggtcgttgctcatgatcaggtcggcgcggtcgaacgcctggtcgaccgcgccgccgatcacgttcacggcggtgcggatgatgtccttgggcgacgacacgctggcgttcgccgccttgccgatgctcgtggcgcacgagtccgcgaagtccgtctgcgcgcacatcatcttgatgctcttcgacacggcgcgcaggtccgctttgccgccgccgccgccgccgtcttcgtcgtctccacctccgccgcctttcgatttccccttcgacgagcccttggagccgccttcgtcctcctcggatttcttcccgctgtacgtgatggcggcggcgcccatgacgatgaggataatgatgatggacaccgtgccgagggcgatcatgatgcgcctgcgctgctgccgcgccttctcggcgcggcgccgctcggtgagcgggccgaagtcgccgaacgccgacgacatggccggaatctatccctagctcttctcttcttcccccactcctctttctcctcctccttattgactgcttcttctttctctctcacactctctgcctgacatcaccattggcagagaggacggaggaggaagaaggccggaggcattggagaacgagggttcattcatgtggccgcgctgacgcttcccgggaaaaaagaagggcccggagacgattgtggaagctatgtttagaagctttggcatgcaacaatggccgccattctcggacgctcccgccattttcttggaggggtcaatgtactctcttctctgcgagaaagctccatgaaaattttggaatacaaggattcttctgcgtcaactagacattcaaccagaaagtatagaagaattcttctacgtcgactagagattcaactagaaaagaaaatagagacggcggaggcggcgctgcgtgccgccagaatcagggaagagcggtaggactcaaactacatattttacaaacgaaaaatatactgcctccgttttttttttatagatgacgttattgactttttctcacatgtttgaccattcgtcttattcaaaatttttatgcaaatgtataagatataaatcacatttaaaatactataagtgataaaacaactcataacaaaataaattataattacgtaaattttttgaataagacaaatagtcaaatatgtgagaaaaagttaacggcgtcatctattaaaaaatgaacacagtatgtgtttttagcgatctaaaagcaaatactggaaaacaaacaacgacaaaaaactttaaaattaactctaaatctaaaattaaaattttaaaactttgctcgtataagtataagcgaaaagatgagtagtctcgatccgatctgacgatcgaagtgacccaaatgggctactttcataggcccatctgggtgacttgggccgttgaggaagcccatcgcgccgtccccgacacggaccaggcggcccagttgataagccgaccgaactgagccgccgggctgcggcgtccccatcgtcggcgtccctttcttcctcatcaacggcgagcttccaattatgcaaccagggtataactataaattctatcgtttctcgggagagaggaaagagcaatgatttgtcgagctgtccctgcctcctcctgtccatcactctactgttagaacgagatgaaacctctacctcgagtggtccagcagcagctgcccctgtggaattggttctccggtccgctttcacttccaacagggagcacagcatcagtgatgcctaccgcctcatcaatctgccggggggaagattaggcggagaacgcgtcaagcatccaaatccatgtcagtatcagtgtagcaagatcgagcggcagaggcctctggttggaatgtaacgggtcgaatctactccctccatcccaaaataagtgcagttttgcacattcatgttcaacgtttgaccgtttgtcttatttaaaaattttttatgattaatatttttattgctattagatgataaaacgtgaatattactttatgtgtgactaaatattttcaaaatttttacaaatttttcaaataagacggacgatcaaacgttgggcacgaatatccacagctgcacttattttgggacggaggtagtactactgatggattcttgcacgagtgagaatctttgatcttgatgaggagcttcttgatcaatgatcatcctctggaattttcagatttgcagttgaaagatgcgcggtttttctttttttttggaggagtttcttttgcgtggcctatagattcgtgcctgcttcaagtctgcatcgtccagttgtaagtacaatgggggtgttgcatcttttcgtgtttggccaaaagagaggaaaagggtaaaggagattcgtgcctactaataacttctgcagttcagcgattctctagaggtgacaagtcacaactcaaaagtgagcggcaacttggccaattctcgcagcagaatagcagtgtaggtgtagcacagtagcacatgctggttttactgaactgaacaatgagcaagaaaaacgtagaaaaaccaaatcattttaagatttaagtggatgatcagcttaaattactgcaacatctgggatccagaagagaataggagatgataaagttcctgtcaggaagtatatcatgcacattaagatttacgatcatgaataaaaacgttgagcacaaacactggatcctaccaccgtattggtgcgtcggaaagcaaagtaaaccacttaaagagaaaattctagatttatgggtgatgtgtgattaggactgcaggattatcttgatccaactggtgataacgcactcgtctgacttttttcccgggatttgctgaggaaaaaccacggttagattccacaattgccgcactaactccattgttcatctctagttttactgaccacactaactctgtcaccgtgtctgttccatgatcggttttagcaagctcatgctttccttgaaagaacaaacaagagcagagaagagaaaagcaaggcatcaactacagctttaattctcactcccacaaaataccaatcattcatcagcttagctagctagctagcacaatcaacattgctgtcaaattcccagcagcatcagttgcatcatcatctttgttaaaaaaaaattgtatcattatcatcttttttttaaaaaataatgaaattgatttacatcccggtctctctaccataagacacataaccaacgagttttgatacctaaaaatcaaaccatataaggtgaagggaaaaaccctcaactccctctaaacaagttcaattgaaaaaacattccaaaatcaaataaattctagcatgtcattcggtatatgctaagtcagccaaagtggaataaaagaaacttggctaccaattccaataaccgaaaattgaccatttttaccatcatttggccccaatttcagatattaagaagataattatatacaatactaattacttaattagtgaccagtgatcacttgtgtgtgtggacagagtggctttaaatacccatcactcctctccccctcacacaccctccctctcaccattgcaaagccactagagatcgagaagaagaagaggaggaggcgagctccgtttggtgcgaggcgccgccgcgcgctgcgggcctctcctcctccccgcgcgctccactccaccatgcttccgagccggcagagaagcatcttccatctcggggaggagggtggcggcgccgccgacgccgagcacctcggcgctgaccacggcgacggccatggcgatcacggtatcatcagtatccaccagcagcgccttcgtgtcgtcgggctgcagatcgtcctcgcccagacgaggcaccaccaccgccagcagcacggccatgtcgtcctcaagcagatgcagatggtgtccccgccgccggcggcgcgtcaccggcggcggcggcgtccttgcggtgacttcttgagcgcgtgctccctgtgcaggctggagctcggccccgacaaggacgtgtacatgtacaggtacgtacgtacggcaacggcacgccgacgacatggccggcggcgggccggcggctagctggagctcgatcgatcgccgcctgaattttggggtggtttgcttggatgcaggggtgaacaggggttctgcagcgaggagtgcaggtggcagcagatcatgacggacgaggcgagggagcgggacgccatggccaagaaggagcggctaggcctgcatcatcggacgccgcggccgccgccggcggcgatccgcggcggctcgccgaggagactactcgccgtagcctagcacgagcgaagtacagtatgctatacttgatgagaccgtgacccatgcttggatgatatatgatcaaaagaaaattttctactgtactctctgtaaaatatggagaaatcgatgtaattaagaaaaacttgataaggaggaaggagagagagagagagagagagccaggttttgagtaatttgaggcaaatttgaggaaacgtatacgcataactgcatgcagtttcatatttcaaatgaacacgaaatgtttggtgggggaaagaagctttccaggtctcatgggtacaagtgtgcaacttaactgtaacctgctcctgcttatgtgcaaaaaacctggtaaattctggataaattagtttcctgtgcgtgtaaatttcatctcgattatttttagaggatgcgaatgattctcagtcgagtagaactcgtggaatgattctgaacacaagtaaaaaagctctgatgaatcctggggcatctgccatcttttgctttcgagatgccgaggtgccagaaatttgatgccaaagacgaagtggagggaacgaaaggatggtggccgtggcatcaagcaccttgatcgatggggagacagtgagacaccaatcgaatcaaagtggaatcttctcttgctagaaaacgaccaacaaaaattggaagcagctagaagcctataaacattggtcaaggaagagggagcagcctaagagaggcagacagcgattgctacattttagtgccacgaaaatctattaggacagttcgaaaagaagccatcacgttcgtggtgaagactaaaaacacttagatcctgtttagataggactaaaacttttaaatccctatcacatcggatgtttggacactaattataaatattaaacgtagactattaataaaacccatccataatcttggactaattcgcgagacgaatctattgagcctaattaattcatgattagcctatgtagtgctacagtaaacattctctaattatggattaattaggcttaaaaaatttgtctcgcaaattagctttcatttatgtaattaattttgtaagtagtctatatttaatactctaaattagtgtttaaatacagatactaaagttaagtctctggatccaaacaccaccttatattaatcagagaaaaaattaagtaaaaaataatttagaaataattgaaattcagaaaaaaagaaatattgaaagaacatcacataaaaaacccaataaaagattaattaaactcagaataaagaataaaataaattctgaaattagaaaaagaaaaaaatgagatttaaataataatataatttataaataactaaaattcggaattaaaaataagaaataatagaagagagtccatatgtataatccaatatgagttgaactaaaatttttaataaataaataaattttggaattacaaaaataaaaataagattcataataatataatttagaaataactgaatttcagaattaaaaataataaataacagaaaaagagtccacatagaatccaacacaagattaattaaaattcaacataaaaaatatatcattacaatttgacataaattaaagatatagctctacttaccctttaaatttcatttatataaaaaaattatacaaaattaccccctccttccttctccctctctcctctcttacccaagattcagttgaaaccacggtcgccggcgacggagctagcagcggcgtggttaggttaatccattgacaggggcnnnnnnnnnnnnnnnnnnnnnnacagattagaaagagggagaaggaagaagggagtgaagaaaggaggaggccggggtatagtttagtacaaattttttgataaatgcattgaagaggtataagtatggcatatctttaatttctatcaaattgtaacggcatatgtctttaaataaacgaataataatgctattttttccaaatcaaagaagtcctaatgggtatgatatagttattttttttaatgtgaggactggtgagcccttatattttctttttttttataggtgaagccattaacttttggacacataatttgaccattcgtcttattttagaaactttgtgcaaatgaataagatataaatcatgtttaaagtttttttagtgataaaataactcacaacaaaataaactgtaattacatactctctcgtcccataaaaaaccaacctagtactatatgtgacacatactagtacaatgaatctggacatatgtatgtctagattcgttatactagaatatatcacatccggttctaaattcacttttctgaaacggatgggactcaaaagttatatcatagtcatcatctattaaaatacagatgtagcatgcatccagttgctttctcaaatttcaggcgccagcccgatcatatcgatgagaaagcagagaacaccatgcaccgccgaacattgacgccgcgcgccgaaccaccgcggcgcgctccgtctccgtctgccacacgtacaacgcggcacgacgtacgcgcgcccacacacaccccgcgatcgattgacacgggtccgacgccccagtgtgtctgtgttccccccctacccgggacgtgtcacctgcatacgctgcctagcgaccgcccaagaagctctcgcgtcgtcgcccatttagcagcgcacgcgcacgcacacgaacgcgccgtgcagcatcagcaggcagcagcagcagcttcctcctcctcctcctcatcttcaccgacgacaccgcacgctccgcttgctcgtctcgccggcgccatgtcgtacaaccattcgccgtccatcaccgcagagaccataaaccagaaggtacgtggctacgtgcgtcgttgcgttcctccgtcgatctgaacctcagctcgcgatcgatcgatcgatcgatggctagctcgatcgagttttattaactgatcaaatatgtgcgcattctcattcgtcttgaaggtcaggatcttcacctacgagccatgtggggagattgtccgccacgcacgggtaactataaatctcatcaacctacactgagggcaaagccaatgtttgaagcttacaattaccttgagatgagacccataaatagttaatttttgttgtagtatgttatacaatacttatgatcataagataagggcaatgtatacgggttaagtagtccttatggtacggttaggccctgtcacaatagacttcagttatctctatttctatcgctacaaacatgggatgggaatcatgggacccactaacaaataaaaatgtattccctccgtttcaaaatgtttgacaccgttgactttttagcacatctttgaccgttcgtcttattaaaaaaattgtgaaatatgtaaaactatatgtgtacatgaaagtatatttaacaatgaatcaaatgatatgaaaagaatacataattacttacattttttgaataagacgaatggtcgaacacgtactgaaaagtcaacggtattaaacattttaaaacggagggagtagtaagtaacatcaaacacaaaagatgaagaggggagcaaaggagagagatattcttatttcttatgggtagtcgttagttactccatggatagctcatgctattgactcccataaagactccttccacaatatatacattggtacattgaaacatgagctcactacataccctatcttattataagttgatgtccactatctcctaaaattcaacatgtaagtgtaccatatcatcaccactagtaaaatataacctttcagtgatggtgggagtatagatggccaaaaggcctgaggcccgacgggccgccccacggcacaacattttggcccgtgcctccccccccccccccccaccggcacgttgggcaggcctaggccaggcccgacacacaaagaatagggagtaaaaatagacatattatatgccacggttcaagaatagggacgcaaaatatagttattttagctatatatatgtcaacctaaagaggagggagaaaaaatagacttattttatgtcacagcccaaagaggagggaagaaaaatagattcatttaaaaaaaggcatgatgtgccacccgtgccttcgggccggcacggcatggcccgactactggtgggccgtgcctgggccggaggtgcagcccatgagccggcatggcccggcacaaagtgctgaccgggccgtgccggcccgatggccggtgggtcatgcctagccatgcctgggccgggccaggctgggcgggccttatggctatctataggtgggagagagcaaaggagttgtcttttcgttaagtagcgctagattaaatttatctcagattccaattagccatcctccaaccccat

SEQ ID NO: 62423 - DNA, 981 bp, Oryza sativa
  unsure (1)..(981): unsure at all n locations
tgcagccacactttcttgctggcggtcgtgcgccactggctcgcgggaccgctcaaccgacttacggtaccgcggcgccggttcgcgggatcgacgcagtcccacactgccgttccgcgtgaccgcctcggtcccgctgcgccgttctgcgcgaccgagcgggcgtcggctcacagcttgattccacaccctcgttctgcgtgaccggtcccgtacccatcattccgcggcaccgctcggcctatcggtcccgcgccgccacgttgcgctttcgttccgctcccgcatttccagcgtgtgggagagatatatttctgtaaatccttctcgcccacgtatataaacgcaaaatgcgaaaaaacaagatattttttcaaatttttttcccgaaaggacgaggttagcttacgaagttagtagtcaacccaaacgctaaccaaccaacacgcggaattttttttttattttttttattaaaagttttacaaaaataatttttcattttgaaaattgacagaagtggtcgcctaccgccctctaggagggcgatttttaaaaatcgccatcccagagggcggcgaaagtgatgtggcagacggccgttcgctctcgggcgacggccgtcaacgaaatttgcaggcggcccccttgccgccctccgctagggcgattttgtactgtgcggggggccgcctgcaaatgggcggcggggggcctggaattttgcaggcggcccccttgccgccctgggggagggcgattttatactgtgctttatatttttgtataaatatcaatagttatcaaatctttttatattgaaaactatacaagattaaaatctccaagactggtaaaatacaattttattattttttagggcctatttggaatgttaccgtacaaatattttnnnnnnnnnnnnnnnnnnnnnnnnnnnnnnnctgaggcgcagtgcaattcgaatntcaatgggccagt

SEQ ID NO: 62424 - DNA, 952 bp, Oryza sativa
  unsure (1)..(952): unsure at all n locations
gacagaagattgcctggtagcagtggctaatgcctatcacccaccacccgccccttttcgcccttcttctcttntttttaaacgntttatttttctccctcccccccccagcgtggtgttgatctgcgcctggcganacacnnnnnnnnnnnnnnnnnnnnnnnnnnnnnnnnnaccttcactccagacgccccagagccgcacgttgccgctgtgacggacgcgtatcccacgcaccgtgaccgagactacttcgtgggggtacgtcgaatttgtattagttcttacaattatttcatttatcttgcataatataggacaactactgaattttttatttccatcttgcataggctgatgccgcacgggatatcagtgccgatatcaccgcagtccaagtgaggttgaacagaggtttgcacttgactgacgttgagcagagggtgaccttcgaccggatgcaggagaagatgcgtgcggtcatgcgcgtcttctcctgtcgcagcgccgtggacgtcgtacctccagctggtccggtacaaccacggcctcgcgcgcctaccgtcggagcaggacctcgacctacggtacctgtttcgcacggtactgctcagcccagaggtttcttaagttttgtttctgtttttgtacgaaaacatcaccccgtcgtaacttgatgttccatcctcgcaggacctcgtttgccttcgagcgcccctagcttcggagcagtgcgacctacagcaccagtttcgcacggtacagttcagcccagagattagttcatttttgtttcagcttttgcacgaatatgtcaccatgttttaacggcacgtttccttatcgcaggacctcgtctgccttcgagcgcgttcgcaggcacgaccggcgctttcgcgagcttcgcaggggcgttcgccacctcttcgggcgcgttcggcagctctttctt

SEQ ID NO: 62425 - DNA, 4148 bp, Oryza sativa
gaacaacatatcagatcattaggtgattccctttttgaaatcatatggataccaccagatctgcgagtgagcgggttctgttcatatcttatcatacttggaaaaccagcaagaaaaatcatctgccaacttttaaagttgttggagattatccatgctgccaacagatttgcttccaggtttacaatagctgatctggtgttcctccctgatctgggttgtatagcttttaagaaaggagtaaaaataaggtggaacctcaggagagaggagtacaaactcaacatggtgatgtagctagcataattagctgctggttcaggtttaaccgcaggaagcttgaagcgctggaagcagggatccatgagcttcgtcctggccaaggtgactctccaatgtttgttgatatattagttaaggatcttagaagccccacacatgagactggtctcagtgccaattatagaggtttctacaaaaattgtagtgctctgagatcttgttcggcccacatgaatttgttcacctctttggacattcgtaaggacttcatggttggttctgctgattggggtaattttgtcaaggctttgggtgatatcaaacttccaggctggtatcgtactgctatgcgatcacctgaaatgaggaaagtactcttctttgagtttaatgatccacatactggggagttacgaggcaaaagatatcgtgccttatcagttttttcatggcttgaatttgcgcggatatttattaagcacatgaagaaagggctggtaaaatcactaacctcatacatgttttagtatagacttttatttgatggttttacttgatggttctaatatagacttttattttttgaagtgtaccgataaacaggcaacagcacttctctgtgtgatattctcgaatattgtacctgttgtggagaagaaacttacttacagttacaggccaccagctaaggagaagagcaatgaaagctttacagttgaagaaatcctggacccatcatagtcataggtatgaagtgcagcttgtttctttgttttccttgcatgcatgtccagtaattgttctgtttgctgctcctagattctgcaagttatatatatacgtatgtatatactaatgcatctggggataaagcgagcatacattttctgttggacactatacatgaatgtaggtgacatagaatgatttatatatccactgtccaacaagaaaagtgagttggtttatatatctactttccaagatgatagcaaaaatgcaattagagttttgcaaactttgtaatcagagaaacaaccaatcacatcctgtgtgattaccctttggtttgctttgcttggagtgtaattagggatatatgtggattagggatacccttgcagtataggcaacaaactcaatgtatacactatgtggattagggatatgtatgttaatataaaactaacagaggaaaaagctactgtgttgcagtatagacaacaaagctactgtgacaatataaaattagcagaggaatacattccctttcttactcttaatatacatcggccggctattcgccggcccggcgaaaaaaaaaattagcagaggaaaaagattagttagaatggactttgacaaaaaaaaaggggagtttagcgtgaaatccttttacaaagctattaaaatgcaggcggtagcctctgatataacaggaatgtataaaaaggtgtggaaaattaaggtcccattgaagattagaactttcatttggttaatgataaaaaaacagcatcctgaccaaagataacttgaggaaaaggggattgaagaaaggaaacgataattgtcaattctgtggaaaaaaaaaagaaacgatacagcagttattttttgaatgtcctatggcaagattcaattgaaatgtggtgatttgtgctttcaatttaaaaccagttaaagatctgaagcatatgctttgggttgatgggcactgaatggtgatacaatgacatagctattgttagttggaattgctgctattctttgggcaatttggaaggccagaaatattgcttgttttaaccaaatacttcccattgatcccactgaaattattttatgtgcttgtaattggatttcaacttggtctgttttacagatgtcggaggaaagacagaatgttgctgtaagctacaaatctcagtatggttggaggatgactctgcaaaggttggagtatgtatgacaaagcgcgaagaaaaagctttcaaggaaagggtttctgaagtttttattggtttgaacagatcctggaaatgaattcatatggatggggagctatatcagttgtagaagttctttttttccttaagttttctgtgtttgtcagtttagcctggtagtgatagactgatagatcctgatgatgtagctgtgtgttagtttgaacgattttctgtttttaagctttttgttcgatgccctggaactgtccaggcatgagtgaccttgtagaaactttcacatttcttttaatagaaatggaggggtattgcccttttgataaagaaaaagggatataatatgttgggctggtattcctgttgatttcaattattctttttatagggcaagcaagggttaaatatggtaaaggtcaagtagttgctttgttagctgtcgtgacttgaagcttatgattgattttttttgacgcaaatcgaaatattctgtttgacgcaatgattgatttgaaatgatgtgttttttagcaacaaattccttttcaaacttttgactttggtttttcgtgtattttctctacagatgcagtggaagatgattgaatgtcttcctggaacatgtgcaagaaattgttaatcatctgcacccctcaaggactgagtgttggttaaaagtagttgttccctgcctccctgggagttagggctttagtagagtttagcgttactagttctcaggaggaatgatgtccagtgcctttcgttaagagttgtgtagaaactgaggtggtcgagtaatcttctctgctgagcgttttcgttttttagctggagtacccagcctaaacttggtttccctttaaagctggcaatacaagctgactctgtttccgtttaaagctgccaatacaaagctgactccgttcaagttttcaaacccaattgggtttgaaaacttgaacatcgaacaactgaacatttgcatcatgattttagcagctatcagttggcatttgtggactgagtgagatgattttgtctttgaaaatatcctttttaaaccacctatgcaagtgatacattagatttcttttctacagcgatggaagtctttgcagagaggagaagaccggagcaggttagaagttagaacaactagttgaagaattcctgctaaagtattgcttcaaaaaaaaaaaaagaatcctgctgaagatgagagttgagacatgccgacgtgcggcccgtagatatctaatactactagttctcttttgtttagatcctactatttgagactgatgatgtctggacttgtgtgtggtactcccttcgtcccataaaaattgcatttctagctccaaggctttgtcccacaaaaattgtatttctagccatgtgaggcccaaccaattgattcatctatataagttttcttccatcccacataatttgggctgctaatgcttgtaattttattaagtatgctaattatatgtgttaattctctcaaattctttttaatcatttgtatatatggaatgtgtgcatgtagtgggttcattaaataaggttatcatggtcattttccaatcctactattttgtcctaaattagctagaaatgcaatttttatgggacggaggtagtaactggtttgatgctttggtagatgctagttaggaggtggtcttttgcaagggctgttcctttttcctttaggccttgttcacttaattcagggaggagatttattccgtacctcgatattgtagtatagaattattccccctcaatctcctccaaaccgaaaaaagcctcagaggtattcctcgaaatgacgtgtccacgtgtgtgtaactgtgtatgtctaaactctaaagcttgagtattcta

SEQ ID NO: 62426 - DNA, 1671 bp, Oryza sativa
  unsure (1)..(1671): unsure at all n locations
cgaggnatttgtannacctgatattgatcatcggcctcgccccnacnnnnnnnnnnnnnnnnnnnnnnnnnnnnnnntttttttaaatacaaactaatcccacacatgaacttttaaacagcttttctttacaaactaaccatgacactttgctttaaaatatttaaacagtttgccacgccagcaaaccgggcgtggcaagtaccgggcgtggcaaaactgccacattggcgcccggttgacgatttcaacagcaacgatcgccatggggcagctcttgccatgccatgaccattggtgccgccactctgtttggccacgccactgctattggcatagtcaaaaggtttagttttgaaaatatttttccgggtggtctcttaataaaattatatttttaaaaggtctaacttataaaaaaaatttcgtcatgatgtgaccggaactctaatgatctcgcgtgatatggtgattagcagcagaaggagctgggctcttacagcgatgtcaccctcccgttgctgcacatgacgccgtcccacccgccgccgcaggggtcgccggagttccagctcgacgggtagttcctccattgctgcatcagaccccgcagcgcgtcaactgccccaagaatatttctccaaggattagccgagagccaagcagtttttgcttttcgccggtagtgagtgctgagagatcaactcaccgtccactccattggtctcgcagaaccccgtcggcgttgtcgccgccagcagcaacggcggtgccggcccgcgccggcccgttcttgccattgcgcgctagagcgcgtgaggttggggaagacgaagaactcagggaagaagcggactagagagagagagagagcccacggcttgcgagagcccacgcgacgctgtatatactgggccggcccaccaaccagccgcgggggacgcgcgtgttgggaattttttttatttttaattttttttattaaaagttttacaaaaatagttttccattttgaaaattgacggaagtagtcgcctaccgccctctgggagggcgatttttaaaaatcaccatcccagagggcggcgaaaatgacgtggcagacggccgttcgctttcgggcgacggccgtcaacgaaatttgcaggcggcccccttgccgccctccgctagggcgattttgtactgtgcggggggccgcctgcaaatgggcggcgagggggcatggaattttgcaggcggcccccttgccgccctgggggagggcgatttttgcctcccccctataaagcccagtcccccctctctgaaatttcattatattcactaaaaatccaaaaaaaacgaaagagagagaggggagggcagcagaaggggagcggcgaagccctgctggttcgctcacttcatcacaggtttgctcccatacatcttttgcatttgtactaatatgttatgtttgagtatatatgttgcgttttagttttagttccatatattttagcatatctgtagcacacagcacatatgtgtagatccagagcatagaatataatagtatgaattgagacatagacagtagnnnnnnnnnnnnnnnnnnnnnnnnnnnnnnnnnnnnnnnnnnnnnnnnnnnnnnggtataggtatcaaaaggntacaaannncacccac

SEQ ID NO: 62427 - DNA, 5639 bp, Oryza sativa
tttgcagaactgcataagatttcattgtgtcaaatttagaaagaatatttcaaccaagtactgcacaaaagaacatagtcctgttgcataaaggaaaagatgaggggaaaaaggaactcacgtaaatactcggacaaaaacacggatgtagaaatccatagacacagagagaacaggcacaatatatcgtttgtatcgatttgcatgactctggtattgagaaatggaaaagataacaagaatcaagatacatgaaggatgaagcaatggaacttcagagtttatgggtcatttagcaaagcaaataattcaaacttaacacagttctcctgcgttttcgagaaaacttctaaaaacagattcttaaataggtattgaaatttgcacatcctttaataggaatatacttcatcttatgcagttttttaaaccaattatccagttatatattgatccaaactaataagttaactgagtgatataggtacctcaatactggcaaggaggattcgcaaagccatttcatggttatacttccctttggttggataggaaccatacctacaagaccgacttgatggttagaacaaaaaactagatttagatttttgcttcaaaccagtagtaatgtccatacttggagtggcaaacttcaccatttggcccacatagaaccgccatatcagtggcagtgcacattaatagcccaccatcagcaacagcctgtacagccgaatcaaggaaaatagaaggtgctccataggggtcaatatcaacctgaaaatgaggcaggtgtaagttgacatagaaagatacaaatggagtaactgtagtattcatcactttctaatgattaaaattcatttctttcaacttaataacatacaattgactgtttggcacaatcaacagtttgtcaataggggaaacaaatcgattaaaagggtaaagcatgaaaatctaccatttttatatagtaaaatgttgctaccaaaaacaatgctataaagatatcctcgtaactaccagaagagaaaggcttaccacatcaaactcttttggatgtgtgagcatataaactcgagcatcagtcaaatgaggctcgatcttactcatagcagaagcaccattaaactttatattccgcttgcaagcttcaatacaagctgaaaaggaagaacccacacagtataatgaatacaagcagagaagcatcattatttagaaaggaaaccagttcagaaaattgggccattacctttatcaatgtccagagcgaccaccttttctaacacgtctatttcacgagcataacggatagatctcaacccagaagcagccaaagcctgcatttagttttgttagccggtaaaaactgaaaaactattacatatcaggtcaggcaacattagtatggaaccgtaaaactgatgtaaacataacacagtaatgatttttttattgtcaaaactgcataacgtattatgacttgcagcacatagaaccaaatattatggtcctcaggttgcaaaatatcccagccctatttaaaattcgaacaatataacattcagagtacatatttaactaaaagtccaaactttcatgtcagagtgttttatgtatttttttaaatattgaattcttgattaagatgattaatttaactcttaattaatttgctaaaattaactgagatttgaacgaagggtggggctctatgaaacccgtagaccataaacctgggattatgtgccacaactcataatatccttgtttttctggaatgtcaaccattaaacctgcatttttttagatttactctatactattcatactatatgtctcacctcaagaacaactggtgccttaagctctctggctactttccgcgaaggtgtctttgttgcttctgttgacagatcttctgtttcatccgcaactttatttgtttccttttcagcatcaacatccatttcatcatgctgtcctgttgacccattctctccatttggaccagatgatttactctggctcactttgttatgcgccttgtccctcttatccatcattgccttatgttcttcctcacgcttggcaatgaaagtccttaaaagagcaactgacatatctctattgtggacctaatcaagcaataaaattgaattacagaaaagcacagtagctgataggagattagacataattttaggccaaatataattactctgcaacttttaaaagcgatagatacaggaaatattaactatgaataaactcatagtaatttgccgatgatatcacattcccataaccaccctttactcaattcctccatagcaaaagttcaggctgttagtgacttgaaaaagttatggctagagatactaattgttgagaatgcagcataaacaagcccgagtggctgttttgaagcttcacatatattctcctagcaactgcaagtctacaaccttaaactgattataacgtgtcgtgatgcgctaacacaaatgaccaacacaatgcaaacaagtcgtaaagaaaagcaaagcaactagtactctagtggctacaccagagaccactcacttgaaacgacccaatcacatacaaatcaaatagccaaaacccaaacttatagtcctacctatgcacgattggtgaagctcgcagctcacaccattcgatcaattcgaaacaaaccaaccactaatgatgcacgtattctaagaagatagaggagccgacaaatccatcatacagcatcaaataacccccaaaaaaatcgcatacagaacatatacacaacaatacctgcacgggattgtagaacacttcatttgctgctattttcttgttgatgatgatctccgcctcgccttccctcacaatctcatagtcctttagcttgttctccacatcctccatctctccgaatccaatccaatccaacaaaaacctcccgattcaagcgacctaacgagagacgcagaccgtaaagcataaggcgtgggcagagatagatgaggaaggaggagcgtgagaacggatgctcaccaccagatagacctctgatgcagcgggaggacgccggcgaagataggcggtgctcggcgcagaaggcggggcgagctcgcgaagaagagacggggaggggagtctatgccgaggcgacggcggcgtcgaactagggtatagggtagagaggaaggaaggagacaggatgggcccaattatgatgtgccgtgatcactatgggctttttgtatgaattaagttcactttaggtcccttcgtttatcgcctagtctaaaattcatcccacatgtcaatggtcagcactttcttcctcctctcttgccacctatcttcctctctctttccatcttcaggacgccgcctagcaagtggcgtggagagcgcgtggtggacgacgtggagaggggctgcgagagcgccacccctgctccaccttcctttctggcttgcacacgactggtgttcgactggtttgctatgataggctctcctagcttgcacttcgccccaatagcacggacatgttgccaaatgctataatcagcataaccagcaccccacacatacatcacacaatcaaagacgcgtactttttgggaataaatcagaaggatcactcggatcacaacgtttcaactagtagtaaacaagaggaggaggagagatataaaaggcacacctttaggacggaggttggccttattccctcgggacttgaacacggggcgatgattttgggaagcaagtctccgtgagcctgctaaagatggctagtccccagggccgctgctcgcgaggtggcggcggtggcggtggagaatgggcgaagcccgatcaaatctattacttgataaatagctatgcaaggacaaagagagagaggagaagcatgacgtgtggcgcctcggaggagaaccccccaccgtcaccgaagtcatcgaggatagtggcaatataatacggctcgtcggagagcttcgaggaacaccatgggggaaaagatcctacaaggtttgggtggtctagggtttttttggaagagtgagaagaaaaatgagctaaagtgggggcagcctgcgcccctatcctggcaatcgccaccaccaccaccgccgtatctactagcctgcgcggtcacctcgctctagctgttcctctccgctcctcctacccctcggacggatgccttggggctcgggcttagggctgtcaacgagccgagctcgagcgagctcgtctgcccaagctcgagctcggctaccgagctcggtcataagtagtataatatatattttaatgataattttttgataagtataattattttctagttaatcacactaataaaagagtagaaaatgattaaaataaatatattatgctaacacatgctaatttattgtgtaaatagatactaatatatatatatatttacctattagtttattatatcaataaggtgaacatgcaatatgaactataaatagtcaagctcggccaggctcggcaaaagctcgagctcggctcggtaaagctcgcgagcttttgctcaggctcgggttcggctcgtttgaagctcgagccgagctcgaatcgagcctaggacgagccaagctcgagctgctcgcgagcctcgagcttttttgacagccctcccgggctctcctcgagcgggggtcgctaccagcaccgttgttgagaggggagaaggacgaggaagagagggaagaggtggatgctgatacgtggggctcacaggggtcccacgttgacttagcatagctaattggagtcaaagcgccaagtaggacgaaatcaagaactatattgccttgggacgaaagttgatacggatttgcgagttcgggacggtctatacatgctactgtggtttaagacgaattttagtctgggcgacaaattaggggaccaaaagtgaacttatttctctttagccgtcagaattgactacggcccaatagacccaatagcccaacaggaaacacattctgaacagcccgttaacccctaacccttccacgctgtcttctccactcccaccgccggcctcccaacccgccgccggcgacgattccggcgagatacctggtcggcggacaccggctcccgcgggtacgagccttctctagacgggctgcgtctctgtccatctcttcttcttctccaacatgaggcccctcgcgatacggcggcgggaggcgcggctcctcccacccctcgccgtcctcgtccggtccatggcgtacgtggacgtgaagatgcgatggaagaaggacgcctccttcgacgccgtccccgtgctgtcccaggcgcgggacctccgcccgctcgtgtccctcgccggcctcctctcgccgtcgccgacccccgtctccgcggtctccaagcttcgcatcccgctcgaggtccccgaccgccgcgtcatctccttcctgcggcggttccccgccgccttcgtggagtccgtcgggccggagcacaaccacccctggttccgcctctcgggctccgccgccggcctcctgcaggaggagcgggaggtcttcaccgcgcggcgcgcggacatcacctcccgc

SEQ ID NO: 62428 - DNA, 9554 bp, Oryza sativa
gtggaggacggatctagagccaggcggtcggaggtggcgcccgtcagttgggggatggaggtggcccccggcggtcggggatggaggccgcggcgccgccgttcacctcctcctcgcctcctcaccgctgcgtcgagccgccgcaccgcagcaccgccgcgcgccgttgagaactccacgccgctgccacttcaagaaaaaccggattgagaaataagagaagggagaggaggggagaaagaagggggaggaggatgggggtactgccgccgccgctcgcagccacgcgccgccgcaccacctcgccgcttcacctccgcaccgccgccgctgctgccacgcaccgctgagccgttgccgccacgcgccgccgcaccacctcgccgcttcgcctccgcaccaccgccgccaccacgtattgctgagccgccgtccagcgccgccttgcccgagggcgtcgggtcctccgccgccgtcgcaagagcggcgtcgcccgaggcattttttttcgcggtggagaaaatgtgtggataagggagagagagagagtgtgagggagagaggagatatacatattagtctgacctagtcaagtccccacccacacctgtgacgggcctagtgaccggaccgtttgaggtgagttaacctcacctttgacggtttataatcatgcaacccgtcacaggtaactagtcacgggccagaagtggaagccgtcagaggtgtaactagttatctgtgacgggttgcagaaggatgcctcactgatgacggcatcctgtaagaaccgtcaaagatgaccctcatcactgacgagtgctaaagtccgtcacagatatgccgttaaaggtgtgaggatctggtgtagtgaacctcttccactacgatgtgagctcacattacccggcctcttcctctccttcccacccccagatctacgtgtactccatgcatgccgtttactactgtgctcccgtggattttggatctgtttaatttacctctgtatgggtgtgtgtatgcacggattttggatgctttttgtttccttgtgtcgttgcaagttcgtttctctgattctttcatttgcagttttgtatggagcgtggcttccaatctcatccagttcgtgggtgtttggtcggagcgtcgcgtttcctttcttgcataaagtttctggtccgttttttgatccttccctttttgtttggtcttttccacttcggtgctcgctgctagtttggtgctagagatctggctgatgtcgagagaaatctcgtggccgcagcacacgcagctcaccattcgaacttcgaatcgaagccttccgttgtgttcgtttcggtgacatgcatgcacatgtactacgcataaagcatatcatgtgctcaacgcccggcctacatgcatgtcgtcgttttcttgagaacgttggtgctgtgttttggaaatgctgatttcgtacaagggtcggcctgatctctccctcgtgagagctagttcgggtctttccctctgcaagcaaaggtctgctcggttcagtgcttttgcatctcgttttgtgctgctttacaagttattatgtttcttttgtgtgtgagagatggaagaagacgacgaagcccctctgtgcccgttcactacctctcggtttgacttttttttttgttgttttttggagactgctctttttgtgtaagcggatgtgttcgcgcgagcttctagctgctttcttgtaagaacatgctaatctgttcttcatgtaattaagcgaagcctttgcgtgaacttttacatcaagtcgtcgtcactgaacgcctggtagattccctttttctgatcttcggcaaacactccatccgaaagattgtcgctggaatggttgcagaaatagagtggtgatccacttttaaaatatctgtgaatacatatgtggcttttggttctgtgttttctgcttttttttttggagtagctatatttatggcaccatatttttcaccaaaaaatagtcagcatatatttacattgtaagtccctaaattatatatgtaattatagtgtaagtgctatataagtgccgtgtaagtgaataaattacatatgtaattatagtgtaagtgccgtgtaagtgaatgtaagtgggtggtaattagtgtataagtactttaaaattcaatattaatttgttttggcaataaagtgaatggcaataccgtgctcggttggttaggagctctgtctgcgacttcgaaggtctgggttcgactctccgtcacggcgccttatggcgacatatttttagcaaatctattttttttggcattttttttttgaaaattttaattgttgtctttgtcgggatctcgttcttttttattccatgcgaaaaaaaaccagtcgtgttcaacagtaagacatcgagttatagacttgttccgatgattttttttttgtccaataacgtttttcagtccctttctatgtttttgggctttcgaagatgtcgatttctgatttctgagctgtggcccagtttatgtgggcttttgtgggccttagaagaccctatatcatccatccttcatgttctaacctagctataatcttcaactctcactatccattcttccctccccattattcctcaacgcttcgccggcgattcccctctagactctagcgttcgccatggatgcccgccccatgtaagtgtcgtaccccgtagtatagcagcgtagttctacctctatcgtgatttgaatggagaagatcaacctctatcaccttttttttgttgtttgatttctgttggtccttgatttaggtttcgttacttttgggcattcagttttttttggtggttttcgcctacattgatttccacaatcaataggctctgatctgaacgaaacacactgaattttgagtagtttggtgtgttagtgatggctaactgctctgatctaaaattactttgttattatgtgatgttcatctgtcgagttcttcttattttgccctaagatcttctctgtaaaaaaaaaaaatctgcccctcatgtcctatagaaaggctgtttatcttccttttggattatgttacaggtttcaatcaatcctgagtcaaaatcaagagcaacaaatagggaagtactcaatgagctcatcaagttgcatgggaagacatctcttggtggcaaattgcctgcttatgatggaagaaaaagtctctatactgctggttcactcccttttgaatcggaggagtttgtggttaagctaattgatcccgaaaagaaggataaagaaaggtttgtatgatgctagctagatattttcgttcttatgaattatgtgttttgtagtctcaggttattgtttattgtcttctgcagggcggagagggagtacaagatcacaattcggattgctggcagaacagacttctaccacctccagcagtttttgcttggaagacagagggatatgccccaagaaaccattcaagtcagtcattgatgttgtcctcaggtagtcgccatcttggaagtatgatttttttgttgtgtttgttttgacttttgcttgattatttactgactagggtactaataatgctgtattgacaactacttgttctgcagttatgtcacagtgtccagatccttcttctctacccagtttggtcaccggggtgacattggtgagggacttgagtgttggagaggttactatcagagcctgcgcccaacacagatgggcctttcgctgaatataggtacttacctgtcagttattgtttatcagttttcgctgaatggaagtgatcttttcagatactaactactgttcggtatgcttcattcagatatatctgcaacatcattttttaagcctgtgacagtgatccaatttgtggaggagttcctgaacatacgtgacacctcaagacctttgtcagaccgggatcgtgtgaaggtaatattcctactgatggaattcataaaattatgcaatactgatactaactcatttttcatgatgttcagataaagaaagcattacgtggggttcgcattgaaacaaaccaccaagaggaccaaatcagaagatacaaaataacagggattacccccattcctatgagccagctgatgtacttatctttcctctgcttctgctataattatctttttgtttacatgctgtaagatacagcaaatcaatgtagattgttgatggaatatttgaaatgtctttgtttatggatcttgggcatggtagtacattaattgtttgtggacttgtgatagaaacattttaatccttttcaaaggtttatgccttagatatcaatttatgcgcctttgatatccatactgtcaatgttgttaaatgtccttcaatgtgcctttgatatctataaatgctgttaaatgtccttcaatgttctaaattgatgtgtaaaggatgattgcacactgtcctgagaatagcagtgctttgtcatccttttttaggacctgcattttgttatcatgcttgttcactgttttatagcatgaacataacttgtttttctccaaactgatgcctggtttgatgttgttagatttcctgttgatgataatgggacaaggaagactgttgttcagtacttctgggataggtacaattacagactgaagtatgcttcttggccctgcctacagtctggcagtgattctcgtcctgtatacttgcctatggaggtattgattcatcatccatttacctctacctgaattgtgcatgctgtgtgcagtttgttcatgcaaatgtggttgcaggtgtgcaagattgtagaagggcagaggtactccaagaagcttaacaacaaacaggtgaccaacatccttagagcaacctgtcaacgcccccagcagagggaacagagaattcatgaggtacaataccatgtagatgcagagccaaatttttatgcttttggattttggctcacatttgaatgaccttctatttctgcacattttcttagaataacatatccgtagaacataaggctattttttttcttgatgagataatgaagataatatcatatatttgtattgacttccatttcatcttctatcagatggttctccacaacaagtatacagatgataggtttgctcaggagttcggcatcaaggtctgcaatgacctagtctctgttccagcccgtgtgctgcctccacccatggtactatataggttttattccatttcttttgttcgcattgtttaaacttctgggaatttctaacaaccttaatctttgcgcttttcagttgaagtatcatgattctggaagggagaaaacttgtgcacccagtgttggacagtggaacatgattaacaaggtgatgccttgctttattattacaactcaatttctctctcaagttaattttgtattgcctttgtttgaaagtgaattctaggtacacttgcttaacttctttatgaattgttcattagctttattttttgttggagagtatctgaaattgacaagccggtactgaaacataatttcagaacctgtaaagatacaactacttagccaacataatttactttctgatgtgtttaaaggaagactctaatacttgttaattttttcagaaaatgatcaatggaggaactgtggataactggacatgtctgagtttttcacgaatgcgtccagaggaggtacaaaggttctgtggtgacctgattcagatgtgcaatgccactggaatggtaactcctgcatagttacaatgctattaaagcagtttaataattatatgtgctgcaattaactttgacttgaccttgtagtctttcaatccaagaccagttgtggatgtccggtcatcaaatcctaacaatatagagaatgctctgagggatgttcacagcagaacatcagaactgctagccagagagggaaagggaggcctgcagcttttaattgtaattctgcttgaagttagtggttcttatggtatgtatattgttggttgggtaatctaaatttccattccctgattttttttattaaatgtagtatatgcatgatttttacagggaaaattaaaagggtatgtgagaatgaccttggcattgtatctcaatgttgtttgccaaggcatgccagcaggccgaacaagcaatatttggaaaatgttgcactcaaaatcaatgtcaaggtctgtaaatctgctgggcttgtatttttttccccttgaagataccaattctgtggactttatcttgtgtgcttttagtgttctcccccagaaatatgacaattctgtgccataaccaggtcggagggcgcaacactgttcttgagcgagcctttatccgcaatggcataccatttgtgtcagaagtcccaacaatcatctttggtgctgatgtcacacactccacctggagaggactctgcatcatctattgctgcggttagtacattcctagctaatggttcttcaattcattacttggtctatttgatgctgtcctacaatataagatcatgggctatcctgtgcataacttgatgcaatagatgaactatctttttcttcccaaagtttattgcttcgcagatgcaaactttactggtattattttctttgtgatcatgtaggttgtggcatcaatggattggcctgaaatcaccaaataccgaggtctggtctctgctcaatcacatagacaggagataatagaagatctctttagtgttggtaaagatccagtgaaggttgtaaatggtgggatgatcaggtaaaatttgtggttaatctggtattgcaattgtatattatcgtaggttcatctgggaactgaccattatgctcttgtttacagggagttccttatcgcattccgcaagaagactggcagaaggcctgagaggataatcttctataggtatgtcctgcaaattctgttctgttcagtgatatgtccagttaaatgaaatttgttgagtggtcattctcctctacagagatggtgtaagtgaaggtcagttcagccgtgtgcttcttcatgaaatggatgccatcagaaaggtgagcttcgcatcatgataaatctgtctgtgttatctattctggacaagccaatttcattgttttttctgagtttaatccttttacattgcaaggcttgtgcatctttggaggagggatatctaccacctgtcacatttgtagtagtccagaaaaggcatcacacaaggcttttcccagaggttcatgggaggcgagacatgactgacaagagcggaaacatccttcctggtcagtgttcttgttggttgctactgagaacatacgtctgctacttcttcaggcatttgataattggatatattgttgtaatctgtttctttttggtcctgcaggaactgtcaaggaccgccagatttgccatcctacagagttctatttctacctgtgtagccatgctggcatacaggtaaacccatgctggaagctgtttgcagattgcacaaatttttccagcctacaaaattttcagttaatgtgtgctgttgacattccttttctcagggtactagcaggccaactcattaccatgtcctttatgatgagaaccattttacagctgatgaacttcagaccctgaccaacaatctttgctatatgtaagttcatttctctctatctccacttagttgcttagctcccttagtctttcggctgcctcaactctgataattcctactgttggcaaaatgcagctatgcacgatgcacccatgcagtgtctgtgggtgagtcttcttttcttgcatctttgtttctttttatttctgcatcttcgtagatatgctaccttaacagatgtatacactagtttctgtgaatggttttactgtgaattggactaatcttattagcatattattctcaacaatacagattcttatttagcatgtttgaaattgggtctttgtttactttaatgcactcaatccatcatgtgatatgcttttaacgagaagtgcactactgtcatcttgttatgcgccaccaatgcgtgcggctcattagctcagcccaggtgctgaaggaaacacgacctaaggaactacagaaatattttctttactttgttttcctcgctgctaatgcaccatcgatgtcatcatgttagctgttgctcaacatttgcttttcaaatccattgcattcatatcctagcctcgtctttgtgatgctcccatattactctctggaactagcaaatgaactatagaagaaatattttctttcccttgtttttttcgctgctgattgagtgcttctttttctttctgtgcagtcccaccggcctattattctcatcttgctgcatcacatgcacactgctgcattaaaggacatagttcaggtagtggctcaacccctggcaatgagcatgacatagttaaaaattctgctccaacactccaggtaactaagggactgttttcctatgtagtattttttttttactttaattcatttgggatgcatacatatatttcagttaaaagagtgactaaccagggaactaaatttcatgcctcacagatccttgtcaaagtgctggacttccaaatagttccactgacaatgaaactgaagtcttcagctgaagacattgtagctttagctctatcaaaacatcgcgtctctctgcatgatgtctatgtctaccatggtaggcgagttattgccaagagcttgactcttgaatctttaaaagcagacagggattcaacttttcttataatgccacgtatgaggggtggatgcaatgatacgtaagtatattttctttcatctattgcaataattatttttttacttttgaattttgttctcttatgatagataaattttaaaatgtaggattggcggtttcaagtgcattcctttagaacaacatatcagatcattaggtgattccctttttgaaatcatatggataccaccagatctgcgagtgagcgggttctgttcatatcttatcatacttggaaaaccagcaagaaaaatcatctgccaacttttaaagttgttggagattatccatgctgccaacagatttgcttccaggtttacaatagctgatctggtgttcctccctgatctgggttgtatagcttttaagaaaggagtaaaaataaggtggaacctcaggagagaggagtacaaactcaacatgggtgatgtagctagcataattagctgctggttcaggtttaaccgcaggaagcttgaagcgctggaagcagggatccatgagcttcgtcctggccaaggtgactctccaatgtttgttgatatattagttaagatcttagaagccccacacatgagactggtctcagtgccaattatagaggtttctacaaaaattgtagtgctctgagatcttgttcggcccacatgaatttgttcacctctttggacatttgtaaggacttcat

SEQ ID NO: 62429 - DNA, 691 bp, Oryza sativa
  unsure (1)..(691): unsure at all n locations
cggtggatgatggatctatnnnnnnnnnnnnnnnnnnnnnnnnnnnnnnnnnnnnnnnnnnnnnnnnnnnnnnnnncaagagcaagatgcaaaccgttcagtccaaaagctggtctccttctaaactctaacaagataaagatttttttttcttcggtactcgttagcacgcttctcaaactgttaaaaagtagtgtgcttcgtacgaaaattttctatatataagttgctataaaaaacaaataaatccatttttcaaacttttaataattacgattcaattaattatgtgctaatgacttgtctcgtttttcgtgcgcgattaatccttgtagggtgatgctaatgactaagccgagaagatgatgctgaccatgtccgtcgtcatggatggtggttgagcgaaactttcggcgaggggagaggaggaggagccagcctcatgatgatcagcctgcttgcagatatcatccttagctcatatgcagctgagctggtgcgagtgagtgcttggccggcgaggcggcgacgtcggtccgtagtattctggaaaggaacaaggcaccaaacgccctttttttttttttgcagaaggtgatcctgatcaacggcgagttcccgggcccgcggatcaactgctggtncaacaacacatcgggtgaacgtgttcaccagcttgacgagccgaagt

SEQ ID NO: 62430 - DNA, 767 bp, Oryza sativa
  unsure (1)..(767): unsure at all n locations
cggagatactgttcgcagtagttcatcaggctcgtcgaaggggaaatcgaaaggcggcggaggtggagacgacgaagacggcggcggcggcggcggcaaagcggacctgcgcgccgtgtcgaagagcatcaagatgatgtgcgcgcagacggacttcgcggactcttgcgccacgagcatcggcaaggcggcgaacgccagcgtgtcgtcgcccaaggacattatccgcaccgccgtggacgtgatcggcggcgctgatntttttnnttttttttcttnntttttggtntttttnttntnnttcccncttgtncttntnccttttttttccnctcccnctattcttctctttctttcccccccccctttttcttttgtttttcctctccctttcatcttttcnctgtgtgctcctcttcctttctctcttcgtcctttttttactgggttttcncccggccgttgaattccattagccggtatcccgccgacactagccaggcagtcgtttcaattattacagtcccaacacaacaaccgggcggatagattgatatgcgttccaatgatccccaaggggggccttttatggatctggaatcctggggcattgttcatatatcgacaagggaaaaaatggcccaaagggagggggagatgtttaaaatagcccctattgtgtgagaggcgcctccatgccctgcatgtctgatgatgcacactgatactttgaaacaaagcaacttgttacgctagtgttattgctt

SEQ ID NO: 62431 - DNA, 2185 bp, Oryza sativa
  unsure (1)..(2185): unsure at all n locations
ttgtgagctcgggatctgtccacagcccaacatgactgtactcctactctataataaagagacctctgttgctgtgatattctatcctcctgtgataccagcactgtttcctgggactggtatcgattaacaggttaatttggagcgtcacgggctaattccagtcgggactagctcggggcgtgacatagagtatactcatgtctcttgttatatttttaatacaatgtaattattttaggtgtgtcgaccgagtttttctctcttttattaaaacaatgtattgtctttttcgtgctaaaaaattcctacaattttttaaatttgaaagtgtggacaaagagggcagctgggcctcacagttaaccacatttaagacgcacgcacagaaaagatcttcttcaacattgcatcatccaccctgtcgattgaatgctgaaaacaacaattccagcttgggcataattacaggatttcaaacttactttattaagtacattgttttgtaatggcaactaacccgatatgtacattggccgttgaaaaccacacatccacaaatctaataaaacgcaattaaacatcatcctgtcgtacattcagcgtgattataaaataatgcaaagaggctgatatttttaacctgatgatgatcagatcacattacgagcactgcatgaaccatcaaaaagatcatcttgaattagtcagggtatcagagaaagccaggttacggatggctatataggacaaattaacacggcgataattacatagtgcgacgcatgcttttgcacatgattctctaaagaagaagaagaaaaagaaatgctcagcgatgccatcggctaagctaataatatagttaatctaactaatttttggctaacactatagtctaattattaatcattggtgatctggtgtgactcgaccagagcatttttcggttgcatccgacgtagatccttcggctggtagctgatcgtaactagtaggtgtagtacatgttcgatcgatatctgtacttgttttttttcagaggaaagaaagtgagatccagctaactagtattatagtacttttaaaagtattttttatatatatgctatcagtttgttagcttttgcttgttgctaaattaaattattgtagcctgtaatggggaaaattattagcatttatttacaggttgtttatttgtgcagatcaattggtgttcttgtcctgcagacagatcaaatgattttttttatgagagaataattgattagtttaatttgctacggcagatcttcctcttaagaaaaattgacctcattatcatttctttaatataagtcccataatacaatctttgaagaatcaatattactaactatataaccaatcattagatattctcttatcattagtgtatatgcagaaaaatgtacagattacctgctagctgaatagatggcaacgttatcagccgtatcaggcaaaaataattccatcatgggggtttgatgaattggtcaggaactttgaagggaatttagtatttttcctaaaccccaaatgaaagtgattaaatgatgttctaagtcaatttatcacgtccatatccaggactaaataaactgatcttgcaccgatgttccagagcattctccttacctgggctctgaaactctgaaggtagttgggatatttgccatgacttctgaccttctgtcctgttgatgttgccccggcccttccccgttagcttcttcgttttcgatgaagatgtaaacaagttggctgacttagcagttgacacaatcattaaccattaacctcttgttcttggctgctctctgaatggtatcaaaattttttagacggtttataactttatatgatgtcaatcacatggttcttgaaaaccagcggttaccggccggtaaccgtccggagttgacgatcagttcgagcaagtgaccaaaaggatatggttgtttttaaaattgaattaagaactattttgtccaaataaaaaaaactgaatttaaatttctatcatgtaaaatccggtaaacggccgttacaagatttgacagagtccgataatcatggacaaacaggtttcaannnnnnnnnnnnnnnnnnnnnnnnnnnnnnnnnnnnngccacgagcactatcaatnnnnanccatac

SEQ ID NO: 62432 - DNA, 5639 bp, Oryza sativa
  unsure (1)..(5639): unsure at all n locations
cggttgaanngtgantcggcttcgtctgcaagtagctcatcatggttcgctccgccgctcgccgccgccgtccgccgtcctttcgcggccggatcgtcgtctaccttccgccggcccgcgtggcagccacgtaggcaccacgtcggcgccagctcagcccagaccgggtcgggccaaccccggtcggtctctccgtgtgcgcgcgttccaccgcgagccgtgaggctgcgcgtgggcccgccgcatccgcgtccaccgcaaaccgcgcgcgtgcaccgggtcccaaccccgcccgcgcgcgtgcaccgcgtgctccctccgcacggtgagccgagccgctgacaagcgggtcccacccgggaccgcgcgcggtgagtccggtccaccggtcccctctctcctccccttccgcgcgcgctctgggccgccttttgggccggccggcccattaagctcggccgagccgccccaaatcccttgggccgcaccctagccgcccgaggaaagtctaaatttcctctctcctttcttttcttttcttttccaaaaaggatttaattaaatccgtttcctttaggccaaaaattcaataatcttagaaattcaataccttcccaaccgtaaatccgttgactccgttcaacttccaaaattccctaaatctcgagatctatctaatggcacgcttagaggtcattaatagggccttatttttttcgccgtttgttgagttgtcccgtttcgcgtgtagtttcggaacccgaagacccgcagtgcgaggatttcgaggatcaagctccggatctcgagcaaggcaagccacctttgaacatcttgagcctatatttgaaatttaattatgttgcttgctaaatattatgcattgataggatcgcacttaatctgtttgtcccgtctgcaaggcagattggcggacctacctaatttgtcgcatttgatccttcctttgttaattgctataccatgtccccttgtaaccacccagttgcgcctcgatactcgtgcaccctgtgcaagtatcgacggtcgccttcaaacttaaaatctgagtaacaacttgggtaaaattggagttttacaaaaagacttggaaaacccgacacctgggtcggtgcttgcgaactaaatgaatttctaaaaccgcggaccgggaacgtacgggtgtacggttttcccgctcccgcacttaaggaccgattccttggaatttcatccgaacataagacaagtacgaccacataggtggaatgggacacccctggctgagtaactagcttatcaggggagccatgatgtcgagagacatgtggattcgccggggtggtgtcggagaggacccccctgggcttcctggcacagtatggtctgggacctaacctgttgttggtctagaacccctctcgtcggcatatggtaagcctgtgtcagctttggaaatgccttgtcatgaaagcttggaggtctcccgacgtggctgatccccacgggctgggtgatccgggttagtaatgtcgtgtgggtaaagtgtaccccctctgcagagattaacaaactgttcgaacagccgtgcccacggtcatgggcggatgtgaggtgattcctagcgtagttttgtttgactactgcttgtgaaattactgtgtgaaaaggggttcggtgtttgaaaaatctgcagctgatgggatcagctaggcccgggtggccgtttgaaaagttgttggcccgggtggccgttgaaaaagctgttggccgggtgccaaccttgtttaaattctaaagactgatacattgcacatactccgaccggacgagacgcactgtctcaaccgtgtcgtttgagaagcactcacctagatgtttttagaaaagagttcaaataaaatcaattacgaaaacaacagcctttccttgaagcctgcattaaacacttatttcccctggcttgctgagtactcccgtactcacccttgctctatataaatattccccccagttgctgatgaagatgaagcggatcctgctgatgaggagttcttccaggagcaagccggttacgatgagttttagggtttcggcctagttcccaagtcgcgcctgtgttgtttggtccaagtcccggcttccgtttcccttttgtaatgcagttgtgagctcgggatctgtccgcagcccaacatgactgtactcctactctataataaagagacctctgttgctgtgatattctatcttcctgtgataccagcactgtttcctgggactggtatcgattaacaggttaatttggagcgtcacgggctaattccagtcgggactagctcggggcgtgacaagagatggtattagagcacaggcttggccctagggcgaaacccgacgcttaggacgaccctaaggatactatgttcaaaaactacttgcgaaaagctaaggtgtcttttgttttctttatttttttcaatagtttgtttctaaaatggttactgatctttctccctctttcaaaattgtagatggcagtgaacgccagcttcagttcccacggttttggtgagggtcaccacgtcgctcagcttcgtgacctcgcccgtttccttggcttctcgtgtcccgagtacacggggtactccgtggaccgtgttccccctcactgtgagctctctgtgtacctttacccccgtggaggtatacacggagctggccttcgcccccaccacttcactgtggccaggcccactctccagatcgcgtaccaggacctctcctggactgcgctttgtcgcctggcccacgactacagccaccgtctcggaggttccgccttccggcagcttccacgccttccttctggccactcagacgccaggtacccttgtccgtacagcgagtctcagccagtgctgactcgcatggttgagctctcggaggctcaggccactcagcacgacctactccttgaggcttaccgctcccttgcccgccgctacgccgctttggaggcccgtttggccgaggagggtgtcacctcagttgacactatctcttgggactcagcccgcctctgccacgccagccacctgtcctcccacagctcccgcggctctgcccgcaccccagcggaccgcgctcccccagctcgcgtgcgccgtactcaccagtgtactccccctacccacacccagttagcccttcctacaccccgggacacaccccagttgcttcctcccgccgtggcccacgctttatccgcaccgcgcgcaagcgtgttgttggttcttccaccgtgttccgtttccgccacccagctcccccaccgccagcggcccgtgctgctgccggccctcgacaggttctgccggtcccttcgcgccagccgatcgacgtttcttcgactgaggagccgactacaggaggcagccaggccgacgaggagtagaggaggcagtcttcagcagccgtccgtgtgataggcccttttgttccgccgccaactcttttggagtcgtggcgaggtagtgcgtgcgtgtgtttgttgtgggtgttgtttggtagtctggttctcctaggtggtgtgcgcacagtcaagctcggtgtagctctgtgacttgtccacacccgttgtatcaggtgtttttatgatttgaaaaatccagtttatgcctagtgtgtgctatctgagttgctattactttgctccttgccctcctaagtgcttatctgactcttaccccgcccttttctgggagtttagatggctagccgcccccgccgtgcagctcgtgcaccagcccgctttggttttgaagatggtagagttgaagcagaagcaaatcatgaatcagctaatgagcagtctcaccacagcaaccgttcgcaccgtactatttcccgcaacgcagaggttgagcaaccccgccgcagcaaccgctcgcatcgcacagcttcccgtgatgcagagatggaacagtctcaccgctctcaccgcactgccagtcacaattctggagaagaacgcctcccttccccacctcatgtggaaaacaacatgcaacacttaatggcagttcagacacaaatcttgcaaggaatagccgcagccgtagccggttatcagcataatgcgcatggaaatggccaccctcacatgggcaacaatagatccaagctgacagattttctgaggtcacgtccgccagagttctctcagaccgtcgagcccgtcgaggctgacgattggttgaaagatgttaatagaaaactcaacttagtgcagtgtactccggtcgagaagacgctctacgcctctcaccagctaagaggacctgctgcagattggtgggagaattactgcaatgcacaccctgaacccactaacattgcttgggatgagtttgctacggctttctgtgcagctcatgtgcctgaaagcaccattgacatgaagaaagaggaattcaacagacttaagcaaggcaacagcagtgtcaatgagtacctaagtatgttcaacaagttggctcggtacgcccctgaggaagtggactcagataagaagaagatcaggaaattcttgaaaggaatcgcagttggaatgagactccagttgctagcgcatgacttccccacttttcaacatatgatcaacaaggcacttctacttgaggatgccagaaaagaggctaccgaagaatacaagaaacgcaaatctaaccaccaggggaattcctcccaaggcgcacctcgccctcgctacggtcaacccatgcaataccaccagtcggtcactcaggctaaccgccagccaggctacgcccctcgtcctcagatgaaccgcccggcaccccagccacagcagcgtgcccctagtggcaatattgcgccaaacagtgttacctctttcaagtcaccgcagggaccgtcagcagttcagtgtttccggtgcaaccagatgggtcactatgccagacaatgccctcagaatcctaccaacaccaactcagggcatgctaatggcagcactgccagaactcctactccagcggcagctcagtctcgtcctagcactcaagcaagtggacaaggttcacgtgcttccaaccactttggtcgaggccgtgtgaatcacattcaagctgaaaccgctcaggatgctccagacgttgtgatgggtatgttctctgtcaactccgtacccgcaatagttctgtttgattcgggagcttcccattctttcatatcacaagcttttgtgaaaagaaatggttggaaaacccaaaatttacgtgtaccaatgatagtacattcccctggaaggaatataagggcaactcaaatatgcccggaagttaaccttagaattgaggaaattgacttcctagccaaaccgatagtcctagactcgcaaagcttggacaacatcctaggaatggattggttggctaagcacaaaggacagatagattgtgccgaaaagtccatcaccttgcaaggacctggaggaaagcaagtcccctttacccctaacacttctaccgcaagttggtctatcttaacctgtttacaagtcacctccttggagtcggtgcccatagtttgtgaatatcccgacgtattttcgg

SEQ ID NO: 62433 - DNA, 1418 bp, Oryza sativa
  unsure (1)..(1418): unsure at all n locations
ggagagatgagaagttagttatgataaatgagagtgaggggatgtatagaaaaggagtaaaatagtagatagaaagaaggattgataatgttaagaagaagaagaattagnggaaagaaggatagaaagtaaaaaaagataggaaagtaatgtataagaaagagaatagtagagaaaaaagggaaaggagagagaaggaggaggaagnaaagaagagaagggagaaagagagaagaagaagatagaaaagaaaggagaaaaaagagaaaagagaaggagaagaaagaaaggaaagaggnaaaaaaaaaagaaagagggaaggagaaagagaaaaaaagtaaanaaaagaaanaaagnaaaataaanananaannnnnnnnnnnnnnnnacatccccggtcacatctcctcctagcttgattctttttgggacggagagagtacctcataactatatccaacctaaaaaaattcttagtccagatacattgtaataggttgtgtctaaccatctcctaagttaccatatttcgggacagagggagtatactttggctgagtttagttccaaattttttcttcaaacttccaacttttccatcacatcaaaactttcttacacacataaatttccaacttttccgtcatatcgttccaatttcaatcaaacttccaattttagtgtgaactaaacacaccctttaagacaaatatagtagtaagtatcatgatcattaggtatttatggcaaaccatttccataactagcagaacggataactaaataagcagaaagggtaaaagcttacaggggatattccagtgatgttcaatgtagagtttgacttttaggacaaccttgctgcataagccaaaaactccaacaagcacatcctatgtatagtcatgtatagtcctggtcctgtttggagagttgagaacatcagttccttcgtaaatgaatccctctcatgagagatcaacatgatacagtactgactgatatataaaggtcaaggggaaaatgaagtcaaacatggttaggtcgcaaggtatgtcgaaagcgactaccgtgtcaacttgtcaacatttttatgtactcagcaacactagagctttctctcaagtgggggaaaaaaaactgctttgattcatttatgtactatatgtatgctagctatatgcaccatcccgtacattcctcctgtgcatcagcaacaaaaatttaccctgagcagcaatttcttcgtcataagtctcgagcactgttgcaacgaaaggggagaaaaaaagaaagagagagaaatntggtccatacttccatcgtctcaaaatataaaagggtttaagatagatgaaatacattctaatactacgaatctagacggataggaatatatttcttagcttaagctttgt

SEQ ID NO: 62434 - DNA, 2563 bp, Oryza sativa
gcttgttaatatggtatgatgtttgacacttgagtttctgagaactgtctgatatagatgcgtatttatgtaatgacagagttaacttatgctatgaaataaaatagtggatgctaatttttgtaacctacccttttggaaacaagagaatacgcaaggttagttttcagagaccgtaggaagccccaatcagttctgaagcagggagtgtccacctccttaataggatttgacattggtctgttactacttggtacttctaacagagacaaaatggcctactcctaatggttcttacattgtacagagctcatgaaacacatctgacatttaattcactaaagacgatgattcattggtgttgctgtatgatgcttgtgctgtcatactttggctctcacttgggttttgccaaggctgaggtctgacaaaaatggttgcagtggtgtatgcccctcaagcaggctcactactttggacatctttggtctcggtgctggtgctgcattggttcagaagagggcaacattcatcatgaggtgcacaagtctggatctaccagctctaggagatttccttactcatgtacaacacaagcctgcaacacatctgggagagaacatcatactgctactaaggtatgttccatgtgaacataccagaatttccatccttcctgtgaaatattttagtcaagaattgaggttgacagggtatctgctttggagttgtttagccttcctgtgaatttccatccaattccaaagcagtagtaattactcagctcctcctctttgtttttgtaataggcaaaatgcttgcgtatcattgtatcaaggaagaagtagaaaaatgcaagcgcatacaagagggagggagtgtcagcctccacgagctgacaacttccaggaaaagagaaggcttagaagaaaacaaccaggattacacaccggaaggatgacctgaaaagctaaacaccagagtttaacctcctcggaaacttgagaacttctgcccaggttcttaactgctggttgaagacgtgattgttccattcggattcccattccttccagatcatccaggcgaccaagattatcaaagtgttaagatactcagctcctcctggtccgattgtttgtgctgtgctaggatcctctcgatctttggcaggggatcttctcttggctagcttcttcaaacctctgacattccaccacttaaggtactgatccattcctctcttactaataacctaaaaaaattatttttttttcattttgtcggcagtcaagtttttctttgcttagttcttttatagggaaaatcttttaattgtgtttatttaattttccacttgatctaataataagcagttttgctataatcgtatcgacatattttctagtcaatcagtctattttctaatcgtcaacactgagtagtagttataatagtagttttctcctgaagagctcttgcgtgtagcagtgtgcaactgcaactctgcaaccaaacagtcaattgaattttttcatcttgcatcacggccctcacttttcctattgaacaaatggagagaacttgtgcctgtactgctgcatatctgtatgctgcctctagtactagtttatactttactgattactttgagtaagattatatggtaattacaccataattatgctgtaactttggtgtaaattttatagatgtcgactgtaataaatttaaatttgtttgagacacattcatatgaattcccataaaatttaaattattaatattacagattccaaagcatactgttcatgcaaaaattaagtttctcaagaaatatcactaatttgagtagcatttgtgctaaacattgtagttagagaaatttgactcttttgtatagttggaattatatcgcatcatgtatagatgcatccacaatgaaaatcttgatactgattttaacataccattatttcctcttaccagttccatgcctcattacagcgtaatctccccgattgtctctctttgtgaacatgttgtggaagccaatcaggaagcacatttactactgcctcaatcctgaaagtaatgttcataatcttatgatcgctgctgatgatctgagggacaccattgatactatcgaggagagaattctggtgggtgaatgtgagggaaagaaaccaaaggcacaggcaacaagctggatacgtagtgctcaatcagttaaagatgaatcagacaagataaaaaatggctatgaggcaaggagaatacatgcgttgggttgttcctggaactttttcttcaactacagtgtaagcaattctgccaccaaaatgcatgctaatgctgatgagatcaagaagagagctcctgagaatgatggtatgttcagctccctgcctctggttggcagagatatgcctctgccaccctacattgtggggcaagatgagtacaaggataagattgttggttccattaagcagggcaccacaggcaccattgggatatgtggcatggcagggtctggcaaaactactctcctcaaaca

SEQ ID NO: 62435 - DNA, 10170 bp, Oryza sativa
tcttgcacaacaaaaatgtcacattccctaattcgtgctataggcctcacgtgtgaactctcagcatgagacagcccagtcagatatgcatgttaactagttcgggtcctttggagtcgcttgatctctcacaactctggatctgtagtgcattaatattgaaccacttccatctgatattggagcattactgaacttgcagcaccttgatctttcatacacaccaatccaatcactcccagtgaggttcagattattgaagaaactgaggtacctatatttaaggtatacacgcaaactccaaacagtcccagatggcaccatatcggcactaagtatgctgagggtgctggatatacacggcagtgtttttttcacaaaggtgaaagcacggtcatatcttgaggaactggagagcttgaccagtttgcagcttctcagggtcacagtggttgatttccagtcgctcaggaggatcttcaatttgtccagagtctccctgcgagacaggattgggacgcctccaagtttcgtcccaacttatcagcaaagcaagggcacaacatctagaagttctggctctgagctatatgaagagtttggagaagttgatgataggtggtgaaagtgaaaccagtgtggattattcagattggtgcttccaaaatctcgatgaattcagattgcatcacctcacaaaactgggaagcatcatgtggaaaggggtgatgccacatgcttgctttcctaaggttcgtacggtagatatcatcggctgccacagcatcaagacactcacttggatcaaccagcttccttgcctagaagaggtgtatttatacaactgcaactcactgttggaggtagtgagtgatgatgatgaggaagataccaccatgccatcggcaacagcttcatcatcatttcctcgcctcaggcacctcgggctaagtcatctcaaggatctttacaaaatatgtggtgatgggagacttggatttccatgcttgcagcggctgcttgtgtacgagtgccctatgctggcaagactgccattcgtgctatggaatggatctgctgtgtgcctctgattctcggtgaacaaaactggtggaacaacttaggttgggacgatgctggactgaaatctaattcagtccctttcttcagagaactacctccaggttttaaagggagtaacatggaagtttgggaggcaatgttccaagcgttgccttaatctcagcaaaggaaataataattggtcataaatctcaaagaagaagaaagctttggtcgcctgttgcatggtgttgagagtttcagttcttgaaagaaagaaaaaagcactacacacattttcctgtttataattggcagtgcgcatctcagttatgcctgtagtgttgaagtgttctcagaatctcagtacagtctttcgtgtagtgttgcttctctcttttgtgatgagtttattgtgcttgtgctagcatttttattaatacatgaccggactttgtcgtacctgtaaattgaaaaaccctatgggaattttttttttaccattctggagtcttagatgggtaagtagcaagggtttggtcattttgtgagaggggtggtgtcatgagagggatcgagcaacattgttgagtccgggcgactaatagtcaatcaaatttttttatgaaaattgatggttattgtctacgttaccctgatacggctgggaaggagcgtatccgtatcagatacgtaacaagatacggatacgtatcggatacgctccgatacgtatcctgtacgtatcctccatttttccgactttcaaaaaaataaaataattaggatacttttttgatacgcacatgatacgggataacaaccctagccgcctcccgtctttttgtgcacaacggcgccgtcgtcctcgacctctgcactgccgctgcgcaacaagggcatgatgccgctgcgcgctgtcgagcacggacgccaccggcgtgcgcctctaagcacggaatcgccaccgctgtcaagcgccgccgagaagggaatcgcgccgccgccgtcaagcgcagttgagaagggaatcgctgccgctgccaagcgcattcctgtggttgtgggcacagcaccatcgctgcacgggttggtggttcaactgttcaagtgaggtaggcgtgagtattgacagttgagttaaatcacttatttgatctgcaatgatttttttttgtccttattgttgttctcctttcttgttttcggaacaaacaactgccatattactatttcagagatccgatagattacgaaattggaaactcaagagtactagtgcatccaggatcttaatgttggcgataacatcatttctttttttattttggtagctgtagcccccgtaagtaagtgacttttagagatccagtaagtactggtatttttttttaaactaatccagtaagtactgggactgcagtacttgaaagctatgctcgatatatctgtgtattgcttccttcagttatctctgaattgttggcatgctcattattttgggcttaatcagttctgctattttctttcaggagttcattgatttttattatttatttatgatgtatatatagacgtatccccgtatccatgatttctaaaaatagccgtatcctggtatccccgtatcgcgtatccatatccgtatccacgtatccgggtaacataggttattgtagtggaggtggcagcggcccgggtggccgcttggcctgtttgcgagttggctctgctgttaattaaggctctgttctatttcttcaactcaaatttcaccttccttattttccgttagcatattttttaaactgttaaacggtggttttttctttaaaaaaaagtttctatataaaagttgttttaaaaaagtaaataaatccattttcaaacttataatagttaatacttaattaattatgtgctaataaagtttctcgttttgcgtgcaactaaaattatcgaacagggcctaagagtgattaaatggagctactaaacaatgccaaatactagttattattgttattgttttttggaatgtgcaaaagttccgtgcttctctgtattaagataggggaaacttcaacaatttacctaaaagaggtgttaaaaccaaaaaaacagaactatagaagaaagaagacgacagcactaggctacgcctcatggtgttaaaactacttctaatgcaagaaaccatctctacacaagaaccaataatgaaaataaggggataggtgtataaaagaagagagaagagacatgattggatgagaatttaatttaacgacaccatccattggatatatgatttctagacactacatagtgtccatatgatatggcaagtatagaaactactggatagtttctgggttggggatgactcttagagtgatttcgggtaggagactaaaaaataattgatggtttctccttgttggtcgcaaaaggcacaggatctagggtgtggtaatcccctcttgctcagtctatctatagtcacaatgtgcgaccaaccatgtaaagtagtatttgcatttgagcggtgcagagctcttctaggtcggtgcagctaggaaggattcccttcctaattaataagaggaaattgttggactgtcatgtagggatgaaaacggagcagatagtttctgtccgctcaaaacgaatacgaatacttttcggatcggataattctcagatagttcggatacggatacgaatacggatattttctcccggatatgaatacgaatatggtatcggggtttccgtcggataataatccgtaaacagtgctatttggatatccacataagccatgagacataccccatttatttataactctatgaccttgaatatacatttttagattttaatagtagttcatctcttaacattagtccacactattaatattatttaaatttttaaagatattcataaattatattatattttatataaaataagctaattatatatgttgatacttgtttctattagaagttgagttggttttcgtgttccgagaaaaaaatgtttccgtattcgtgttcgatcatattcgattcttattcgtattcgagataatccgtatttgtttccgcattcgagctatccgtattcgattccgtcaggcacacaagcttacacgtatatatgcatcccaaccccaaagctataccaaatagaacaaagaacactcatctcccttacatactcagcgagccataccatataccaaatagaacaagattattgacccatttttatttctcggagcaagattgatcgacggcacatggatctatctcgtaactaagctctccgctgagcgacatttaactatttgccacttttaagattagatatatagctaggtctcgctaccggtttgtccggtggcggtagtggttttctcattgcttggagccggagtgatcgggattccgaccttgtcacgcccctgcaggggcttgcgcttggcgacggtcaccagcagcgtcccgaaggtgagctcggcctcgaccttggccgtgtcgtacggcttgttcggcagcagcaggcgcacgtcgagggagttcgccggcgtcgacgtctcgtcgccggcgccgccgtagctgacgaggagcaccgtgtcgtgctcgatccgaaccttgagcttctccctgtctatctccccgacgtggaaccacagcttcacgtagtcgtcgtcctccgtgatcctccacctgttgcctgacgtcggtgggaacttggggtgcaccagggcttatatcacatatgatatatatgtgccacatatcacatggcatatgaaatataaatgcttattagacttgcattgcatatacaacagggaagaaaataatagaactgagagaaattttatggtccttgagaaaaggatagaacaacatcggcggaaaccatgttgttccggccttcatactcaactaaatcaacaggaaggcctttgtcctttattaccttgtataatttagtcataaaaatatattttacactaaaaattattttggtatctcgaggtaccaagttctacactagaaaaatttggtacctcccagcacttaaaggatggtaagattaccctaaaactaaacttaaacttcacagatatcgtactactaaagatgaaccaaatcgagaaataaaattcgtatgaaattagaataaagttaggagctgaatataatgaaaactaaaacatattacagtacactatgctgtctataaacttaaaaaaattgtacttattttgaaatttataccagcaaatactataatatgctttcggaatatttacaacagagactcaccaaagggtgcgatgccaaagggatgcccagtatcagcagggcttttcggagaattattagcacgcaccaaaagacgcggagacttcctttggagggccaatgccgctgctggcttgcttgcggatcgcagggctgcaccaaagggagctttcagtaccgaaggcgccgtctggctcatcaggaggttgaaagatgtaaccatggacattgctgctcagtttatgtactaaatctgttagttttggtgtgctagctagctacttccaagggtagcttatatagagatcaggaggaggagatatatacattctttaactttgcttcgccctgcagaatgcttggaataactgatcaaagaagttgctaatgagcagcttagctagctttttctaaaggaacaaattaacaaagatgatgctaaacttgatgcaggaagtgttatcattctcacaaaagcaccagagaaatgtgggcacacaatgcatgtcttctctgttcaggtacaaggcttaacttattcctgaaatctaaaacgttaaaaaaaaagagagtacacttcacaccccttaacctaaaaatatttccacttttctttttgtcatatctcaggtgcttccgtgaaaacgaaaacaccctccgacaacaagtttagcatcatgttcccagcattgcacctttacaaaagctgcatggcaactatttatattcttgcaagcatatagttcaattgtatgagaaatcaatggccatagtctaatattgaagataacattaaataattaaactagaagataccccgagcattgctacaataattcttagctcaacgaaaattgaaatgtatgctgccaaatgaaatttatttatacagttattatataatgcatacagccacacataggaacatgtaaatcaaacagaggcagcaagatatataataagagttctaagttttatttttttatgttaaaaccatcttcagtgagaaccatggcttgaaggtgaggttgtaagagcttgaaactctgatagttattgtttgataacatcttccttctgcaatgtgcttgtacatgtaataactacttctgaattcagtccagaagaatccttgaggtttgcgattgcattttactgcaaatcatcattttcccagaatgtatcctaatttttggcctaatttttcttctgatgattgatttaacctctgataaaaagatagaccttggttctatttcatctcttcaacaagtttagtaataagcataacggccctattgtttcgatggagagaagaacctataattagcttttcggaaaatttccaaacgaacaatgtcaacaaaatcttcatatttgcagtaaatatgcaatcgcaaacctcaagaattcttctggaccgaattcagatcagtagaaaaggaaaacaccctccgacaaacctctattctccttgaggtttgcgattgcatatttacatgtaataactacttatgcacatgatgtagaaaaggaagaaacatgaagagattcctagaatgggaagcttatagcaatgcgaatggctaaacagagataaatcatcataattcattacaattgaactataaattgaagatccatatttagtacagtttgaattaaagcattatatgtaatcttgagctatactctcaccctttccatgtcatacaacgtacagtcatgaaaaaaaccacgaataaatttgtcaatacacagattatatcgttatatatcacttcatttaacaaacatacttaaactagatctacaaaaaaaaatgctggtaacatcctaacaattacattctatatttttttgatattttaataaactttatatcaacatcttcttttgtataaaaaatatatattcatcaaagatccttgagtttttttttgtggggatcaaagatcctcgagtttaatcaaattcttagcaataaatcagttaagctatacagtacagtatactaattagtttataaaggatattatatcaattctacatccatcccatgcctatgaattcaatcaaacatgtaagtgttccatatactaagtgaccaacatcaacaaaataaaaggatgccaccgaccattgaaaggacaataggtgacttgagggcaagtggcaacgagcttacggctaggtaatagcgtggtgtcaaaccttttcaagctgtctttgtctttaccctaagcacataggacacaagcgaggagataatgatggtagattgcacacattctctaaagcataatgaactcgataacggttgacaaatactgtattttgataagatgtcatttagcaacaattaattagacaatagacaatgacaaaagtaccttgcaatttttagtaatggtgtgacgacttggtattcgatgagcttcattttggtgccattgagaagaataatgtgatctgttttgaattggtaggaaacacccaattgggcaaaccaaaatatttattttaaataggaaaggtgtttcatttagtttggtgaattcaggagatgtaaatcatataaaactcattgattagaactaacacgacaaaatgtaatgtccataattagaactcatacgacacaatgcattttagtctaaaatacttgaaattttataaacaatcaacacacactttaaatttatatagtcattgtgttattttagatgaatttgttcttctatagtagtgaacacgtgaaaaaagaaattactcccaataacgtattgacattttatattagctagctgcgcagttgcatggatgatttgtaagggctacacatctcatctagtgagtcggtgactgaagagtaaagaattgtttttttggcacgaacaaaagcactaataatatatgtttatgaggtttctctaattctcttcgatggcgctgatgtcaacaatcctcgttccatcttccgtaggagccttcttcttgatggtcacctctaaccacactttgtcatcgaccttcttggaccgccactccaccttcttctcatcatagcccggtgtcatcaagaggcgcacatcgagaaggctcggctgttgcttcttctgctgctcacgatccctcagcgagatggtgagcacgtcgccatgatcgatcgcaacctcgatggcgttgttcaccttagattcgtcgccgccaacaatctccgtgaccgggaattgcagcgtgacgctgtctcccgcctccacgatcatctcctgtcctcccatgtttcttccggccttctccttctgcctttcgctttcgcgagcgggatgcaccagagctttcattgatcatcatgcacgcaagaccgagaaaacgttgtcaggaactcatcagaatgctgtttttaggatcatgtacatagagtacacattgagaaaaacaagtctgaagtttaatgattgtaactctggacatttcttcgagcatacaatcatatgaaatcactcaccatccggggaaaagtttatggcagcagagattggggcaaatcgatgtcgaggcagcccatacttgtcaggagcagtagagaaagggagaagagcagctggtgtcgttagtcgtcgttgtcgtcgtcgcatgctgggagaagagaagctaacggctgctgctgctgcctcaaggcagctgatgtagcaagagattgcagcagctggttgcatttctccaagagaagcatcaaatgtaatgatcgttatgtgtttgcaggtggtagcttgcatgagatgacattcttgtgcatatatataggggtataaaaaccaaattaaagcttgaggatttacctttgcttgccccggttggcttggcgaataaagaggctgtgaagctcagctagcttttgtgaagttggttgcaatagcaaatggattgtttaccaaatgatgactaatcgtaggaatctgatttctttttttctttaaccaaagcacgtccagcatgcatgatttgatgttatttgatttttcagcaattctaaacaatagaatctcctaaatattcaagtaatatgaaatatattaaccatatttttttataatttggagaaaaacatgattgtatttgaactctatttgctatcgtgttaaaaaattggaaacgtttgaccttttcagataaaatatttgaattgttctctaattatttttaaaataatatataaattgactaaaaaagggtctgatcaccacgatatataaatgggtaaccagtgacaccatgacgtggacaaggctatcgatggacataacgggtcgacagtggaagtcaggaatgtagctaatttcgcttcgcgtcaaatggtttggaacaaagcaccaaaatattgcgggcacacctaatttcctcgctgacatgaatggaccattggcaaatttgcatgcggataaaaaggagaaaagaaccactttttcagtgaccagccaccattgtccagaagctcattcctcttctcatcccctccagcttcttccttctccctgccccaatattgcaactccaaatccaccacacttggtaggtctttcccctgatgccacatgcttgcttccctagggttcatgtggtagatatcatcggttgccttaagggtctcttatcccattatgggtggcgtagttccattagaattgctggttgaatcttgtgaaatcaaaggtgttttttattattattctgtgatgaacaattggcattggagattattggttttgatatttga

SEQ ID NO: 62436 - DNA, 11334 bp, Oryza sativa
tcaccacaaagacaggaaagaatgttggaaggcagttttatcgttgcccagctaatcaggttcattcatgaccctgtttatcctcccaccctctctcttcctctcttctttcctcacccaacaaagcagggaaagttgttttactgtacaatattatgctgatatcccctataaaatgagttctggtactgtgttgattatctacagctgtctcattcttgctaaatgagtgcgtcatttgctaggcccagtatgattatcatcaataactatagtacctacagatggaagttactttagtgctttggattgtaccatgggaattttgaactgtttatcttgtgaataggaccaagatactgctcaccttatgttagtctagaagatgtggacagtatgatggttacagttgcacagtgcattcgtgaactaagattttttggatcagtttgccgctgttgtgttgtgtgctgccatgcttagtatgaaggtgttgctgaaaagcagttgtgagtaacattgagccggcttataatatttattacattatacaaactgttatccaccgctgtgtttctccacctgttctgcatttgaaatacccaaatacgtccatttaagacttggtttagaagacagcagctagccagctgatttagttttggttcaacttggttccagggctggttaacacgattattcttgatgatgatgatagtttgcttactagtttaaatacgctcaatataaattctccccagtttccattgattggttgatgcatttggtgtgaccccatagctggactcaatgtcctacttttaatgctttatgtccaaaacccgtagtacttctaatgttaacagtgcgttcttcttacccttgcaacttcgtattttattgttacaattctatgtcttgtttgctcttcataccaaaatgttcttttgcatttgctttaagagatatagtggtaagttcctatgtgtagttaaatccttttgttctagtggagcacttatttctatctgcacctttctggatagcaattgatgctaggatatgatatcatcacttgttctgttttacctttttcattattgttatattcttgtatgcatttttttcgaaactagggcatttcatatctctttcttaatgtacgatcgggacatatctccagggaggtagctcttgtggctatttcaagtggtgtgatgaacaacagcttaggacagctgctccactgcaagcttcaacacaatatcatactgatgttgcttcaagtggccaaattcccagcaagaggagctcctccgcctgcttcaaatgcgggcaagagaaccattgggcaaaggactgcccaaatcaatcttcagatccttatcctgacaaaggtgggagaacatttacttctgcaagctctcccgatgcgtgtttcaagtgtggtaagagcgggcactggtcccgtgattgccccaccgcaaattgtggttctagtaccgtctccagccatgtcaagtcctcttctactttgggctcatggaacagccacagatactgatagccggtacctgtgaactcaattgaactgacatggacatgctgtacgaaacttggacaaatgcacatgacacgtgttgcttaggtacgcattcttgccaaattccttttgctacttttaagtttggtaatgagtttttactgaggacatttccgtcttcatgctggttgctctgggaatcttttgtcatctgctctagacatttccactgatgtagatataagaaaaatcagcactatgttcaattctatgctctgttttcgtactgatttcatgttcattttcgtgctccttttgaaagctttatttggatatttacatgagttagattgaatgcccatttaaaagtttagaccctgggacctgtagggtagttaatagatgaggtagatatggtgcccttaaaactttagggcctggaccctgaactacactttaatatacaaccttaccttctgacaaggctaagtgaaacacccacaaaaagattgggaacagttgttctgttgggttggataaacttaatactatcacccactgtgccattcataggacccgtctattaaaggataggaacaaaggctgaccattcactcactgcgccaagtggggagaatgctattcactcaaggccacagaagctcacatggtcatgagctcgtgagggcaaggaatctcctctcccctggatattagttatcatcagtagtagcagcagcagcagcagtagtagtagacagccgtagtaatcatctttgcacaaggatgtggtcctggttgctggtgcccagccaattgaactgcaggatggttggtgccatgacatgtgcttattgtttgcccctgcaaggctttgaatagtcactggccaacactacctgccatcacaggtcggtttccctcagcgatcttggggtcccctatgcgtagatctgagatgcctccactaacctcgctgggagcttgatttgctgtttatttgtttgctgtctgttcggtcggtcttttgcagttgttactttgcactcagtgcttcgcctctaggctcaagggagggcctgatttagttactccatagtcaactagatagaaaattttaaacatctctctggtaatttatatatgcccctataacatactcagtgcttccgtatagtctggtaatttttgcttggtctttgactagaacatgaatccaacggtttatactagttgcctgcatccaacggtgcttgatttgtggcctacgtggctcaaccaagatccgagaaagattttattctttcactactttagatcagatagagttcctccaaggaaatctttcagagtcactagacaaagtgttgtcatgattcttgattagtccccatagcctgcacttagcggtagtgaacctcttgaaattctttatggccccttgggagcacatgaattagttcaattcctacgaacttcctcttccccccccccccaccccaaaaaaaaaatgcctatatcctgactgtaacagtcagttgttgctacaaatcctccccggtgtgactgtaacagttcgttgctgagttgcatggttgcatgcatgcatcaactcatgagtcagtcattacacgatgggaagcatttaggagtactttcgtggcacccagcaaaacatgacaagcagccgaggacgctgggcctgcctgttcgagctgccactgccgcctgcatcatcccaaggaggaccaccacccgggagaagtggaactggatcgattggcaagaacacgaggccgcgggggccacagccgtgaagcgcagcgagacaaatcccatggggcctctcctgcctctcccctctcttaaatgcccctttggcctcggcctccccggaccccggtggtggatttcgctaaggccttcttcggtcaatccctacgagatcttattcggttaatccctgtgaacaatcccctctaaaccgaacaaaagcgaacaaaaggcctaagtttgaaaaggagagaagagtagtacagtactgtagcaaagatgccggcgagcgacacgctcacccaccctcctctgcgccggcccccagcctacaggggcatatggctccagcacggcgtgtacaacaacgtagtgctcggggcatccactgtgcgtgccggcccgcccctccctgtccctgtggatgtggcctccagctgattgatgcctttgcttgttattattgctgctggtaggagaagtagtgcatcccgttattttcagccacttcactctattattgccgtggattttttttacctctatttttttttctattgcatagcttagccccctttcctaagctactccctccgtcccataataagttacattgggacgaagggaataattgtttactttatttcttaaaatagttaatttatccttacaattaagtagataatttgtatcaataatctagtaaaaaaatcaacaaaattttgagatgtggtctatgagtgatcagtcagtgagaatatgaagaagctagagttaactggctcctgaataccgatatgagtaagaatatggattatttggggataattggagattatagggataacttttgctgtcacaagttccccataacatgggtttagactttagagtagcatggtttggccatttagggtctcttgcctgctactccttcggtattattattgctgttgacttggtgcttctgctgttgccgactttgccatgagccatgatgattgtgctctcatacatggggtggccgggtgggcactcatcagggggaggaggcatccttccatcttgtcacgccaaatggggttaaccccggggaattttttccccttctctcatcactcacctctctgaagccgatccacatcggtgtgtatgtcacatctgccgatggtctcttcgctccctttctccccgtcacactttgcttctccctcactcactcacaacctcttcttcaaatgcctctgttctttttgcgacttctactactgttgcgtaataattgtagtactagtaattcaatggtcgatttggccacagtaattcctctttaatttaatggactagacatctgttactatcatcagtgaactgtagtactccctttcagaatataaggattttttttcttgcgctgattctcatcatttcgatttttgcaaagccaattaaatatttggaaaggcaatctaaataattcaacaattgacaattgaaatgaaacattactgtttgctaagggcccctttgaattgcagggtagaaaaaacggaggaataggaaaaacataggattctgacaggaattgaagtgtaaaacagaggattgcaaaacacaggaaaaacacaggaatggtcgtttgattcgagtgcaggaaaaacgcaggaatcggatgagagagatagactcaaaggaaattttccaagaggttggagctcttgctaaatttcctccaaaatctacatgcaatgtgtcattccataggaattttataggatttggaaagcttcaatcctttaaatcaaagggccaaataggaaaatttcctataggatttgaatcctatgaaattcctacataaatcctttgatttaaaggggccctaaacaatgtagaaactcttatattttcgaacggaggggtttacgatttttttgagctccaatccagacagtgtgaggattggattggggcgtgatgaattatcaatcagcttgtggagcacagttgaaggaatggtacaaggagagatggcatggaccactactcctttcatcctttggccattgaaaggtgaagtgttgggagattgagagagatggggtaagctgtaataacaagtgagggaggccaagacaaaacaagccgagacgcgcacataaacaaaatttcctttcgctttgagttggaaacacgtcctttttggactgaaacttgatggatgtgtccctgttcgggacaaactcgtaaggtggacgtgacagcgcgacgtgcccatccagatctgccgagattttactactaccatcactcgtgagggagaaacaaacctttctccctattgcttcagatcatactaagggcccctttgatttgtaggaaaaatgtaggaattttggaggatttcaatcctatggaaaaaaaatcttatgaaggcctttgagacaaaggattgaatcctatccaatcctttaaaattcctatggaatgggtaatcctatgcatattttggaggaaagttagcaagaggtctaacctcttggaacatttcctctgagtctatctctctcatctgattcctgcgtttttcctgtggtccaatcaaacagctattcctgtgtttttcctgtgttttgcaatcctctgttttacaattgtattcctgtcagaatcctgtgtttttcctattcctctgttttttcattcctacgattcaaaggggccctaagattttactactaccatcactacaacaccaacctattgtactactactaatgaattccacttggagccaatagtattcctcccttctcctgcactttaggaggtaataatgagttgctaactaattaatccaaggcctccatggctccaactaactagtaataatcttttgcaagagtctttttttaatatatatatagcggataaaatttggtctttgcttcgtaatactccctcagttccaaaatataaattttttttgacctcaacgcagttttcttgatactactttgaacaataatatctataaaagtaatatattttaaataaaatgagtggcatatgttgatagtttgttgaatgataaatctactagtaacatcaaagttgcatgattgatgttttttatttttatatgatattaatagtcaaagttaaaaatgtttgatttgtcgctattctaaaaatccttacattttgggatggagaaagtacttattatggtctgtttggtacaactctagagatggagctgagtctatccaaatagtttcagcttcgtctaaaatggaagcagagctagggtttacaaaaccgcacggttaccatgcggttatcgcggttaccatgcacggtaacctttttagtttttgaaaccacggtatgtctcgcggttaccacgcggtaaccgcgcggttaccgtgggggtgcagcaaccacgccaaaaagagggttactgtgggggtgcagtaaccgcgccaaaaagggtaaggggaaccctgagtagagctaggtggagcgctctcataatgtgaaccggggtttaggctgctccacaattctattccagactcaactcctagagtaaatttaggagttgaagctctaccaaatagactcttataaagtacttagctccagacaagtataaaagattaaaagtatcttaactagttatcctctgtgtcttgagtgctaaaagagtttatactgcaagtagcgtttagattagcagtctcacgtggtggcctctctgaactctcacaccctagaggttctgctgccaaattgttttacttgcagctttctacaaagggtaactagcagatgttatgcgaccaggaaggacaggtcacatttggcatcttgcgagggatagttttgtgggtctgctttggggacccatctaggtatcccctgttaatgaccagcttagagaatcccttttggtgctgaattagttagctacttgttgtagatgctcctgttggaatatgtgtccagatctttatatgatgcatactccacgactagactaaagataaccagtaaaggcttttgtttggattgatgcccaaaagaaccttttataacaaaattaagaatactacaagcgttcaagtaaacccaatcatgcaaaatacgctagctatcctgctagtgttggtaatgattgtagaatttatccttagctaccagaaacttggtatggaaacaactttaatgtaaaaaaaaaaaatcagccctagcaactttcaaaattctgactttaatttgtcagcaaaattgttcaactttattaaccttttttggtaatggtcaacagatcaaatcaaacaacccataaaatctctcaaaattgggtattttctactactgatgtgtgttcgtggaggagtgcatgcgtgcgtatagcacatgaccttcgcgtccatttattattattattgtcctggctgttggatgctaccaagatcgcggcagcagaacagctaagcgagctcctgtagctggataacacctctcgggccagttgccgcgaacgcatctccttttatctggtgaaataattaggtaatcagagtacaaataaatttgatgtgaatcgttttatccccttgcacttaacatcacttaggagcacatatagtagcttttttttttgttgtttctctctttaaaacgtgcattagtaatagcaaaaaaaaaaacgacttgcatgaaaggttaataaaactctgctgttactcgactctgttgggtgtgagtgtgacttttgtgttgaattcctttggtttttaaggcatttacgttcttggtaaacgagttttactttaatatatgttgcaaaagataatattattgtttagaaaataaaaataatcaggagaggcataacatttgaatacattctttttttgtataatcttagattgatatgtaaaacaagctatagcaattactcccttcgtcctataatataacaacatcctggatacatcctaaaacaaactatgaatcctcatagcccctgttcaaatcgatagcagtaggatatgttattttagatgttactgtctctccattttgtattataaaactacgaatctcgatagccctcctgttcagattgatactagtatgatatttcatccgattctagtttactccgtttagtattataagttgtttgacttttttcctaatcaaactaaatttatttaattttgactaaatttatataaaaaatataatattactttcaaaacaaaaccttccattttgtgaagttagtagaagaggatagatccagtaaattgtagtacatacgaatgtcaatcttaattattgtagattaatacactggtaagggtcgatcaggcaaataccaaagctgactcccgaacaaaacaaacatattatcaaactatattcaatggtaaatttaatgaaactaatttcatattttagatgttgagatttttctacaaacttgatcaaacttaacaaagtttgactagaaaaagtcaaacgatttatgatatgaatcggatggagtatattttgggacggagggattacaatcaaggcccccccccccccccacacgcacacacgcgcacacaaaagcatggtgcacgaaatcaattataaaatgagttcgtactcttgcacgtgttgtatgtacgacttcggtacagaatcaccaagtcgttacagtagaccaaattcatttcactatgcacacagctctcctgtgtgttcctgctaatgattcagatccacttaattctgttgcagcagttggctaggcaaaaaaggtagtgggcacctctcgtaccacatttaccaaaaatcacatgcaaatgcgggcaatgtatcaagtactaacattatatgggagatgccgatagttgcagcttcaagaatctctagcttacttaaacaattcagattttcatttaaattttgagaactgtagttattgaatttagaaaatgaattaaatttggttgtgtgtctaaaagtggaggccgaaatgtaaataattttcactatctaaaggagaaaataaactagaaacaaaaaattagaaaacttattttctagattttcatcagctagctacttggctgttttaccagattgttggttatgagtgagggaactccaactcgaataattatatgcttggtttatcaagcttgatttttttttctaaattagaactagcatagattaatcttgttggcacgctttttaaattgttaaatgcgttttttttaagtaagaggttgtagggttgagagtgtcctacctcgttttaggtgtgtctgaaaaagctaagccatcgtagtcaaactccatacaccattcttagaccaggttttaaatactgtattttagaccataaactcaatatataatgatgagctaaaaaagagtttgggcatgtcagtagaggacccaagcacaagctctgtttggcgtgcaagttggcaccagtcctacatactgtagtactccaacgtacacgcccacattgctgccatccactgcggcagtgctgcttctgctggtgggccccacctcgctccgctgtggggcccacttccggtgggggccagaaattattgcgcacaagacccgcaggcccaatggcgagccgccacgtgtacccgcgcctcccctccccggccaatcgggaggcctcgtccctctgggatccacctgtcggtggcacagagacctccccacacacgctcgtctcccactacacgcccccccgcatatattcccgtcgccaccacggcgcaactgcgcgaccggaccgaccgagaccgccttgtctcctccttttctttccctacttttttttctccactcgtgtgtagtgaaaaaaaaatcgcccactttaatcatattccctctgtctcaaaatatgactgacgattaattttagcaaggtctcaaaattaaagtgtagtatttttatcgacaaaatcatttttcatatattcaaatgttaaaaatctaatggtaggagtactaattaaattgacattaacctaattgccggtcaaattctgcaacagtagaatcgcaccttttttaaaaaaaatttagcacggaagaaactaatatgattaattaaattttgcatagtaccggtactgtgttggatagttgtacggaaaaggctatacgtactaactttttcttactaaattcttactaacactgatgtgtcatgctatgagtgcatctagatttttttttaacctccatctacttaaatcaaatggttgagatgattgttataaaagtttagtaagaaaaatttagtacatttagcattgctcagtactagtgttgtgactcgactccaataataaaataataatattactattccatctattcatgtccttgcgaagccaaatagcgctgaggctactgcttgcagcaacaattcttccttttctatttccatatatagaaacaccaacctcctcatttcccccctgaccccaaccccaaacccactctactctactgtgcctcacctcttgccactactatttctagtagtcgtgtatcatcatttcagatatcatatcgccacctctcgtttttttaataatatcagcggcgagcgagcgagatggactccccgtcgcctatggcggcgcaggcggccgacctgtcgctgacgctggcgccgtcgggagggggtggtgggggaggaggaggcggcggcggtggtgggtcgtcgtcggcgtgcatcgacggcaaggacgtgcggctgttcccgtgcttgttctgcaacaagaagttcttgaagtcgcaggcgctgggcgggcaccagaacgcgcacaagaaggagcggagcatcgggtggaatccctacttctacatgccgccgacgccgcaccccgccggcaatgccgccgccgccgccgcggcggcgacgcccggtgggatgtcgtccgtcacgacgccatccggga

SEQ ID NO: 62437 - DNA, 1090 bp, Oryza sativa
  unsure (1)..(1090): unsure at all n locations
atgtgnattttgatcgcttgctatgcagtatttcatcacttagacatgaagagctatctgaactggtcatgtttgctgtctgaccaccatctttggtaaagcagctgtctggcttgttcaccacaggaggttcactattgcaagcagcttgattattttcactgctttcacatggctgatctgttatcgatttgcaagcttcttcagatctatcagaggaagcttcagctagttcttcatgctccgagccaagtatttggctacaattgacaatatcctttgaacaccccacttgattggatcgatcaacaccgctaactgtttcagaagaaccattcgaactccctaagctagctttctttctagcatccattggctcccatacttgttttggagctgcattcttgtttggcgtactaccaactcggcttccttttgacactatgaagctatccaatggatagcacctgcggtactgtaaccagggcttctcaaccattgttttcctggacatcttcatctctctacttgatctagctgttggagaaaaatacccataatcttcctgctggccacaactgcaggcattgtactcatacctttctcttgtccggttattcgcactgaacaaagagttgcagcctctacctgcattccttgccctctccctagattgccagtgaatatttccaacacccccagtgtcatcttggcaatcttcataccaaaaaccagtggtctgttcttgaagggaatcccttctaaatctgagtttcctccttgaggatgtagattgttcacacatgaaagaaccattgcaatctgatggaataaattccagtgttgtactgcaatgaaactcattgctttgtccatcactttcccttgttagagattgatcaacacaggtatcaggagagaacgattccaaccaaggatcaactagctgacatctttaccaagcctcttgatgaaacccgcttttgcaagttgaggaatgagttaattgtcatagacttctctaatgtggcttgagatggtgcaccattgatgaactnctgtnccatcgagtagatgcatgcaatcaaaa

SEQ ID NO: 62438 - DNA, 7888 bp, Oryza sativa
tgatctagataagattcctaatgcaagcagcaaatttttggtgccaaatccatttggcgctaaagcatgtaatttgggctgctaatgcatgtaattaagcatgctaataatatggttaattctctcaaacttccttttaatcatttgtatatatggaatgtgtgcatgcaatgggttcattaaataaggccattgtgatcattttccaatcctactgttttatcctaaattagctataaatgtaatttttatgggacggaggaagtatataaaacgttggcaatggcttgaccgttcgaaaaaacagctttagcaagcctcacggagacccttgacaaggtcatcatgagcagtttagcacccgtcttcttcatcacaagctgggctctccattgtctccaagaactggagcagctacctgaactggggctgggatatcctccctgattaggcgaaaatgaaatgtcagttcactgaaaagtgaaaactgggagagaatgttgaaattacaacatcctaatcacagcagttaccttcctagaattcatgctaaaagcacaggatgcaaatgcaccatccatgcatatgatctgcaagaccgcaatcgacattcaacaggttacagttcaattgatttcaaagcaagcacaaccaatctccgcgaacacctgtagccctttgctcaggtattttgggtaagaccatgcccatctttcaacccagaaaattcatcagtacaaaacgttcgcaaagatcactttacccaacctccacaaattatgctacatataatttgacacaaagaaactacgcgattaaacatggcaatacaagcaagaacattgccacagtaggtataacgttgcttgatatcaaaggtttacattctcaatcatactgatactagcaaccgtctacaaatacaccatttctctaaactaaagcacaacgaaacaatcgcatcatatccggccatactcctagatccatcttcgaacattacacaacccgcatcaagattctacggctacatacagaaacatcaagacgcgtggcaccagcagcaacacgcggctaaggagctaaagaaaatctcaggcttcgagcgcgcagtgatctgagagcggatggggatgcgccgatgaggggagcagagctcagcgccgccgccgccgccgcggcggtgccgcctcctggggtttaggggggcggaggctggttgctcagctgggccgcatatccgcatctgagaatattgtgggcctgaatttttggcccttttctactaaattgtggcccattcatgagtagaaaacttacgggctcgtatacatggatgggctgagttttagggatgtatttgggaagataaaaaaaaaaggaaaaataacaatagtaactgaaatgaaattaaacactatactagtataggtttagaaaaccctaatttttgttgattcaagtctggcttatggccccccatatttcttggattttaaggtttgacaaaagaacccttccatgtaaaattttacagtcctatgaaattgtatttgcccaaaacagcaaacatattatatcaaaatgatgcaataatcttcaatggtcgacaagtttttttatggtagcaaagtcgagtaaatatgtgtttttgtagttgtttgagattaaattagattgagtattgtgaaaatctagaaccatataactcaagaggtaaagtctacccgtagagctcctcgttggcttatcagttaaggccaaattttagtattataacttacttttaaatttatttaaggttttctttttctccttttaagcattgggcgttatgttgctaagattaccagtagaagtacagctatgcctatttttcaatttataagccaggaaaaaagtacctaccaagcatgtcgctttaaaaagtatgatcggttttcttaaaaaaaaaactagcataaatggtttaaatgaccattgtgcgttatatataaaaaacatatacaccttccattttttgattggttgtcatatttgctttgtgcccggtaccaatacaaccccccatgacacttaatcagtattgatcaacgtgtgttgacgtttcgtatccatgcacgccatcatgatctgcatggcgcattggcctcgcccgcgcgtcgcgccaatttattgtgatcgcataaaatccatgcatacgaactactcccaaattgatttccgcaacacaccatacaaaagcatcattagcgtcttccacttgatttctgccagctcccaacgtcttgcgacgatcaaacatggatcttttttttattgtttttagcaatatgatgaccaatcgcggatgaagggactacatacgactcagacgacaaataatcaattgaactatttcaaataaaattaaataattaataaccttatttttatagacgagtatagatggtactccctccatctccatctacttttgatagtcatatttcatcttggcacacagaccaagaataagtaattctacttatcatccatttaaacatgctactagtcattctttgtaaataaacgattcattaatatttacatttctcaatgcccatgtagccaatcatgtgtgaaagaatggagagtcatgcattaaatccgagaaagtcattaagatgatagattgttgaattgaaatatgcctatcaaaaataaaatttccagatttgaaaatatgactatcaaaagtagatggagagagtattaagctatctactaggctgtttgaaggtactcttttttctctctcgctcttccctctacataaaagttcgcaaaccccctaacatcatgccattattgatgccctaagccaaacacttagtaataatattttacaatccttactacaaaatactccatattattttgtctaaaatgtaccctctaaacaacaaaacttccctttacgtaaaagttcttacttgtgtcacctactcgtataccctaacatcatgccattgttgacaccctaagccaaacacttagtgtaacaatatttttacaatccttactacaaaatactccatattattttgtctaaaacgtacctctaaaaacaacaaaactactttagtggagggtgtagttagtaaaaaagccggctttgtctcctcgtatatacactctctcggccttgctcggttcctcctgtcctgtctcccctctccactccaccgccgccgccgcctccgcgaaatggcgaatctgccgccgtcgctctccatcggcgccgcctccttcgccgcgccctcgcccccgccgccctcgcctggcgcctcctcgtcgtcgtcggcggcggcggcggcggctccgggggccgccaaggaccggaagatggcgtccgcggagcagctcgtgctcgacctctgcgaccccgagctgcgggagaacgccctcctcgacctctccaaggtctccccttgtcgcgagaagctatgcgttttctctcctcttcctcaattttcattttttttatcctcctctctctcgatcgatcgctgtgggctccggcgagggggattttatggttggattcggggggggggggggggggaatctgtacgtgccatgtggtgcctacgaaagttgcagcctttgtgatgtaatgctctgtctaggcaaaagtaggttgggacttgatcatctgatgctagtagtctgttctgaacgcagatcggctcacatgctactcatccaggggtaaatagcttgctccatctactgtttgatcagtgtttggtatgggaaaaaccagtcctttttttttgtacggagggttcttctctgggagttcgtggtatgcagatgtggtagcttattagtttcattacattctgccttccccatatccggcaatgacgagaatctagagattttgtgcaatccttcaattaattttagttaggtgaatcatataagctttatttgtgagtgggaatttgcgttttgttttgatgtctatgctgtgatgatgcatattcagaatatttgttctgtttatctgctatacatgttcatatctcctggttgcaaaagagttaattatctccagagggcatcctcagcttgcgatttctgtttctgtgtctgtgttaggtcacttgggatttctgtttctgtgtctgtgtctgtgttaggtcacttagtttgttctacttagggttgttcttattaaaatggatagtgctgtggttgtattctacgttctgttaggattggacagcagaaggcacagcccatgatttattaagagtaccaattaatctaagaactagaagatatacatatatatatatatatatatatatatatatatatatatatatatatatatatatatatatatatatatatatatatatatatattaagtcagaatcaccatgctctgtactttttttcatttaatcttgataagttacatattcactagatattttctttgtcgctatagcatgagtgtaaagagcaaaccaatcgtaaccactaacataaacaactactttttgcttaacagaacattaatagtagcccaaattggattttaatatgtgaaattgcttattttgctttttaatgtttgaagtcataggcaacaaatatagaatacatcattcttttttaaaattttaatttgacaactgtaacaatgaaaaattgaatacctatgaatccagagttgctaagcagttaaaaatatatgacttgttgaaatttttctccatcaagtcaacttcccgccaaattgtgttcttggtggcgtgggaccttgggagttccaatagcttgggtttgcattcaaatcctgggccagcctccagatgcatggtgttagcagatctcctttgaagcccaagccccacttgcagtgttccctagtcctctttagttcatgggtttgccttccataaaaacgaaaagggtcggcctgcaggtatagtggattggacaaattgatccaggtgcccactgtttccgacatgatccacgtagatgtaaaggggccgtggcccaagtaaaatggtgaggtccaggctgcgcctggaaacccaggcccaaaactattttgccaaatcggacatcgtgtctgagtcggattccgacatggcaacacctgtctgattctgactagtaagtacctcacaagtgtgaacacccaaatctgagtcagaccccgacaaacttatccttgtctaggactgtaggtacactttgctgaattgaatccatgcagcctatgagtacgaagatttgcttgggcataggagcggtgaatgaaatttgcaatctgctccaccctagacgagacaatgaaaacagtaactcacaactcatttttcgtttatgaatttaggcgtaactttccttattttgatgctttcatagtactcctaaatgtactgtttggcatcctgtggttacacaccctgaatggtctgatacaagagttaaatgtgtgattgtgcttttgtgtgcaagtgtattggggactgtttctatctatggagtggaatcttaccaattcagtgctttatggcatatagcttcttgaagattctcctatttggtagttgattagtttttccgttttgctgttcagcaaagaaattcataaatcattgttggtttctcgtcacgcctgaccattttgggaatagagattttgttgcctaacgattttcatggacttctttttccagaagcgagagatttttcaggatcttgctccactcctgtggcactcttatggaacaattgctgcactactccaggtaggttacaattcttcatgttgtttaagtcagtgtggttgagtacgaatggtagttcttccgaaaagaaattcatttgagtctttcatggttttctcattcagtttatttgtggtttggataatgcaggagattgtgtcaatctatccatcactttcacccccaacattatctccaggggcttcaaaccgtgtctgcaatgcacttgcacttcttcaggtacacctttacatgagaaagaaagaaaccttacgacagtgagaaatctctacttatgacactggtgcctcatgatgggatgagagaaggctattttttcagcatgttgcaatgcataaaagggggattgataaaatgctactacctctatccccaaatataagggactttgcctatgtaattacataggcaaaatccttatatttgaggatggaggtagtatcagcttaggatccctaaactgatttaatacaacatgttgctttctaaacttcattgtatttttattgcagtgtgttgcctcacacagtgacacaaggattcctttcttgaatggtaataagtgctgccatttttattccaagtattaaatatttccatgatgatactcattgttcaagaatatttcccctcttgcccaatatactatgttcacactattattgtatttattaaaaaaaaccatgtaacagataatgctgattgcatctatttagtttcagctgtgagcaatatgacctacttatggactatggcagtcccaatgctgaaaatttcagataatactaatcacatctagttagttttgcgcataggaatgttcatctgtatgtggctttatgcttccagttggctattgtgagtgacctgtttcctctcttgatttttcccttcttcttttcagctcacatcccactgtatctgtaccctttcttgaatactactagcaagacaaggccttttgagtacttgaggcttaccagcttgggtgtcattggcgcacttgtgaaggtaattgcaagccagaactttatgaaaattatgagggatatgggtgtgtttcttgagtggaagcgtagatttttaaagctagaccattttctgatctactaagatccctattcagctgttcaggtgattgacatgtggttcaatttaaccttacctatgctggtggggtgggcacttcagcttctacatgttcctcttttgactcccttctacatgactttttgggaaatattttggcctgaatttataagagtatcattgtgttcacgtatatctaatatgagtctataactttccttattccaacaacttcacaattgatacacttcgggtggcaagccctcttgtataagagaagctgtgagtttgaactacttatttggtatatctagtatattatattctttgcctgttattttccttctgggtttacttctggacaagctgcttgttcaattttttctctgttcttgaatggtggtttggtccagttctcaaaactatgttgagagggagggggtgaaagaaaaaagaaaagatggtgcaaatggtatggactatgggtagaactttccctttcttcatgacagttcttgtggacactggatacttatctagtcatgctgatcaaatggcctgatttgggtttggatccccaaatatccctatgtgaactgcaaagtttgagccaaacaactcgatgatgttttttttatgggcatactaccaggtttaagccctgtagttaattttataaaataagatggtaaaaccatcaacagttttacagagtttgagccaaacaattcgatgatttattaatgatcaagttgcttttaccagactttgattttgtcaatgagcatactcaataagttaattcggttttgttttgcaatatatgcaggttgatgattctgaagtcattgggtttctgctgcaaactgaaataattcctctgtgtctccgtactatggagatgggcagtgaactttcgaaaacggtgtgtagctacctgcctcctttctctcttgtagttcttccactgtttt

SEQ ID NO: 62439 - DNA, 82795 bp, Oryza sativa
  unsure (1)..(82795): unsure at all n locations
tgaagaagctgaggaagaggatgtaagctcatttcttaagtaataagattaggatgatcagaacatttgttagtccatgttgatggtctgccaattcatatagtctaatttgttatacatgagcaggaagatgatgctatggacagggatggaaatgatactgatgtcgatggtgttcatccacagaagcatgctaagagtcctgaacttgccagagagtttcttttggatgctgctgcagtgatattcaaagaacaggtagtgtatatcatgcaatttctaagtcctaatcactaaaagatacatgttttttttgtgatattagctgtatatatagcaaacacttttctaaatttatgatctgcgtctgaagtatcattgttgttgtatacaatatcgatgtcttctgtgtaatatatatactaggatctttagcatatgactatcgcttcagtgtcattaagatgtttagcatttactgctaagttatgaaaatatgacatggtattctaaaagaactttttttaatataaaactacccttttcaaaggatgattttctttgtggtctagatgaactaatctttattcatactcatcacaatatatgtaatatatgtattgtattagaatagccaacatagttgattaaatcatgcgacatagtatgttcttaactagttcattgaactgtttatgacattagatgattgtactcactctccagtgtatagatagattgtactcgctcttcaatgtaccaaacattcatggtcaatgtaatcagcacacgtgtcaagctattgttgtttcctcttttctttttaagatagtcgtacttaagcctgcagcatcatctcgtgttgacataggaaacattgtttttcctgtgaaggttgaaaaatctttgagggaagccacggcacaacaaaatgcacatagcgtatttgtgtcccttgcattaaaattgttggaagagcgggttcatgttgcctgcaaagaaataattacattggaaaaacaggtgagctacacatactttgttgtgtagaagaagagagagggagcaacttttgttaggatttgttgtgccttagttgacatgtagtaaattcgattaacttgccttgtagaccaagcttcttgaggaagaagagaaagaaaagcgtgaagaagaagagcgcagggagaggaggagaacaaaggagagagaaaagaagcttagaagaaaagaacgtttgaaagaaaaggaaaaggagaaagaaaagataccagttcaattgaaaccttacattggtacctcgtcatcacccctgagcaactcagcaacaccaattaatgatcagtcaccagatattgcccactccaaatactcagctagcgatgatgaagataaagatagtattgtggtcacggaatcgttctctcctgatacctgtgttgatcaatctctaacaagggaaagtgatggacaaagcaatgagtttcattgcagtacaacactggaatttattccatcagattgcaatggttctttcatgtgtgaacaatctacatcctcaaggaggaaactcagatttagaagggattcccttcaagaacagaccactggtttttggtatgaagattgccaagatgacactgggggtgttggaaatattcactggcaatctagggagagggcaaggaatgcaggtagaggctgcaactctttgttcagtgcgaataaccggacaagagaaaggtatgagtacaatgcctgcagttgtggccagcaggaagattatgggtatttttctccaacagctagatcaagtagagagatgaagatgtccaggaaaacaatggttgagaagccctggttacagtaccgcaggtgctatccattggatagcttcatagtgtcaaaaggaagccgagttggtagtacgccaaacaagaatgcagctccaaaacaagtatgggagccaatggatgctagaaagaaagctagcttagggagttcgaatggttcttctgaaacagttagcggtgttgatcgatccaatcaagtggggtgttcaaaggatattgtcaattgtagccaaatacttggctcggagcatgaagaactagctgaagcttcctctgatagatctgaagaagcttgcaaatcgataacagatcagccatgtgaaagcagtgaaaataatcaagctgcttgcaatagtgaacctcctgtggtgaacaagccagacagctgctttaccaaagatggtggtcagacagcaaacatgaccagttcagatagctcttcatgtctaagcgagggagacagagatagtagcatgagcagcatgacctcattgagtgctcagaatccggaatcctcgtctacttctgattcagaaggatcttcagaaaggaacaatagcaacccaggcaatccaccaaccaagaacggttcgcgttcattacttgaaatgtgcgcaggaaatggtttcagagaataccagccacagaatattcacccttctgatggcaatcaatttgggtttggtgtgacccctttccaggagcagctgttacatcagcaaaagattcatgcagctccatacccgtcaaccttgatgggtttccataatcatcacatgtcagttccaacaaatggatacctagcataccctcaacctggtcatttctacccaaatgctgttggatatggtgtggctggaaaccaatgtgttgacttcccaatgcagtacagtaatgtgcatccttatgcaggtcctgaatttggttatgtgcctgcacagccagtccataagactccggtgaactttaatgccatggtgccaactgctgcgctctttagaaatggagcgccagaagtcataaaccctgtcattgtaaaaccagacaggcagcatcgccatacccttcctcctgagccgaagcgggtggatcctgatcctcagaacggctgttcagaagataacaagaagccgcaagatggctctgtgcctttctcgttgttccatttcaaccttcccatatcctcgcctgcccaggcatcatctgaagacgaggtgagtggaggatgtttggcgtcgagatcgccaactccaagtgctcaaaaagctcagccttgctcaagggaggagaccaacataaaggagtacaacctgttctctgcaaggactggagtggaatttcccttcttctagacaacagacgcgcctattatttggcacagaacaatacatagcgagtgatttgtattctccaaaaaaacaaaaacaaaataagttacctcgaggtttttaccgtgttccctcgaatatttatttatttcttcttccatttgttttggttgcccttgtgtgtaaggaaattgcaaagatagtgagtggtatagtttctaaattttgagatatgttaaatgtttgttgtcccgttttccaccgttgcttttctaccgtattactatgtttgttccagattttcagcaaaggtggtacgtagattggtggacgctgttgacatgttttgctgtgataaatggacgcatcaagttcaattggtgggtaccaaccatcacacaatcttccatcgatcgccgtgaatttatctgctgaatggttttcttttttttttttgagagggtacaatttaggacgctcacgaacacaccacatcacacgcttgcgcatccctaacacgctagaattgagattggagacgtggaaacgtacagtcccataaacatgtgtaccctcccggtgcgaaacctgcgccgagtagcgctagaacgtgggtggtgagcacttcaccgagccatcggctcgttcgcatctgctgaatggattttgaagttgaaaggtgctgttcatggcaggtcatcaatcaccgtgattttggttgtgatctacttcctccgtcccattttaagtgcagctatggttttccgtatccaattttgatcatccattttatttgaaaaaatttaaaaacttaagtcacgagtaaattactattcatgttttatgatctcacaacaacgaaaaatactaattataaaaaaatttcaaataagacggacaatcaaaattaggcgccaaaacttatggttgcatttaaaatgggacggactgacggagggagtattggctatgaaatatatctaagcacgcaaagtggcagcctccgaatagaccatttttacggagaacctatgtacaaaccataaaagtaaactatatgtggatccgtgggtctgttcagttgtatccgatccctaaatatatttgagctatgctccggtgctttctagtggccagtattgttatggataaattaataatttactaatataataattagaagttactttatcatttatgtgtattcccggctaaatcgatatataattatctattgcgctagcatcgctcatatttcatcgaaaaagctaaaaaaggagaaaaaaaagattagtcactgctaaatgacgattagtcatttctaacaataatgttcatccatgtttttactaccgctaactgggatgataatacaaatagatctaaagccttcgatcaaatgagatcaacggtttagattgatttctactaccagtaaagagcaccgtagtgaggataaaaaaacatcattttacaacatctcaatatggagcttagctaaattgattgtagcgtgtttattttgctggtttggactagacgagttagagatggccaaaaatgtaccaaaaaccgaacaagagtgtctttcccttctttctattgtacttcggttttggggcctgttcactttgatgccattttcaatcttaccaaattttggtaaagttgccaaaaaagtggctacatttagtttgctgctaaattttggtaactatataagaaatcctgtcaaaattttagcaagttgccaaaattaactatgccaaaattttggcattaccaaaatttggtaaggttttttttggaaaatgaacaggcccttggtctttcagaagttcgttatttagtctttggctcagtttgtgacttctggaaacaaaactacatatgtaaaaacccgctttagcctcatcaattcaagccctatatatgttggcaaggtccgttacatccctacgttggcatatgcctaatccataactttgacagacttaccgtatgaaacggaggtagcacaaaattttcaacgtatgtacggctatcatctatcttctatctatctattatctattattatatactaaaaatccattaaacttcctacaaacgctctcaagccatcacatggcacttctataaacgctcctagaccgccacgtagcaatgtctaatctcaccatcgattttcacttaaatcggtggacccaataatttagaccattatattagattagatactaaaaatccattaaactttctacaaacgctctcaagccgtcacgtggcgcttctacaaacactcttagaccgccatgtagcaatgtctaatctcaccgtcgattttcacttaaatcggtggacccaataatttagaccattagattagattagacgtattttatttaaaaggaaacgaataacatactgttgggcggaaaaagaacgggcggaaaaagaacggaaaacataagtactccataaatacttaagtacgactaaaaaacaatcaagtttacataatgttgatcgaagaaaaaaagacctacgcactgacttgcttaaaataaataaagccaaaaacaacataagtacttagtaccattgaaaaaatataaaaaacaacaaagccaaaaaaaaatatacgtacataataccattgaaaaaaccgatgatctttatatataattttctattatttaaatataaaatataacactccataaatttaaccaaatattaccgttggtttttcactttttcaattttgacgtaaactaagcacactccaaaagacgtacaagaatctatcttagcaagttgattgaaaggcacggcaagtgggactgcctagacatccgtttacttctgcagtaatatgcagttttacgggcaccaacacatacataatttgttcaagaaaaaaacatacataatcatacttactgcagtaacatgcagtacattttcttattgcaataccacactattaacacataggatgaggcacactatgacagcaacacactatatatactatatactgtacatgcagtaacatgtagtactttaggcagttggcacgacggcgacagcggtgctggcggcgtcgacggggtgtaccgtgcgagccctcttccctgccgcccaccaccaggaagcggccttccagccggcacagcaaacaagagtaactgcagcgagaagtacgacgatgaccacaatcaaacatgaaaaaatcattatttagtaattccgaaagaaaagaatatatgaagaactaggacttgaacgtatgacctcctagctgactagctgaggaaaacatattttctcgtggctaatgatttagtacagatgatcttcttgaacctttgatcgtttaagactcatcgtcattattacgggtttttattctaaatactaaggataaagataaagaagagataaaatccaaccaatctaaaaaatagatactccatccgtttcatattataagtactagtcaattttttttaagttcgactaaatttttagaaaaacataggccttgttcagttggggaaatttttgagtttggttatcacatcagatatacggatacacatatgaagtattaaacatagtctaataacaaaaacaaattacacattctgctagaaaactgcgagatgatttattaatcctaattaatttatcattagcaaatgtttactatagtaccacattgttaaaacatgacgcaatttggcttaaaagattcgtctcgcactttacacgtaatatgggtaattggtttttttctacatttaatactctatgcatttgtccaaacattcaatgtgaccacgtgaaaatttttgttctgggaactacacaaggccatactagtattttcaacacaaactaacatgaaaatatattcaatgttagatttaatgatataatttcatattttagatgttgttaaaatttttataattttgatcaaacttaacaattcaaatgtcttataatataaaacagagggagtactaacattacaaacatgctccaactcaccgccgataatcttcatcagtagtaagtactaacaaacattcaaaagacaccaccgataatcgtcatcagtagtaagccctaacaaacattcataagaatcaggggcggatctagagtgtaacaagcggagcccttggcccccactcaattttgcagcgagtgggggcaaatgcccctttaacactttttacttccttagtctacctaagcggtagatccttagcccccacttatactattttctgcatccgcccttgaaaaaaatcagtcaacggggacgcggcgcattattttagaccattagattagatgtattttatttaaaaaactaataccttattactctatgtacatatacaggagattaaataactgttggctaaaaaatacaaaaaataatacataagtagtccataagaaggtacgtccaagagaaagaaatgaagcttatcgactgaccagcggaagaaaaaaaatatgcgcacggacttactataaaaacaatacaaccaaaaaagtatgtatcattagaaaatgatcgatggtattttgaaatagtattttatactatttaaagataaacatattactctacaaatttaagtaaatatacttagttaaactagatttatattataaatacgagatatccaatcaatgatctttaaatgttctacttaacttacgaggctaatatatataataactaatgctatgattatttttttattttacatcatattttagggtgtcaaatatcacttgacgaatatacaacactaatttaaatctaaatatgtaaaaataaaaacaaaacaatttagttgttttattttacaccattatattagatttattatttaaaaataaaacatttctcctatatacggacacatgagaaatatataattgttaaccagaaaaagtactccatacgttcatatgattgaaaaaaaaaataatgcttacgtatcgtttgccgtaagaatagaaaacatagttatgataaagccaacaaaatcgatagtccttaaaatagaactttctaataaaatataataatattcaaatttacgcaaatataaatataaaatatccaatgaatgctttttgacgttctatctaattattttaaaactatatatccaattttttttatcccgttgtattcctttaaataaataaactattaatttgtgtaaccctaaatacaacaaaatatatggagccgatatgtaataattaatgttatgataataatttcacatcatattttagattaaaaaacacttgacgaatatacaacactaatttaaatgtgtatatatattctccaaattactaaaggtgtctcatgtgataagataggtgttaaaaacaaaccaaacattgaactaacatgcactacactagatatcactttgtcttggttactgttaacagtgaaatttggtaagcctggagtagtcatcggcttagagtcaacatcgtcttcgaagttctgagattagccgatgagagttgtcaagtcgtcagttgtcggattcttgctatattcggttaaggaaattgatctactaaaggaagcttatctagaagagactgagttcaaagataatacggcatggcaagttatatattaattaggaatatagtttgttagtttccttttatatttagaaaagtgtgtttagtgtcctataaggactttatcttttccttttatctttaggaaagtttctttcttgttcgacaaggacttgtatcaacccatgggtataaatatgtacacccggggtctttgtaatttatcttcacgatcaatacaattcggcgcatcgccaccttttaccttttctactttattttatcgtccggcgggacttggcacctgacgcgggactgcatcggtgttcgatctccagctaagaggtaagtccaatgttccgccggcccaggcaattgtatcgtctacgtcggcgtcgttcaaggctgcattagtacattcgacctcttggattgctctggtttggatgatatatttgcctacctatttatcatatgtctttgttaatctagtcttagcatatcaatttagctctatcggctgcttttcgttttagggtttcagccggtatcggctaaatcgcgttgctagattagattagcttagacatctaccaccctgaaaactcagtcaacggcttgattgtctagatattagatattatgtttcttttcatacttagtgctgcatcagttaagtttgatctactaagtcgtgcttagaaccataatctctagcctgcatctaggcccctggtgttaattttggtaattaatgacaagtgctaattgtggactaaccgttgtctttgagctatacattttaagttaggtccacgtcatatgtgcgcatggatgattatcgatggattaaaattgacggcgcaaagcagagggaaagaagacggtaaaactagcgctttaatttagaattaatcgaggtgtagggcgatcaaatttgctagtttatttttagtttcgccgtactattaagaggggtaatgacctagcaaagagatgattttaattgccacactaggtcattgcattttcacttgtgctcacattttcatcacacacacaaaaatcactttgcactttcactgggttcggcctgaccagggacggtcagaccggccacatagtggcggtctgaccagcgtgccctggccagtctgaccggccgcaataaggcggtctgaccggcggcacatgcccggtcagaccggccccctggaggccgagatggtgctgctcgaggtggctgatacagagccgacggagccgtagtcggtcagaccgagccgatggcggtctgaccgagccgaggccggtctgaccgcccactcaacgccggtctgaccggcaaggccgatggagccctctgacagcacttcaactgctagttttctagccattgcagagtagcacggtctgaccggccacatatctccggtcagaccggcagagcacaaagttggaggatttcgcccccaacggctagttttggtgggtgagagtataaatactcccccaccagcagcaaggggactctcttggcacccaattcaattgcatacaccccttgcacctctctcacactcacttgagctttgtgttcatccatctagtgcgttagagggttgattagccaagagtcaagtgcatttgcttccattgtagagctagtgtggcacttgatcatctccacaccgggtcattgcttgttactcttggaggttgccgcctcctagacggcttgtggagaagttgccggtgacctctccgagaagattgtggaggaggcccgatgccggtttatgagtggtttggagttcaccaccttcggagtgaaggaagaactaccctagtgatcgaggcttgggtagttctctccgtgggccggctcccgccttgcccaccccttgacgaagggggcgtgcggtggcttcgtggttgagtggtggagttgggctcgcctcaacggggagtaggaaaccggcgagtttccgaacctcggtgaaaaatctcgtctccttgtctcattttattgtcgcatttacatttgtgcaatttacatttctagatgcaaacttgagatcatatcaccctaggattgctaaacattgacataggagtgtgatttactttcctagagatataattgagccactatcaccctaggtttgcaaaacataacttaggttcttagttagagttgaccctcaccaagcctagcaacttagattagttttgattaggtgtcatttagttttatattgcctattcaccccccctctagtcgacatctcgatcctacaagtggtatcagagcttggtctctcttgattgggcttcaccgcctagagagaagatgtcgaacgaggtgaaccatgtagggaaggctcccatgtttaatggcacaaactataccacttggaaaattaaaatgtctactcacctcaaagctatgagcttccatatttggagtattgtggatgtaggctttgctatcaccggcacgcccttgacggagattgatcaccgcaacctctaactcaatgcccaagccatgaatgctttgttcaactctttgatccaagagtagtttgatagagtgagcaaccttgagaccgcatatgagatttggaacaagttggtggaaatccatgagggcacaagtgagtacaaggatgccaagcttcacttcctcaagatccaatatgagacattctccatgttgcctcatgagtgtgaatgacatgtatgggaggctcaatgtcattgtggatgatctcaaggggcttggggcaaactacaccgatcttgaggttgcccaaaagatgcttagggctctaccggagaagtatgagacccttgtcaccatgctcatcaactccgacatgtcaaggatgacaccggcaagcctcttggggaagatcaacaccaatgacatgtacaagttgaagaagaaggagatggaggaaacctcaccttccaagaagtgcattgctcgccaagccgaagttgaagacaagggcaatggcaaggtgaatgaagccaatgagaacttggaggaagagattgcccttcttgctagaaggttcaatgatctcttgggaaggagaaaggagagaggaaggggctccaactccaataggagaagaaatagaagacccaacaagactctctccaacttgaggtgctttgagtgtggtgagaagggacactttgctttaaagtgcccttccaaggatgatgatggagacaagtcatccaagaagaagagtggaggctacaagctcatgaaaaagctcaagaagtaaggcaagaagattgaggccttcatcggggaatgggactcaaatgaggagagctccgcctcatccgggtccgaggaagaagatggtgatgatacaagctccaagaagaagaagatggccgttgttgccatcaaggaggctccatcactcttcgctccactttgtctcatggcaaagggctcttctaaggtaacatctcttagtgatagtgagagtgatgatgattgtgatgatgtttcctatgatgagcttgtgagtatgtttgaggagctctatgcttatagtgagaaggagattgtcaagttcaaggccctaaagaaggatcatgcttctttggaggtcttgtatgaggagctaaagacttctcatgagagactcaccatttctcatgagaagcttaaggaagctcaagacaacctcatttccactactcaacatggagctctcattgatgttggcatatcttgtgatttgcttggtgatagtgctacttgccatattgctcatgttgcatcatctagcatttctacctcttgtgatgatcttgtggatatgtctagctctagctctacctcttgtgtttctatttgtgatgcctcacttgttgttgagaacaatgagcttaaagagcaagtggctaagctcaacaagagcttggagaggtgcttcaaggataagaacactcttgacaagattttgagtgagcaacggtgcatccttaacaaggagggacttggattcattccaaagaagggtaagaaaccttctcactgtgccactcgttttgtcaagagcaatggtaagtattgctccaagtgtcgtgaggttgggcatttggtgaatgattgtccttgtggtaaacctcctaagacatgcatgtttgattctcattatatgcttaggaaggctcatgatggtagcattgttgctagatatgtgggttcccctatactcggtggtaaaaagaatgccatttgggtgcccaaagctttggtctctaacctccaaggacccaaacaagtttgggtacctaaaagagcttgatcttcttttgtaggtgaactaccgcaccggtgggagccattgggtgtttgatagtggatgcactcaacacatgaccggtgatagggctatgttcaccacatttgaagtaggagggaataaacaagagaaagtgacatttggagacaatagcaaaggaaaggtaattgggttaggtaaaattgctatctccaatgatttgtcaattgataatgtctctcttgttaaatctctaaatttcaatttgctttcggttgctcgaatttgtgatcttggcttgtcatgtgctttcttaccgcaagaagttattgtttctagccttcttgacaagtcttgtgtgttcaaaggttttagatatggaaatctttatttggttgatttcaattctagtgaagcaaatttgaaaacttgtttagttgcaaaaacttctttgggttggctttggcatagaaggctagcccatgttggtatgaatcaattgagcaaactttcaaaacgtgatctagttgtggacttaaaagatgtgaagtttgagaaagataagctttgtagtgcttgtcaagccggcaagcaagttgcatgttctcatcctactcagagtatcatgtccacatctagaccattggagctcttgcatatggatttgtttggcccaacaacctataagagcattggtggtaatagtcattgtcttgtgattgttgatgattattctcgctatacttgggtgttctttttgcatgataagtctattgttgccgagcttttcaaaaagtttgcaaaaagggcccaaaatgaatttagttgcactcttgtgaaaattagaagtgacaatggttccgagtttaagaataccaatatcgaggactattgtgatgatcttggtattaaacacgaactttccgctacctactcacctcaacaaaatggtgtagtggagaggaaaaatcgtatattgattgagatggcaaggactatgcttgatgaatatagtgtttccgattccttttgggcggaagccataaacaccgcttgccatacaaccaataggctttatttacatcgtctcttgaaaaagacttcctatgagctaattgttgggaggaagcctaatgttgcctatttttgagtttttggttgcaagtgttatatttaccgaaagggtgttagactaaccaaatttgaaaatcggtgtgatgaagggtttcttctaggttatgcctcaaatagcaaggcataccaggtctacaacaagaataaaggtattgtggaagaaaccgccgatgttcaatttgacgagactaatggctcccaagaggggcacgagaatttggatgatgtaggtgatgaaggcttgatgagagctatgaagaacatgtcaattggagatgtcaagcctattgaagtggaagacaagccatccacctccactcaagataagtcatctacttccgctacgccaagtcaagctcaagttgaagtggaggaggagaaggcacaagatccacctattccaccaagaatacacaccgctctttccaaggatcacccaattgaccaagtgttgggtgacattagtaagggtgttcaaactcgatctcgtgtcgcttcgatttgtgaacattactcgtttgtttcttgtcttgagccaaaacatgtagatgaagctctttgtgatcttgattggatgaatgctatgcatgaagagctcaacaactttgcaagaaacaaggtttggactttggttgaaagacctagagaccacaatgtcatagggacaaagtgggtctttaggaacaaacaagatgagaacgggttggtggtaagaaacaaggcaaggttggtggcacaaggtttcacacaagttgaaggtttggactttggtgaaacttttgcccccgtagcaagacttaaggctattctcatccttcttgcatttgcatcatgttttgacataaaactatttcaaatggatgtgaaaagtgcttttctaaatggtgaaattgccgaacttgtctttgttgaacaacctcccagtttttaagatcctaaaaatcctaaccatgtttacaaactctcaaaagctctttatggtttaaaacaagctcctagggcttggtatgaaagattgagagattttcttttgtcaaaagatttcaaaattggaaaagttgacaccactcttttcacaaaaatcattggtgatgatttctttgtgtgccaaatttatgttgatgacatcatattcggttctactaatgaagtattttgcaaggaatttggtgatatgatgtctagggaatttgatatgtccatgattggagagttgagcttcttccttggacttcaaatcaagcaactccaggatgggacgttcgtgagccaaaccaagtacattaaggatctactcaagaggtttggcttggaggatgcgaaacccatcaagacacatatggcaaccaacgggcatctcgaccttgatgagggaggtaaaccagtagatttaaagctttatcgttctatgattgttagcttgctttaccttaccgcatctaggccagatatcatgtttagtgtttgcatgtgtgcacggtttcaagccgctcctaaggagtgtcacttagtggccgtgaaaaggattctaagatatttaaagcattcctctactattggcttgtggtacccaaaaggtgctaaatttaagcttgttggctattccgattcggattatgccggttgcaaagtggatagaaagagcacatcctgtagtttccaaatgcttggtagatcccttgtgtcatggtcatccaagaaacaaaactccgtagccctctctaccgccgaggcggaatatgtttcggcgggtagttgttgtgcccagttgctttggatgaaacaaatcttgttggattatggcatatccttcaccaaaaccccactcctatgtgacaatgatagtgccataaagatagccaataacccggtccaacattctagaaccaagcatattgacatacgccatcacttcctaagagaccatgttgccaagtgtgacatagtcattagccacataagaaccaaggatcaactagctgacatctttaccaagcctcttgatgaaacccgcttttgcaagttgaggaatgagttaattgtcatagacttctctaatgtggcttgagatggtgcaccatggttgcttcttttgcatattgtatatttgctcctatttgctcttatgctttggatttattgccatttggttcttcattgcgaaaatggagcatgtcacattaagggggagttttgcactcttgcatgtgctccacttccttttatatgtgagcaaatcaactaaaagtcaacataagtcaaaacttttgcaaaatcaatgtaatttgaaaactatctcttggaaaatgtttcaaaaggttccctatatgttttccaaccctcactttgcaagaaaaatgttttttgaatgaaaatgccattttggccctcttttgaagaaactagaatcttgttttttggccaaaatgagattaaaccccaaaatgagattgagaaggaatttgaaaaaagtttcaaaacaaagttggtagagaagaagttttgaaatgtttttggtgttcaaatcatattcaaaaaccaaatatttcaaaagttgtttgaaaatcaaattcgcccaaaaacccctatagaccataaatggtcacctcctagcactcaaatgagttttgttgcaaatcttcataaatttcaaatattatgaatggttggcaatatttcaactcacacatttcaaaattgctccaaaaatcaattttttgttgaattttattgtgcggggtagccgaactgtgcaagggctgtgcacagtcggctaggggctaggcggtctgaccggcgctatatgcgcggtctgaccggcctagtagcggcggtctgaacggcctctagggcccagtctgaccagccgcaccccggcggtctgactggccgcatatagccggtttgaccggccgcaccccggcggtctaaccggccgcatatagccggtctgaccggcctgggatggtgggcccaggactttgtcctttcttcctcctcctcctcctacgcgacccctcctcatcccatctcatctcttcacttctccaactcgaaatttcttctcctctctcctctcccaaaccctagccacctccctccaccaaatccatccagttcaaccgtcaaaatcactccggttacaccgtaagtgaatctcctcctcttcctctctctattccatggattgatttgagattttattgagtttgtgatccatggcatggaaccctaggtgaaggaagaggtgttcttcgatttgcaccaatagagggtagtttcttggtgtgattcaactccttcaaccagtaaatctctctccctcttgtgcattgctctcaaatcgatctatttcaatctctagggttaagggtagtttcccccattactttaatcttgatgaaatagacctacaccttgatgttcatgtttcaatcttgtgcaacactgtcctagcaatttttagaatcatttgtgtggattatggaaggattcggtggtgctactgtcagtggcagtctgaccggccttgagccgtcggtctgaccggccgtcggccgttggtttgaccgacttcaggcatgcggtctgaccggccgtggctctcggtctgacctcccctgacaggccgtactcccccttcctcccacttcactatgtggtttctaaaattattacttatatatcctttgctcctgtttttcagtgatgcctccccgcactcgtcatggtcgtcgtgcgccaactccggatcctgtgagtgagcctgaggaatcgagtggagaggattacgctcaaagagatgaagaggttgaggccaatgttgagggggctagtgaggaggaaagtggagatgatgacagtggaagtggagagtatgaggatgaagaaagtgatgatatgcacattgatccatccatccagtttgttgtgaacatgaggaatccatcacagtataccatcttgaggcaccatgatcagtttttgaggcctcgggacaccccggatccccgttttcacaccgctttccagaagagtgtgtatgagcaagtctatgcagggaaagcttttgcagagcataagtggatctcttggagagacatcaatgagactctagagtttgagggcttgcaggatctcttcaggactgttggcattgaccggattatgactcttaagcaagattacaatgaagatttgatccggcagttttatgctacagtgtgggtggctggggactatagtgagatgaagtggatgtccgacaccctctagtgttctatctctaggaggcaattccggcggctcctcaatattcgcttggactttggagatgacttgcatgaggagcacacccataatccgctctccatagactacctctctcagttttatgaagatggagcgcggtacacatatgggaaggttgccggcttgaggaccatcccgagtgtggttaacaagattgtgagagctaccatcctccctcgcctgggtaacaatgatgacattaggggggtggcttggcacgtcatcgatgcaatcattcagggccgacagttcgacattgtgactctcatgctgcaagagattgccatctccaaggggaccttcactcagggaatctattatgccccttacatcatgaggttgattcaagacaagcttggggctgctaggcagaatttgaagaagcacaagcagtacaagccccgccttcagcttggagctccctgtgctcctagggtggcgccctcctctcatcctggagctagctcaagctcagcacctcctcctcctcatgggtatgatccaaatgccttctttcaccctcagtatgcctattttggaatgcaacccaacgagtacttcaacccggtacttggggctattaataccctaagtgaaagcattcaacgcttgtttaccgggcatgaagctttgcatgaggatgttcgtggcttgcgcacagatgttggagacttgaatgcttccgtggggagattgcacactcgagtgggtatattggattctcgagtccaaatgttggagagctcccaagcttctcatcgtcgtcgtcgtgatgcttctcatccttccacttcggcgtgtcctccttctcctccacaagagtgaagacctttttggtgcttgatgccaaaagggggagaaaagtgtgttttatgttgggttgggactagtagtagtgaggttagtcacctcatatttaataggttaaggaggtttgggctatattttgtgtgggtatgggctattactctatcttgtgtgttatttgtcattttgttaaactctctatgtcatttggaccctttgtggtcttgtaatagcctatgttttatttgtgagcccttgatgtggtcttaatgtgaacttgtgctatgatgcatggttggagttacattgatatacttgtgaccatcttatgcattcggttgattcatatgtgaagttcacattataatttgcatatgtgttgtgctatgttgaaatgtgaaattgaaatgtgcattggctccatatttgctatttgtaattgttatgcatatgtttagggggagcttttgcttgtcaatgcaatatatgtccatctgctctatgtttgattatatatatttgtggtgtttgtcatcaattaccaaaaagggggagattgaagcatctaggcccctggtgttaattttggtaattaatcacaagcgctaattgtggactaaccgttgtctttgaactatacattttaagttaggtccacatcatatgtgcacatggatgattatcgatggattaaaattgacggcgcaaagcaaagggaaagaagacggtaaaactagcgctttaatttagaattaatcgaggtgtagggcgatcaaatttgctagtttatttttagtttcgccgtactattaagaggggtaatgacctagcaaagagatgattttaattgccacattaggtcattgcattttcacttgtgctcacattttcatcacacacacgaaaatcactttgcactttcactgggtttggcctgaccagggatggtcagaccgtccacatagcggcggtctgaccggcgtgccctggccggtctgaccggcgcataaggccggtctgaccggcggcgcatgcccggtcagaccggccccctggaggccgagatggtgctgctcgggatggccgatacagagccgacggagccgtagtcagtcagaccgagccgatggcggtctaaccgagccgaggccggtctgaccgcccactcaacgccggtctgaccggccaggccgatggggccctctaacaacacttcaacggctagttttctagccgttgcagagtagcacggtctgaccggccacatacctccggtcagaccggcagagcacaaagttgggggatttcgcccccaacggctagttttggtgggtgggagtataaatactcccccaccagcagcaaggggactctcttggcactcaatttaattgcatacaccccttgcacctctctcacactcacttgagctttgtgttcatccatctagtgtgttagagggttgattagacaagagtcaagtgcatttgcttccattgtagagctagtgtggcacttgatcatctccacgccgggtcattacttgttactcttggaggttgccgcctcctagtcggcttgtggagaagttgcccggtgacctctccgagaagattgtggaggaggcccggtgccggtttgtgagtggtttggagttcactatcttcggagtgaaggaagaactaccctagtgatcgaggcttgggtagtcctctctgtgggccggctctcgccttgcccaccccttgacgaagggggcgtgcggtggcttcgtggttgagcggtggagttgggctcgcctcaacggggagtaggaaaccggcgagtttccgaacctcggtgaaaaatctcttgtttccttgtctcatttgattgtcgcatttacatttgtgcaatttacatttctagagacaaacttgagatcatatcaccctaggattgctaaacattgacataggagtgtgatttactttcctagagatataattgagccactatcaccctaggtttgcaaaacataacttagttgcttagttagagttgaccctcaccaagcctagcaacttaggttagttttgattaggtgtcatttagttttaaatcgcctattcacccccctctagtcgacatctcgatcctacatttcatcggggttttagccggtgagttatctggacgttgcatcggctcataagaattgcacatacatataagttggatttagctgatgacaacaaaggtttcactgtttaatctaatcttgtggatttcatgacatcggacctccagccgatgtgcgctttaaccttcggatcgatgcttatttatcatatcattgccagccgattggtttatactggattatattgttattttattacatcatcatcagccgattgcttttatatcatcatctacattggacatatagccgattgcttaaaccctattgctatcggctggtatcagcatcggctattatcggctatcagctggaactactccatcggcttgtcagccgatcggctgttctgatctactatttgcatatcttgtcagttgcaggatcaaactgactggcacgcccgcatctcatcaatctttggacctgcacgggagcttagcagatttcccaggccagtgtgttcgattttttcgtcaacagttacatataaatgtttctattattttgggataaaatttaactccttagatttatgtgacggagggagtataagtaatataagtctatctttaattagatgaagtagtatcattagctatatttttaatagaaaatatctttcattaatatataataaaattaaattgttccttaaagtcatctatagcatacaaaataaaaaatgttatataagtttggaaactccacaaatgtaaaaaaaaataatcactcatatatcgtacaaatagatatgcaccacctccatcattgtgacatattttttttctaataaatttgagcatatacggtttcaactaatatgcccaaaccagttattaacggacccatgtttaaaatagagtcaaaaataaaaattcgtattaaaattcaaacaacattaaacaaacttacacgcgcgtacgcgcgggctaccttcgtagtttttatagtagttaacatacatttatccatacattcgtagtaaaagcacgttgcaggtaaacataaagtaaaaattttcccactagaacggaaaagcgtaaaaaataatccgaagatttgttataatttgaaattaacagtaaaagcaagtttttaggaaggtttgtgtcgcagcgaataaaagtcttatgcatatttcatctttcatctttttaattgctcgctcacaagaagtatatttcaagaattgctcgctccaataaaagtcttaggcatatttcaactttttaatttcaaatgagattatcatatttgtaatgtatatataataaattaaaatgcatttatatttggaaaaagcacaccgaaggtccctcaacttatcagcgagataaaaaagtcctcgaactgcaaaaccagatatgcggggtcccttacctatataaaatcggtcgcaataggtccctcggtaattttgatcccagttttatccaacgtggcgctttgaccacggccatcggcggctgagtccacgtaggacccatatggacccaacatgtcagcgtgtccacctcaccttcctctctctttcccctcttctctcccttcctcctctttctctttctctcaatcttctctctggggctttgggcaggccaccgccgtcggtagacggggcgaggcgggagaggaggtccgcagccggtgacacagcggcgacgcgggagcaggggagcaaggtggcggcagggggagctgtgactggcgtgggggagctatgcttgcccggagccgccaccgacgacgaggccgagcggcggggagtcgtcggcggcggtgtcgaggtggcctgctcgacgaagcagtggcgcgagtggcggcgcccgagtccatactagcgcgccgctgcgcggctcgagggagagaggcggtggccaagtcggcgaagggaatagcgagcaggcggggcgtgatgcgggaggcgagcaggcgacggccctttccctgcccggatctgccaccgccgacgaggccagagtcgtaggcgccgccactccgcatccacagcggcggccccatgggaggaggacatggcggcgcgcgatgcgagagcaggaggcggcatcttcgatggcggtggcgatggaggtgaacgccgggaggaggaagacagcagaggggaagggacatgcttcgtcgccgctctcccttgtcggccgccgcgcgcctcgcactctcccccggccgccaccgttcttctccccagcctgctcccgcctcgccgctgctcttctccactgctggtcgccggtcgccggccgtcggacctgctctcctctcccacctctccatcctcgtcggcgcctcaccaagtcgccgccgcatcgtccgtcatcgatcaccagacaaggagcaaagtgagagaaagagaggaagggagataagaggggaaagagagagatgatgtggcatcctgacatgtgggacccacatgggtcccacgctgacttagccgccacgtaggacaaattcggcgtcaatactgccctgggacgtcaggtgaccggtatagttaatggaccccgcgtatctggttttacggttcgaggacgtttttgtatctcgctgacaagttgagggaccttcggtgtactttttcatttatatttatagtgttctgggccggcccgtaggcacaaaagcccaccatgctcttaaatggaaaaaagttcatttttatccgtcatgtctttgggttgtctcttatatggcttagtaagtctattgttcgtacctcatctctttgagccatgcttataggctggaataagtctattttgggtcccttaacgattttgcatcccctgatgttgaaccgggccggcccatggtgacgaggcccatcacgggcccgacaccagtcggggcgtgtcatgcttgggccggtccaaaaccccatgatatgggccgggccgtggggccccgggccttttggccgacggtgtgaatgtgtggggaggaaagtagcagagtgaaagctgatagtggggttgaagcgaagggcccacacggtagacagagataggaaggaaaagcatcccaacgtttcgaaggcgaaaattcgaaccatcccgcccttcccaaaaaccaggtgggcccactaccactacccactgcaggtggggccaccaacggttgggcccactcgtcatggtcacaggtaggtgcgggtgcgggcgattgattccgaaaattttgggggttcccgctccggcttccgcccaactcccatctgaaatcgattcgaatcctccctccttcgatttcacgcggatttcttcttctctccatttcctcttctccaggttctcctgctcctaaacccatccaaaaccctagcaagaggaagaggcagcagcagccatggcgcccagctccccgtcctccgccgccgcgcccacgcgtaccttcacgcgtaagcgcgccgcctccgccttcgccttcgccaaggccaccgacgagccctccaccaagcgcacccgcaggcccaaggcggagaccaagcccaggaagaagaaggacgaggtaaaggaggaggagaagccgcccatggaggacgacgcctgcggggaggagccggatgcggaggagatggccttgggggaggaagccgaggccgaagaggcggaggcggagcaaaagcagctggacgcccccgcccccggtgtggcgaggaagcgggtggcgcagcccagcagggtccgacacggcagcgacggcgaccacgacccggagttcgtcggcgaccccttccccgccaaggaggcgcgcgacaagtggccgcagcgctaccagcgcaacgccgccaccaggaggtataacactcacgcatcccagatctggcctcctcaccacgtttgcatcctcctctcaacgcgtcctctgggttggtggcaggcccgatgaggaggaggacatcaaggcgcgctgccactacagctccgccaaggtcgatggcacgctctactgcctccacgacgacgtctatgtcaaggttcaccaccccatctcaatttccttccttccttcctttattacgtcttgccatgcttcgtgtctatgctttaatttattgcgacttgcttgtcattaattgtgtcccacttaactagctcatctggatctctaacacatccgcctcaccctgatttctttcgttgtgtgtgatttttgttgcatcaaacaaggatgctcctttcaattatcaattgtatggaatgccccacatttccacttatatcttattgttaactgaatatcctgtcgtcacaattcagtctttgcatatactcctttttcgtgcttgtgtatttgtcaaataatcacaattatgtggccttgctcgatgaaattactttttctctaaagtagtacatctccatttcgtttgcaacaatcataggctgaggaagataaggccgactacatcggtagaattactgagttctttgaggggactgaccactgccactattttacctgccgttggttctttcgggcggaggatacggtgtgtatcaaactctactagagtatgctttcctttctttttttttggtgtgtgtgtgtgtgtatgtccaaactctaacaacgtacacatctgggaactatctttgaaggtcatctcatccataatgatggagaatgctgatgatgaaaagcatgatctcaagcgtgtttttctttctgaagaaaagaatgacaatgtgcttgattgcatcatttcaaaggttaaaatcgtgtatattgatccaaatgtaagtggtctctctcagaatcttgtgctacctcatgcttgtaatgttccacattgtgattttccccttcatttcgtttagatggaatcagaagccaaagctcgacggttggctgattgtgatctgtactatgacatgtcgtacaccgttgcttattcaacatttgctaatatcccacttggtaaattgctctgttcttgttgctagctgaattaagatgacctctatatatattgcccaatatatatttgtgaactgtttcaaatagaagcactaactcatattacttccacctagaaaatggagcatcaggcagtgacactgcatcagatatttcttctgatgatgtggattcttccaaaggcaaagttgtctctgattcagaggcatcttcagtgggaaaggctacactccttgatctgtactctggttgtggcggtatgtctactgggctctgtttgggtgcggcacttgctggactcaatcttgaaacggtattattcttccctcattcgtctgggagaacttttgcgatatcagtactaaaccctttttttttctgctatgtggccagcgatgggctgttgatttcaatagttttgcgtgcgagagtctcaagtataatcatccaagaactgaggtatgttgtgaactgcattgatctatttgttttcagtgttgttttatgatctgctaactctaacgagctaatcattggatcaacgtgctatggattgtgtaatcaaatttggcatactgtgaagaaaccatttggtaatgctagtaccttttttttcctgaatgcaggtccggaatgaaaaggcggatgagtttcttgctcttcttaagggatggcatagcctttgtgatgaatatgtcaagaaagatattgatttcagttcagctggtgcctcagagaacgaagaggatgatgatgagcctcttgaaaaggatgagtttgttgtggagaaactagctggaatctgctacggtggcagtggtagagaagatggcctctatttcaaggtacccttgtctcatcatttgcatattatttatgggttcctgcagtattctgtgagtgttgcttcaacataattcttttaacaggtacaatggaaaggctatggccgtgaagaggacacttgggagcctattgagaacctcaggttggtacctttctggctggcatataatcattaacaaggtttatttctgtttgaaataacctaatctattttttaataacctagggattgcccattgaaaattaaagaatttgtgcaagaaggatacaggagaaaaatcttgcctcttccggtgagtatttgctttccttttatgctcttttctgctatatactttgatctgctgatgccatctatgtttaataattccatagggtgatgttgatgtcatttgtggtgggccaccatgccaaggaataagtggtttcaatcggttcagaaaccgcaaagagccactaaaagacgagaaaaacaaacagatggtgacattcatggatattgtggcatacctgaagcctaagtatgtcctgatggaaaatgttgtagacatactgaagtttgcagatggttaccttggacgttatgccttgagccgtctggtggctatgaagtaccaagcacgacttggaatgatggttgcaggttgttatggcttgccacaatttaggatgcgtgtgttcctctggggagctcttcctaccatggtttgtttccattgcatttgtgaacatttggtagtgtttgatcggaacagtgaccaggtgcatttgttaatgtaggtgctgccaaagtatccgcttcccactcataatgttgttgtccgtggtggtgccccaaatgctttttctgtaagtctgaccataactctaaattccattgaaagtctccgtattctgactagcttgatcttgcttgcagcaaagtattgttgcatacgatgaaacacagaagccaacattgaaaaatgcactgctgcttggcgatgcaatttcggatttgccagaggcaagtgtttcatcatctattaatacgtttcttgacctgcaactgcaatcttaccccttatcttcaggtaaacaaccatcagcctaatgaagtgatggaatatggttcttcccccaaaacagaattccagcgctatatccggcttagccgtaaaggtaataaaacaacctctaatagctatcatttgtgtgctttgaatatgatgggtgggtttatttttgttatcaatgattttttcccttacatttcaccctgtacaccaagtttaattcattttttccccaaatgttctagaaatgctggatagttcttttgaagggaaggatggtccagatctaggcaagcttttggatcaccagcccttaaagctaaataaggatgaccatgagcgtgtgcagcaaattccagtaaagaaggttgtcagttgtacagctttggtcctttgtgaacttgtccactcattctttctgcagtcataatcaatttactgtgtttcagggagccaacttccgggacctgaagggtgtcagggttggggcaaacaacatcgtggagtgggatccagacgttccccgtgtatatttatcttctggcaagcctttggtaagtgttccgtgctctccccattgttgtgaattgtttgctgcatctagtatctgctgcttagtatgcagctagtgccatgctgtttgcagtcacaaggggatgtatttatattcaggggagcacgtttacagttgtgatgcatctattactttgtggggacaaatttacaggcgccctaggtgctgattagcccttttgaattatgctccctttgttttgtattgtcaggcaccttgattttttttctaagtcaattttttttaaaattgatcaagtttatagaagaaacgtagcaatattttcgatactaaacaaatatactatcaaaatatattaaatattagatttaatggaattaatttggtgttataagagttgccatattttttctattaacttggtacacttatagaagtttgacttaacaaaagacaaagtgtcttatgattgaagcggagggagtatattgcatttttaggaaaaatatgttaaaagtattagaaggcctgacaaagtagctagagaatttctaggagtggagtttcaaaccaaagtaacaaagcatggcatcctctaaattttcatgaactttgttatgaggagctcctagcttcctaatcttctattatatactaaaagtccatgaaactttctacaaacgctcctaagctgccatgtagtattcctagaaacactcttaaatcgccacgtggcattttaataagttggtgggcccattattttcaatgaataaatttatctttagagggaaaaaaaaccacaatccctcccaaataccagtcccactctcaaacaaccctagtcggatgtacatagtcgtacatggtacgactatgtacgttcctccatctgataacctattactctaaatataaataaagataattcaaaccggtgaactcattaaatttattttaaaaatacaaactctactaatttttaaagtagaccgttatccctttcatgacaaactaagtaagaacgcaacataagaaaataacaatatttattattttatattaaattcattttatataataaagattgattaaatcaccacatgtcacgttttaaacttaagaaaagtaattaaaagaaaaaaagaaattgatatacctattatttttaaccattagatcattttcagaaaatcttaatccaccacatcatgtcttaaaggttaaaaaaacattgaaatctaaggaaaaaaaacattggttttcacttagatatctgcaaatcagtcctccaccttcacatcctgccagtccatcacatgtgcataatagtgcccaccccttgccatctctcaatcgagcactgcactatttattcctcaccagtccctccctatctagttttagctatcgaagtaaaagagaaacaaccaataattatagatattgaaaagaccatagttttaagctacacatattatttctaatccaactcttgctgtatttatatttaaaacaacaatttaaaatccacatgtctgtattttgcaatataaaatatatgacatttaggcacactccaccagtgcacttggcatgtcatccaaatagcaacggattattatataaattgtcgagacatatttcattactatacatcagtctacaaatgctgatagctatactaaatcaatagtacccaaacaaaattggcaaattcatgttccaatcattgtttttatcgatggacaacacccttgctattttacatgctattggacttgccttgaaaaactatgaaataattcaacaaggcacgttgctccatcatatattgttttgcaaacatgcaaaactaaactagatattcagtgcataagaaaaagatagctgaaattttaatagtctaagctactacattaaaaaataattcgaagggacaaacaatttaacaaacataggttgcatcattatacattgttttgcaaataggcatagcttaacgagataaacaccgtattatgaaaaagaactatctcaaatatgaagatgcagagttgctattgtattaaaaaaaatggtgcctgacttatagaaaacaatatgattacttcgtattttttaaaagggacaagtttgtgcatttgaccctacttttcaaaattagagttaccgtctcaccctgttttgaaatgagtaaacttaaaaaatagcgttagtagattggtatttaggttttgaaataggccaaaatggacaattgtcctttttaaaaaaactaatatgctcaaataatccaaatgttcttcctattttctgtgtaccatgttaccctaaacaacaattttaggcagtcacttgacactctaataaattagagaaaattctagaaattccgagaaaagaaaagcaaagcatcttgccatccttttatcacttaaacaagtggattcattatttccaatcattacatataccttatatatatatataaaaatatcacatccacctccaccttctgctacctatcatattcaagcatgtattcatgatagatcacattccaaaaataatattacccaattatatttagccgtccaaccatattcaccataggctacgtagagcctcatgtcccaaccaatccatccattaataaaaattgacaacttatataggtaatcaattaaaaaatgaaaaaaaaaaacaccacttttctgttacactaaatttggtagacatgttttctaaacaaaataagtccaaaataagacgattacaaggattataaaaaaaatgtttatggggattgcttaagtaagcaatagaaaaaaatggagaaatcgtgcttttgaagcatagcaaatgttttccagtttatattccgccattgtaagtgtataaaataacactatacgatgcatgcccgcgcagatgcgcgggctatcttcctagttgttacaattgctgaagagctagcttgtctgtgtggctaggttcctgactacgcgatgtctttcatcaaagggagatcactgaagtaagttgcacaatatctctggtttcttctcctgcagtaaaatttggagtgcgatatatttcttacaaatgttgttgtaggccatttgggcgcttgtggtgggatgagacggttcctacagttgtgacccgagcagagccacacaaccaggtccgattgtcaagaaagtatagcaatttctacatctgtgcatcctttctcaacgtgtctgaatgtgcttctctgcagattatattgcatccgaatcaggcgagagttctgaccgtaagggagaatgcaaggttgcaggggttcccagactactacaagatgtttggccctatcaaagagaagtaagctttgtccctttcacatcacatattatattgagttgcaccgtccatcaacaatggtgtcaactctaaatgttgggttctaactggaaggctgtgtttgatggcggttgcaggtatatacaagttggcaatgcagttgctgtacctgttgctcgtgcattgggttactcccttgggcttgcataccagcgtgagtcggaggggagcagccctctgttcgtcctgccagacagcttcacggaagtcgggcgacaggcggcgccggcaagagcatcctctgttggtatccctgttggcgaggttgttgagcaatagaacacttgggtagagtagagtcattatttggttcgattcgaaccgatccgggagaatgttgtttaaaatcactgatcagccaccttggtgctgtcatgtgatcaccatcaatgttattattgattgattgaatgttgtaaggctggtggcactcctgcttgagtgcttgttgtacttgtagcataaggtccaaaacattcattcatatccttctatgggctatcttatgtctgtatcctgatagattgtttgtgttcaatcatcatctcacattgtataggctgcccctgatatcattgttgcatcaaccttgtgcttttttggggcttatttgttagtccctcaatctgaactagtaaagttgaagtttggatgttgaaatggattttgggcctagagttctctttggtgtattgctggtacaaaggcgctttgcgaaattctatttgggtagctccctttggatagctagtttgtcctagggggtgttttggttgtgtcatgtttcacgatgtgtttttttcttgttttttttttggtgtttttagagaggtcctttggatcactcggttatatagtttatcttcttaatgaaatgaagcgtagttctcttgtgtttttgagaaaaaaaaagcaacagtcactagttagatagtgtgatggatcaaggtgccagttgaggctaatgacgactagagccaaaccaggtatcaagtggatatgcaattaaattgtttgctcctcttttgtgcgtgttagtacattcttttttttttcaatcggaaagactactactccatgcattctttctcacatactcccttcctaataaactgagactatcaaacatacttgtaggataaaagaaagatcttaaaacaataggtcttgcctagttacaatagttctactagttctttttttgttgtttctttgtagttatgtaaatatttactctctccgtactcgtaaaggaagtcgtttaggataatgtttaagtcaaaccttgggaatataaatcataaataactctcaagttgttgagtttaaaaatgtaaaaattatatgaatagatttatcttgaaaaatactttcataaaagtatacatatatcatttttcaataaatatttatagaaacaagaagtcaaagttgtgttttggagaccgtgtcaatgtcctaaacgacttctttaatgagtatggagggagtacaactatactgagtattgtctagtcagtgttcccttaaaaaaaagtccaccattggatgaaacttgcttttgaatgtttataactattaaggccctgtttagttcccaaaacaaaaattttcacactgtcacattgaatgtttggacacatgcatggagtattaaatgtaggaaaaaaacaattacacaaattgcgtgcaaattatgagacggatcttttaagcgtaattgcgccttgatttgacaatgtggtgctatagtaaacatttgctaataacggattaattaagcttaataaattcgtctcgcagtttcctggcggaatctgtattttgttttgttattagactacgtttaatatttcaaatgtgtgtctgtatatccgatgtgacaaccaaactcaaaaattttccccaactaaacaaggcctaaagcttgttatttgcgtgcatcgtacaatggcaagaaattgtacttttattgtataaaaataactaataaagttgtagtttgtaccttccatcacatatatgcatatgtgggtttatttgtagcatggctaaaaatggagaatggcatggagagatatatggcagtagttggaaaggatgacgagaattgcgtgtcaccctcttccctttggccctgttgcccccaattcgccttcgaccccttctccttctccttcaacatctaatcatcacggagaaaggataaggtacattacccccatcacaatacataaaaaagttgttttttattgcatttggttgaaacttgcatgattgttgatctagcgttcatgtgacatgtttctctaatgttttgatgtgcggacgacatgtgtattgatcccttgacatttgtatctcaaattaaatggtgatttgctcatgcgtttgattcacatgctttgattattgcctttcgtttatgaaatactttatctatttcatattataagtggtttcgactttttttcaaagttaaatttgatcaagtttatagagaactgtaacaactcttataacacaaaaattagtttcattaaacctaacatttaatatattttggtagtatatttgtttggtgttaaaaatgttactactatgtttttttcatttaaatttagttaaactttaaaatatttgcaaaaagaaaaaaaatcaaaagaaacttaataatttgaaatggagggagtataagaatgcacgtaaatatgtgatgcacctccacacattcaattaaaccgttcactttaatgacataagatactccctctattttatattataaattgctttaacatttttcatagtcaaattttatttagatttgactaaatttatacataaatttagcaatatcagctacaccaaataagtttcattaaatataacattaaatgtatttttacaatatattgaatatgttactatgttttaagttgaagtaagaaaaagaatatattacactcacggtacaacaacttggcgggtgtgtatgatatagtgcaagaacttaagaattaaaacgttcgagtgcaataatttgataagtgagtgcactctagtataagaacttgacaatttagtatttagtgcatcaacttagctaaacatatgctaggtgagtttttctcatgatgtcaatataccattacaataaagttaaaacgacttgtaacggaggggtaacatgaacaaatcaactcacaacaatttttcacctgtcctaattttatccgttattgattaattaaatttaactttttgcaggggtgggttcacaaattttttcaattgtgttcttatttattagaggtaattaagtaattattattagaggtacaaattaaggtctctgagagagaggggccggggtgggccctagctaggtaatggcagcctcgccggagtcgtctccgtcgtcggccaactccaccaccccgtcagcaccgtcgccgtcttcgtcgttgtcaaaatcaccctcacctccctccccatcatcgccgccgccaccagcatcgacgaacgcgccaccaaaatcagctggcggcgtttcatcttccacgcaagcgcaaccatcgtcggaatcatcgtcggagtctacgactacgccttcggcgccagcggagaggaagagcggcgggtcctctcgaggagagtccgggcggtatcgcggtgatgtgaccgccggcgtgtttgtggggttatttgtggtggcgatggttgcggtgttggcgggtgtggtggccatcgtggtgtgctgctgtataaagataacgaagaagaagaagcggccgccgccgccgaacatgcccttcttcaccgacgagaagggcaacgtgtactacgccacaggcggcctgcctcccatgtggcagcagcacggcagcagcaactacagcatcccacctccgccgccgcccggctggcacatgtcatcgtcggcggggggtttcagcggcgagatggggatggggtactcgtcgggaccgtacggtccggcgctgccgccgccgtcgccgaacgtggcgctgggtttctccaagagctccttctcgtacgaggagctggcggcggcgacgtcggggttctcggcggcgaacctgctggggcagggagggttcgggtacgtgtacaagggggtgctcgccgggaacgggaaggaggtggcggtgaagcagctcaagtccgggagcgggcagggggagcgggagttccaggcggaggtggacatcatcagccgcgtccaccaccgccacctcgtgtctctggtgggatactgcatcgccgccaaccagcgcatgctcgtctacgagttcgtccccaacggcaccctcgagcaccacctctatagaggcggcaatggcgatcgagttctagactggtcggcgcggcacaggatcgcgctggggtcggccaagggtctcgcctacctccacgaagactgccacccgcggatcatccaccgcgacatcaaggcggccaacatcctcctggacgccaactacgaggccatggtcgccgacttcggcctcgccaagctcaccaccgacaccaacacccacgtctccacccgcgtcatgggcaccttcggctacctggcccccgagtacgcctccaccggcaagctcaccgagaagtccgacgtcttctccttcggcgtcatgctgctggagctcctcaccgggcggcggcccgtcgacacctccaactacatggaggacagcctcgtggactgggcgaggccggtgctggcgcgcttgctggtcgccggcggcgaggaaggaggattaatccgggagctggtggactcgcggctgggcggggagtactcggcggtggaggtggagaggatggcggcgtgcgcggcggcgagcatccggcactcggcgcggcagcggcccaagatgagccagatcgtgagggcgctggagggggacgcctcgctctcgctggaccaccaccacgacgacgacttctccgcctcatcggagatctcgcggcatcggcaggtggccttcgacagcggcgactacaccgacgactacttcaccacctccacctccacccactcctcccgcctcccacccaagcgctaatcatcactaattcttttatttatcgatttaaattataattagctggtttcacaaatcaccctacactcgtggagaaaccatctttactcccggttggatatccatttaatcccggttttccaaccgggagtaaggatccgggactaaccgggactaaagatgtatccttagccaccaaccaggactaaaaagaagggatcaaccgggactaaacagacaatagcggtagtgcagatggtccctttttctttttctttttttttattttctcccgaatcaagtaggcaaatccccaaatctaactaacatcccaaattcacaacaccaaatccacctcacaaatcataaagttacttatacacacaaatcaaatacatcacaatatcctaagaaattactcaaatacatcacaaatccaaacaatgaatcacaaatttgtaacttctcggataaatacatctcagtgaatcatcacaaattaaaaaaaaaagaatgccgctgccggtcgccacgaacgacgggcgcggccccgccgcccgccgccgcccgaagccctgccgccgcccgccaccgggcgcggccctgccggcctttgccccgctgcccgccggccgccgcagcgcgcggccccgccgccgaccggcccgccggatgggaaggggaggccggccgggaaggggaggaggaagggagagaaggggaggagaggaggaaggggaggagttggagaagagagttagagaggatagatctgaggggagggggtgagattcgatctgttaagttgtaactgtggaggagaggataagggatagggattatatactacgtgtttaattttagtcccggttggtactaccaaccgagactaaagatcatcttgatctttagtcccggttggtactaccaaccgtgactaatgtggtgatctttagtcccggttattgacaccaaccgggattaaagatcttcggccccctgacatacatctgacaggggatgaaccgggactaaagatcatctttaatcccggttggtgttaccaaccgggactaaagatcaaaatttttataaccgggactaaagatcatctttaatcccggttggtgttaccaaccgggactaaagatcaaaatttttataaccgggactaaaaacaatctttagtcccggttctttttggatccgggactattgtggattttgccggaccgaccaaagatggtttctccaccagtgctacgaatcaaactcgagtatacttacttctatggccatatatgtgtattatatatagtcgtttggatttaactgcttgtgtataccatattcttcattaacacatatacatacctatatataaatcctactccctctgtcccaaaatataacggattttgaacggatagaatattttctagtataacaaatctgaacagagttatctagatttatagtactagtaagtgtcccacaagtccaaaatcccttttatattttgggacaaagggaggagtatataagtagccccatagttatgatttggtgcagtcacgtcatctgtattatttcagccattagatgaggggagagtaggtgtcatatgaaccgttcgattaaatctgagtattggatacttgtataattgttgccccaactttacttttcatatataaggatactctcatttaaaatgataccacaaatcactgctccactactctaaatattctctccatttaagctactccctccgtttcacaatgtaagtcattctagcatttcacatttatattgatgttaataaatctatatagatatatatgtctagattcattaacatcaatatgaatatgggaaatgcttgaatgacttacattgtgaaacggagggagtagaaattaaccaagaggtcaccaatgccataaatcctaaacgaccgttaccactgtcattttatctccatttgcagtttcacatgcatgggcttaatcaagaattaagaacatatctttatatataagatagctttgtttacctaagaattctgtactacctgcttaatgctgaatataccactgatggaatcaaccaaggatgggtgccaattaaaaataggttagtatgctcatatttcatcattttgcatttttgtgtgatcttcacatctttttccataattacactataatttactctatttttttacttgcatcacatttctaatcccttctcttttgtccaaacgagtttgcatgaaaatgtccctctaggacaggagcggatccatcatgggagcggcgggtgtttgaaccttcaatactggcgtgaggaccatgggagtccctttaaagcatctacaattttttttgccatatgtagatgggagagggggttatagctttgttctagtatattcatacccctactatttttttcatggatccgccactgctctaggatgtcacttacactatgatatgcgtggctcaatgttttctccaagggatatatgtttgggatcgtcggtacgagagtatatgcgagattgaggtaaaagagatgaagacaaggattttcatacaggtttgggccccttatatatctaattggtaatagccctacatcctattggtcgaaaccggtgttgctcttattcatctgaaccacacaagtacaatatttgggataacctatctagttgtcgtcgacttgtcggcatggataaccaactcgtagtcgatgacagggtagtcttcctcctcgaattcgcactcggcgagatcagaggtagcgctagatccctcttgttggcctccgcagacaccatattgggattgtttaggcttatctctgatgtcgatatccgacggcttgtcttggcgtatgttggcttgtgtattgtgtgcaacatcttgtggccttgtggcgtgtccctctccttctaggaggccttgtatttataaccatagatatccccttgtctaagtagaactaaagagaccaatatggatacaatccgagtagtccttgtcgtttcctcgtagaactccatttgtccttctatatacgaggtatgattccatataagacttagtatgtggtgtgtcccgccgagcttaatcgattactattaattgagtatgtgatatctataaccctaacaagacagacatggtttttcatagcgaatgcatacataataaaactttgtttcatcttccaaaacaaaacataacaaaaataacaagaatagattaccagccaacactatattacggtcattgcgccctttacgttttattcaggagaaaatatgctatatcaagttattctatttttaccacaaaatagagtaataattgttgatggtatcaacttattatcatagcttcctcctttgttacttgatgaatgtaaagttttcctaataaaatttcaaagttgtacgtttcttcgtttacttaagctgtactatattttatacgcacaccaatccaatgtcacttaattttatcttataaaatttgcttatgtcaatttcatacatattttcacagcaacacgcgaagtactatctagttaatagatgactactccaccaactcctctgccgcgcttccgcccaagtgctagctaaacatatattgcatctttaaccaactagaatttaatttaatcgattgattaattaattagctgatgctggggcatgcctttgcgtgccgcttgtacaaaggatcgacacgctataatacactagttgattgacaatgaataccttcatgaatccttcaaacatatcttgaaatttatgaagacgctgcagtcgtctcactatcgatggttatgtcgttaattagctataaatacaagcacatgtgttaagtttaggacttgaatccgagtggatagattccaccaccagaaatccttctaattggcattcaagtagtgtagaccataaggatccaccctcatttggagcttgaggcgatgttcattgcttgaaagctattaatgtgcaatggagagggagtaagagtaagcagagaaaacttgactagagaatgattcggttgttgaaagatatttgtcatctgacatgacagatttttattacactcatttttttaaaatgtgaagtgcataaaaagttgatcatagttccttgttcacacgctatgttgcacgtaagataataatgattttgtaggcacctctctaattaatatgtagaatcaaaggtttctaggctctgtttggttccatgggctaatgtttagccatcaccttttagcctcaaattagccttcaatgatccaaacatgtgggctaattttgagctaatatgaattagctcccctcaaaacattagcccctccaaggggtgctaatggggctaattttgtgttgggaccatcaaaaagcaaagcagctctctctctctctccttctctctcctctctttctactttctctccaccttttagctttgaattagcccatggttccaaacatgccatcgtaagctaatgtttagcctaccaattcatgactaaacattagctctcaaaattagccctgggctaatcttccaaacaggccctggtagggtgcccaacgattgaaattgatgctacatttattgccatgcacatagactatactttggtgaatcctctcaacatgtgcttaggtagatatttaaaacttcatgaagtttactttcaaacccatatatatgaactatgaagacatgattatcaaaaattaaaatttgggcttagagttaacaacactgaaagtctcatttgtaggaattaaatagtcatgaccatatcatatccttcattcaaccttggccgccacaacttcaaccgtatattgattataatgcttcctctgctatggattaccacattcttctcgttggtgatgttgatcgatgtgcctccttactactgagtggcatctactatcaccaatagtagtatataccattgtaaaaatatgttttatcataaaaaaatcatggtcctaggttcataaaaaatgaatgaattttaaattgcgcatgaaattttgatttggaggtcctcataaatagaggtagagtgagcatgtgagtgtttatagaggtgagtgtgcgtgtgtgcatatgaggctatgagcacgcgcatggtgttttcttttaagaaaatcatgtttcgtccgttttataatataagttgttttgactttttcatagaaaatttagcagcatctatgataccaaattagtttgattaaatcaaaaacattaaaaatattttgataatatattattttgtgttaaaaatgttattgtattttaatataaacttgatcaaacttaaaataggttcagttatgaaaataaatcaaaacaacttggaatatagggagtactaagctagctcatcgtgactgttcagatttgtggtattaggatatgttatatatcatagtagattaatgtgggacggatgagtagcaatgtatggtccaattgagatcctacagtactgcatgtgtcacatgtctgtatccggtatggtctgttcaaacgcctgagcgactagttacttgctggagttgttgtattgttacagatagacccttgacaatcaggcggatacgagcaaaagcaaaggcgatatttgaagaaaaagatgagaatgagagtgaaattttagaagtcggccattggagaagtaggaaattggaaggaagagggtatgtgaaggccgcaggtggcaattcggcccaagaaagcagaaagtggggtggcaaaattgtagaaaggcccaacaaaaattgtagaaaggcccaacaaattgtgcgaaaaccaccccacaaaaatatcgtctcctccgcgtgtgcggaaaccaccccgcataatttccaaaatacccccgagccctaatcccctcttccccttcctcctcgctacggcggcggcggcgacggcgaccgccggagccgacccgatcccacccgagtccttccctgtgcgcgcaccgctccttcctctacttcccgaccgccgcttcctcccctgttggtgtgggcgcgggcggctagaggaatcgaattgaaggtatacgtcctcttcctcctctgcgtcgtgacttggtggattgaagggccggccacctgcgtgttgtagattgggaatccgtccacttcttttttctcttctggatcgatttctttctttcttccccttcaatctcatgactctgcttctggatttctttgatgcggtgtggggtggggtggggtggggtggctggtgtagtactaccaggcaccagcagcagcttgtgtttcatcctcctcctcctaagaaaaaaaaagaaaatagaaccaacccatgctccatgttaggtcagccccttgggcttcttgttattttggatctgttgtttcttctttgcaatacatctcaaggccatgtttttttttcattacagataagctggggttccttttggtgcctgtcggtccataaaaatagtttctttggttcaccgaatggtcaaaaaaagtagaattgggggaccaaatgtgtgattcgtatgtaattagggggctttccattatatatatttggggtgtgtttcaatcctcttagcacccatgaaaacacgactgtttcttaaagtattctgtttccaagtgtaaaaaggaaaaggaagatatgtagcaggggcatcctgattcaaaatctaccttaggtttggggtcacgcaaaattacaatgttgaactgttaatttgtttgcttacagttcatttgcttccattttgaactgttgcatatatgttttgatacagtggaacagattacatcttcagtcttggttctttttttttggataatcactggaggggagagattccccacctgaattttccattgataagagatttcattacaaaggaggttacatagggcgggcagaacgacagtgccgttgccattacatatgttggagttgcataggacaggagaaaatttctttccaggctgaaaccacaatctgatcagggcgctggatacgctcagcccacaagttagcttcatcaagacagcgtcgaagaagtcgtcggagggaaggttgctcatttctgaagacgacatcgtgttggtggttccacagacaccatcagcagagcaagaagatggtccgatggtgcgccaccggtattgtttcaggggggtaaatgcaaccgacatctcgtacatcagagattccaggatgaacagagagggccgcccagaagtcgcaggtgaaagggcacagcaggcataagtggctggctgtttcatcgtcgagtccacagatatcacaagttggggattgaacagaacacttatctattctaaaccactaatataaaaaaagtatcacttgcgttcttccctacctccacccaaaagaggtgtacactgaactactacagtcacctgccttcaatcaaatccaacgttccaacattcaccgttgcaatacggacaaactatgcaattaatgcattaattacacataaatatctaaggtagatcataaaacctgctaaatcctcaccctaaataatgcccatgaacgtagttaacatatactgctattttgttctgcttgggaaacttgctcgctgaatcattcttttttttaaaataaataaataaatattttagcagggccataattcacgcttctgtagagttcatgtatcagggatatcgatattattgggtttcatttaattttggataataatatttatttcatagtgacgtggattctttatgtactacttaatttcttattgtactgtcctggattacgcatgcacattgatttatttcctaacatgtagattacggaacaactctggaggcatggcagaggggtccctagttgttgccatttgccagtatggtggagagttcacttctggccccaatggcaatttgatctacaaaggaggagaagcacacgctgttgacgtcacacgagagatgtcactagataacttcaaggatgaggtgtccaaggtgtttcatgttgaggtttcagatgtgtcactgaaatactttctcccgaacaataacagaactcttatcacaatatcatgtgatcgagatttgcaacggatggtcgattttactgctagttctgcacaagtggatgtttttttgataagtagagtggagaacaggtatttccttttttacctttttgtgcagccttttggagtaacttttgcaagcctacagaaccttcgacaaagttatcttagaagtacagattcaagccgtaattttgcgataccatggcttaaacctatagttttcttataaattgagtgttaaatctatactttttttatactatatcttaaatttctagttttgcaaaatttactattttttgagtaaatcattcatgttctgttttgattagtatgtttctcttgctaggagtataactcagactggagcctccactgctaaacctgggtctaatgcacgaggtgataaaaggaaaacgccaacttccaaaaataagtaggtgccactgttccagttttctctatctgatgttatttatagccccgtgcttttccatgttatattgaataccatctttctccagggcatcaaaaaacaagaagaagactcccagtgctactggcactgcagttcaagctaatgccaataatgtgaaacagccaagacaagttgttaccgaaaatgatgacaacaggtacataattgggtttcatagaattgccacatttttgcatgtcttctctaattttagatgttacatcattttattttaatgaccgtatcatgcccaaatttatacggttgctacttttgttaaaataaactagggtttttccactggaatttgggagtgatattgcctttgccaatacagctggagctggttccacagctccagacatcttgaatcagcaaaagcttgctcttgttgataacacagcgaggtaattgtttgactaattttatgttcttcatcattcctgcaagtttgtgaagtatgagttcaacggatgttggcatggcttttgcagggaatcagttgggctttttgatgattcagtcaatccatatgttggctctgagatcacaacagaacctacacagggtcttaacaatcctattgtgttttgggatgatattatcaaaggtgtcggtcaagaatttgataatgtgaaggattttcgtgctcagttatgcaagtatgctattgggaaaggatttgtttatcgattcattaaaaatgaaaccacacgtgtcactgtaaaatgtgttggtgagggttgcacatggcggttgcatgcatctgaatcatctcggaacaagaaatttgttatcaagaaaatgacagacgagcatacatgtggtggaggaagtggagagggtcagcggcgagcaacaagacagtggctgactactgtcattaaggagaagctgcatgagaatccattgttcaagccaaaggaccttgtcaaggaaatttatgaagaatacggagttatgctgacctattcacaggtttggcgaggtagagaagtggcacagaaggagctttatcatgctatccgggagacatatagccatttgccctggtattgtgaaaggcttttggagaccaatccaggtagcatagctttgttgtctccgatggtggatacaaaattccgccgcttctttgttgcattccacgcttctttgcatggcttcacaaatgggtgtaggcctctcatatttcttgacaaggttccgcttaaagcgactaatgagtacaagttgctggttgctgctggagttgatgcagatgatggtgtctttccagtggcatttaatgtggttgaagatgaaaattatgagagttgggtttggttcttgatgcagctgaggtatgctctccagaatcacaactatccttacaatgctatgacatttttgtccagtggacaaaagggattggatgctgctgttccacaagtgttcgaagaaagtcaccacgccttctgtttgcatcatatcatggaagaattcaaaggagagctgaggaagggaccgtggtcacaacagataagagatgggatggttgaggatttcactcgagcagcccaagcctgcagcatcgaggattttaacgcatcaattgagagcataaggaatatatccactgaagctgctgattggattattgcaagtaagccggagcattggtcagatgccatcttcagaggctgtcgttatgatcatttctcctcgaacattgttgatgcttttaataactggatacctaccaagaaggaaggatcaatagtgctgatgatagactctctgagaatgaaaataatggaggtgatagaagcaaggcgcgagtcttgcaagtcctggtcagggcctttaactccttccatggaattcaaagtgcaggatgagatgtccaaagctgggaagctgactgtgctgtgctcttctgaaaccgtgtttgaagtccggggcagtgcaatttatgttgtcaaccttgcaaattgggaatgcacctgtcgaaggtggcaactttctggccttccttgtatgcatgctgttgctgtgttcaacagggttgggcgatctttctatgactactgttcaaaatttttcagaatagagagctaccatttggcttactcaggagcaatattcccaattcctgacatggataccgttgattttagtgctggggcaaatttgattccacctcctaagccacggacatcagataaacccagaaggaagcgttttaaccccaacaagatacctactgttgtacggctctgtagcaggtgcaagcaagcaggacacaataaggcaacctgtgaagcgattttgtagacaatggaagttctggattatccagtatgcgtagaaggtatgccttcagtccgtactccaaccttttcgtctcctaagataacctctttccttcattatgaagtttgaaatgtgtgagactgaaattcgatagtctgtagaaatccgacatcttaaacagttaaaatcgatatgccagttgtatctataagtataactgtacagaaagagagcttgttgactgaaaacatctaaatgtcaatatcatggtctttcatatgccaaaaaaggatatcctttatgtaaaattcatatatgccaaccctccaattcaggggcaatgaaaatgcaaatggcttgtattcgagaaaaagaaaatgcaaatggctttcctatggtattgcctattcttccgctgattttgattttacattctagattgtgatcctgggtatcaatttcctaatttgtaatggtatggggaggactatatgtgcattcccatgttttcgccagtagaaaataccgatatttatggaatgtaacagtagatatcaatttgctcacaagctattgttcccctctgaatatgttttcctctgttgaatttactactttccactggtagcatggaaccatatacatattggaggagctgtgctgtactggtgaaatagtaatttgggcgtactgaaaagtagttggtgtagtatctgttgatctttgtctgaaatgtttgactaatcacatattctgaacattttatctctgtttgacgattacagggtgaaaggtctgaagctttaagtggagtagcgctggtgagaagccgtagattttgttggatggatggaagaacgatgagatatgatgaatgataccaccgttttgtaacttaatattatattataaatgggggtggaaagatgtagtaatttaaatgtcaaatcttaagaagaagaggaatgaaggatgagctttgttagtagatagattatggttagcggtttagaagtcataataggtagcatggctgttgaaaatgatgatgattcaagtgtaccagtccatgattttaaacattgtctttctagtcttctattcagtgttaaggatggctatcaactagttaccttctcatgttgtggttctactatctgggtacatgcaatgtttcttttaagcatgcattattggggtgtggtcagtatatcttaatagctgcgtgaggcttactttggaacggaaaaatgttgacaaattcctggaaagaagtcgtaaaatttgtgcgttccagaaagcccctaataatctgatgttctttcatactacctaaacaaacaatatattagggaggggttttttgtggcaatattttgtgagtaaattgtatcggcaatctagtactactgaatttgtagaagtgccgtttttgatgtaggacttgcgtaatgcgtgtgaaccaagactaaagtggctgatctttttaggatgccacataagctactattaaagagaacatatcctatacacacaagcttttcacgtacactccgtgcgcacaaactatcaaatgacgaaaaattttagaaaaaaaactggacacatacttccaataatattacatctacgtgtaaaatcttatcatcaaattcattatattttagctggaagggtctacacgtcgggcgcccgatcaggattgggaaaaatcggactctgacatcagcatgacatcagcaccacgcatgcatgcaaaaccactttaaactgatttttctcttaaattatttatccaaatcatgatccgattacacaattaaattcattgtaattaaatcttaaaaataagaccacacatggatatatttcgatgaaattttttttagcttattattgaattatttttaaatgttgcacgatgttccaccacgtatattggaattgttttactacgtagatcgaaaatgtttcaaccatttaaatcgggtgttatttcaccttatataaaaacaatgtttcagttcactgcaacattagatttatacatagtgaaacattgtgagtacactaggtgaaacatttttggtggaacaaaaaatgaaacgaattctcttaatagagggtttccaaaatatgtgggtgatttgttgcaaaagaatgtttcagttcactgcaacattagatctatacatagtgaaacattgtgagtacactaggtgaaacatttttggtggaacaaaaaataaaacgaattcccttaatatatgggtgattagttgcaatggagtatatggtggagacacatggtgggcccaggaaggagacacgtgcgcatcgggggggggagggagggggggagagcgtccgatccgtctccccccgcgccggttgcccggtaacaagcaatttcgattttagctgtaacaaaaaataatacaaaattctaataaatttttacctataaaactgttagatttttcacttttttgctacggttaaaatataatgaatttgaatatgatactttgcaaatatatgtagtactattaggagcaaatgtctaatttttgtgggacatttgctagttggtgtgcacggagtgcgcataaaaaacttgtgtgcataagctatgttcccctattaaggtattaaggtatgatagttgtagagagaaagtagctgtttataagccaatgaaagatatataggctgaggtcttttatttgagtcctagtttttcccgcgtacgtttttcaaactgctaaacggtgtgtttttttaaaatttttctatatgaaagttgctttaaaaaaatcatattgatccatttttaaatagttagctaatacttaattaatcacgcgctaatgaagtgttccattttccttatggggaggtggagttcgtagcctcacctcccgaacacagccatagtatgccttagaaacacttaaagagattattcaaagtgttactccctccaggctgataatacttatcgttttggataagggtgaggtcaaactttagaatctttgattatgaatcatttttaaaatatttgtctttcaaatatggtgaccacatgtatagattagtcttaaaaaatactttaataagatcatatatttgttaataattttttacatattatgatagaaaataatggtcaaagttgtttttttaagaccgtgcccttgtccaaaacgacaagtattatcaatctgggggagtacacacatcttttcgcttatgtgtatagttataagctaaaatttgagttgattttgtgtttttctttatcatagtttattttatagcatttatttttgagtcgctagcaaaacatatataaaagttttattcattgttcggttgctaataagtggtaagaatatgtataagattagcccaaacaataactccgtaaatctttagttagcacactgctacgcaagggaagccgattttctgacgttgctgttcaccttgactgcatcactctagggcccacatattaaccgttaagttggagggagatctcaatccttgtcaccgtaatcactttagtccacctttcccaactcatttttcacgcacacattttctaaacggctaaacaaatacataattaatcatacgttaatgtttaatgagtagcttcattttgcaggtggaaggattagttcccaaccataggaggtagcagttgcgtttgttatgggctttgggcccatgagatagataagatcggcccactaatcatagccgcgggtggggtgtggcgtgttgtgttgttgcctccgcctccgccgccggccgctcgagcctcctcctctcccgccagccgccgccgccgccgccgctgcttgcttgcgatttttcagatggagagcccgaatcagaaccagcagcaggagagcagcagcggaagcagcgtgatgtgccagctggtcagtcccgaaggagaccaccttggcgccgccctctacttgcctcacaacgtcggcccgccgcagctgcaggagatcgtcaaccatcttctccacaacgtaccactatctcttcctccttactcttcttcttcttgcctgcctgcttgcctgcctgataccttttttttttaatttcatattgatattggcttagggaccaattttatttcttctcctttttttcttttcttttataaagaaagaaagaaagaaacattacaatgtatcaatctgcctatctagacaacacataagctgtctgtactcgttcctagggcccatttgaatcgcaggattgagaaaacgcaggaataggaaaaacgtaggattttaataagaatgaagtgtaaaacagatgattgcaaaacgcaggaaaaatacaggaatgaccgtttgattgaaccgcaggaaaaacgcaggaattagatgagagagatagactcaaacgaaagttattttttcttgcacaactctttggtgagagaggaaatccctttaatgtttaacaagggaaaaaatacaaggttacaattcattatgacaagtttaattataatatagtaaaggggaaatatttgagctaattgtcacgttgcatttatcttcacctatgtaatgtactcccatttggcagttgtcctgcatacttacttgtgtgacctcatcactctaaacatttactttaggaggacaagctgccatatgcattctacatcggagatgaagaactctctgtccagcttggtgcttacatgcagcaaaagaatggtgagactccactcacaagttcatcctacatttcttttcgtcgattaagaaaattaaaacaaactaggtgttgcatctcatttctgatttctatcttttgatttttgttaaatgaagcaaatgttgaggttaccctgcgcatagtatatcaaccgcaggcaattttccgtatcaggccagtcaaccgatgctctgctacaattgctggtatgtataccttggattacgttcatttcattgttttctttttccattacaattttaggactcttttatttgacatgttctcatattgctgggattacaatgggaatatcatcggacagacaaaccctttgcatccttgttttatttgtcattgacagcaccagtaccagcctcaattatgtcgattttgagctttcttataccactgcgaatgatgtaatttatcatctgcaggccatacagaagctgtactagcagtttccttcagtcctgatggaagatgtttggctagtggttctggtgataccactgttaggttttgggatctgagcacacagaccccattgttcacatgcaaaggtgaatcttagcattcttgcatacagataatttcaagtcatttttctcataccttaaataagtcgaatgcccgtaattgcattggtgcttgttttatagagttacaccatggttattgttctttacggtaacctagtgcttaccaacacttgattaacaatttctcatgagagagatcttagatgattgatgcaaaagtgtttagcaactcagtgcttatctttatcaatatgtcctaactcacaatagacctgtaagttactttcagaattaatcttttttaatggtagacctaaccttaacatgtactggataatcaaagcttaatgtttgataccatagtatacagtgtttgttccttttagatgaatttagtaggttgagactattaaaagataacataatttattacttgtaattaacacattacataaattgtttatttgtcgatattggatgttcagacgacctaataggagtttactgttgtaacattgtgataaaactcatgtttatcagacattacttccagtgcatttgagtataattttttggtactcttagtctcgttgacagttccatttgcatatcggtatatccaatgtttttgagggtgataccattaatatttgaaagttatcaaataacaccgcatcttccaggacacaaaaactgggtcctctgcattgcatggtcgcctgatgggaatcatcttgttagtggaagcaagtcaggggaacttatattatgggacccgaaaacaggcaagcaattggggactccacttacggtaagattatgacatctttgtctttcaacctgtagtttttgtagaagtatgaaataagaattattcagttgcatatttgcagacctaactgccctatgtgtcaattcatgtgaacctggaaaatatatgttagttacttagttgacttgaagataactgctccagttcttttttcttagtaccatggattcacatacacttaatgttggaaatagtatatggagttgtactttatatattgcagaagtttcttttttcttgccatgcagtactcattgatcattgcctttactcattaggggcataggaagtggattactgctgtatcttgggagccagttcatttgcaatctccttgccgccgttttgtaagtacaagtaaggatggtgatgcacgtatttgggatatgaccacaaggaagtgtgtcattgcccttacaggtcacactaattcagtgacttgtgtgaagtggggtggagatggtttgatttacactgggtaagactattacaccttctgtttctattataaggcgtattttgtttcgttaagacaagggtttgactaacaatttctttacaagtaatatattatttatgcgttacaaaagtgtaatcataagtaagtactttcaaatacgaatctaataacatcaattttgtgtcacacaaactataccctaatggagtaattattggtcaaagtcttgtcctaaagaaacaaaatacatattatatttttgatttttcaaaaaagggagacatacataggcagtcctttcagcattttgaaataaaaggataatgactttttttttcttttgtacttggtcacttttggttattgccattggatttgttaaaataggaacaacaacaaattttataatgccatcatggcaccattattccatggtgcaagaaagcactaggcgttagtcgggtggctgggtggcgcctagtgcctaataggcctaggtcagaccaactagtcaatccaagaaactagcaagcatattacataaaaaatagactatataacactgagatagcaagaaaacaccacgcaaggtagttgagtcacctaatgcaccatctaatgcgctacccagcgcctagtgcctaatgggttaggcagtggctagggctgtgttttagaatactgcattatttaggattgaatcatataccagcgttgtgatacagggaatatatttgtagtaaaatcgtattgcgcctgcatatatatgatgtatgaactctatttctgtttctgctgctatgtttgacagataagttaatcgagatctcaaaccactgtttgtgactagaaattctgaacatgacagattcagttcagattctattcaatctgtattttagatggaatctatttatataggaatgcttactgcttctactttggcaattgtgagaaagaactatcaagatagcttccagcaacacaggccacaatcctttattggtgccatacagacaattccctacatttattgatatttatttaattgagttattgtgagaaacccaatacgtaagtgacgttccgttagccaaaggatacacttttgctggtaggaataggccttgatcaggctaagagttccagttacttcccttttcctcatactccgtttactattttgtttatttataatagacagctataacttgaggcaaaagtggtcgagttcttcctagatggttaaaattaagtagctgaaagcatatgcgtaatcacttagtctgttatctcatttatcatgaatgtttatagtgttgcaaaattaagtagctgaaagcatatgcataatcacttagtctgttatctcatttatcgaatgtttatagtgttgctagaaatgatgtttaatgctatgctgtatgtttatttgtacaaaatgctgtattttacagatacagttcttaaaatgctatgtacaattctaaaacaaatgtatgtgtactgcagttctgaagattgttcaatcaaagtgtgggaaacttctcagggaaaattggtcaaaacactgcaggtaatgtaccagcatttcagtggacattcaaagatttatgcaaacttttatgctcccaagttggctttgctagtattgaattatgagcaaaatagcaaatatcacacaaccacatgctttatgaataaagtaccagagaactacaggttttatgatcaattccagagagatacagattttacgggaagttgtattgggaaatggcagattctgcagcttctgaggaattcctggcctgcatgttctacatatggacataaatgggtctggagatgctcaaacactagttaggtcccgctgaactttcaactttgcgtgggtttgtagtgtaactattgtaggggactgatactacacacgttctagtcatgcatcatccttacctacagaataagcacatgtgaatgcatattctttatgaacgacatatctgaggcaaacatttttatttccttctaatgttgatggcaatgatagtttaatctaggggtggaaacgagccaagcctggctcggctcggcttgcagtggctcgcaaaaaagtaggcctggcttggttcggcttggttagggaaacaagctaaaacttgagctcggctcggctcgttctggctcgagctggcttgcaagccttcctgttgaaatatctcttcatatatattttataattattaaaaaaagtaaaaccaaatcatcaacatgtaaactttaaataagtttatatattcaatacttcaaaatcttgatgataaattttaagttgacaaattataatgccatataaagtaaaataatcgatataaacacacgatgacctaggctcgcgagccaaaacaagtggctcacgagctagctcggctcggctcatttcagcaacgagctaaaaaggaggcaagcttggctcgtttggcttacgagccgagccaagccaaccaagctcgagccaagcccgagctgagctcacgaacccgagctttttttccacccctagtttaatcttttaagatgcaagtagcctatgaaaggccatacaaacttggtttgggctcaaaaaacaaaatagcaaatcaaatttacaaggatgcccatctacagcattctaaggccaaaccccgataccaattgctttgtgaattagagaattcattgccatgtagttgatggtttactctgaccagggggtgttagaggaagaaaaaaaacaaaatttactttggaagacgtgtgcatgctatagccatgaactgagggagtaattttgtgtgcttaattcatgaatcgtaccaaataaattatacattctttcaattgtgaactgtcagctatacccaggaaacaattttgtggaatatctttgatctgattttgcctgttttttgcatgtgctggacctattattttggtagctgtgaactattaccttgctttcaagtcagctattctatgctagttgtcactgtcatcttgttaaagtagttacacacttacactgcatattcagggtcatggtcactgggtcaattcacttgctttgagcaccgagtatgttttgcgcacaggggcatatgaccatactggcaagacatattcaacagcagaggaaatgaaggaggtatgatgtgatcataaattagtgttagaactgactcttaatattttcatttgttgcttgctgaaatgaattttttcacctgagaactttggatatccaggcagctcttgcgagatacaagaagatgaggggcaatgcacctgagagactagtttctggttctgatgattttacgatgtttctctgggaaccaacaattagtaaacagcccaaagcccgcatgactggtcatcaaaaggtatattgtcctgacagctccatgaaatgttcttgcatttgtatcattgtatgtacattttgacttgtttatgcattcagttttgtctcactgaatactgagaaaagattgaaaattctatgagtttcctccctgaaacttgaaaataataatgaatcggtgtcatttaaaattaatggtatgagtgtttccaaactccaaacccatctatagaacagattattgttgaaatcattaggacttgtgtaagttgtcaaatggcatgaacaagttgggagcgctagataaaaaccattcgatattattgcaagtcgccctcgcgcggcggctcgggggcgaaaccctagccgccgccgcccttcttcttccttcttcgtgcttcgccgctgccggagcttgtcaccggcaaagccgggcgacgcgctgggatggcggcggcggggccatcctcctcggctccatctcgccccggcgcgggcgtggcgacgatggcggcgggacggcgaggtcgcggcgacggggacggcgcggcggtggggctctccacggcgcggcggcggggctctccgcggtggtcggctctggctccggcgacgggtgacggagtcgctagatccggttgcccctctggccggggcgaccggcgacgggctcggtcgacgccgacgccgctcgggcgtaggcggatggccggtgacgggcttctccggcgtgggctcgtcggcgacgacggcatcgggtcggcggcggctcgcattcgtcggcggcggctccagtccggctctcggtggagcgcgcttcggcgccggctgccgctgacctggccgggggctgccgatctgctgcgattttgccggcgacggggacggcgcctccatctccctccctcctttttctccagatccggttcccctcttctttagttgttcttcttccagtgctcaccggcggtgcggcgcccgctcccctcttcttaggggctcctcccttcttaggctaggctacttccagttgttgccggggagctccttggtgcggtaggggtggcgtgcggagttggtttccggcgtcctgtctcgctggcgtcggccgcgccgtaggtttgctgcagttgggttcctgtgtgtgaggtggtctctggtcgagctgcaatgtgattgactgttgaggcagagtcggagctgcttgtcttgcaagctcggcaacgatgaccctcaatagacgtccaggcaacgcgatgagggtttggaggtggagcattttgagagagtctcgggtgaaaaccttgcctagtgtttttctaggttgatgatatcgacgcctgtgggtgccgtttcctccttggaggtatcgtcatgatggctctctctcgctttaggtgaaaactgggttccttttggaacgggcgttgacagcattcttgatgttgttcccttgttgaaggcttcgctcagaaggtttctgctccactagaggatgtttggtggttctggagaccttgtgcattatgttgtcgaagctgcttgcctttggcaagctcggcaacgatgagttttgtgaggtctcaatagttgctttcttttccttttctgtataggttttcgccggtttcccatttaattaaccgtgcttgttcggtttttgggcccggtttcccttattaactgggccaattctcttctataaattccggcgggagaaactcctgtcgtcggttcctcgaaaaaaaaatattattgctttttttaccaatgcagggtaaatttttttatttaagtgtgcttggaaatgattttgtcatttgcttttctttgtgcagctcgtaaaccatgtctacttctctcctgacgggcagtggctggcaagtgcctcctttgacaaatctgtcaagttatggaatggtattacaggcaaatttgttgcagctttcagagggcatgttgcagatgtctaccagatcaggtcggtttttctatcttgctgtttccattgtatgtacatgccgcaatgcctaatatcatcatttctgtccatagctggtctgctgacagtaggcttctattgagtggaagcaaggattccaccctaaaggtatctatctctgtctccgcttagttctctgtcttttacctaactggtcaccgacatgccattcagtctgtatgttgtcaatctggcactggaattcattatatcagaatacttgtctttgaggagttaattctgtttgcttgagtagtcatccgaaaactggtgaatctgacataaatattggttggaactgccaagtgtgactggtatcatacaattgtttttaggcatgcccttttaattatgtttctattaacttggcttgtaaagtccattacttgcatagcatggaccatggaactgatacgttatgctcggtctctatttgttggtacgattcaggtctgggatattcgaacacgcaagttgaaacaggatttgccagggcacgcagatgaggtacatgcatgcatattttggaacaataaaaatctgaattgaaattattatagtgtagtaacaaagattatgtatatatatataaatgtaaggtgtacgctgtggattggagccctgacggcgagaaggttgcatctggaggcaaggacagggtcctcaagctatggatgaactagttcccttagagttaaggtacttagctagtagcttcttgtcatggtggctctctcttgttcttggtgagagattttgtagggttgggttggcatttcttgtttttattttgcaaccaaaggcttgagggtttatagctggttttttttagataatggaatataatattccggtttttgttcaaaaagaactacagccaattattacaaagatccactccagaagagagtgtagtttaagacaagttgaacacaccaaataagagaagagataacccaaactgagaaaagcaaaacaaaatgtggaggctagaaggccttgtcaaggcttaggactgaagtttgaagccaatgcatagatcatattctcattccccggttggatcaatatatatatatatatatatatatatatatatatatatttgttgctaacttcaattgggtgtatacgtatattatttcttcctcctactgtaagggatgtaaaagacatgacaaaaatggttactccactggttagctagctaccatgggcattattatattaattaatcggatgtgttaacagaaagaaaataacatgatatggttgagctcgtttgagtggccttggattaggctgatctcgttttggcaactagctacggcaaccataagcatgttttgtacggaagtttttctatatagtagtatcttaaaaaattaaataaattcacttttaatttataataattaatactcgattaatcattgtgtcatcgaagatccaaatgaactaagccttacacgtccaattggcttgcggtcatgagttgggaagagagttttttagcatgtggatcgagatgaccttacctatgtcacttttccaaaagattaaagatgatgaaaaacagaagcttttctcccgatttgtaaacaaaaataaagacaaaatcatcagagtatacaaacgcgtacagagtatgaaaattgaactaaattgaaaaaaaaaagaaacaatggctaaagcatcagagtatccaaattgaactaaatggaaaaaagaaagacttgtaataaaaaaaataaaaaacaagctcacaaagagtatgaaaattgattataaatgggaaaataaataatattaagtaaaaaacggaatgagcgcgccaggnnnnnnnnnnnnnnnnnnnnnnnnnnnnagnnnnnannngnnnnnnnnnnnnannnncaggcgcttgtgatttcatgatgatacaaataatatttagcctaaaacaaataaattcaaagaacttgcagacacaaagaaaatacatacattatctctatgcgcaacagaacaacaatttaattacttcccccatctgtacaaatatttccggctctccatacgatctgccactttcacctaaaaatttctgagagttgattttagattcttcacaagttctacagtggtacaagatgcattatcaatctgcatgcaaattaatgaataaaaacatattattaatcttcaaaaataccaatattaaactcgagacaatcatcatcctatttcattatgtacttttgtaaaaaaaaagagttcctacacaagttatagtctcctctaattggtaaaaaaatatttgacgtttaggacaaaattcggataaacttttgaaacttttatcatcaatttacattagaataagtttgtaaaacataataagtttttatagtaattttcaacgcaaatctttgcataccatttcttaactaagtatttgagaagttcttgacaattacagacaattacagttcttataaaatttgatcaaatcatgttaatatctatatctatactatcttaaaagaatccataggtggtggtgccattgactgtggaatctacatacttcatctcctttatttgctctcaccaactccaagtcacaggctctcttaattcttagacttctaagaacgtttgcaaatcacggggattttggacggatgggatatttgctagtactataaacctggacagactccccgtctagattcattgtactaggaaatatccaatacgtccaaaatcctttatattttaggacggagggagtaaaatataatgggagtaagttatggagtacctgtgctgtaatggtgatgtttagtgatgaatctgcaaatggcacaacattagtgttcatggtggacaggccgagcttctcgagctcggtcagcagcttgatcaacacccccttcttctcagggcacacaaccctcagcagaacagtcgtcccctgtaaatttgcctcaacttttatctccacctcattgttgttaccatcatcgtcctcatcatcaccggagccggcacggctgcgagcatcggaaattgggggttgcgtgctccccatgctttggatgtcctgcaggatcttcaccctctccctaagatggtgcacatactcaatggtgctgccgagaacggagaccttgtccgtctgagaaaaccaggaaatcctgacggcattagtcatgactgtcgttacgaatatgtggcggcattgttattatctatcgaccgttgtgtcaactgctccctcccctaaatatttgacgccgntgacttttttaaacatgtttgaccattcgtcttattcaaaaacttttgccaaatatataaacctatatgtatacataaaagtatatttaacaatgaatcaaatggtagaaaataaattaataatggcttaaattttttgaataaaacaaacggtcaaacatgtttaaaaaagtcaccggcgtcaaacatttaaggatggagagggagtatatatttaccttagtgatttcggggacgatagatgctagagttgtaaactgctggtgcatcttctctcgcctctttctctcggcgataacatgttcttgcatgctcgaggtcgccctccttccgcctctcttcatctctgacagcggcgagcagaattttgtcatgggaccactatcctgctgctgctccagcgccgagaagttgagtgagctggacgagccattggtgagggagaagaagctgtcacgaattgcagcagctgctggtgtgtggccctcgggcttgttaatatccccgacaaaggggaggaccctcagtgatgggttatggtatccatgctgttcttcctgttgttcttggggctggttaaaaagctcgttggcaagggattcagcgagttgctgcatgctgagagggtccagatgctcaagcgctctaggatcatcatcattctcctgcataaaaacaatgcacatatagcgcccaatcagtaaagtacctcgtctgcaaaattaacctagatgccaataaactagcacaacatataatagattcccttgtgataattaacacaaaagattgataaataacttagggttcttaccagttctgcaagccattgcttggccgaagaatccatattcagttggagtttgtgcaatcctggaccagaaccaccataagaccactgatatatagtttgtgatacagttaattacttgatgccaaattgcaaaccttgatggctactttgatgcccttgatcaaattaattcagagtagtcttgacaagccacacacacagcgaagaagaagaagaagaagaagaagaagaagaagaagaagaagaggataaggaaagaaccaagggaggacgaggaggagaagcagaaacacatcagcagcaaagaagaagagcactaggcactagctaatgtaagagaacaaaatggaagctggatcaaaaggctgtactactatataccttctatactgttgctctggtaccaagagtgtgctactgtactaattattaactggctgttagcttcacccacgagcatcctgcatatgaccaaactagtttattagcatcttagcttgtattgagttcaacaactagaacatccataaaaatgatttttttttaaaacggtccataaaaaagatgatttagcaactgtggattccaacttttgagcctccatggcatctgcatttgctagcgactatctatcaaaaaaaaaatgctttctaaccttgcttcatcatatataactgttaacgttgacaaagtactgaaagtactacatgtgttttagctgagatggtttttctaaactagaaagcaattgcacacattattttttaagggcccaacactcgatctgtggttgtcaagttttccttgacaacaaatgtaatgaagttaattagttatgtttattgtttcacaaaaaaatgtattaatgatactatatctctgcaggtccaggtgctcctgaagtcctgttcttttgttattcacctaaaaaaattatgacaactgattttagattcttcacaagttgtatacggtggtggaagatccattttcaatgtgcatttccaattttccatcaagaatgctttaattaatattattatattttcgtagtgcgaccgttatgaacatgtttctatgaaaattgtagctaagactttcacaattaataccatgcatgttggagtatcattatctataaaaaaaacatgcatgttgaagaataaaactgctctaatttagggatgctcattatctatcaagaaaatgcatgttgaagatagaaaacaaaatgcaagttgaagtctgaaactgcccttatttagggatgcaagtaggttttgaagaactaaataaacgaaaacacctgattagtggagtaggccatttcttggtttgctgcaagcctgcaacactatatattggttagattttttgtctggttgcaagttgactcctctcgttgtctttgagagatcaacccctatctcatgtactccctccatttttcaatagatgacgccattgactttttctnacatgtttgaccatttgtcttattcaaaaaatttacgtaattataatttattttgttatgagttgttttatcactcatagtactttaagtgtgatttatatcttatacatttgcacaaaatttttgaataagacgaatggtcaaacatgtgagaaaaagtcaacggcgtcatctattaaaaacggagggagtaatagcaattacattaattattacaaatatgtactagctagcttgtgcatgtgcagtcaaagcctcaaagataattaaggtgatttttaatccctcaacaaggcccaattgctgtactttccgcactttaattaaagcaccaaagatgaagtgtttgtgtgaataaaaaatggggtgggttgtgtgtgtctatatatatatatgaatattaatagcctgacattaattagctgcgggcgtacaaccagtacgctgcacacgtgctaactcttaatgatctctggaccgtatcacagcttaaattccagtatatcacagcttgatttatgaatgctcaattgttcatatacaagagcaattagagtcgtctgttcttgtatcatctactaaaaacattcggttttgataacatccgttttagtcttcatcctattggggtggggaagcacattttgtgtgatggtagagttcacatgaagaattcatgcttatgtgcatactaatgcactaggttgactacgtataattcgtaagccgctgaagaaacaacggttatatatgcagttcctcgccaaccatagatgaaagtttgttatttccatctttagggtggtgttctaataagtatttttctttattttaatcaaattgtgattttgtaattcgtagtcttttgacctggtacctcatataagtatgtaatcaaggaaaataaaacgtttgcagcaaatcaaaggagaagatggcacggagagaatcatatgcatgcagtaagggaggggtgtaacatgtgtgtgtgacggccaatccaacctgagattttctttctgaagaaataaggtactctcatctggcatgttacgttgcagcttctcctagcttgtagaaagcgaattattcccctacatcatgcgtgttcgctggcttgtgattacgctaataaatgcattattaattagttccctccacatattgatattgccaaacaacagtagcaggatgcctagctacatacttgcacccacagtttggagtcaaaaccacctgggctaagtcaattggagcatatgttacgtatatgcaatgaactggatagaaatatttctatgttgatacatcctacatgatgttgaaaacctaaattaacctgatctcctcgaaaaaaaaaaaaaccctatcgtttatatatacattgctagctataggtttatctatgaattcaatctacagttatgtaatcaagctagtagttctagttgatcagggcttaacctttcttccagaaccataaggcaaaaaggcacaagaaggagctttctacagcagagtatctcctttctttcatgtagcacactaatcaagaccttaggtgcaaattgcaatgggatggtgcaaactctaagtaagcttattaattagctactacatgccaatgaatattgcatttgtgtgttttcctacaaaactatctaatggctccttgcaactaacactaatctcatactcctttagttcccccaaaacatatattacgtggtaaaaccaaactattatttcttttttgtcagttgactagcattaataaccaacatggccaacttgatgaaactgcgcctatgggtcatgaaaactgctgtacgtaccatttgttttttatgtgctatatatataaagatatatacacaaggaatagttcatatatactccctgcttcttgttaatgtttggccttgtcatacattaactgtgtcatttagaaatagggaaaatacatctagactctgaaaacaaaagggaactgcgatattattctgtggcatttcatctggttgagttattctttgtttgcaaagcttgtgaaccactcttacttgttcatctttcagttgtttaaaaaatctatataccagacggaatcaaacagaaagaatgtaatgtattctcctagtctaaatgaatttggattaaaaagcaacaaaaattaaaaccagaaaagtaatgtgctttcgttgagagtcgaactcaagacctcccgcttactaaacgnnnnnnnnnnnnnnnnnnnnnnnnnnagcttttgcagcaaattattatttataaatatttattcttttacaatcagaatttatgtttttagataatgtcagtagtttatgtaaatttgatacattaatttacgaacaggcctcgcctccttgtaaataaaacaagagacagacctaatgtcacactggaccaaaattatgatttacgtcagaacgttctttagaatacgaattcagaacgaaatctactttatttcctacctttcaaattgctctgcatttcctgtaattctctacagaaattatgcctctgaaacgagtattccacgtactaaatatcttacactagaacagcaaaagttaaagactggaccaggagaatagtgggctagaacttaaaagacaattattatgggccgtaatccatcacaatctagcttagcctgatatgcctgttgattgcctttgtctcttctttctcataacatgcgtaagttagggcccatttgggaggaccaattttgtctaaattcttgcccaatatggactcccaaacgaaatgttaagagattgggaaaaaaatgttaaagtgatggattcccaaacatggagaaaactgagatatacgaccctgcaatcagatcgacctagagagccagcagccctgcagagaagtgttttggcgaaatcgacgttatcagcaacaccaatctatcacctatctgccttagcagaatataaatggctctacaaaagatcattgttaatgcaggaagcagcttggaaaattggcaggtaagtaggagtagtatgcaagccaaaaaatctgcttagaagacattggccctgtgagtggatctgttgtcgttagcactttcgaagatgctaacaatctggaaacaaaggaatgccgcttcaccaatgagaggtgtggccgcttatctgtaactggcaaggaatgacagatttttccaaaacaacatctggctggcaatcgacatcagagagtggtaggagctgatcattatcaaatcaatgccaaagagtatactaggaaggaaaaactgggagctcttctaataacttggtggaacatttggcttgaacgcaacaggaggatctttaagaaaattttgtaaaatgaaactcagggtgtgtttagttcacgccaaaattagaagtttgattgaaattggaacgatgtgacagaaaagttagaagtttgtgtgtgtaggaaagttttgatgtgatggaaaagttggaagtttgaaaaaaaaattggaactaaactcagcctcaggtgtcctttctcatgaatgaaaacctagatgaattcgaccttgcgctggcgcttagcccagatcagatggcttctatcccagcagtagtgttttcttttatccctgtaaataggctctgagtttcttttcctgttcctagccatcttttagtacacatattgtattaaggcttgttggccaatttactccctctaatatatttggcaaatctcctgcggtccgttcttcaaaacaaaataaagaaaaaggttgtaaagagatactccctccaccgttcttaatacctaaactatgtcatctcagtttggtattaagtaattagattttgacaatgaaagttgtatgattatattcgtgatattatatatttcaataattaatttatcgtattttcaagtatttataatttttttgctaaaaatggatgtggtcaaagcttaaaattgaatcgtgccagtgcaaattattcaagaattaatgtgggtaggatacaaaggtaaaatgagcgcccaatcattatcttgaaaggaatcgaattgatgtggagttaatagaaatattgtaatatcaggcattcattcaggtgcccttaagggatcacatggatatatcaattgtcaacgattcccatttagctcaacactcagctgttgtggtcctagttcatgttgctttctttctttctttctatccttgcatcattctgtctcttcgaatgaaatggtgttaaaatgtcaaactagctaggccagagctgtttgatatcatatatatatacctttttcaacattttcaaacatcagagctactggatagccattcctttgatccaaatgacaacataggaacatttttcataggattgaattcctccaataatcctttgttcccaacgagctctaattaggattacaataattactctgatgttttcttcataatttttttagcgagaaattgagaacaagctgttataattaactatttcccttaaatttattgtacacactctgcatggtctgtgcacatggtgcacaggaaaaatatgtttaatatttatattcctgtaacatttataggcaaaatacttggggtttaagaatgcttttttagcgatgagggcttaaaaaatgcttaatttgcttttctcagacaaaattctgcataaaggggatcattcctggcttaatttattggaaaccagggtatattgaaggaaaaaaatagagatttgctccggtccaacaaaaagtacctcaaggtaccgatatctcacgataccaaatcgtttccgatcgttggatctaacaatgcccatcctgcccagctagatccaacgatcagaaatgatttagtaccgtgaagtaccggtacctcgcggtactttttattggaccggagcaaatctaaaaaaataacattcatacatgttcttattttcttaatattaaattgagttatatagtactccgtaagtgtttttccatgaaataaataaagtctagtaagaagatatatgctacttcctccgtcccagaatatagcaatataggatgggatgacaacgaatctgggttagggacggagggagtacactccaacaaataaacaatatttttttgagcgatacaagtaaataattaaatactacctccgtcccaaaataatttatttctaggatttaaaatttgtcctaaaataatagtaattctagagtactaattgccccatcaatcatctctcattcaaatttctctctattttaccctcaaccatctttccactctcacataaacaccatttaatgaggagcaccatagtctttcttatcaaaccttaatatatgctaaacaacatagaattacaattatttggggacagaggtagtagcaaaagtgagtaattaattaaaacgaaataaggatcggagaagcaggcatgcattgcatgatcatatggtgcaatgatcatggtattaatatatggagtatatatatatatatggtgcatgcaacaattaagtagaaaggttgatatgatgggcagctaattaacagggggttaaacactgtagttgatatgcatggaaaagtgatgtttgcccttaattaatcggtgtatgttcctctccattcaaacttcatcactctcattcacgtgtgctcgatggttaccgcgcatacatacacacaatcacaccagaacgaacaatatcaataattttcactttgattaatttagtacgtagtatatctttttggacggtggataccaaatctttatgtgaaagatacaagcacgaacacatatatgcatgtgcatcacctgttacctcgatcgactttcaaaagagtaaattccaacagaagctttttccagactgccaaaatcactgttcacatgtggatgtagcaaccgcctaaaaccagatgtcagatttttattaacaagcctcagaaccagaactatatatatatatgtgtgtgtgtgtgtgaaaatcgattttcatagtcgacgacacctcctaaaggtatgtatgttaacaaaatatcttttggctgaaaaagaaattgaaaaataattaataatccagaaaccgttgctccgatcgatccctagaaaacaatttgcagaaaattccacattggtgaaaattcatcaatgaagccaccgctgtcgctgcaatatatatatatatattccatcgccagtgcgatgaagccatgcatcgttgttgcaagctgccattgtcgctgcagccgtagtgctagctagatttggaggcctgccatctggatacacgcaatgttgccattaattggacgatcatctcctcaactgtcgtggatccagaaggccctgaggtcaccaacgtcggtgcctgagctcatgagcaacgtacgtctcgtccctttctcacgtcgtcatcggccacaagaaggaggagatcgatgggaaacatacatgagagagagggaggttgagcatgacggggctaaggggacagcgtgagcgtgaggggggctttgagtgattttcacaagcggttaacttacaagcaccgcctgtgacaatatcaatatggatatatttcacacgagcctcctaaaaggcttgcctgtgaaaaatatcagatattcctcctaaagggacgactgctagtgaaaatcaaattttatgggcaggtcttgatgggggagtccttttcattttcacaagcaactcttcttttagctcgcttataaaaataaaggcaatatgtacaaattaaaaatggttttctaagtgatgttaatttacatgtcggaaaataacaaaatatcaaatcaaacaagttcaaataatccagaatttcgtattagcccagctatttcattattgctttaataatttccatcggttagggacgatatagagttgatatacatgacgcgtacagttttgcatacgtgagtagaggagccccatatagcagcaaggttgtctgctaattcgtataagagcccgtacaattacaatgtatagtttattttacatccactagtgaaaaaaaacagatgtacacaataattcatgtcccgcgcttacatctttaattagacccaacattcgatctcattaaggagcactggtggagaaaccctttgtagtcccggttcgtaacccccctttagtcccggtttgaaaaccgggactaaagatcgctatctttagtcccgggtgaaataaccgggactaaagatcgatctttagtcccggttggtttgtttttttgcatcgagatgaccttttgttttgcatgaccctgttgctgcatggtttatatatataatatatataaaccatgcatatatatgtttcagtacatatatgcatatataatatatgcatatatatatattatattatatttatatatgtttcaatacatatgtatatgtatatatatatatatatatatatatatatatatatatatatatatatatatatatatatatatatatatatgaccaaaatatatttacattatagaaaatgtgtacacatgcatatagaaacatatgtagtcatgtattaattacaatccattatatgtcctagctagctatgatttcgacgtagtagtagtcgctagctcagaagctaaggacctatgaattgtgtttccgtcgtagtagaattcacccttgggatcaagaatttgttcgttgatgaattccatgagttgttcttgaaccgccgcgataaattccttgggtgtggtcaggttatccctcatgcgaataaactatatgaatgtatgaaattgattagtaattaaacaagaaatcgatacgtaatgaaattttgaatttatttgtacgtacatttagctctcttgtggtgatgatttggtctgcaaggcagtggcaatactcgcacacgtaatagccacacaagttagttcccttcttttgctttgcgcactacaaataaatgacaaacaacgagagatctaattaatatacacttgtatgtatttgaatcggagaaatataaatgtagagcatgtgtactcacaggaaatttgaaattccgcctaagtctttctctccatttgccgcggaccaaatgacggaaccgataccaagccctacatggagtttaaagctatgattcgtagtagcaattaacataacaagattttcttaattaacagaggaacttatgatggtatctgtctataagttcgaaaaccttgtcaaatgtagactcctttttatccattaagtcatatacgttgacggtgcaggccgacaggtcgaagagtaaaagcacccagtggaatttgcaatgtgcgtgggatgcattacatatgaaacacttagcaagttcatacgggaatgaaatttggtataggaagacagtaaaattaaactaactctgtgttgtacggcaacagtatgaacgtcttgtaatgctgcgccttcaggagatggacgagattgtcctctgtggcttgcggatattggtcgagcattgcgacgtttactttccgagggtcgatgaatccagtatcgaaaaccccccgctgtcgggccctttgaatctccattctacaacgataaaagggagtatattattttctatagtctacttatatacaaggacctaattaattaaaggagacgtagtaagaaatctaactgaacgatatacttacaaaatccagcaactcataatagagacgtcgagggcgtccagctggtatagttcgtagattcccttgaaattgatccagagaatgtcatctccttgcaagaagtccgtgtccctgatcctcgctccgatcatctctctaccggtggcgctcatctccatgtacagctgatggaacttgtacatttgtgtgggtagggactgcaacagctcaggcttgacaagcggtttaccgagttcgtacatgtatttcacttccgccttttcgattggtgcgactcctagcaattgatccgtagttagaccggtgtcagtaataaattcttctatcatcatttctttaccggtcaccaacggctcgatctcctggtttggttgctctccaagctgagggactggtttggactttccagaagatgctttcttcagcgttcgctcatagtccgatagcttaatggcctccttggcaggtgcagacatacccctgaagaagttcatgacactcgggtctataggaatcttcttttctggacttcgaggcttgaattgtctcttgacttctaatgccacgtaagcgtcaagctcctcttgcgtgcaatcgtactctggatccttgttcttggcggcgtcaacttttcccttcttcgttgcccttgtgtgggcaggcagtggagcttggggggcccttgactttgaaggtgccggaagaggagcttgcggaggagtcagtgcaggagcctgaggaggagtcggtgcaggagcctgaggtggagacggtgctggagcatgaggaggagacggtgcaggatcctaaggaggagatggcggagccggaggagatggtgcatgagacgccgcttgtcgcccagggaagatgatgtaccgcctgcgccatagaataatggcatggcttgtgtctcgtagatgcgtctcaccgtctcctccagggtaatccagctcgaggtcctcgtacgcgccttcgaccaactcaacttcgaccttggagtatcctgctggaatcggcctgcagtggtaaatacctgaagggtccgttgggatggccatgcccgacgccaccttcatgtggtgagaggttatttattagtaatcaacatatataagcagcaactagcggaatgggcaaatctaaaatatataaactacgagcttacctttattgataagttcttgaaaggaatatgcagctcacatggtgtccgctgagtgatgtcatcaacgaggcaggtggattcgtcctgggtttgcatggcgtccatgctctgtgatcctacctgccccgttgaggcgtagctgctacggtttcctgacgggctcaccattgcaggaggaatggtcggctggggatcattggaccgatgtgcggccatgcgttcatcaaataatcttatatgctaagactaaatgaacagtcatgtatgctaagtgtaactgtcgtatattagaaccctacacaatcttagaagctaagtctaattacaaatctaataatcttatactaaaactcaaatagtgatgatatatgctaagactaggtgacgtatattataggaccctagctagtcaataattatatactaagtctaattacaaatataataatcttatattaaaactccaataatcttatactaaaactcaaatagtcatgtattctaagtgtaactgtcgtatattagaacactacacaatcttatatgctaattaagtctaattacaaatctaataatcttaattgcattacaaatataacaatcatatatatataattacgtcacttgcctgggagaattccttcgggggctagctctaccactccggcttgagggacgactccgacaatgtcttttctgcaagatacaaaaagatgtattaggataaacgcgaagtaacatatattgcatttgacgttcacgtttcgttcacgatatcgttcacgtttgcgttctcgttaaggtcacgtttcattcacctacatttgttcgttcacgttcattaacctgcctataattgcatttcacgttcatgttcgttggctcgttcacgttcgtccgacaacattctcattcacgttcattcaccttgttctcgttcacgttcattctctcgttctcattcacgttcgttggctcgttcacgttcgttcgctcattctcgttcacgttcattcaccttgttctcgttcacgttcgttcgctcgttctcattcacgttcgttggctcgttcacgttcgttcgctcgttctcattcacgttcattcaccttgttctcgttcacgttcgttcgctcgttcacgttctcggtgtgacggcaacgaaacggcggcggggcggctcggcggcggcgtggcgccgcgcgcggcatcgggccggcgcgtggcacggcggcgtggcgccgcgcgcggcatcggcgtggcgcggcgtcgtgtcgtgacgaggtcggcgtcggcgtctgaaactcgagagggagagagagagagatcgagatcggagagagagatcgagagggaggcggcgcgcggcggctctcaccccagagatgcggcagcggcgaaggaggcggaggcggcggcgacgacgacgagcgcgagacgacggcgagatacggcggcggcgtcggcgtggggatgccctaggcagtggcggcgaaggagaagccgagagagatcgatcgggcaaaaacttctaagtgttggtggagatgacgagggcgcgcatcgggaatatatatagccctagatctttagtcccggttgatgagaacaagcgggagtaaagattagatatctttactcccggttgttgagaacaaccgggactaaagaaaagatgcttactcccggctcgtctcacgcaccgggagtaaagatatctttactgccggttgttctcatcgaccgggactaaagatattttcccgctgtttctaaattctttttaaacttggttagggttaagaaccgggactactgataagcgcactgaatattattttccattacatatgtttttctaaaatagaagataatgcattacaattatttaaagtataaagattaatgacaattacttcgaaaaattattgttgtctgtaataaattaagtggataaaacgtaataagcaaatatatgatttaaaattaataaaaattctaataatcatatatacttagcatatgaatgatattattaaattggtaaaaactctaattaacatatgtatatacatacgacatgatttaaaattaataaaaattgtaatcatcatatatacttagcataggaattatattaaattaaattgtgaaaaactctaattaacacatgtaaatgccacatgcatgatttaaaaattttaaaaattcgaatagtcatatataattagcatatgaatgatagtaaattaaattgtgaaaaactctaattaacatatgtaaatgccacatgcatgatttgaaacttttaaaaattctctagtcaattataattagcatatgaatgatagtaaattaaatgttaaaaactctaattaacatatgaaattgccacctgcgtgatttaaaacttttaaaaattgtaagtatcacatataactagcatatacatgatttaaacttgttaaaacctctaataatcgtgcgtaattaacatatgccatacatcaattgatttatatggataatcaatacatccaaaatagtttacatcgtgtacacaataattacggcaatacatcgacggtgacggttgaccgcacgtactttctcctcactattgttccctccttgtgatcgctacgtgagtaaggggtgtcttcatttgataggaggatgctagggtcaattgtcaccgtgaaagggggttgcccatccaactaatcgtaatcctcgtcagtcttgtcctcaactctgatgatttttcttttgcctgggagaaccacgtgacgcttagactcgtcaggccctctgcccttctttcctttgctagacatgtccttcacgaaaaagacttacgttacatcattggcaaggacaaaaggttcgtccgagtatccaaccttgttaaggtcaaccgttgtcatcccactgtcatcaatcattacgcctccaccagtcaacctaacccattggcaccggaacagagggaccttgagaggaccatagtcaagttcccatatgtcctcgatggcaccgtaatacgtgccagttgttccatcgtgtcccatggcaccgacacgaatagcgctgttttggttcgtactcatcatgtcttgggctctcgtgtagaatgtgtacccattgatctcatatccctggaatgtcgcgatcgacccagacgatcccctcgctaggaaggcaagttgttggttgatcgactcattacccatgagatgttgtcgtatccacgcggggaaagtatcaatgtgatgccgtgtaatccatgcatcggacttaccgatgttcctggcgcgaactagagccaagtgctcctcgatgtaaggagctaccaatgaagattgttgcagaactgtggaatgggctttacgaaataaattgttgtctaccgtcattattgctttccttccgagagttccctttccccgtagtctcccttcatggcgtgattcaggtaccccgattgggcgaagatcttcgataaattctacgcaaaattcgatgacctcctctgttccataacccttggcgatgcttgcctctggacgagcacggttacgaacatacttcttcagaacgcccatgtacctctcgaaaggaaacatgttgtgtaggtacacaggcccgagaatactgatctctttcacaaggtgacaaagcagatgcgtcattatattgaaaaatgaaggtggaaatatcaactcaaaactgacgagacattgcaccacatcattctgaagggcttctaatatatccggatcgatgaccttctgcgaaattacgttcatgaatgcacatagctttgttattgttgcccggacattgtctggaaggataccccttattacaactggtagcagttgtgtcatcaacacgtgacagtcatgagactttaggtttgtgaacttcttctccttcatgcttattattcgtttgatattcgtggagtatccagacggtacctttatgctctccaagcattcaaacatgctttccttctctgccttgctaagagtgtagctggctagactcaagtaatggcttcctttcttctttggttccgggtgaaggtcgccgcgttgttccatatgcttcagatcattatgtgcttccagtgtatctttcgactttccgtatacacctaggaagccaagaaggtttacgcaaaggttcttagtgaggtgcatcacgtcgattgcgtggcgtacgtccaagaattcccaatagggtaactcccaaaatatagagttctttttccacatcgccgcgtgaccatcttcgctctctataggctggcttccaggcccctttccgaacactactttaagatctttaaccatagcaaacactgttttcccgttgcgatgtttagacttcgtacggtggtcagccttatgttcgaagtgcttgcctttcttccgtaccgggtggtttgctgcaaggaatcgacgatgacccatgtatacaaccttcctacagtgcttaagatacgtactttctgtttcatccatacagtgagtgcaagccttgtaccccttgttggattgtccggataggttgctaagtgcaggccaatcgttgatggttacgaacagcagcgctcgtatgttaaactcctcctgtttgtcctcgtcccacacggggacaccttccttcttccacaacagcttaagatcttcgaccagtggtcttaggtacacatcgatgtcgttaccaagttgcttgaggccttgaataataatcggcatcattatgtacttcctcttcatgcatagccaggggggaggttgtagatacacatcgtaatgggccaagtgctatggccgctgctcatctctccaaaaggattcatgccatccgtactcaaaccaaaccgtatgtttcgtgcgtcctttccaaattctttaaattttctgtctatgtttcgccactgcgaaccatcggcggggtgtcttagcatcccatcctgttgacgctcttcagcgtgccatcgtatcattctagcattccccttgttcctgaacaaatgccttatctgtggtattatagggaaataccacatcaccttagcaggaattctcttctttgttagctgcccgtcaacttctcctggatcgtctcgtctaatcttgtattgtagtgctttgcaaacagggcatgcttctaggttctcatactcaccgcgatataggatacaatcattcggacatgcgtgaatcttctgaacttccagtcctagcgggcagactatcttcttagcctcgtactcgggcaatttgtttccctccggaagaatgttcttgacgagtttcaataaatcgccaaatgccttgtcactaaccccattttttgccttccattgcaagaactccagagtggtatccaactttttgtgcccctgctcgcaacctaggtacaacaaagttctgtggtcctctaacatcttgtccaatttatgggctcccttttcactttcgcagtccttcttggcgtcctgcaacatctgaccaagatcatccgcaacgtcgttaccatcagcatccctttcctcctcgcccgtttgatttccttcaaatccaacgtactgagcaaaatccggaatattgtcgtcttccatttcatcttcttccatttcaacaccttgctctccgtgggatgtccaataattatagcttggcatgaaccctgactcaaacaagtggaaatgaatagtcctggatgcagaatactccttctgattcttacacttattgcatggacaacaaataaaacccctttgcctgttagcttcggccactctcaaaaaatagtgcacgccgtcaataaactctttggaccgtcggtcagcgtacatccattgccgatccatctacatgagtcgaaaaaaaatcatacaaaaataattattcttacaataatgacagtcatacaataattataagataattacaaactgtttcaacagtcatacaataatgacatatctttattcatacaaaaatcataaaatattacaccaaataattcttatttactatttctaaagttttaaactaattttaatgtgttttacttcttttaattttcagtttagtttgttttctagtattcaagactaactttcactatagttttccttctcaactattttataaaaccttctttagcaaatcaactaagtttctatatattctttcttccccacacaaattttctccctcatcaacttacaactaaattttggagacaaaaaagtgtgcaaaacatagctgcaaatgtaatatgaccaaaaaaaacattggaggatgaagttgcaaaccttttaggcacctccgatttgtatgtaatcaccaaaataaattcactagaaattttggcatgacctcccctcttttttgaagaaattttgaagcttgctcgggcagctggaggaggaagaagacatatatatataggggtgggactttagtcccggttggtattaccaaccgggactaaagttacgatctttagtcccggttggtgttaccaaccgggactaaagatcccggggggcctgacaggccctgacagcatttgacccgggactaaagatgatctttagtcccggttggtgttaccaaccgggactaaagatcaaatatgcccgttaccctttttaaccgggactaaagatcatctttagccccggtttttattgcatccgggactattatggaattcggccgaccgacgaaagatggtttctccaccagtggaggctttgctgcgaaatatatatatgcatatatatcaaatgttgtacaaatgatggatatatttatgttgagatgttgtagaaatgatgtgaggaatgagattta

SEQ ID NO: 62440 - DNA, 745 bp, Oryza sativa
  unsure (1)..(745): unsure at all n locations
agtgcctggaaatcgactgcacgtnnnnnnnnnnnnnnnnnnnnnnnnnnnnnnnnnttgtttgttttgtttgtgtctcgacgagatgtataaatttggttggtacaatattacaaatattaatatatatatatatatatatatatatatatatatatatatatatatatatatatatatatatatattatgaaacgtacattgtacgtgcatgtttatactagtataatatataaaacagagggagtactacatattttccctatcatgggtaaacagtacagtgaactcggcccatttaggcccacccacctgtatttggatcgagacccaaaccagcccacgaaaatttgggccgcaaaatacgggggggccggcctatacacttttgtgatagggaacatgcagctttcacttcaactgggttagctgcgacggccagggcacgtcaaaattaggcagtgtggggagcggatcgcacgcgccacggggagccggacgaaaacgagaagctcacagccaccggcgcgcgccaccagcatatactctctctctctctctctctctcgtcgacgcgccgatgcgccgagatggccccgatcatgaatggggcggcggcggctggtgggggcacgggcaggcgcgcccccgctcataaagaacgcccacccccgcgtccaaaagtcgcgtggaaagggccggaacccgccgccggcgcgggggttttgctactccccgaggaggg

SEQ ID NO: 62441 - DNA, 11949 bp, Oryza sativa
cccaccagaagagagctgtgtcctcgtctcgtctcgtcgccggcgaagctcaccgacgacgcgacgccaccccagccgccgccgcagccgcagcccggcgaccggcggcgccgcccccggctccctgacccgccgcggccgcacgggggtaaggcggttcccctgtcggggctctcgccgcaggtacgcgacgttgcctcttcttgttcgtttccccccgtgctccggcgatcttttcgccgttccagatccgcctccgctcccgtgctttgacctggcgttgcgcggtttaactttttgctatcttgattaagctattttgggtggtcatctgcctgtcccccgattgaacagcagggatcgattccttgttggggttgggcatttcggctttgatgggagacgccaaggaaggagaagaggagcggccgcgctgcgtcggctgtggccggcgtgtgaagacgctctacatgcagtactccccgggcaacatccgtttgatgaaatgcgtaagagagggactagtgttgttgattgggcatgtgtaaatcctttttgtcatgtgcgtgtaatctgtttaagtttggatgccctgttcttgtgcaggatacctgcaaggctgttgctgatccctacatcgagtgcgagttcatggtgcgttaatctagcagtgatgatatcgaatttctcgccatacttgtgtgatccgattgtttgcatcacatatgcagtttatttactgctgaactgatgcattgagttgagcatttaactattctttcttttttttcgtagataatcttgattgatctgattctacacaagacaagagcatatcgtcatcttctatttaataagttgaggatttattcatcacttgacaaggtgggaatcatatggtattcaaactcgttcacatgctacttttagttaaaatgaaaaaggaggtgggctcagctcttttgatgtttacttccgttttcttcaacaatgcttcttcctagttttacctgtactctgtcctgtctgtctgtcatgctgctcaagaattattagcttcatctgtcttagatctgcttgttagttagtatattcttggtgtctatgttctgtattacatgatatctttagccatttatgccttgtcagtccatctgacaatagtttaaaatagccaatcccatggaatacacagttttctattcattcaagttataactgcatagtttggtaacgtttttgtaataactttctgtcaccttatggtagttccattagccgttattccctgatattttgaatttgtttaatggggtatgtcaagactcaagagttacattttcctatgttcctgatttttgttcttttcagggagtactggtgttgtccattctgacgcatcttgttcttgatgcatgtatccattctatttataaatgttcatcttcaattttggttttttttatgtatatattcaacttaagcaccccttaactatgtaagtcagaatatctttttcaagaggcaacatagctgatggggattcttccataaacatattctcagcgattctcaattgcagcaaggtaattaaagttgactgcattgagaagttctatgtttctgctgctcattaccttagtaatgtatccggtgtctattattcttcaggttctgggcgatgcattgttagggaacatcgtatttatgaccatgttattcctggaagtgcaatttatcctaaaactatcttttgatattagaaggtacattgaatacctgtgatgtggaaatttcaattacatttgttggtagttcattacgcgcaaatgaattggtgtattctcaattggaattatgcaaccagtagggattctgtaatagtacacttctgttgtagaagatgaaaccatatcagaatttcacattaaatgtgtcatgggttaacagttgcgcttactttgtcatttctcaggtatagggaggttctgttagccgtcatcatttcaagctacttcaagttatttctcatggcaatgatggtatagaagatttttgtgatgatttatttctaagttttatttgacttttttatttcctttcacgttcatcatcaaattttgcaggtttgggagtttccgtcatctgttatattctttgttgaaatttctgttctctcttcaaatactgtagcactgagaggtaagtgcacattttctttcctcggataattctcgtctttgtttatgacaatttaaactgttgtatcaatgttgtttagctgttcctttttcttgtgctcccactccagtaacattcatgttccctccattgggtatatagaacttatgcagcatccctggtcattgaatgtagctgtgttgaaaagcatgtagaaaagctggaaatcgtagattttagtgtcattactttatgtatgttgtgtgaactggcactgaattacagaatcctagtaactctgcagtccttccacaagcactactatacaatactagggtgaaaagggcacctctgttgtcacaatctccagtgattggatcatattgattaccaaacatctgcatcaaataattgaggttttgcacatcccaccgtatcacacataattgattgatagatgcctcagctttattgtttccatcttctagatttttctttgaaataagctgcaagtccaatacagaatcaatagtatagtgcgtttatcactccgatacttcatatttgaattctggatagataacctaaatacaaacaggttcatcgttctgaagcattaatatatcgatgcacccttctctttctagaaaaaagtactgacagggatgttctttgatgaataggaacctaatacatagctcatactattgatgatcacaatgttcctgtttcttttgcagttgtgacggagttttcaaaggcccattgcttcggagtctgctttggagcgcacgcagcaagatacctgactgagcgatggcttctcggggcgccatgaacccaaccgccgtgcttcctgcatccatcaagctccctgtagctcgtggtgccccccaaattcatcaggattcaggaccacccgccatgcttcttgcgtccatcaagccccgtgtaggtagctgtactccccagtttatgcagcatctaggcatactgtgccgctttgatgagcttgctctgatgaaaccaaatgtgatcatttgcaatgcactcactgactatgatacacactgttcctgtgagttgcaactggagtgtctcttaggccttttgtacgagatgttgagcaatcctctcctagtttccccatctaactggggacagtacattactttatggctggtctattttcttgtacttatatgcccaacgcagtagctgctgctgctcctgttcagcgaagtacgcaatgaaagggcctgttcaccttctgatgattgtaacggtggcttctgaagaggtatgttccctttgttccatttgcaatataatgatacgaatacatacaacatacagaataaggttctgaatattactcttaacaagttaggctgcagcagagtttcagttcaagagtctgaatattactcttaacaagttaggcagcagcagggtctcagttcaagagttttgttcttcagtgctctgaaccttcttgaattgaacatgtccctcttttcctgtgctccttcccttccttttgctgcttcgccaccaccaaatgcttatctgcactaacaccaaacagctccaacaaatatgcaatctgcctcctaatccacagttttgttaatcacctgcactgaggcgagaactattataattcgttcaccctgctcatgatacatacaagatgatgtatcgagtagacggggcacaaagtttgcttaaacaaaattacacttttccccggaatttaaaaaactcacacttttgtacgtaatttgcgctaatctgcttgtgtaaagcatcgcattatcggttgggttgcgatcatcgcggccggcaccactgaaattaacaagtggagtacgtgcgcacttgtttagtgtgaatgtgtggtagctttggtcgtgtttgcttcagtcttctgtggagcctccactttaaacaagctcctctcacaccatcatttttaggattaggacaaataacacactaatttttaggataaggagcacactatctattgcgatgaaaactagaccaagtcaagaattaagacacgagaaatagatttcttgttttttttttttgctgaaatcgttgtacttttagtaatttttttattaatgtgtagttggaacaagaaagttcagaatttgtgtgcttgaggcaagcggccagcaaataagaagaaatagatgaagcatcatcaaggctttcttttagctgtttaatatttgttgaaatgatcactgtagttagtaaaagaagttgcaactaattaatctccgcaacttttgacgaatgttgcaataattatggattcgggtgctacaacttaattagtgagcttaagcacatcaatgcgttacgtgttacgtcagatttccttagcagctatgagaacctacactcacatatgtcacacaccaaacgttccctaaagctaactaacaaagcttaaattctacagtagcaatgagtagctagcggcgaatcgtatcaagaaacaaggtgagtaaaataaataatataatctaaaactttatgaaagatacttgtcaagacataatactcttatatcctcccttgaccttcgtgttgtgtaactttcttatcatctactactatagctagtgctgtcacctttcatcatcttccaacaagaagtggaattataatatggagttgagcctaatcagtgtgcctcaacttttttttttcttttttgagacggtgactacttatgatcaacgcgggattttgagttctttgtctgaagaatattttatctttagaccgtaagtcaagcaaaatttagtggccatggaatgtggctctcttcaaccgagtcaccaaattacatgatcaacggctattaatcatcttgtgcacccaaccttagcttcaaagaattcttccttgtgcatgattgcactgcaatatatgaaatctgaccagaaaattccttgtcctgtcatgtagatttcagggccatcactggttgtaccggacctactctattttaatttgggccattgcaacattaagaaaccagactcaaagcttccaaactgatccacaatacaatcccaaatcaatatcgttatttcatttgcaaaccaataatttgaatttttaatttttaattggatggcaaaataagcagcataaacattaatatttttagcttcctgatttaaatttctatctcttgacaccaatgatatactcctaggtaaacagagaggggaaagatgtcataaaatgaatctgacaacattaattaaccataaatttagctgacgttgacatgctagaaagattaagcattagactggggaacaaagttggtcaagcacccgtgctagcttacacttatatagctaataggaagcttttgctgctaaatgtgcgccccaaccaccacctagctgcgtctaatttcccatgacacgagatcgatcatatcgatgcctctaaaatccttaattaggtcgaaacacaacacgccaagacgcgcttagccaacacacatcaagagaactaattaatcacatcttaattggtaggagaagtccaatgctgattaatcattaaaagggatgcaattaagtaggactctgagatcttcattggagcaaatgggattcatagactggtgatacctttgttcccagtgttgtccatgtacagtcactcggatttgacgccctaacaatacataactagtacttgtcatgcatattaactaggaaattgatcttagctaggccccaaaatgatagggggacacgctatctcgtgatagttattgacacctacggcccattacatagaaagttacagttattttagacagaattcacggcccagttagttgcaagaagtcactgtgtcaccagatggcctacagcctaccagtgaccagccaccggccgtcccatttatgtgttaaaccttgtttggatgagcttatatcaggtacagtttctactgtaatctctgaaaatgatttgtgtaactcaagtagacatacactcgtttcatgcatatctttcaaaatgttacaaaaatgtttttttataaaatagatatcactacacaaacatataaggtcaaattcgacttatataatttggaaaagaaacaacaaatatcaactataaaagttacgcacgtttgatagccacatttatcatttgtgtttcaactcatgtaagtcgaatttaaatttgtatgtttacgaagtaatatattacatactgatcaaattgttttaattttttatgactttttgagtgacacatgaaacgagtgtaccactcaagtaaaaaagaaaagctttcccataatctccaccttctcaaacaataattgagaagattataagaaccaatcactgcataaggtgtgcatgtgtacgtttataaagacaagtatgcgtgtttgtgtatatgagtgtgttaaaaaaaatgaattcagacaaaaataaactattaacaagaaggcgttagctaagaaattacacactttatttagattctagctggtttagtgaccaaattgtttccaaggccttacctagctcttcctcgccaaaagaaaaggaaaaaaaatgcaaggggtttgcttttttctcttcgtttttttcttttatactttgtggacatggggccatgcatgcagatgtttttttctctaggctttaggaagccacagcctctaggtatcaaccaagcagcagcagatttccccagcaccccacgggtgattgcccccatctgaaataatttaatcgatcgttggcaaatcgacgaaaagtaaatacagtagtggattgttcgtagctgatgcatgcttataattatatattcttgcaattatatatctaccccggccaatgcaggagcaggatcgacgacgtgatatattccccggtctgtggatcgatcgatctaccggttgctataaagtgtacgtgcgtgcagtgaccataggataccggcatattgtcacgttgatatcagtccacgcatgcagccatgtactactcgtgtttagtttctgaaattggggagaagtttggggaaagttgttagtttggaaaaaaaattgagagtttttgtgtgtagaaaagttttggatgtgatgtgatgtgatgtaatgaaaagtttggtgtgaactaaacacaccctagtactccctcagtaggcagaatataagaaattctggtatttaaatcttgttctaaactgtagaaatttctaataccattccgttaatcacccgtcatttaatttcttttctatcttacctctactcgttaattatttttttcttaatattagcttaaaaatgcttatattcttaaacaaaagtactactataagaaaaaaagataaccaaggaggaacttaattatcaaataattacaatcgtgtaattaattgggaattgaacagagtacctcggggttaaaatgacaagcactttctatcaccgctatcaagtgcatctggggatattacaataggcatctgcgtggttttcacatatcctatgcgtccactgggcccaggaggcattggcacggcgagtgtggtggcccggcggcggcggagggcgcgccgacgcgtcctgatcggggcgggccggcgatgtccccggccgccccggcaagcacgcatatgagccgtacaccccgtgcccccggcgtctgcacctgcgtgtaccgctcgatcgcatccgtccgcgtccgtatctgcatgcatgcatgtgtgactgtgtgagcaaaaggtttgcatattactttttctgtttcacagttaaaattattctagttatgaatgtgtgaaatactaaaataactttcatcgtgaaacggagggagtacgttgcgttgcatatgaatcggcttgtacctgtgtggctgtttggtctggctctcgtactaggacacatgcacatacgtataccgggaggagcaaccacgtacgtacgcagcactgccaactacgtaatcccttcactttaaaatagacaaacataataaagatacgaatgatataaacttcttaagatttgtagtattaagaatatatcatattttatattaaatttattcattttacaacgaaaggatactacgctagctattacgaccatacgggtatctattgaggtgatctgtatggcattggcttcttttcaaaaaaaacatgtatggcattggcaaagtggttcagataatcctggcagagaggcatgaattgtttcgctcaaccagagcaccatgaatcgatcggccgggtgcattgcgcacgttgtctttggaattgacggatggaatcaaccaattatagttttattacctaagttatgctttgggccatattttattacctaagtttcactttggaccacacttaaacatatcttttcactttggatcggataaatttaccattgttacgatttggaccaccacgaacgattttttttctcatgcaatcaacgatcttaaacacatcagctctaatatacggccgatctcctctatatatggttcatatgtttgccgaaagggaagttaaacatgacgagaaaagttgttcatggtagtccaaaccgcaacaatagtaaatttacccagtctaaattgaaaatataggtttaagggtggtccaaattgaaacttgggtaataaaaggtggaccaaagtgtaatttactaaaaaaaaatcaaccaattatctccagcaatggatcggagtgacgtccacccagaggcgaagccaggatttgagattaggaggatgtcggtgagggtaagccataagagttgagaatgaataaccaatattaatattgatagtaaaaaaagggtcaaatagttactctcaataacaaccaatgtttaaactaatcctttaaaaaactggaattttagccctttaataatatcatccaaagtttgaaactagtctttaatttattgctaaattcttttaatgtaaactattgaataatctcacaaataagtataatctattttactttgaaaaagatgagaaatcacaaactaattttgtagatcatgtttcttgctaatgtttttagacttactaactaactaagctgataataatttcaagctacacaaataaactagataaatacttattttagttaatcttaatatagagtaaaaacagttgggtgtggtggtggtgttcagatggggggtgttggcaccctctagcaatcccctagctgcgcgactgcgtgtctgcgtccaccatccacgggcatcacgtaggcgcaccatatgtataacttgttgcatatatatgcatgcaatatgcacattctcgacgtttcgaaacgttgggttaaattttataactttgactattaattattttttaaaaaataataaagcaacatatattgatttatcttacaaaggactataacaaagtaaaattaattatttactatatacactataataaaaatatattttaaagattatgttatattggaaacatcaataattatgaaccggatgaagtaaattccgtgaacctcctcagcttctcttgacgccgcatcctcacattctcacctccctctcgagtctggaccatgccccagctttaatttgctggcggctcacctctttttggtgtagatccatgcatgaccaccaaatcattctgttcttgatacctcctcccttccgaatgtgtccatcgtatccgtgacaaattcatccccccaatccaaaatcctaccaaacgtcgaagctgtcatggcttcctgaatgatttttggtcaccatactagtagcacacgaccatgcattatcagctcattactgtcggttcggcttgaaccaatggcgattggctgtgtttggaactccaaattcccgacacctccctctcattttccacgtgcacgtttttcaaattgttaaacggtgtattttttataaaaagtttctatataaaagttgcttaaaaaatcaaattaatttatttttttaaaaaaaatagcaaatacttaattaatcatacgctaatggaccgctctgttttccgtgcgggaagattgggttcccaatcctaaaatctgaacacagtgtgtatataactatataccactgacggttatcgccacaaatcggcattgcttcgaactgtttggatgcctgacgtaaaagatagcggtccgggttttgaattggttggctggtcaattggactgcccaagggtttaacaactatccaaggtcccttctttttccccgcaaaccacaattagagaaacggatttgctaaataatggaaaatactataggacgatatcgtgttaaataatgagaaatgtccaaacgtgctaccgttctgtatcatttcccggatgtatggattgaacccacgatctcaagtgtgcatgcttgggtccctcaccaaccaagcaatgacacgattccaatcagttttatgccagttacattgtaactataattataccataattacatgtaaaagtttttcatccaaaaaatggtcaaaagttatatagctaatcccttagagaaatgaccccactaagggcctctttgaatcgcaggattgagaaaacgtaggaataggaaaaacgtaggattttgataggaatgtaaatgtaaagcagaggattgtaaaacgcagaaaaaatatagaaatgaccgtttaattgagccgcatgaaaaacgcaggaattggatgagagagatagactcaaagaaaagttaccaagaggttgaagctcttgctaaattttctccaaaatctctataggattgtccattccataggaattttaaaggattgtgaaggattcaatcctttatttcaaagggctttataggaaaatttcctataggattaaaatcctctaaaattactatatttttcctccaattcaaagggtcctaaaatacaaacagtaattgatcccatggattaaatttctagttcaaccactggagttctaaaaagaaaagttcaactactggtgacctagtgcacgaatcttgatgtcgatcaaacggccaaaattcgcaagatttagggctgatttggtttgaggccctaccaaaatgttggtagtgccatagagtagatttattactatttagccaatccaaatactatcatgaagctactaaaatattggcatggcacaaattagcactaatccaaacatgcccttattgaaccaaatcagccaattaatactcctcaatcaccaatttaccacccaaatacccggatccaattcttgactcgacgcacgagttacacacttaactacacgagacgacgaaactcgagtaattaagcccagccagggtcatatcgttacctcgccgccgcaccggtgagtgtgtcagtcaacgccacgaacccaactccactcatcctctcatcccgcctctataaatcctacccgtacgtgctaccaactgctcgctcgatcgatcgcccacacgcgctccgcacgtcgacgcgcaaaacccctcctcccctcccctcgccggcgatggagccggccgccgccgccgccgccgggcagctcgacgtggacaagctcacctacgagatcttctccattctcgagagcaagttcttgttcggttacgatgatcccaagctcgtcttcagcggcggcgacgagccgcagggggcggtgaaggggactctggcga

SEQ ID NO: 62442 - DNA, 745 bp, Oryza sativa
  unsure (1)..(745): unsure at all n locations
ctgtgcttttgataacctatnnnnnnnnnnnnnnnnnnnnnnnnnnnnnnnnnnnnnnnnnnnnnnnnnnnnnnnnnatggtaaaatatcaatttctgaagttagcagtgccttatggattaaagatgatagcttaaaaatgagaactaaagaaagtatttctggaagattacttacaatgcaggaagatcagcatcacatatggcttcgctgagcatgtgctcatgctcttggatactttgcttcatttcatgtgaaagtttttccatcccctcaagttttgctatgcttggatagtaagctcttgcaacaaagagctggtctttaagtctcttcactacagaatctttcatcacttccttgtgttcaacagaccaaacacaatagcttccaaattctagttggcacgattttatactctcatcaccaggtaaaaatggatttgcaatgtagctgaatttcttctccgaagccaaatttcagtttgttaactgttcacagatcagtttcaggctttcagctagatgtgaaagatgcaggtcgtttatgttttctttcatcatgcgatgttgtatgatcgtctgaatgtcatttgttcttctatagattgctactactgatggtgctgaaattactttctgtgccacgatttattcctagaatgtgtgcatgatgtagaatgttgagtacaatttagtagcagagggcttcttggtcgccaaaatcatttagagataacaggctt

SEQ ID NO: 62443 - DNA, 1262 bp, Oryza sativa
  unsure (1)..(1262): unsure at all n locations
accacctttactgggactggcggcgactctgttaaccaatcgagcagttattatagttcaatgacgncgtctaaggtgacggacnacgtccaagtgtcacccatataactcaagcctggcggaagggcttgagagtcatgtctagaagacggtggctgctaacaataatgtcgacctgaagaagtaccaggcgtagctagaagtcaatatggtagggtccctgacaaacgctgtaggcggtgtccatcatcggggagtatcataagagcgcgcaggcgcaggcctgtctcttaccacttacatactggaacgcggaggcggggttcttcatgatcggtcagcggagcacagtgcctcccgcggctgttgccgcccaaataatgataggggccatctcggcgcatcggcgcgtgttttagacagagatagagagagacagtataatctggtggcgctcgtcggtgcctgtaattttctcgttttcgtccggctccccgtggggcgtgcgatccgatccccactaggccttattttaacgtgccctggccgtcgcagctaaaccagttgaagtgaaagctgcatgttcactatcacaaaagtgtataggccggcccacccgtattttgcggcccaaattttcgtgggctggtttgggtctcgatccaaatacaggtgggtgggcctaaatgggccgagttcactgtactgtttacccatgatagggaaaatatgtagtactccctctgttttatatattatactagtataaacatgcacgtacaatgtacgtttcataatatatatatatatatattaatatttgtaatattgtaccaaccaaatttatacatctcgtcgagacacaaacaaaacaaacaataggaaacattaatgataatgtggagaggtggtgccatcgtaccaactcactctcagttccatcatacgtgcatgtgcggccatgccaactgcctacattcctccacatataacttgcttctttatgcccatgtcaatttgaaacagaataagaataattttaaacttcaacttgattgttatacagtttgactggaacctatatataatttgatcacaattactttaattgcaaatataacagatcatattggattaggagcagaagatgcaacagtagaaaagcaaagtatggataattcannnnnnnnnnnnnnnnnnnnnnnnnnnnnnnnnnnnnnnnnnnnnnnnnnnnnnnnnnnnnngttnaacaatnaaaacat

SEQ ID NO: 62444 - DNA, 9676 bp, Oryza sativa
tcttcccgtgccacgtccgagtcaccgcatgataccatggaaatgaaaacctgtctaaatcatttgctccttccttaaccacctctcctactcgtggatttctttttgttcctttctttctcctctcctctcttcgtaccccctgtcacgtagttcttgtttactctttccattaggtgtcacaggtttcttctcctcttatccttcctttccatcggttcttgtacttggtggtatacccctagctgctcgcctttgtgttaatttggttggattgggagtttcttgttctctctttagccttgagcgatcttggtttcttgcaattagcctttgactgcttcttcttcttccacttgccgccggcagctagaagtggtccatcgtaccaaccctttcgtcctcattgaaccattccgcctcgctcccagctccattactagaagcactagagctagcgtgaatgcgtgatccttgatgcgtagttagcagctagctcctgcccccaatctgccatctccgcattgcgattttgagtttttgagattgtaatttgcgaacgatctcggttgtgctgagagcttagcgttgacttcgatgggtgcatcgcgttcgatcgccgattctgatttggtcgcgtgatccgggggtgatcggtgattactccgagcgggaggggagatcgtctcttggcgcggttgcgcttcgccgcgcggagggagagacattcgcggcgtaatccgaaggtgtttgttggatcgaggcgtggtgtccgagaaagattcggagcggcggcaatggggaacacgtgcgtcggccccagcatcagcaagaacggcttcttccagtccgtctccacggtgctctggaaggcgcgccaggacggcgacgacgcgctgcccggcgccaatggcgcccctgacggcggcggccagggccggttgccggcgccgccgccgccgacttccgacgcgccgctcgccgtccaaaacaagccccccgagcacgtcaagatcgtctcgaccacggacaccgcctccgccgagcaggacgcctccaagtcgagcgccggctcggactccggcgaggccgccaggccgcggccgagggtgccgccggtgaagcgcgtctccagcgccgggctgctcgtcggctcggtgctgaagcgcaagacggagagtctcaaggacaagtacagcctggggcggaagctcgggcaggggcagttcgggacgacgtacctgtgcgtggagcgcgccaccggcaaggagttcgcctgcaagtccatcctgaagcggaagctggtcaccgacgacgacgtcgaggacgtccgccgcgagatccagataatgtaccacctcgccggccaccccaacgtgatctccatcaggggcgcctacgaggacgccgtcgccgtgcacctcgtcatggagctctgcgccggcggcgagctgttcgaccggatcgtccagaaggggcactacaccgagcggaaggcggcggagctcgccagggtcatcgtcggcgtcgtcgaggtgtgccactccatgggcgtgatgcaccgtgatctcaagcccgagaacttcctcttcgccgaccagacggaggaggccgctctcaagaccattgactttggtctctccattttctttcgcccaggtgagcgaatcacattttcttttccttttttcttttccagaatggcgcattgaatttagtatctataactgttataacaaacaagatttccaatccattcaagaaatcacactgcatctatggataagtagagaatgaatatggcctaatctttcatgtactgatttgatctttagtgaatctgaagttcttgagtttcagcatttgtttttgggacaactgcattattgtgcttatgatagtactaatactgctgtgagattttatgcttcagaacttaatttcctttacctacatttcaaagttttcaacaccatttgtttctgcataagttctgcaaaaagtttggctgcatatctttaccattctgcagtctgctaccatatcattcagatgaattcattctccattgggtttctactcatatgccattcttattccaggtcaagtattcactgatgttgttggtagcccttactatgtcgcgccagaagttctgaaaaagaaatatggtcaagaggcagatgtctggagcgctggtgtgataatttacatcttgttgtgtggtgtgccgccattttgggcaggtaagaattttgctgatttttcagtcaatcacaaaacaattatactaactttcgtgacaaaatgtgatgtattttgatccgaactcttgtactaattaagctctccattgttgtgaatcagagaacgagcagggtatatttgaagaggttttgcatggtagacttgactttcagtcagaaccatggcctagcatctctgaaggtgccaaagatctcgtaaggagaatgcttgttagggacccgaagaagagattgacagctcatgaagttttaagtaagttacttgattaattttcatgatatattcctaaatgtatttttctagctattttagtagtgcagggctgcaggccatgaacagtgcagtctgatttacttggcattatcatcttttcagggcatccatgggtccaggttggtggtttggctcctgacaagcccctggattctgctgttctatctcgtatgaagcaattctcagctatgaataagctgaaaaagatggctcttagggtaagtatgacttggacacaaattgttactatatttctgatttctctatgaaatattttcccaatattaggatagcaccatcttgtcgttggccttttgtcctcatgcaccaaaggaaaatctgtttggagtttagctcatgcaagatacagtacataatcattttaaaaaataagtatccaatgttgtattagttggagaatgttgttcatcttgaatggttcaatcatacttacctgcatgtcctgatacctttgttgattccaggtcattgcagagaacctatctgaagacgaaatcgccggcctgaaagaaatgttcaagatgatcgacacagacaacagtggacagatcaccttcgaagaactcaaggttggtctgaaaaaagtcggtgctaacctccaagaatccgagatctacgcactcatgcaagccgtaagttcttaagcaatctaccaattccgtcgagtacttttacggtggtctctactggtcgaaaacatcaaaattgcatttgtatctgaattctgaaatggtattattacaggcagatgtagataacagcggcacgatagattacggtgagttcatcgctgcaactctgcatatgaacaagatcgagcgggaggatcacctgttcgcggcgttccaatacttcgacaaggacggcagcggctacatcacggccgatgagctgcagctcgcctgcgaggagttcggcttgggagacgttcagctcgaggagatgatcagagaagtcgacgaagacaacgtcagtaaaaaaaaaaaagaacctacttttccattccattctgatcgaagctagctaatcacattgcctgaaatgcttgatctgacggaactttcgctgttctttttcgtgccttgtgtttgcaggatggtcgcatagattacaacgagttcgtggcgatgatgcagaagccgacgatggggctcccggcgaagaagtccggcgggctgcagaacagtttcagcatcggcttcagggaggccttgaggatgtcttgagaaacagccactagagtcagtcacacacttgtagaggcgacgacaacgagatcgatatgttgtcttccatagggctggtaatttcgaaacggggaaaaaaatggctggaggagatgtgcgtgtacgtacaggcgtagaggggggtgggtcactcttgggtcattggttcgattgttttcttctgacgttaaaaatacaagagaggtttttcgttcctcgccgccaccgtcgttcatgtgataatccttggccccctcgatcccctgcgcgcgatgccattctggtgcgtgatttcgccgtgtgctaccgtgttttcggcgggcggagcggacgaacgcgctgtaccgtccaaccgcgcggcgtgtgctgcaaagcgcgcaatcgctcgtaataaaacggagctccgatcgcgagggcaaacgccgtgtgggggacaagggcagacacgtgaaatgaagccgttttttgtccttcctgggttattacttccacttctttctcccagcggagcggcacgttggtttcggaggccgtggcactgtcgctttgcccatcaatccgcccgcccacgggcgcagatgcagagatactactggactgctacgactagtacccgttgcgctgcacgtcctgccgggaccaccaccagactctgaccttctgcacgttgtagtagtgtttagcgtttactgtaactctctgaagatgaatctaccactacaaggcgatcacctgatgcagtggtgggcaagttatgcttccttgctagtacagtattatagcaacctgcaacctcatataagttgtagtaggccactactccctccgtccaaaaaaaacaaaacctgagtttccgtgtccaacgtttgtccgtccgttttatttaaaaaattatgaaaaaaattaaaaagacaacacgtataaagtattaaataatgaaaatactaattataaaaaaattccatataagacggacattcaaacattggatacagaaacacagggtttgtctttttcttttgtcaaacattggatacggaaacccagggtttgtctttttcttttggacggagggagtagtagagatgctgtggtaataggacacccgcaatggttatctataggctctgtataagatatatatgtcagcatattttcctacttgaaaaagattaaatgaagagagagagcaaagctatctactaaactggagatagtctatagagaaaaacgaagcaatagattagagagctatagatacccatgtagacatactattgaggtggtttactattaatctagtctattgctgagatgtacatgttttatattttatagagagcaccttactttatcattgcgggtgctcttaggcgaagacgattcacattagctgtcactttatttcattaataacgacgtcgttgcttcttagttggagcatctatagtttatagttcagcaggtacatcgtgtattcatgttctcacgctgattagtccgctgtcccgaacgaataatgcaggcctgtacgtccaaatgacaaatcatagcctaataatcttcagagaataagattcgcataaatgattagatctatagaagatgcagaattgattactactagctttaacaccaaggatgctgtgatgtttaattgtttactcggcattctgtcaaaacagaaaaagaagaaaaaatgacggaaaaaaatataaaaaaaaacgctcctatacacagaagatctcggtcttcaagtatgaacattttcctgcctttttttttttcagacaccaacagccaccagattacattccccacctgatttattattcgtaataataaacaaaaataaaaataaaaaaaaaacaaatggtaatgtggacggctccagcacagtccatcacctcattctagttcgtgtttcggtatcatgagatcaatctttcgccgtctactggcagcttgcgaatcgcaatcgctgaccaaggatgccagccatttggcacgttgcttctaacaacttgcctgcagtattttaaaatgaacaaagcataagattattattatcaatgtgtgattaacacataacgacactggtgttatactgaagggaaaaaaagctagaagaatatgaggctggggagtcagacgattaatgttagattatgtatcattagataccctgtcaattcaacattgggtgcctataaaatttttggcatttttgttgttctcaagatgtggcaatggcttcatgtagcttggactcaaaggatacaagtagtaagcaataagctcaaataatctagaccaggcaatagcaatatctaatgtcgaaatcacaagacaactgaaaatttaggtcatgaatacccaagaaatatactgccatatagttctataatcagcatcacaccacgttgcacacctaaatgaactaatcaacaaaaggaatatcaccaagtgatcaaggttcacaggcaccagggtagtttatcttactcacgaatccacaatccgtggccacccaaccatttctatggagcagtatatatattgctgctcactatcatctaattcttgagattaaaatcaacataagttttcttcagatcatgacaacttatagatgcttggcatactttttgagcacaggtctaggaaaatcgaggggatttagattgatcttaactatctatatatgacctagatcatagaaaaatacatctaagacaaaattttatctttaacatacatatgtaggttttctacttctgtctttgttttcaccaatcatagtccaaaaatagctcgctctaacatcagcagcattcgcatacaaaggcacacagtttagcaattgccatccctcaacccataaccaatccaatcaggctactaccattccaccaaactctagtaacaagatgtggcaaaggcttaagcatgagccttttgatgctttgggggaaagaaaagctgttgctcatgtgtcacgggcagagcacaattcttgcttgcagtcccaggtacagtatcaagagatggtaaagacagtaacccaccagcacacgcacaattctaatgtttcagtacacaatccagtgctaatatcacagaccagccagctatgtgtaatggcctgaataaaatgtataagtgcatagacaccaaagagaatgactgcaactttggtagtattactgaccacatagtagcaagtgcccaaacgggcaccgacaggccatatgccattcagaacggcaataaccctaattgcttctattttatgcctaagccttcgtctttattccgcccagtacacaccacccaccaatcgattaattaattaatccccgccgctacgatcagaacacttaccggtagcacttacctgttcctaccggtgaagagtaaaccctcacactggcaacattactagcatcaacccgcattgacttaagcaattgcataaacaaaatcatctcctaacctccccaatctaggttgtgaactgtaaatttctatggcggatttgcacgattaataattgagtagaaaatgcaagttcagatctgaagagaatggctgacctctccggagtttgttcttcttgcgagtgccggtgacggcgggcgccctcctgaccggcgccgtgtccggcgccgtcttggtgtcatccggcgggaacagcacggcgtcaatgccctgcactgcgatcctgccatccgtgtagatgtccgggtcgaagagatacgccgagccctcgccatggccgaacttgactgagccgtcggcctcgcgcgccaccaccttgtgcggcagccgcagcgtgtcgtagcgcaccttgccgaaccgccgcaccgcgttgtacatgctctcctcggtctggtactccgggatcatgtggtagtacaggatgttctccggcgagccgggctcgctgagctggtcggtggtgaggcgcgccatggcctcgtcgttgggcgcgagcacggtgagcacgtacccctcggagacgagccggcccatctcggtggcgagcgaggtgaggttgacgaggatgtcggcgagctcgttgtagccgccgtacaggaggagggtctggatgaagtccttcacctggctgtggccgtcgaagtggtgcttcccggagcccggtccaggggcaggcgccggcgcgatggatgggccgggggccatggcgtcccagatcggaagcaccgggggcgcgccgggtggcacgggcggcgccggcttcttgaggcggtgcgtcctcgggtcaacctcgggcgcgccagttggcagcacggcggagatgtcggcgaggctgcggcggcggttgaagtcctcctggacagagcgcggcacgaggaggcgctcgatcccgtggatgacaccgtccggcctgagcacggcgtccgggcgggtgacggcggcgtgggcgacgcgcatcgcgccgtcgttggcggcggcggcgagctcaacctcctcgccggagagcgtggggtgggagacggcggaccaggacccggaggggaggcgggcggggaggacgtggaagaggagcagcgactggagcgacttgaggttcctcggctcgagcaggaagcgcttgaactccgggtcgaggtcacgctccagcgcctcgttccgcggcgcgaagatggtgacgttgtgcttgccgacggcgtcctccagcgtctggagcagcagggccttctccaccagctccgccagctccgtgtaatgcgagtccagcagcgccaccagcaccgagttcgagttgattcccgttccagcaccagcgccagatgttgtcccgctactagccgccccatcggcggcggcggagggcaatgtgggttcctccggcgccgtctccgcggccgcgccggcgagaagaagcaagaagacgagggcgccgcgcaccggcgcgcccatcgctgcggcggcttctcctgcccgaatctctccggatgcggctacggctgctgctgctcccaccgctctgctactctgctagctactctccaccactctggtggttcggcgaaggaatgaattgggggaatgggggagaaaggaggagaagagaagtaaactagtaatggaggaggtgggtggtgtgagcttttctcctctttttctcactttcccctccttttttactccaacggaagagagagagagagagagagagagagagagtgaggtgtgtgtgagcttgcttataagtgaagagagagagagtgagaagggttgtcgaagtggaatagtggatgcgaggccgaggcgagaccgcgagacgaggaaggagaggagaagacgacgcagagtccgtggttggtgggggcagcgtgcagcggcggcacaggctggcgggtggagccgtggagaggggccagcagcaacaagtgtcggtgtgcagctgtgcgtgcgtgcgcgcgcacaaggttcgcctgccgtaagcaaggaaagtgtgggcagtgggggcattcggtcgcccgccgctcgcgccttgtctcgcggctcgcgcgcgcgcgcgcggcgtatgcaacatttcgccgtgccccgcccagacgcccagcagcgcagcgcgaagccgagccgcgaatatttccgcgggtttcgcccgctttctgccgcgcgcgctgccttgcacggagacacagtgcaggcgtgcctggatttttcataatttagtccttttaaaaaacttatttcgtaaatagacctaaaaaaacttaaaatggtcctttttggcgtcagaatggctggcgccgtgatccaactggacagcgccagccactctagcgccgtcctcctgccgacgtggtgggacggtgctaaagtggtgggggagggcgggtggcgcccccctc

SEQ ID NO: 62445 - DNA, 4521 bp, Oryza sativa
cgtctgtttcatgggaagggtaatatactctaaaagttgatctaattaattaattaaactccgaattgcctcttgatcaagacagtaacatactattaattcttacctgctttctgcctttgaatgcagaagctctgaacacataatttgtgctgttaattttatatttgaaacgaattcacatgaattgctggtttctgtctattagagcatgtgttgggcgacgcatttgcggggacgtgaagtgtgatgttacatatgtagtggtgtatgatatatatgtgtctgccttgtgataaaaaaaagaaatgcccatgaatatatgaagctgcatgtacatatatatacatcctactagaaagaaaaaaaaataccatagtcttttctttgatatatatgaaagcatttacttgtgtttcttgttaatattgttccctcgctacatttacttgtgtttcttgttcaagctaggagaaaaccaagccatcagtgcacgcataagtaatatatcgatcaggcagagtcaggaacatatatgcatatcttcttcgcttaattgcatcgagacaaacattgtcatacttcttgggctgttgtagtagcaagaacagtgctgtcgatcaccaggatagctgcagcttcgcatggctgctttaagcaaaaacaaaaggtgcttttacctggcgtgtttggagatttggcgctagcaaaaaatgctcatgttcttcttacatgcatatatcttggtcaatttgtgtctgccatagtcttaaaaaaagtttatatttttcagtgcacgcaatcaattaattaagcaggcattttctaatgcaaaataaaggtttgtgcttttttttcttcaacaggagggctcggctaattaggaaattaaaaccgtcgatccctgtttttataagatgccacataggttaaaccgatcacatgacaataaaatatatgaagagataaaggttacaatgggttttataccggtatacacacttacctatgtcttggacaaaattaaaactcacaatttagcaacactatagctagtatatgaaacccaatgctctagagcgtacattgtttaattcatcaactcaaacctctctagacaacgcggcactctttaaaactgtggaattaaactccccataaaaaatgaccttatgttcaactcaccccgaaattattaataggcttatttcgaaatgagagtattacactttgaattcccaaagccattaaaattttcatgctatgcaaaagctttataataagccaaaagaaatttcagaaaaaaaacatttatttcgcaagctgtgtcattgtcatcatgcactagcttgcaccatatgagagacctaccaacaatcttggccgtaagtaaccgggctctgatcacgagaagacagcgtctccagtggcgtcactccatctccagtgagtcatcagcagccaggggcaaatcgggaaacacacgtgcagccaggggcattttcggaaacccccgagcattttaaggcagcaaagagagcattgcatgcatagtgtgagcagcagcttcatcacaccgagctcgcaaaaaacacaatcaatcgatccccaattcgatccccatgggcgccgcgatcagctgctgtggctgtcctcctcgccgccgtgcaggcgcggccgacgacgcggcggcgggactcaccgacgacatcctcgccgagatcttcctccggctgccgccgcacccggcctgcctccgccgcgtctccctcgtcagccgccggtccgccgcgtggtcaccagccgccgcttcctccgccggttcagcgacctccacggcggcgcgccgggggctcccctcgtcggcttcttcagcaaccacaaccatggcccctgggcggacacccgcttcatccctgtcggcgtcgacggcaccggggacagccgtcggagccgctgccgcagccgccgcgccaccgcggcgcgtaatcccggcggggtgctcgccctgggcgacgacgccgagtggcacgtcatcggctgccgcggcgggcgcgtcctcctcctcagccccacgcggctccgcctcctggtgctggagcccatgctcggccgccgccagtacatcccggcgccgccggcgccggagtacaggccggcatacttcagcaacgccgccgtggtctccgccgcggggggccacgacgagctccgcctccggccgcacctgttccgcgtggtgttcgtctcgagcaacgccgccaccaagcgctccaccgccttcgtctacaactcggcgacgttccggtggaccaaggcggcggcgacagagatgtcgtcggtgatcgacggccggccgagcgtcctgatcggccagaccctctactggcacctcatctcgcacggcctcgtcgcgttcaacctggagacgcacgagctgcacgagatcctggtgccggccgacgcgttcgacgacgtgcacgatgccaacctgagcatcgtcgtccccaggagcggcggcggcggagtcggcctcgccgcggtgtccgggtacatcctccagctctggacgctgcgcgactacacccacggcgcgtccacctgggacctgcgcaacatcgtggtgctggacgcgctgctccccctgcgcaacgctcggctgccgccgccgccgcagctgccggcgtcggcgaagccgatgcctctggtgtggttgatggcgctggacgaggatgagaacgtggggtacgtgtggaccgcggctggggtgttcgctgttcagcttgacaccatgaattaccacaaggtgcttggacctgtttgtagggggatgcaattcgtttttccctacaaaagcttctttctccctcaaggtacataacatatatactcctgatcatagctttacttaattttgggcactaaattttgaaaagttcaatgaacctaaattatgctcttggttgaaaataattgttgttttgaacttggctgatatataccaaactttaaaaaatttgactataaatcaattaattatgagttacgacacgctgataattcactagtcagaattaatgatcaacccgtactacgtataaacaggacatacattgtaacaattgtttgtttttataaaaaatcttctccttttgtaattgttagttacatatgtgcaaatcttggtcatataaggacttattagttggaatttgacatgaaaatttctgtttgataaactcaatgaacctaaaccatgtgttcttatttgtaccttattaaatacggatggcgctgcaaagtatttttgcaaatgcttatcgtttgttattggaaacagtaacattcaatattaattctcacgcatgtgcttacactgtttttgtttttaagcagactatatattgacgaaaagtttaattaactgtgtgttttgtgcttttccacatttacttatagtctattatcactttcttaactctaactgcaagtttttgttttggtttgttatcatggttttccattattataggtgtaaatatatatatattaatgaaacatatttcagagcatatctaaatttttcaggtggaagtgcagccatgattatgtaattctactccttcctgggaaaagtaagttgatttatccaactgcatgaacataagatcgagataactaattagtgtttaataatattttgacagaaaatgacaatatatatgcatttgtatatcttgcttgaaaaataataagtttataatattctaacttagtttctttttcaactgcatttagaaagaacagtaggatagtagctcaatatgcattttgaaatagtatatggttgtccatattccacacttcatctttctttttgtgactgaagggagtagcacgttttcaccatgctctttggacagatataattaattcaaacagataagtacaatataaatgaaggctgtatgttgtgtttttacatattacaaatttctgtaatccatagtgcctatgttggatttataaaaggtgaaccacctgaatcctaaagcaatgttttgctagtagtaggttttcatggtttaaaattaggctcttgatgcagtcccaaaatacaattgtgtttatgaaaacaaatgtaagacttggatcggaaaatctatatctatgcaaaattgcatcggaaaatctgctatatctagctagtttgttactataggcacaaaagatatgatataaaagttatactactgcgtacatatgatcgatattgatggtacaccatacaacccatttatatccacgccattgtgtttgattatttttttcctgtttatgttttgttcttcatgtctgttgtatttgatctatatatgtatatatgtatatatatatatgtatatatatatatgtgtgtgtatatatacatatatacatatatgtatatgtatatatgtatatatatatatatgtgtatatatgtgtatatatatatatatatatatataatatatatat

SEQ ID NO: 62446 - DNA, 5720 bp, Oryza sativa
  unsure (1)..(5720): unsure at all n locations
ggggggagggggtttcactgtgttttattttcccaaaaaaaaaatattttctttctttttgagaggaaaaaaaatattttccgaaaaaaaattaccgttcgcgcgcgcggggtcagtctgtcgtgtggattaggaaagcgcgggagaaacgtccgttgcgcgcgggctttttgtttgtttggcccatttggcttgtgggccttctcttcacacggcttgttaggctgtttggtttggaagcaaaatttaacctactttggtatacctctgtgtttaaatatagagtaattttttttatcaaaatatcctataaaattatagatttaaggtattttctcataaaactataaatttaacaccaaatttatcaaaaaactatagatttgtgactaagtatcacaaaactacatactatatatttaatattgaagttatcacaaaattacagattttagagtttataaatccttagcagtactgcttatgttgaaactttaatattgtacttttatggttaaattgtgactaatgttttgtgataaatttggtactaaaaatatatttttgtgatactacatcttaaacatttagctttgggataaatttatttgctaaatttgtagctttgggatacactgatttaaatctatagttttgcgatagtttgatatagttatatgtggttgtgtaaaatttaatctcaaatatatttttattactaattttctattgcaatatagtgatactctatctaacacaattataatattgtaaaattacatgtaaactatactttttttttttgcaaaatttgctctagtacctaagtttgtgacattttgacatttggtataagagtctctaaggctatgttatttggagtagttggaacccttctccctgctaacaaaacggcatggcagcaacgcatgattaatttaagtattagcttaaaaactttaaaaatagactaatattatttttttaaagcagctttcctatataaaatattaaataattgcagcgtttaatagtttaagaagcatgcgtgaaaaaaagggagtaaaagttgggaaaagaaaacaagcgagcagaagtacggagaatgcagtacagaacacaccataattttgtgactttgttataacacactctagatagagttatatgataattttctaaaaaaaacactgtcaattatttaaagagaaaatcaaacaaattccattggcaagcccctaattccaaggaataccatcggtaagtgcgagttacatgaaatgtcatcgtacacctgactttgtcccataaataccatcgctgttagagcacttaacggaggatgctaacaaaaccttaagggtaatggtatttttgagacaaatttgtttgtgggatgacatttcatggaactcgtacttatcgatgatattttttaaaaaaattgcgtacttcttgtcaatggcatttcttatatttttattttgatatactcggttacaatggagagattaaactttacaaaagaccattttaaccttgagagactttgcaagattgaaatgtgtagctaaatttagctatatttttcaagaatgaacctgtcctaagctgtggaaatgagaattgctaaaatattgtttttttcccaaaaagttgaacaaatattttttaaaaaatatatttaaattgaatctaattgtatttttcaaaattcaaaactcgtcctaaaccatggaaatgataattgccaaaatattttaaaaaattacataattatagccctgggaggctatgattagagaaaaagaaaagcacaacaccacacgtggcaactcctgtatacaaactcgagaatataattaacaccagccggccggtcaccgctgcctatatatgcatgaccggtatccgccaacccttcaaaaggagaacaaacacattgccctgctcttctccaaacacatttccaagcactattgcaaaataaattgattgacggggagaaagctgtcaaacattgcaaccccatttcatctcaccatccgatctctgccaacatgtgtagcccgatgcatgcccatccatcatcccgccaccacctgactggctgactccaagactaaatacagtggccttctgctccacaaccgccaccacgtcgacacctctttaccagcacctcacctctgcacaccgtcatctcgcaaacgacccaccatagccttgttgatgtaccagtcaccagggctagatcggacccctaagcatctacacttgtcatggatctcctcggagaagtaggggaccgaatagagtggactcgaccgtcgtcgccattcgcaccgtccacgtgtcatttgggcctttgtgtgtgccttgacctcgttggccatttgtcggagcatgctactgtccgggagcagatgtccctagccactccctcgctacatcccgacgtcccgccatccatgcctcgttgcagcccagtactgtccgtctactagccaccaaccgctcgagccagctaccatcgctgttgcttgccagttcggtgtgctggttcggactcctctacccccgtcgatcactggcatccttaccggatctggccgaatggcccagttctaggcagagatcttagagggagggataaagagccctgctcccaatgtccctggagttgtccaacttccaacgtccacttcggcggcgatgacncgagggagaggatgcaggaaggttgtgtggtggtgagttagtcgtgttcgcgcgtgtagcctctggagtgggagcgacatctagcattacctatgtttgttttggctgtggaaagatggctgagcatatagatctcaccgttttcgtaaactgaaccaaccgctcttagattttaatttttaaaactttaattttagagtactttgaatgtagttttttaagcgttaaggatatgcatataaaagttttaccagtaaatgattatttttattattaataaattcttttggtttataattagctctcttaaacaaccgacgatggagctacgattatagaactcgatcagatacacaaattcgggaatcgttcattagtatatcacactggcggtacggtagtgttgactacatgcaacctcgtgcaacacacaccacgtattatattagtatattacctagactatagtttgaaacgaagtgtgatgaagctaggttgacttctcgctgttgatgttctgcccccggccacctgatgattaatttgatattagtagttaattaagaataatatcacctcacatgcagagctaggtgattattgatgtataggccacatggggtcaccgttcccagagatgcgcgcatgcaattagaagcaacatcaccggagtcagcagtgagatcgagcaaactagctagcaaattactcccttcatccctaaatatttgacgcagttgacttttctaaacatgtttaaccgtttgtcttattcaaaaaatttaagtaattattttttttatcatttgattaattgttaaatatatttttatatatacatatagttntacatatttcacaaaagtgtttttaaataagaataacggttaaacagcgttaaattttcgggacaaagggagtagctgaaatcgcgtgcgcgcatgtgaaccaggatatgtgcaggattcatttttattttcagactcttttgaagcgcagggattctaaaactatagaaataagaaaacaaatgggaaaacaaaggtttgaatcatataattacttaaaatgtgtttcgatggcacagaaaaagatataaatattgaaattatatgttatttcgagttgagtagtaagagaaaagagaggtgtggctttggaattatcatagaaaaacanataacacgaagtacgtacgagctcatgtntaaaatccttaatttggattggagcatangaatgaatccaacgggattttaatttgcaagcccaaatcttaccaaccaaaacaacctcttcataaagaaaaaaaagcctaaaaattaattaaaatccttcaattttcctttgaaaatgctttaatacaaataagtctttattgggttcagggatagacagccacatgtaagtgataaaatcacctgcctttgccttccaagtagacgacgaaagaacctacgcatgcgcgccacccagccactcactcagctcgcgcgctggagtacaattactaaacaaaaactcaaaaagcgagggcggcgtgagctacaagtatacaaggtgggggcatcttcttcctcccgctcgcttgtcttctcctccacgcgcgcgcacgccgtcgggctcgtgaccgatcgatcgatcgagagagaggtcgctcgatcaacatgggggaggcggcggcggtggtggcggtgaacggggagaggtacgaggcggtgggggtggacccgtcgatgacgctgctcgagttcctccgcacgcggacgccattcagaggccccaagctcggctgcggcgaaggtcggtcagctctcttgctagctgctgctctcatttttgtctcctgtttctatttttttttcgtgttatatatgctacgtttctagctattcttcttgttcttgttcgatcggaattaattaatcttgagctggaatttaataataatggttgcaacgtcgtcccatccacctactacgggatgtagttgtagcgatccagtttttggttgatttatcttccttcctagctagcttaattttcaacttcctagtgttttttcagacgcggcaggaacgtactagtactgtttcatttcattccggtcgatctaacattgtttagcctacctgattaattattatatatatcactctagttaattacagcatgagaaaactagcaacaatcgtgtacgtgcagcaaaattgttgtgacagttttttaaaaacacgagataacttgctattgctactaccacaaccaatcttgggagctatacgcagtggatgtgaaatcattggacaaaaaaacttctcccaccttcccgtgatactactataatagattttgtgtagatataatacatccgtctgtcaagattcactgtactataatgtgtcatatccacccaaaattacttatattacggaataaatgtgtaatttattagacaataaaaaattgtctgagtttactaacagaaaaatactaaacttttagtagtataaagaggaaaggcgatcgagtttgttcaagtcctcgagagcattaccttgtaagaaatggaaaggtagtacacgtactcacagtagcttactgatgattacgctacctagccgtcaacgcatacgtttgtacggattattgttattactgtgttgattattttttgaacctaacagttttaattaattagattaaaaagatgggctcgcataaattatagcttgctaattaatttgagattttggaattaattaaattaacaaagcactaaattattagagttcaaatctcttcacatttattagttcaaaatttggaattagtaaatttaaaactataagtcataatttagattatcagtttggagcagtttcagcgcacctctcaatcctagggaatcattccaacctttccggctgcagtttgtacttttttgtttgctttttgtttattttattaaggagtattaggtagcagagcctcacatg

SEQ ID NO: 62447 - DNA, 997 bp, Oryza sativa
  unsure (1)..(997): unsure at all n locations
cccacaatcaccctngtatggttatggaagacttctcccccacccagaccntccacggtctccctcatccagtnatcgttatacccccccaccccccccccagggtgatgacggctgctggaccncccnnaganngagaannggaaccccccagccgagacggaccccaaaacaagaggaaaacaaacgagcacaagcttattctcccaagaagcctcctaactaagatacatccgctgtcgtccatagccttccttcttgcttaatcctctcgacgatgatcagaactgacgataggacagcgtcgaagacacgcattacacttctaccatagttgccaggatgtcaacgaaacaatagaatcgaaggggcggtgatggtccctcgcaagtcgatgccaagtttgcggccaccggtcttggacccaaaaatgatggtctagggcaacatcagcccatccagcggcgcgaggatttggaactagacctagcgagcgaagagtcgaagacataagcgatgatgatatggttcgcgtctcctgctcctgggtgtagaaggggcaagcaatgtggctctccatggtatgacgcaacatgacatcggcgatccaacaacacttttgcagcaccagccagaggaaaaaccagcacttcgcaagcgcttgcgcatgctagagggggtcggtacacgcgaacaagtgttgccccgtgaagaaagctttataagccgacgaggtagatcgagaaggcggtattgttcgaccaccgccagataaggttgtcctccatccgaggttgcagctggataggctgtaccatgtcccagagcaggaggaactggctaaggattaatccttacacggagagaggatatactccctccctccagttccatattagctgacgttttagacaaggttgaggtcaaacttttannnnnnnnnnnnnnnnnnnnnnnnnnnnnnnnnnnnnnnnnnnngcatgtcatttcaacgctg

SEQ ID NO: 62448 - DNA, 1029 bp, Oryza sativa
caaataactatttgccacccctatctcaatgacatgtgggtccacatgtgtctatggtatgtgggtccagtggtaaaaagttaattgccatatttaaatgtggcaaatggttaaatatctcgtttgttggcacgttgtcaagttagagaacaaaacgaggagctgcacaatacaacagtgttggcattgcatcgaatatacttcactggtactgtacaaaaatttgttttttccccaagtgacaaaccctaaccctcataatcgggtgacattaacagaagcaagcatataaattagaatcatatcttccaaattcagtaccttttcttgcaaagaaaatcaaatcggttgcaaacaagaagagagggcatgcatgcatgcatgaagaacagaatctggaggccggccttgcctgatgactgtaaatcagggttttaaatctcccgctatagctgtttgagaagggttctagctatttgctctcatatacaatttagccgctatagctccatttagcccgctatagctgccgctatagctgtttgagaagctaaccgctaaatactttagcccgctatttaaaacattgctgtaaatcgatagtggtcgaaaccacgtggagcagccgagagaggagtagaacaggatcgccggggtacgcagccgcccgccggcgaggctagcgcacggcgtcggaaatatcgctccggcgaagcagggcgtcggaatcgggacggccgcggccgggaaggggatgatggatcgggagcgagcggtgaaccaccatgaggaggaggaggaggaggaggagagaagatgaaaaggaaaaggaaaatattggaggggacaacaaagctgtgggctgccgtatgtgggccgtacgaggaaacaaggctggtaggcccagtatttaggtagagcactggagcctgggtttaattgggccattcactgagaagctgcctgcggagaaagtccatactatatcccagaaaaacatgggttcggtttgatacggggctgcaggaa

SEQ ID NO: 62449 - DNA, 7853 bp, Oryza sativa
  unsure (1)..(7853): unsure at all n locations
cgcggcggcggcggaggcggaggacgcgtacccgccgcagggtggtggtggtggtggtgggtgggtgtcgaggctggtggacccggcgtcccgcctcatcgccggtggcgcggcgcggctgttctcgacggtgttccgcaagcgcctcgaccctgcgccggctccggccccgccgaagtccacgcctcccggtgagcctgtggttcctgtacgctcccatctgggaagactcgtgcttgctcccgcggttcgtgctcgttagctttgcgctagggtttcaatcatccagggcgttctagggtttagctcagattagctggttcctacttctagtctgattgattttagctataaaattgctatcctccttgatatggagcagtagactcgtgatgaaaatgacgctgttctacaatggaagtttagtgtggagtttcatcacctcctatttgtgtgttttaactttaaatcataccagagtgtcccattctcttatttaaaaccatagcagtgtactatttgcttgtctgtcccaaagactagaaggatttgatgctccaaggtaaaaacatcaagtgtagtatgatgaatgtatttatgccacttaaaacaatcttaattcagtgtaatatccggtctttttatttttatttaaaaccatatggaaagaatacagtatgatatggtcttattttgtctgcctgtagtattacctattgataattttgtgcttggtgctgcagtacgttactaattttatagtcgcttcatgcatgcaggaagcaataatgagccaaaccaaggcttacctgagtcaacacaaactgtaagttataaccaagtgcttgcaaaaaaaaaaaatcggttgtattgtttggcaaattgtgctttatacttttggttaacctattatattccgcttggtgtttttttaccctttattcctttatatttatataacaaaatctgatgcagggttcaaaaccaatcctcgagaaagggaagaaccccactggtgcatcggacaataaggcattgtctgaagtagagcacttgttaatgaggaaaacattcacaaggaaagtatttttcatattaatcttcttgaagtggtacttccatgataactgattttttagttaaccagtgaggtatcaaacaatgttgatttacccccagtgtaatggctatattggttttgtgatgttcaactcttctgttgacaatcgttggaggatcaaacattgttgttctctttccttttttgctggtgtcaactttttgggggtcctcttaaaattctaaacgacagcatctcttctgtcccgtgctttttaagctgccaatgacaatgtgattttgtatcagcagggttgagtttgaccgccttacagacttactgcgtgcaagaactgtggagtctgatttgtctgcaccggcagataaccttgataataagaatgaagcaaggaatacaatggatggtataggaggctccacatcacatgggatggctgcagatcattctattgctgctgatgtaagtagttcttttggtcatgaatattttttattctaaatgctagtccatgaattctggatattggataaatctcctcgagccaacaaagaaaatttaatcatacctggcaaacactgaaagtttatgttgttggtactgaggcatctgtagtctgctggtttggtttgtttctaatgccaactgatatactgtattaccctttttgccatcttcccattatggaagctccttttattgtctgattcttttaatccttttattgtctgattcttttaatgcaaggtaggctgtagttcctaaagtagccttcttgttacttgaactcgtgagtgcaaaaatatttttcgggtgcacacatgttagatgctgcattaattgctgagaaatgctgatttggatttgttggatctgtcattttttttaggcttgattgtgcatcaaagctctttactgaccttttaatatgtttaagtgctagctatataggatatgtgcagctaaacggccctttttgcagtgttggtatgccatatgattgttggattcaattcctacaaattcccatgttacatgcataaaaggcagtggattttacctttcgtttccatgctccatccaactaccatattgcagctttgctacttaggtttttcagtgtttttatttaggaaaaaagcaagcaagtgtgtccttttattcaacttcctttggaactttagtctgtgtttaattttatttctgtttattttgtaggatccggtttgtggtgctagttcacccgcagagctcgcaaagcaatatatgaattcccgttattcgaaagaaaaccgaccaaacagtttgcggagccaagtactcctgaagaacaaggcagaagcaagcaacattgcctatgatagaaggagacctggaggaccatttgtgcaagaactgagtcaatttagcaatgaaaactctgagcttcctgtgaatggctatgtaactccaggattacatgggcggtcagcaatatatagaatgtcctgttccccattctttaaggtattgtgtttactgcacataatgtcaaatcattctcagccatgttttcatgtgttctcaacatgccatactgattactggcgctcgaatttttttcttgttcagtataatgatgctctaacaatgatctcacagggaccaagctcttccaatgatataaatatgtcaccattttcatcatctcagacacgggctaatagtttggtttctggctgcaggcaggtaatttattagcactttatggaaacatatactgcattatatacagtatatattttaaatttgctatacacttagttgaacaagttcatgttactgagaaggtgttacggttgaataaactgtctagctattgaggttcttttctttttcttatatatgtctgtatcgttgcaaatgcaaagcatatatgtggtataaagtgctggtcatcatggacttgatagtgtgttgtgtcgtggcaacatctttagacttgcagggtttgcaccactgagaacattctccatgatatatgatctaaactagacataccagagcttctcttattcctatgtctccctaacaggtcttgaaacgaagaggtgccgaattggagaatgagcttggatctattggtcccatacgcaggattcgccaaaagtcaaatatgatgtctacttttagagatgctcgctcgagcccgcgaggaaactttcttcccagccgtacaattggttcagatttgaccgatggcggttcacccattcgggattcacctagttcgaaaagactattgctggggacgggtcaatctgtggaacctgcagaagcacgtaggaatgatgaagatggtaaaatttcaagtgataatgttcttgctgcgtcacctcaatcaaacaagatggctgaaaagatatttgagcagcttaatataatagtcccatcaccaaaagagaagctgtctcttccacaatttgctgctgggaatgcaagttgctccatgtcaaaacaacctgttaggcaaggcaatgagccaaacgggacgagtgaccctagtagttcccagaaatttcaacctatggatagtgttaagcattcccttgatccagaactgaatggttcaccatcgagtaaagacaagctgagaaaagatggatcatcaaaacttctgtcacattcatttaaggatttaggcaacaaagacattaggtctgataatgttgctctatcttcagttgccgctactacatcaagcaaaccgggctttaaaatggctgtttttgaggtatggggaaagtttactcttggttcctcgaattatattaaacgctcactcatgtcctgagattattctttatcacctttttttgttgcaggatctaccagagtttgatgatgaccaggaggctcctatcccatcgaaaaattcaatgggcaagactgaggtgaagacaactgataaaaaaattgatctgaagaaggagcagaaagttgaaccaattttattcaaacaaaaagttgagtcaaattcagtgcagaaggctgtcagttctccagttagtgaaaagcctatagcatccgcattgaaagatgcccgtccattaggcttattttcacctaatgaccctgaaaacagggctactcatgatgttccttcagacaacaacaatggtttcaaatttccacatgtaccttctggcacccttctggagagttctgtgtcacaattgccacttgcttcaaataaagacgataagctgatcagtgcatcatcttctatatttggtctcaagcagtccagtacaccagattcagaacaaacaaacactgctgatgtaaaaacagaagcaagacttggggagaggtgattttcttggcactccctatttccctttttctccttattaattgtttgcactggtcatcttctggaaggaggaagagtaaaaactataaaacaaagacaacccagtatttgcaaattcgtttttcttcaagtgcttgcaaattcatttgttactaacacataacctactaaaaagaatgttcattctagctattgacttgagaagtcccttatggttttttttctcacaatgacatgacatgtatgtaaaggctgaagatcctgtacagtactcttgtttaactcggtcataatttgtatatacatgttaagagatggtacattttattccaagggttattttagtaggatggatcgtaaatatgtaattgaaatgcatgtacagcctatcaggatattccttttttttttcaatctttgattacttatttgctgtttggaggaattttttggaaaataacataacagggctttaaaataggatatcccttttgtagtgtagaattgctttctatctatggagtaaccgcttatgttttctgctatttatgtttctagtgtcaccaagcccacaacattggacatcactaatttggagggaggtaatgaaagagaaagaacagaagatgtccataaatcatcagataaggtattaccctcggctgctcctttccactttgcatctgctgcatcaactacagcaagcctgagcaatggtttctcactgccatcatcatcaaagttatcaaatgtaacaccaattgataagcctgaagttagcttggctccatccactgtatcgaccacatttgctccatccagtaccagcccacctgtttcatctccaatccctgcaattccgacattcaattttggttcaagcacttcaatggtggcagcaactaaatcagatagtacaaatacagtggcaaagccagctagcagtttattgttcggtactggggatgctatagctgaagccaaatctactgcccaggatacagccaacaaggcatcatcaaatctaagtaccactcctatttcttcaaatatttcaagttctccagtcacatcctcttctgctttctcaagcatagcaacattttcatcttctatggttgcagcttcaaatgatggaattgcctcaactacttctgcctcaacagcaccttttacattttcgagctcaggaaacaacacttttgggttcaattccccagctcaacctgctggtttcagtacatctgttgatggcagtaccacccaaccatctgccaccagcacgatctttggtagcaaactgccacagtcagagggcacaatgtcgcagccatcgaagagttcacctgttcagtttagttcaccgtttcaaactgtgaccactaccacaggagcttcctcgtctgggtctggatctgtagctttcggagtaggaacagcctcaactggttctgggatcacatcttttggaaccggagcatcctcatcttggcctagcacagtgtctttcggattaggagcttcctcatctggaactggtgctctgttatttggagcgggggcttcctcatctggaactggggctctgcctttcggagcgggagcttcctcatctggaactggggctttatcttttggagcaggagcaggaacctcctcatctgggcctggaactgtgtcttttggagctggaacctcgtctgggcctggaactgtgtcttttggagtgacaacttcctcatccgggtctttgtttggtaattcaccatttggatcaggaactactttctctggccctggaagtggattcgcattttcatctcctagctcttctgctgggtcatctttaactatggccagcacaagtatgttcagcaccagttctacggcttcatcatcccctgctttcagtaacccattcggttcaagttcatcacctcccagcatgtttacatttggccaatcggcttcttcaggaggaggtttttcatttggagcacagtcatctccagctttctcctcacaagctccagttttttcatttacctcagcaagcatgaattcatctactccgcagcctgcttttgggatgacaaatgccaacacatccttcggcatgggatctcctggaaatgatcagatgaatgtcgaagacagcatggcagatgacactaaccaagcagcaccagcaccagcaccgatatttggttcctcaccatttgggcagcctgctagttcacccgctgctccagtatttggtgctccagcagtcccgtccgccggagttttccagttcgggggccaacaaggttccatgcagcagaatgcggcattcccgcctgccggtggtagcctagagtttcagggtgggaacttctctttgggaagtggtggcggaggcggcgacaaatctagcagaagggtgatcaaggtcaaaaggaacccaaagaaaagataagacgctctgttcaaatgtgcatttcatggtgccattttggatctgcctggcaacatgtcgtgatcatcagagcgggactacgaccatggttcgtatggtcatacaaattttccagcgtcagcacagttttcgcagcatcacccggctggcttgtaaaccccaaggtcagtagtgtattaccactcaattattcctttcattggcaaagccggattgcatgttgttgtatgcctgtgctattggagtgtaaaatagaacaaaaaagaagtgtatcccgaggtgtaattttgttctcttttccctgcgcatctgctgtcttatttgcctccgatatatttggctcggagtgtaatgtacactgttgtatttgttctttttgtttacatccgacatgcccagaactccctagtatagaatctccctagtttatcaatcttcgaatcccactgagttttacatcctgcgtgctttacatttcaatgtagtttagttttcttctattgtttagtgtggtattatatgagctgttccgtgatatctaactccacgctgtcttgtctccattagaaacgacttctttttatccaatgtgcctgaccagttctttcagaaaacctatcaacacaaacgttgaatttacaaaccataatcaactagtagaatcagcgttgcatgtcgcaggccgttgtgtgactgggacgttaccggccacctgccgcgtgtgaagtgatgctctctccctctctacctacactgcttcttggatggtggtgatgatgcgatttggacttttgcacaggagcacgacctggtcggccaccatgccacacgcgctttccccttctacgctctcgcatttgccatttcttttttcgcgatcacattcgcgttaggcaagtagttgggcaaggaagaagaaacatggaaacaacacgacacaagagtacgcanaaaaaaaaaaa

SEQ ID NO: 62450 - DNA, 2128 bp, Oryza sativa
aaccgctcgctcctaccgaatttggtgctagcctcgtggagcatggcaccaggacaaaaaggtccttaattttggactcgtttgcgacaacaacgagtggctcatgcttgatcaatgctcatagttatgtgcactgccgtatagaggctaaaccactggagacggactgccatggccccctccttgcgggttgccgaccactactatcgccttccttggcagtcaccagtcaccaccaacacaagcttctcgtcaagacttaggagaatcgcataaactaggaaaggagagaaaaagggtagagattgaagatgacatgtgggacccaccatactttcaaggtgtttcttctaattagagacttggtgtgtcacatagtcgtcaggtcagatgaagaccgtgtcaatgtgccacgttaaaaccaaaactgctatcaatattaccgaggaattcattttgcgctgatttttaagagttggagatgctctctaactggttttgcggtcgagagatgcgaatggaactcgacctgtccttgagggacctgaagtgaactttctgcgctgcctgtcgatggttgtggttgtgggctgttagtccatatgaaaattgatccgacagacagaaaaccccaaaaaatgagtgaggcggagatgacaagccgccgccggcgtcccacctcgccggcgccggcgcagccgctggaagacgacgaccttctctccgagatcctcctccgcctcccgccgctgccgtcctccctcccccgcgcctccgtcgtctgcagccgctggcgcctcatcgtctccgaccccggcttcctccgccgcttccaatcccgccaccggaagcatcccctcctcggcttcttcaaggccgggttcaggagagtagaccccaccttcatccccacgctggacccgccggaccgcatccccgccgcgcgcttctcctggcggctccccggcggcgacgatgaccgctactccatgttcggatgccgccatggcctcgtccttctcttcaactgggttcttcaccggctcatggtatgggaccccgtcaccggcgaccggcgcgccgtggacattcctggctcgttcctcgacggccatggcaggagtctcgtggtcgtcttccggggggcggtgcgttgcgtcgtcgacggaggctgccactttgaggtagccatactaggcaatcacccactgcaaacacggctcttcacctgcgtttactcatccaagaccggcgattggggcaatgtcatctcaaccgagttttattcagcgggttacatctgtcatcattctagtgcactggttgggaattctgtttactggttgttccagggtgatggaatctccatccttcagttcgatttcgatacgcagggactagcccggatcgatgtgccaccggatgtgcatgcccatgtggttacctactaccagattcggatcatgccagcagaggatggtgggcttctcctccttgttctgccagaatttagcctcaatgtgtggaagtatcaaggccaattgtgatgggtgttgctggatggatgctggaaaaaacaattgaactggacaggcttctttccgtcgaaccagggcgtcatggagctgcaccaactattctgggctttgtggaggaacataatgaagtattgctgtgcacagatattggtgccttcatggtcaatctgcactcaatgcaattcaagaagctttcccaaaccatggaaccaggattttatcatccattcactagtttttatactaaggtaataccttgccaacgcttttacgctggtagttggtcctttgtgaatggctattatttgttatgtgacaattattgttcctttaaatgcttgatgaactgtcctacatagtatggcatgcatttctgatattagtcttcaattatgcagtttgcatcaggggtatattcatgtgttagctcgtttggttaatttattctatgaacgttcaccataccatgattactcagatttacatattactttgaaaattggcgacaaacacatgcaaaactacctgaaccaattgaaatattctcttgctgactgtttgtgtgcatgtttgactaggggctgcaggaa

SEQ ID NO: 62451 - DNA, 18816 bp, Oryza sativa
gggggagggttagggttctcatcaatttggaacttatccgagccgtccattaaaacgaacggctcagatcgatcgagcgttgggccaaaccacttgggccgtacgcgggccggtggtccagcaagcgagaggaggagtatggggatattaattagactttggtcgcttgagggctgaagaagaaagtgggctgaaaaaggcccatagagataaagggatttttatttagatttttatttcaataaatgctgaaatgatgtttgtattataaaaatagcaattaagctatgtaaatttcaagaaaatttcaatgagtgtaattaatatagaaaatttaataaaaaataaatccaaccataacattttatttctcacacttactttacttataaattaatttaattatatacctacctacttaaaaaatacccaaatatttcagaaattttgtgtttcatttaattataatttaatatttttctaattcaattttatttttttcttttcgtttcaacgcacgaccaattttgctataatttcaaatagtgtaattaatattgcagaaaatttatatttcattaaattagaatttaatatgttttaattcaattttcttcttttttttcattccgttgcaacgcacgggcatttttgctagtaataatagagatatagataaagatagctagagaagtagaacttggtccgtccgtctacccttattaggatattcatggggattgatttggggagtcaatctcccgcgactttgggaagtcgatcttaaacgactctacatattcgcaaaccctgggaaaatggcgaaacttaagcagagcttcagccttctcttgctcatcgaacccatcgcagtatgggccacaatatattttctcatattttgaagcaccctcgttggatctgtgaagagcctctgcatttttcttgaatatcttgaaccggtgagtcatctcagcaaggtcacgcttcttatcgtaagccttgcaccagcgctcatacatggcccctatggcttcatcagactcaaaatccttgtccgtaaaatcgtcagcagactcatcaaaattcgtcaaaaaggcacctggctcatgaccatcatctatcacaatggaacaacattaatactgtcaagaacagcgagttggcttgcaagtttcaatttggttcctaatttgcgagcataaatgtctactattgtaaacattaaagatgtttttgtcggtactttggtacgttatccgtgtatgagttggattttaagttcgttcacttttggaaatacatatccatatttaagttcggttttaatctcgttcacttttggaaatacaaaatgagtcgtataagaaattctttaaaaaaaagattcgcatgctaacttgatatgattttctagaaaaatatatatctaaacaattctcacggtgaatttcaatgaacaataataagattaaaatagcttcacctgttacaacgcacactttttctagtctaaagaaaactatcctgcctaatatgcccatgccctgatgatggcaatcagaaggcccgtaagagcaggtacaatagcaggctataagccagctataaacatattttaaagagataaacgaagagagagaagagcagcgggctatagatctgtagccagctgcagcacggactccaagacgtaatgtgcgtatgacaggtagaaccgagtattaatagtatagtaagcaactattatatgaattggctattacattagctatagatgatttgtagttagtagttggctatactattaaacttgctctaataagattggggggattagcttacctgatggatcgtaatcgtcgaggtaacataccgcgcgtgcagcgtgacatgcggcgacggcggcttggcgtgctgcgcgacgtgctgcgatggccgccgagtgtggagattatggttaccccatatctacatagcggttatattccagctggatatatggtaccaaatatagatagaatatctttatgaggactcgggttagattctaaacttgtatgtcaagaaaatacccaggattctagtcggttacgattgtattttatctgtaatcccatattccgttaggatatggactgtattttgtattacggatcccttcccctatataaggaggggtccgggttcctctcgggacgatttcttttttctctcaatcatacaatcaataacatactcggcggaatcatccccggataggagtagggtattacttcttgaataagaaggcctgaacctgtataaaattctttttctccaaacccatccactttcctagcttgatagccacccccttttattattgccgaaatcttgttttgacagttggcgcgccaggtaggggttgcgtcaagttctcgccgactaagtgcgatgggtttcgtttctggcatcgacgactgcgccttccttcctgggcaggcgttccggttcggcagcctcaacttcatcaccaacgacttcggcaagatctctctccttgactcggattcaaaccagttggggagagaccaggtcctcgtgccattcggtattccgaactcggccgaggcctactccaagatcatctctcccaagtcggcttcaaaccactcggacgagatccaatctactcttccgcgaccagatcaagacgacgggtcctatccctcaatcctgatgaaacttcctgatgatttggccgctgttttcactgtcaagacatctcccactcgaagatctaggagagctccggcttcggccccgatccaatctagatccagagaggttggcgttatactccaacctcttgggacagtctcgacggaagagttggatggttaccttagctcccccggcgtcagttctcgaccaaccgagatcctcgactacaacgatttcggctaccactatgaccatggcgacctcgacaacttcgatgacagctctgaggataactacacgcccctcttcttcggcgtattcatggctgacaacgaaatggaggaacagcgccaagcccgagaagcggaccaagatcgcgcaaggcaagaagctgaacgtcgccgactggaggaagagcgacagtgacaggagcgagaacgactacagcgttagcaacaagatcgcgaacgggttgcaaaggaggctaaagatcgacggcaacgcgccttggaatctgggcgccgagcgagagagctcattgggcaacaagacgtcgatggaacagcggtctttcgcaccccccagcagaacgcggttgcagcaatcactctcctcgacaccctcctcaaggaagacacactcaaccaagctgatcatgttgtcaacatcttgaatcagacgaagaccatgatcgctgcctcggttccagccaactccgcaagcacccgtaccccgactagtagccgagtccctcacttccgatctcatgattatcatcagccaagcctcagcatcatcggcacaggatctagtcgcaggagcaggggtcacgacgaacgatcttttcactcgcctcccgaacgtcacagggagcgccgagctaaacggcctcactctccacctcaccagcgtcccgtcgaccttcgcgacatgatcaaccagcgccgtgcagcgcgaggtcaccgccattcaccaaatcgctacgacgacgacgtggatggagtagctgccttcactaatgacctgcgtcgagtggattggccagccagctttaagccgactggaattgagaagtatgacggcaccactaatccggagtcttggctcaccgtctacggactcgcaatccgcgcagcaggaggagacagcaaggccatggcaaactatctacctgtggccctagcggactccgcccaatcctggctcaacggactaccccgtggcacgatcggatcatgggcggaacttcgtgatcacttcattgccaacttccagggcacctttgaacgccccggcacacaatttgatctctacaacgttgttcagaagtctggagaatcccttcgagattacatccggcgcttctccgaacaacgcaacaagatctccgacatcaccgacgacgtcatcatcgccgccttcactaaaggcattcgccacgaggacctagtcggcaagttcggatgtaaaccccccaggacggttaagcagatgtttgaaaaagccaacgagtatgccaaagccgaagatgctattaccgcgtccaaacagtcgggcaccacttggaagccaaagaaggacacgccgaccgcaggagggagtggaagtaacaaccacaaggatcgcaagcgtaagcctgaagaacttgtggcgaccacctctccatcatcctgacaacgttcccgcgtcaacaccttcgacaagataaagaactcccaatgtccgcatcatcccaactccaaccacgtggccaaagattgcttcgtctacaaacagttcgcggagcaatacgtcaagaacgcacgtaaaccttcagacggagatcaaggcacatcaaagaacaaagatgatgaagacgatgccccgactggtttccaagatcatcgcaaagaacttaaccacatcttcggcggacccctggcttatgagtctaagagaaaacagaagctaacagaacgggagatcaatgcggttcagcctaacacgccccaatatcttcggtggtcggagatagcaattaagttcgaccgctcggatcatcccgactgagtggtccaccaggggcggtaccccctggtactagacccagtggttcgcaatgtcaagctccgacgaactctcatcgacggtggcaacgcactcaacatccttttcgtaagaccctggacgatatgcagattcctcgcacggagttaaagccgagtaatgcacccttccacggtgttatcccaggactgtcagctacaccactcggccagatcactcttctagttaccttcggcacgggggaaaattttcgcacaaaaaatgtctgtttcgaagttgctgatttcgagacagcatatcatgctatacttggacgaccagctttagctaaatttatggccgtcccacactacacctacatgatgatgaagatgcctggtcctcgaggagtcatatcactacgaagtgacatcaagcaggccgtcacatgcgacaaagaaagttgcgagatcgcccaaacccacgagactattctcgcccgcgaagagatccgactggctgcgaccacgacaagcgagggagaagtgcctgcaaccaagctgacgaagaccgaagaaagcgatgccaagacgaaaaagattcccttagatccctccgatcctgataagactgctgtaataggcgctgagttagattgtaaataggaaagcgcgctcatcacctttcttcaaaataataaagatatttttgcgtggaaaccatccgatatgcctggtatccccagagaggtgattgagcactctttacatgttaaggaagacgccaaacccatcaagcaacgactccgccgttttgcacaggacagaaaggatgcgatcaaggaggaattaaccaagctgttagcagcaggcttcattaaggaagtccttcatcccgactggctggctaacccagtcctggttcggaaaaagacggggcaatggcgtatgtgtgtcgattataccgacctcaacaaatcttgtcccaaagacccttttgggttacctcgcattgaccaggtggttgactcaacagccggctgcgagttactcagcttcttggactgttacttgggatatcattagatccgactaaaagaatccgactgcttgaagacctcgtttattacgccctttggagcctaatgctacatcaccatgccctttggattgaagaacgcaggagcaacctatcaacgcatgattcattgatgtttttcaactcagatcggtcgcaatgttgaagcttatgttgatgatgtagttgtcaagaccaagcagaaggatgacctgatcgcggatttagaagaaacttttacaagcattcgtgctttcaggatgaaactaaacccggaaaagtgcatcttcagagtaccgtcaggaaagttgctcggatttatggtatctcaaagaggcatataggccaacccggagaaaatcaacgccatcctcaacatgaaaccgccaagcttccaaaaagacgtccaaaagctgactggttgcatggcggcgctcagccggttcgtctcacgactcggcgaacgggggatgcccttcttcaagctgctgaaaaagactgacaattttcagtggggacccgaagcataaaaagcctttgaaaagttcaagagacttctcactactccaccagttttggcctcgccgcatccacaagagccgctactgttatatgtgtcggtgacctctcaggttgtgagcacggtcctggttgttgagcgtgaagaggaaggccatattcaaaaagtccaacgaccaatttattttgtcagtgaggttttagccgactccaagacaaggtatcctcaggttcaaaagttattatatggtgtcttaattaccgtcagaaaattatctcactattttcaaagtcactcggtcacggtagtcacatcgtttccactcggagatatacttcacaatcacgaagcaaatggacggattgcgaagtgggccttagagttgatgtctttgaacatatcattcaagccacgaacttcgatcaagtcacaagctttagctgatttccttgccgagtggaccgagtgccaagaaaacatgccagaggaaaagatggaatattggactatgcatttcgatgggtcgaagaggcttacaggcactggagctggggtcgtcttgatttccccgactggagaaagattgagctacgtattgtggatacatttttctgcgtcccataacgtggcggaatacgaggcgctactccatggattaaggattgcaatctctttaggcattcgccgattaatcgtccgtggagactctcagttagttgttaatcaagtcatgaaagagtggtcatgtctagatgataatatgactgcttatcgacaagaggtacgcaagttggaaaataaattcgatggactcgagctcacccatgtcctccgacataacaatgaggcagccgacagactggccaattttggttcaaaacgggaagcagctccttcagatgtgttcgtcgaacatctttataaaccgaccgtgcccagaaaagagacagtcgaagccatggatgctcaaggcgtaagcatgattgaagctgactggagagaaccgtttataaaatttttgagcaaacaagaactccctcaagacaaaaatgaagccgagaggatttccaggcgcagcaggctttacattattcatgagactgagctgtacaagaaaagtccatcaggaatactgcagcgctgtgtgtctttggaagaagggagacagttgttgaaggatattcattctggtatttgtggtaatcatgctgctgcacggaccattgtcggcaaagcttaccggcaaggttttttctggcctacagctgtgtccgatgcggacaagattgtgcggacatgcgaaggttgtcaattctttgccagacaaactcatttgccagcccaagagttacaaaccatcccgttgtcctagccgtttgcggtctgtgggcttgacatggtcggcccgtttaaaagggcagtcggcggttacacgcatctctttgtggctatcgacaaattctccaagtggattgaggctaaaccagtcatcacgatcacagcagataaagctagagattttttcatcaacattgtgcatcggtttggggtacctaatcggatcatcactgataatggcactcaattcactggcggagcatttcaagacttttgtgaagacttcagtattaaaatttgttacgcctccgtggcacaccctatgagtaacggacaagtcgagcgcgctaacggcatgatacttcaagggatcaaagcacgagtttttgaccggctacgtccctatgctggtaagtgggtagatcagctgtcgtccgtactctggtctttacgcactactcctagtcgggctaccggccagtcgccgttctttttggtttacggtgcagaagcaatgttgccgagtgaagtggaatttgaatcgctacgatttcggaacttcaacgaggagggctatgaagagggccgagtagacgacatcaatcgactagaagaagcccgagaagcagctttaattcagtcgactcgatatttgcaagggttgcgccgttatcataatcggaatgttcgatcgcgagcctttttagtcggtgacctggttatgaggaaaattcaaacaatacaggatcggcataaattatctcccttatgggaaggaccgttcataattgctgaagtcactcggccgggttcctatcgactcaagcgcgaagacggtactcttatcaacaattcttggaatattgaacaccttcgtcgattttacgcttaggcatttcgtttgtatctctcctctttgactgctaacttcaagtttttccttgaagttttcagtcagggggctactataataataatggagtgtgatttttatcaattcaatttgcttacttgatgtatcattgccctgtttgatttcttggcttagtcaatgaggactgaaagttttttaacaacttttgcgggttttaggctcaacaaggtttggcaaaaacttttaagaaatcaggaactaagttaagatatcaagcatagcataaattcatcagtattgtacaaattgtgcctccatcatcattaatcatcaaaatcattggtacagtaatcagtatcagtcttttcatcatcagaattatcaggaccagtcggtcgaagatcggtgtcctgaaatctctcaactacatcagcagcaatcttgtcagcggctttttgtgcattgctgatgaggtcaagagcagcttcttcgctcgtcccgtctgcaaagccatcaatggcatcaacgtcaaccctcgaataaagagatttggtcatcgccaacgccagacttgctcccatacttccagcttctttgatgttcttgaaatatgtatccggagcaactctcagcttgtcgaaaatttcagaagcatcaagtacactcgggccgttgttattgaagaacatcgcttgaacaattggggcagcagcgttagcaacctcatcccgggttccttcgagttttttgatcttgccaaccaggacgtcgaattgagcttgagattgatcttgcggtctgcatcaacagattcacattaataagttagcatatggaggataatggcttttgaggtattcattgttgataccttcaacttcctttaaagccaggtctctttgtcttgccagttctgccttgtcactttccagaatttgaatctggttctccaactgagatatcttggcagcttgcactacattgatcacggttaatcaagattgcaaagataacagtatgagtcagttgagcagagtttgtgcgtaccttttgatgagccactcagttcaaaatttgattcctggagctcagcgatccgatccctcagatcatgttcattcttcctagcaagttctttcacttcgtgcagttgattcctggtggcttcgagggttccgagatgagggactaacctctctaaggttactgttttggcttcgttcctaagatgaatcctctgcaagatagtttaattagcgcgtgaattaaatggcaaacaagatggttgaaatcaggtaccagagggcttacatttacaatgcgggttgcctgaccaagtgccttcttcagtaggcataactcttcgtcctctttttgcttatttatcacgatcccttgaggctgcatgttgtcatcccaccacttgaccagaatcggagggcatgaatcctcagctgcttgtatacgggggatttcttcttcatcaccaatcattggtcctaatgtattcactgacaaaggttagacaatcgatcagagttatttgggtcaacatggtttcagacaaagtgtttacccgtgatgatttctggacgaggacgagcggattcggatgcctttaaaggagatccagatctctggttattgtccgcgttttgtctgcgagggctgtctgcttgggtttcgacttctagaatctcttggcttggccctgcgtccgactggtttccagtcgggggctcctgattaactccggcttcggcttcggccgactggtttccagttgggggttgatcaccgaattctacattatcagttgccggatgattgtcactcgggtgatccccaacagttggcccggtttctttggaagaattcgtgcccatgttagtcgggtcagagtcttttccagacgggtctatatcagatggtttcctgcaaatttgattatcagtattattgccgcaatgggtgcgtatcaatacaagagagatcgttatatgagttgcacctagaagacttcctgatctttggcacatggcgactggatgttttcttccttggagtagcttgttttggtagtttcttggtcgtctctcggtcttcaggcctcctggtggtatcatcggcttcgtcgtcacttagaaccaacttcctctttcgataatctgactggccgactggatcagaagcactaggttgagtttcagaccgaattcttggtcctccgctcccttgcccagtttggtggtggggagatcggcgttgagcgattgggggatccgactgcatcaaagcaaattcctggatgtaatatccttcattgttagctgattcaacaagaaaacaagatcatattttgagaaagattgaagtgtatgaatacgtactggtggaggaggattgaatgcattgaacggtacgactggcagcaagtgtgagtagctgacaacgatggcgtttgagaagagcttatacatcctttccttcatgaccttgaagtcaagagaatctggatcttcacggtttgggtcatgcttgccgtcaaattcgaaggctgtgcgagatctttctttgattggagctaaccgacatttgataaagtgccgggtgatctgttctccttgaaggccctgttcttttagctttatcatcctctccatcagttctactgcttgtgcagcttcgtctcccattagcagtgagttccaagtatcccgataaactggaggaagacaggagtactcgggaagaacaggctcggggttttgaacataaaaccagtttgcgtgccagcctttatttgaggtcttgaagggcatggagaagtatttttggcttagtgttcccctgagttggaaaccagcacccccaacgacgcatggtttgctcttatttggctggggcttgaggaagaaaatgcggcggaataaggcgaaatgaggcctaatgcccagaaaagcttcgcaggcatggataaaattggcaatatgcactatggaatttggattcagatgatgcaagctaatcccgtagaagttcagaataccccggaaaaatcttgaggttggaagagaaaatccgccatagaagaaatgagcaaataccacgatttcgtgtgtatcgggggtcgggaatgcctcaccaaatgccggtcgccacccgatgatctcttttgctggaagaacgtcgtgcgccaccatctccttcagattgtcttccgtcacatcggagggcgcccactgactctcgaagctttctctttcttccgccatgaatgagaactgatgatttgatttagttcgagatacggctggaaagggatggggaatcggagcggtggatgcgggaagagatttcgtgaagttttttaagggtggattggagcggattgatgaaccctagtttgcccggcgcaattttgtactgtagcaggaaatggggaaaatggcgagagtctcagcggggaagacgaaacgacgtttggacttcggtgtttttagggtatcgggagtactaatgggccctggcctgtacagtacttcagcccaattatgttttcagcgtggcccgttgtgatccctagggacttaggcgctttttgctttggcaatatgtgctcacaatgatgcggcccgatgctgttgaaatcctttttaacgcgattcaataattctttggaattattatgatgcacatgaaaaggtgcccaacataaaggtattataccatttttgtaagcttttttaggctacgaaagctgttgggttaatttgagatgactggtttgttagtagtcattctcccagcatgttatatgcttattttggttatggtaagggtcacagcctaggctattagactcattaattaccatgattttctatcatgtttgatgggtcattttatgagattcttactcggattcctatcaaacatgtctatttttggacctttgagtgtttatcactcggcccttttcatattttttgtccttgatatattcaagtgagaagcagtcggctgggtattttattgagtaccatgcatgcttcgatataagatcactcggttcttgactatatgtttaatttttcaactaatcacatagtcgggggttacacctaattaggtgcatctactcgatgcaccatgttttattttcgcccttcacagtcttctagcactcggtaagccggagcaagttgaattgaagcactcagattattgttttttgtttcgagaagactattttggtcaactgcgaaggtctcgggggctactgtggagattatggttaccccatatctacatggcggttatattccagctggatatatggtaccaaatatagatagaatatctttatgaggactcgggttagattctaaacttgtatgtcaagaaaatacccaggattctagtcggttacgattgtattttatctgtaatcccatattccgttaggatatggactgtattttgtattacggatcccttcccctatataaggaggggtccgggttcctctcgggacgatttcttttttctcccaatcatacaatcaataacatactcggcggaatcatccccggacaggagtaaggtattacttcttgaataagaaggcctaaacctgtataaaattctttttctccaaacccattcactttcctagcttgatagccacccccttttattattgccgaaatcttgtttcgacaccgagcgtgcacaaggactagacgacgcgaccgccgaggagcgcgcggcacgggatgcggcggccgcagctaagcgggcggcggctcgcgcggccgatacgtcgcgggcgagcgacgccaccagcgccgccgttgacatgggcgagggataatcgattgaagaggaacggtaaaccctagttctccccacccgtcccggccgactgatccgattggagtatatatatatatatatcattaatatgcagtagtatcggccgagacggaacagtggatatataacaatctttctgctgctccgattttgtttcatggatactactgcttcatcgaagaggaccagtagatgaacaaaattggagcagtggatatatagcaatctttctgcgccgactggtccatgaaacaaaatctctttctgctcttcctcttatgtggtgatgctgcgttcttgactgccagtgtagtagccatgaatttttttccttgggtaagttcagttcgtaggttcacaacacatgctaaaattttctaacaccaaaaaaccgatacacaagtacaaatttaatataaatgcgataaaaatcaacattcaacaaccacaatttacaaagtgcatactcaatcattctcagattcatgaatcacaaatcgatttatgaagcagccgggagcggagagctggagacgggcaccggtagacgccacgccagacgggagacagcgggcggcggctctgcgacaagacggcaaccggccgacgtcccgcagcaaggcggcgactggcgatacaaggagaagttgtaacgtcgtcggcccccagctcggcgccgcgatggcgcggacggcggacccacgggcgtcggcgctgtggtgtggctcggcactgggctgcgccggcgctaacagcggacgcggcgtggcgccggcgcggacagcggtcagtggcggcgtggaagcgggcatcgggcacgaagggaatagatgctggaggtggaagcgctccaggctccctcaactcaaccctagctgtttgtgggctgttagagatgcctctaacggagtggttatttttgactctctaaatatctatattgccaggctgataaaaatttagagagtcaaatttatcttctattccaacatactattcacattccactctattaaccaatggattccgcctgtcattctcctcctctttcttcttcctcccctctctccaatccttagcccgtgctcctgctcgtgccagcgggtttggcggtggcgaaggcgtcgagcatctcaagttagcatttttctaggagtttgactttcatttcaagttagcatttttttaaaagaaatttcttatacgacttcttttgtatttttagaagtataaacgaacttaaaaactgactcaaacacagaactgtatttccaaaagcaaacgaacttaaaaaccgactcaaatacggatcacgtgccaaaataccgacaaaaacatctttattttttataatagttgagataaagataaagatagagaagtagaacttggtccgtctacccgtattaggatagatttggtgattcatggggattgatttggggagtcaatcttccgcggctttgggaagtcgatcttccactgctctacaaattcgtgaatcccgtgaaaatggccaaacttaagcagaaattcagccctctgttgctcatcgaacccatcgcagtatgggccaaaacatagtttctcttcttctggagcatccttgttggatctatgaacaagctctgcagtttccttgaatatcttgaaccggtgagccatctcagcatggtcacgctccttatcgtaagccttgcaccagcgctcatagaaggcccaaatggcttcatcagattcaaaatccttgtccgtcacactgtcaactagatcagtctcaaaatccttgtccgtctcatcgtcagctggctcaggaccatctatcacaacagcacaacattaatactgtcaagaacagcgaattggcttgcaagtttcaatttggttccttaaagttatcctgcctaatatgcccctaacctgattatggcaatcggatcagaaggcccgtaataagatgggggaggattggcttacatgatggcaatgggctgggaggagcaggagttggctcgtagtcgctgtagtcgtcgaggttataagacgggatgcgtgacaccgcgcgcgcggcgcgagatgcggcggcggcggctgagcgtgccgcgcgacgtgctgcgacgacggccgccgagcgtgcgcaaggactggacgacgcgaccgccgaggagcgcgcggcgcgggatgcggcggccgcggccaagcgggcggcgtctcgcgcggccgatacgtcgcgggcgagccgcgccaccagcgccgccgttgacatgggcgaggcgagtgatgatcgatcgaagaggaacagtaaaaccctagttctccccacccgtcccggccgactagctgctccgattggagtatatatagaacaggaataagttcacttgccaagtctaatttaacgcttttgctattctgatcgcgacaccggggggccaagacgcgatgcttacacggccgagtcaattgcgcattgacagtccattcgtggtgccatctgctacggcatacggctcgtcatctcaaggaagcaacaatgtctcacacagcagtcaagaacgcagcaccaccacacaggaggaagagcagaaagagattttgtttcaacgagtcagggatttccaaggagaagtggatgtagagctagctagcttccccttcatgaatggccgctggtacatcggcacgccctcgatcgtcgttgacagccttgaatgaatctgcaacaagatgacaggcgatatgagtaaacaataaaatggtttctaaaatatgcttaaacaatcatatggtttttgatatatgcggctatgaatctgcaacaagatgacgggcgatatgagtaaacaataaaatggtttctatatataatgctgcttaaacaatcaaatggtttctgatatgctgctgccctatcgtgagttttctttgtagtgtacaagttgggacttgggagacagctaaacatcgtttcaatgcttgaaacaattttgccatagcaaattactcccccatcccaaaatacctattttattgtaaaagcctatccaaccaacattgccacgtcaaaattatctctgcctctctacatacatgaatatctattcggctttttcttcatacgtggatttatagtggtacttatcagccatatcgtctcataaaatgtggttgtgaggtgaaatcgggttagagtcaactaacctaaggacgagcttgagtcaaactaacctcatagctagccatataactatccacactgatatggtccgctgcgaatccatgtcagaagaaatgggttgaatcaaatgtttgtgaaggggatggacttggcagtgctgagtgagtgggcttttgcaacaaaataggttatgtggtggaatatcaaaacaagagcgataattaatttggatggtttacataattttttagtgctattgttcttgtaaaatcgataaataattttaaattaaatttgctgaaaatctactgaggccctgtttagatccctccctaaaatttttcaccctgtcacattgaacatttgaacacatgcatgaagtattaaatactttgcgactaatttacgagacgaatcttttaagcctaattactccatgatttgacaatgtggtactaaagtaaacatttgctaataacagattaattaggcttaataaattcgtctcgcggtttaatgacggattctgtaattagttttttttattagtgcccgaacactctatgcgacaccctatataatacctgatgtgacacgccaaaactttacaaccctagatctaaacaccccccgagtaaagcactcttgtaccatcaagcaaactatccatggaaatgcagtgcctctgtgtcatgactcatgagagagagtgactactattttttttctttttaccttttcatgagtgttctttgcttgatccaaaacacgggggcgcatttagggaaggcatcactggaggcaggctgctcaagtaatgcattatccatattcgattcaacccaaccaaacctaacccaaaataaaatgatgcctatatacttctggcagttgaccttccatcctgactagccggcggttcaacttatttttcagaatctgcatcgagacagaacagaggagaaagattcagaaaaaagaaaaagaagaaggatgtaacacatctgtctctgagcaaccattgttcggctctcaagtaccagtcggttggtcagatggaataaggttgctgcagtagcagtccatttctcttgatcttgatttgagtaggtgtgaagcaaaacctcgtgtcaatttggatgactttgtatatatgtagctgtcattgaacttcacttctgaaacctgctaaatttgaagtcggtatctttgcccatgtttacgctgtatctgatcaaaaccatttataagcatctgtggtttcactcaacccggcgaaaaagatgttatttagcgatgaatcagatattcagttgtaaagaagtgctcgctatagtattcataagtaaacaaactattttttggacaatacaagaggtgacttctattcttctagaatgcaaaggaagcaacgatttgcaaacaggtcaagcaagaaaatctcttctttttttttttttctgggccggccaaaggatgattgaccaatttcattaagagaggggaaaaaataaatagccaattacggagtttgttacatcgacgtgaaggatgtcgagggcgatcaaggccaagccttagatcaaagtcgttgtaatgtgaagcaggagtagtaccgttcaccaaaaaaaaaagtgaaaatagtacttcacatgccaccttgagaaattccttgttctcaaggcactgaaaggactactataattgcaactgaaataaaaccttggcttgcaatgcagaaactggactcgaaactcctcaaaatggccggtatgcttcacacgactttggaatataataaaaaccgtaagagaaatacaacctgtcgaagcaaagtcaaatcccaaacacacacatgattgcattgaccattacaaaccaaacaattcgacagatagtaagctacgcaaggacaaacaaagccacagcaaatcacacacaaactcatcttattttaaacatatttgaatctttttttcaaaaataaaaaaaaccatggccatatgcccatatgccattgacctcgaaaccattgcacaacctcatcgtctccttctctctctgtccaagttgtgtgtttgcaacatgcaaaagcgttgacgtcgcactcgcaacctccccctccctcgctttggatccaaacaaaaaccgcaccaaaccatcgagctcagccgcggcgcgcgcgcggcgacaccaccaactcgctggctcggcgtcgat

SEQ ID NO: 62452 - DNA, 1094 bp, Oryza sativa
agctccagactcacgtgctgatgcggtataagttccacttgtccgggtagaagcatggtaagttgcgaatgtgttgatgtaaaaacacgaggcctgggagatctgcttaactccagtgcaggtccaaaagcttgcctttaggtgtatgagcgtgctagttgatttgatcctgcaatcaacaagaaacaaagacaaagaaaccgcggttaaatccataaacgacagccgattggctagttgccgatgacatatcatttatctctgagccgatgtcatctatagatcgatcggcaatcgtgaataagtaagaaagaactaaatctactcgatcggctgtagatattaacaatatataatccttatgtcgatatatacttaaatcaagtgattgggatagatcggtcgccatgccgagatagtataaatcacttagatcgaaatatatattaacaacaagactatatatgttcatagcatagccggttagatagatctagcatgtatcggctaatactccgataccactctatattaagatattaaagcaaatagaatatactaaacagaagcataatatacttaaatgcaacaagatcttaatataaagggcagatttaacatgtcaatcaagcatatagaataactatagttaaatcaggtaagatcggctgaaaccccgatgctaccctaatcaggaatcaaagacaggctagagattgagattctaatcacgactcataagatcaaacaactgatgcagctataagtatgaaaagaaggacaatatctagacaatcaagccgttggatgtttcatagagtggtggatatcgtatataatctaagcagcgttgatatttaacctaatcgactgccctctactgatagatgttagccgattgtaggttagatagcaatattgccagagattatataaaatatatgataactcgacgaattacataaataagattagagtatcataaagatggaagcactaatcccgaaaacacaagccgtcataacaagtttacctcttgttgaagatcgaaaccgatgcagctcaacccgaaagcaagaactcgtcgaaacaaa

SEQ ID NO: 62453 - DNA, 647 bp, Oryza sativa
agaaatcgccggattcaatccctaccgtccgtccgtcatgtaatcaaatttcatccatccatcgggtgaaatcaccgaggcggcttttaatccatccatcgtccatcgccgagacaatcccggccaccacatcctccccacgttaccaaaaggccccgcgcgaccaacacatctgccctatgcgctcactatgctgtcacaccctaatcgggcaccgccgtacaacggcacctgacaggagcgtgtcgtaggaataacggcgcgaaccacttcctacgaaaccgcgatctcagtaccagtcccaggacatagtgctggtacccacggtgacaaatatgaatcattgcaaatccttaaaataaatagaggacttatttaccttaacttaggttgcagctcaagacagcctgagaatacaaccgaagacacagacgaggaaacaccagcaacagcagcagcagcggaaccaacggtctaacacccaacaccacaggcgacagctgggaaccaggacgaaaccctaatcttcacttcacttcatctttacttcaaggcggaggaactatatatatttatatagagcaaggtgagtactttcatactcagcaagtcacggggacttaggtgtttaatgcaagcttagaaga

SEQ ID NO: 62454 - DNA, 699 bp, Oryza sativa
tccattatgtctcaggtcatgaattgacttagctacaaatgtaacattaatgcatagctaaatgtaaatcacacatgcactcatgcacgcataccacataacagtcaataggaaccggctcatcactgccagttcacacatttttcccacccaaataatggttaattgatatgaatgtgatattgatactccttatcagtgccagctcgtggcatgcaccggcacagtttttggacagacagtgatatatcatggtatcgctgttggttgccaggtgttcagaaactagcacaggtagccattgtgaaccggcaccaatggcctatccagtggtagtgacagacacacagtaacacatactccctccgtcccatattataacaatgaatttacacatgcttcctgtttagattagttgtactataaagtgcatccggtcctaggttgttatattatgagacgtagggagtatatacctacacacacaaatattctactgttatatacttctgctagatgatttgaaattttatatatttccaataaggaatggtactgtacaccagtaataccagtagattgagatataattgaagtgcgcataaaaatttaatgatgatgttattcccttggccctcctatatatttcgctcaataacttgtgaataaatagtcaaacaaattattatattggcagta

SEQ ID NO: 62455 - DNA, 708 bp, Oryza sativa
ttgaaacaactggtgtcccacaccagacagttgacggcgccaacaacggtggcactcgtcatgaaatcaaagttgcagctgcagcctctgaggagtataccttgctctactcctttgtctaggagctccagactcacacgcatatgtggtctacgttgcagtcatccagacagaagtagggtaagtcgttaacgcaatagtgatgtggaacttcattgattggcagtcacaatcatcggttccggcatgttctgggctattgcagctgccgatcatggcggtgtggtaactgtcatcattggtgaagtaacttccgggcatggggattacgtcctggcggtggtgagaaaatccgaaaccagagatctccccttccaaccaattaatggtttgcatcgacaggtcaataaaatgcctttacacattaagtgaaaactgagatttcttttacagaagaagctgaagtcacacatatgtcaaatcaatgcatattaatttgtgtcttgatgctgaaaccatttgtgtcctcttccctaccacccacccagtggacggctcaagcgacgatggtgctcggcatgaaaccaaagtcgcagctgcatttcatgtactttatctcccaccactccttcatctacgagctccagactcacatgctgatgtggtataagttgcactcgtccaagtagaagcaaggtatgttgcgaa

SEQ ID NO: 62456 - DNA, 1142 bp, Oryza sativa
  unsure (1)..(1142): unsure at all n locations
ggaaaagagtatttaaggaaatgagaggtgtggtttggaaaggaggagagaagagaaataataggggaatttttggggggtagaagaggtagtgttgaggtgttgtaagagggaaagaaaaaaataaatggaaagagagaggaggattgatttgaaagaaagtttaaatagagtggaaggtgttctgtttattttagaaagagtatagtaaagagagagtgtgtgagagagtgtatatggggggggnagggagatagagaggggggagtgaggtagagaaaaagtggttatgngagagatggatatttagtatatatatatatatatatatatatatatatatatatatatatatatatatatatatatatatatatatatatatatatatatatatatatatatatatatatatatatatatatatatatatatatatatatatatatatatatatatatatatatatatatatatatatatatatatatatatatatatatatatatatatatatacataaatacatatatattatgcatgtacatatgtattgaaacatatataaatataatataatatatatatatgcatatattatatatgcatatatgtactgaaacatatatatgcatggtttatatatattatatatataaaccatgcagcaacagggtcatgcaaaacaaaaggtcatctcgatgcaaaaaaacaaaccaaccgggactaaagatcgatctttagtcccggttatttcacccgggactaaagatagcgatctttagtcccggttttcaaaccgggactaaaggggggttacgaaccgggactacaaagggtttctccaccagtgctccttaatgagatcgaatgttgggtctaattaaagatgtaagcgcgggacatgaattattgtgtacatctgttttttttcactagtggatgtaaaataaactatacattgtaattgtacgggctcttatacgaattagcagacaaccttgctgctatatggggctcctctactcacgtatgcaaaactgtacgcgtcatgtatatcaactctatatcgtccctaaccgatggaaattattaaagcaataattgatgaactactgtaccatactatgaggagcatcact

SEQ ID NO: 62457 - DNA, 783 bp, Oryza sativa
  unsure (1)..(783): unsure at all n locations
cgtcccttgaaagtgatgttgctncgtctgcaannagnccancacagtatgatgttactaagctatgcgactcttttgtgcggatccttattatccgccgctcttctaatgattagatttcgaaagaatttagatttcttttcgaaaaagaagaaaaatgttttgcttaaaacatttttctttaatgagattgaatatttctatgcaaaaagaagtgctttaaaaagcaccttttttcctttatttccaaattattacaaatatcaattaattgagcgtttggattcttggagttatcgtgtcattagtctagggtttacccttttaaccataggtattctttgtggagcagtatgggctaatgaggcgtggggatcctactggaattgggatcctaaagaaacttgggcatttattacttggaccatatacatatacatatacatatacatacatatatatgtataatgtatataaattccagaaccctttgcgatcacttacctgagcgacaagacaattacaccgactaacaaattcttcaagcatcccaacgggaatcttattgaaggatttgagattgtccaagatgtgcccatcattcatgacgacaaagaagcaatcttggaatcatgtctttgaaatccatgaaattgatggtctaataagcctccatcgaaaaacttttataacaccctcggtaggccgcctcaaatttttttagaggggatgagtttcatcccattcaagcatcaaggtcgcttgactgcctccattctgaaa

SEQ ID NO: 62458 - DNA, 1942 bp, Oryza sativa
  unsure (1)..(1942): unsure at all n locations
acagaagctcaggcttaagcctttgatttgtttaaacattgctgttaagattttagcatcatgtttctgttgaacaggtgtttggcggcaacgagggtggtggttggaanccaaaacatcgcaggtagggggtgtgctcatgattgccatttctgggatatttttgttctattacctgaaatgttccaatcacatgggggtgtggttaggtgtatttatcctaattaggtttggtcaatgatgactgatggggtactactgcggaaagagaatttaatctttagatcagtgatgcatttttttttcgcaggaaaatgacaggctgccagtcaacgacacgaacaaatttccgccatcgattgaaaaggtttgcatttgagcccatcggccgcagctgtttcttctctttgttcatgcgtgaaattttatccaagtagagtgcttgttgtgagttgctatcgtgccgattgtggtctcatgggtagtgtttgagtggaattgccttttaatacatggtccatggccccatttttttggaaatgtcagtctgcttttgccatatcatggatcttgtttcacatggccctcttttgcatttctactgcaatcaaggcactgtttctttccttttggcatgtaagaggctcagagctgaatggggttttgaacttactaactgtttgtcactatgtcccaaaaattgcattgcatcatctgaaaatcttgtctatctaccgaaacatgcaatttttttttgcgttacctaattgatttagttgttcgttcacaggactggagcaaaacaaataccggtaattctgatgcagaaagcaatgggaccaacaatcaaccaagtattgacaaaccgattagcaatacctcaatccatccaggtaagcagggcccattctttgaccacttatttagttttaaaattttaaatatcaagttacagctttaattcttcttgtaatgtgcaggccttcctatcaaacaaatcgtgatctttgatgatatatcattactgagtgtaagagctaatatgctttacagttatttttaacatgcccttgtctgttcgtgcagtaaatatatatgctgctttcgcatgaatttctgagcagggcatgtgatatgcaccttgcttttgcaatattttaaagaaacatttcaataatcctttgtaacttgtttgcggacttgcagaattatcatatattacatactttttatttttcacctaatgttgcagaatactgatgctgatcctaaggacaattttgaacaaggtttacctggtgatgagagtataaaatcgtgccaactagaatttggaagctattgtgtttggtctgttgaacacaaggaagtgatgaaagattctgtagtgaagagacttaaagaccagctctttgttgcaagagcttactatccaagcatagcaaaacttgaggggatggaaaaactttcacatgaaatgaagcaaagtatccaagagcatgagcacatgctcagcgaagccatatgtgatgctgatcttcctgcattgtaagtaatcttccagaaatactttctttagttctcatttttaagctatcatctttaatccataaggcactgctaacttcagaaattgatattttaccatacatgaaactgttgggtatttaagcagcctgactttgcaccaaaaatggtctacctactaactgttgtgcttcactgtttgttttttattttcacagattttgatatccgctnnnnnnnnnnnnnnnnnnnnnnnnnnnnnnntagcaagtnagctcgcaatccacacatgggggggnnnnnganatnagaaaaaatatcttcggaaatgannaanatagnnncacagtttaacctgatcaatagccacatcnaacatagaatccggaaaaatcgtatnggnacgccacgagtg

SEQ ID NO: 62459 - DNA, 1278 bp, Oryza sativa
catcctcgatagttagagggttattcgtagttttgctatataaaatacaatcatatttttataaataaagttatgagatgtatatcaaatatagttttacttttacaatctgatatacacaaattacaattatatttttgaactagtttcatataagggagatcacctatcaatttgtaataagataataagatgaaattgacagactgaccacaataaactagtactcctatgtcttattggttttttttaagtggtacactggtacaaatacaaaaaaaaaaaaggactgtgcaggaatagtccggtgcctctccaagctagggattggggatacgatcgtcgttgtcgtttccctgtacgcccacaggaataatacagtacagtactgtataatttatattgctttctcgtttgtttttcaccgtggaccggacaagcaacaaagggacgacgtgacacacggtcgtccgtcccggcctccacctctctctgtccctccctcctcctctcctgttcatcggtccattccgacgtgtcacgcttacacttggcgatggcgacacccactacttagctcgagagcttagctccagaccggacgattcttcccttagctttcatttgtcccattcaaacgcacacgcgtcgtacgttcgataatataatctagttaatctgtcattattgagtaattgatctgaaacacactcagatacattcgatctcgtgctgattgagctctagctaatccagagagaatctctcctgccacacctgcaagttaaagtaacactgtgtatcccactcatatatgcatgcatctgtcgtgtaagccacagctagcaaaactgaaaatgccatacttatgaagtttttgacggtgtcagtttcccctaaatcttcagcgcgccagacaaagatttgtacttaaaatctaagattcgatatgtaggtacaatttttttttaaaaaaaatctcatatagttcaaatcttaagaaccctagaattatcatgttctttcttctcagaaatccagtttttctgtattcttatcagctgcacgctttaatttctcagaattagcaactccaaacaagcaggatctcggaaggaactacgaccccatcgtggaataagccaaacggtatttttacaaatgaaaagtaatggtaatttgtaaataaaattttttaatacgtgttcttagagatccaaaagcaacaactgaaaaataaacttcgatgaaaaaaaaccttagggggatccactagtt

SEQ ID NO: 62460 - DNA, 49796 bp, Oryza sativa
ccccccctcccccatcatttttcctctcttctcctctatagtgtagagggaagagatgtccaacaatttttttttcacatttagaaacatataagaaccaaccatagaaagaaaaaacttaaatgacgaaatatgtgtgacggagcgtggggctcctcaccgggagaccgcgcaggcccccctttgtcggttcagccgggggccctgggtgagattctaagctcctagtctgtggaaagttcgcgagaatggaaaaagcacaagacacgggcgatgtatacaggttcgggccgctgagaagcgtaataccctgctcctgtgttctggtggatctgtgtatgaagaagctaccaagagctggagagccagagagctcttattctaaaaaccctcttctccttttttttttttctcgtgggatctcctctccagatcatccccccttccagcctctcctcttaagtgggcaaggtcctccttttatatctcaaggggataccacatgcaccacttctccctctctctttttgggtgggggcccatcctatctatagtaaaacttggcttgccttctcttggaagctgaaacactacctgtttttgagtgtggccacgcgtcctcgttcgtctgacctcggggatcaccctgtcatcccttcataaatgggcggagatttgcaacggctgctgcccgagtgacccttctgatgggacggcccatacctacctccactccgccggaagcaggtgcaacgtgggaacacggttgtcttccggcgacataaccagtgtcagaccagtcacagaccggtcacctttgtccaccacgtgtcagtttagcaatctgcatgttcgcccttcttcatacaacgtcttgcttataatggttgggataaagcctagcatatatctgaccaggaccaacgtgccatctccaggagctagcacgctggctccggctagggacgagtgcctagagactctcatcctgacgggacggggcgaggcgtgtgtcagatcgcctgttgcctcctaacccgcaatctgaccgatctgtgaccggtcacagaccggataaatgagcgtgtcatactgcgctacatgtggcgtgacgcgctcgtccaaaccgcaataaatgcggttaggtgagccccgctatgctcacctaccccatatacgcggcgcaaaacccacaaggggtcggggcgcctcggccctcggggccgagacgggagcggtccgacccctcggggagacaaagagaagggcggccgtatcaccctcgggcccgacccccccccccccgagggggttaggccacgtgggtgatcgtgtctgcctcaagtctctaagtcatgatactcccggtcccatgtcaccgacagtagcccccggcgttatgccagggcgatcgccctcctcgagggaagcggtcgggcgtgacgccacttcctaaggcctggtgacaggtggggccggtctaaaaatcgggacaagccggttcatttttcctggagatatggtgatggcgcttcggtcggcgagcgtaattaacgcgcgcacgatatgttccatctcgactgccacagccgcatatccacctcatgcaccgcaaacgggcgaatgggattagtggaagcgtgggcgcgagaaacgagggggcaagatagtgggcgcgagaaacgaggagccgggcacagcgttggcaagggtataaagtcgccgaggaagagatttgcttccttcctctcgccattattccccttgtcttcgccgcttgcgccctaactccttgtttcctgtgccctaccttcgccacacgcgctcgctctcaaacatctcttcttccggcgtcatggcacggggctccgctccgcttgacggtagcgtgctgccgccttcccgcatcgtgagcgagagacaggccgggctgccgcgccgcttcatgccggaatttgccaccggccgggagatagtctcgctgggcgagggatgcccggcaccacgctacccggggcggtccgtcttcttcctcccttttgctatggcagggctggttccgccattttcttctttcttcatggatgttctggagttttacgatctccagatggcgcacctcacccccaacgcggtaatgacattggccatcttcgcgcacctgtgcgagatgttcatcggggtgcgcccatcccttcggctgttccggtggttcttcaccgtacagccggtgtcgccgccatcggtggttggtggttgctacttccagccgcgggggccggtgctgaaccgctacattccctgcgtcctccgcaagaagtgggatgactggaagagcgactggttctacacccccctcgccgacgaagcgcgcctccgacttccgagccagcctccagcgcaggcctccaactggcgggcgccggtagatctgggagatggctacgacgccgtcctcgaccgcctggcgggcctgcgatcccaggggctcacaggggccatggtgttcggtgactatcttcgtcgccggatcgcgccactccagcggcgcgcccggggcgcctgggagtacaccgggtccgaggactgtatgaggacccaccggggggtcaaatgggactgggtccccgaagacttcaaggtaatgatccaacgggtgctgaatctcagctccgcggaggcatccctcatcccccaaggagtcctccccctctgcagcgatccagatcgcgccaacatcctgtccatcatgatggcggtcggggcctcagaggaacgagctcctaagggccatgacagtgcgagcgggagccgcaagggagatcaatctaccccaggagggggttgtgcttccggtccccgtgatgggggctcggggggcagccgccctgccgacgcccgagggaagagaaagcaagagggtacttcctccccatctcctccccgagggggcggggcggcacgtgtcagcagcaggcgcccggagggggccgcgccgacgccgcagcccgagggggagcggaagaagaaacggctccgcaagatggggggacagaaccatcccggggaaacctcatttcccctccaaggtggtcgtttaaccgaccccctcgcaggttcgtcccacgcccattgtggctatattcattcttccaacacaagttttcattcacccatcttgtttgtcttctggcttttcttctgcttcagcgagatcccgtcgcgtccttcttgccaattcaagtccggccaatctgaggccgagaatgcggcgaccacggaggctcggaggcgggaatctgaccggcgagaagccgcggatcgcctacgggaagccgaggaggccgcccaggtggccatccgagctcgccaagctgaagaagccgctcgggaggaggccaaacttcgccaggccgaggcggcgacgacttccgaggcagctcgcgacgaggccgcgggcgcatcgcttgggcccactccctcgggcgacgctcaggacaagccaggtccgggggacatccctgagtccggcacgtccatcggcgggccgagccgcgcggcatcctcaccgaggcggctctcccccacgccttctgctgccccactgagcgcagagcctcttctgcaggccttggccgttgctaacaccacggtgttggacgggttaagtgcccagatggaggccttgcaagcagagcgggtggagctcgacgccgcatgggcacgtgtcgaagaggggcgtcgctcggtggaggccatggtggaggtgggccgcaaggcacaccgccggcacgtctcagagctcgaagcccgtcggaagatgctgggggagatcgccagggaggtggaggaggagaggggggctgccctcatcgctactaccgtgatgaacgaggcgcaggacgacctccgccttcaatacgggagctgggaggcggagctagggaagaagctcaatgccgcccggggggtccttgatgctgccgctgcccgagaacggcgggcggcggagaccgaggtggcatcccggcggcgcgaagaaacccttgaggcccgtgccatggcgctggaagagcgtgcctgcgtcgtggagagggacctggcggaccgcgaggccgccgttgctattcgggaggtcacactggcggtgcacgaagctgcctgtgccgaagaagagtccgcactccgcctccgcgaggatacgctcaccgagcgggagcgagccctcgaggaggccgaggccgcagcacagaggctagcggagagcgcgtccctccgcgaagctgcgcaagaggaacaagcgcgtcgcaatctggaaagtgcccgcgccgagagggccgcattgaaccagcgggccgctgaactcgaggcgcaggcaagggagctggatgcaagggcgcgtagcggcggggcggccacgggcgacagcgacttagccgcccgcctcgcagttgccgaacacaccatcgcggatctgcagggcgcgctggattcgtccaccggggaggtcgaggcccttcacctggcaggcgagatagggcccagcatgcttcgcgacgccgtgtcccgtttagaccgcgccgggcggcaggcgggtctctggggcgggcggactgtgaagtacgccgccaaccaggggggcctcgcccagcgcctctcggagatggccgggactctccagcggctccccgaggagctcgaggggacgattaagtcatcctcgagggacctcgcccgaggagcggtggagctcgtactggcgagttaccaggccagggaccccgatttctccccatggacggcgctggacgagttccctcccgggaccgaggacggcgcgcgcgcgcaggtccgggatgccgccgaccatatcgtccacagcttcgagggttcggcccctcggctcgcgttcgccctcaactccgacgaggagggcgatgacggcggtgtgggcgacagtggcgacgaggctggcgacccgggtgcatcggagtgagcccccaggcccccgccaatcctcagttttttcttcttttctttctttcaaggccttcgggcctcctttttgtatagattaacttaatctgcaatcaaaataaagaaatttctgtgtcaatttcattttgctatgtgtatgagatgaggatgatctgtgccgtggtccttttatgtcttaacttgattaagggctcgtgcccaggtcccagtcctcaaaaggcgcgggtcggggctagtgcctggggagatccacgtgtcgagactggccaggccgggagcgtggtgaccgagggttatgggtgacccgattgtgggtttttgccgatttccccccggagttcaccacgccccggggcacggctcggttctgggccccttttggcgattttagccgacccgagcccccgagggcaggattgagcacaagtgacatatttcaagtcaagattcttcaaaaggaaacaacagcacaaatacagcctttaggaaatcgaaaatgcttttattgaaatacagatagaagaaaaaatatgcatatgtggtagcccccggccaaccctgcacgcctgaagggggtgcgtggttggcccgagcccgaaacctgacacccgaactccattaggggtagaagcgacgaaggtgttcgatgttccacgggttaggcagctctgtgccgtcgcccgtggccagccgaacggagcccggtcgggggacgccgatcactcgatacggaccctcccacattggtgagagcttgctcaatccagcacgtgtttggacgcggcgtaggacgaggtcgtcgacgcagagtgatcgtgcccggacgtggcgctgatggtagcgccgcaggctctgctggtagcgtgcggctcggagggccgcgcgccgccttcgctcttccaagtagtcgaggtcatctctgcgaagctgatcttgatcagcctcgcagtacatggtggcccgaggggacttcagggtgagctcggatgggagaaccgcctccgcgccgtagacgaggaaaaaaggcgtttccccggttgctcggcttggtgtggttcggtttgcccagagcactactggcaactcctcgatccacgaatcgccgtgcttcttgaggatgttgaaggtcttggttttaaggcctttgaggatttccgcattggcgcgctccacttggccattgcttctggggtgggcgggtgaggcgaagcagagtttaatgcccatgtcttcgcagtagtcaccgaaaagctcactagtgaattgggtgccgttatccgtaataatacggttaggcaccccaaaccgggctgtgatgcccttaatgaatttaagtgcggagtgcttatcgatcttgacgaccggataagcctcgggccacttagtgaacttgtcgatcgcgacatacagatactcaaacccgcccggggcccgcctaaacggtcccaggatatcgagtccccagacagcaaacggccatgaaagtggtatgatctgcagtgcctgggccagctgatggatttgcttggcgtggaactgacacgctctgcatcgccggaccaggtcaaccgcatcattgagagctgttggccaatagaaaccttgacgaaaggctttgccaaccaaggcgcgcgaggcggagtgggctccgcattcgccttcatggatatcagcaagaagctcgacgccttgttcccgaggaatgcacttcaggaggattccgttagccgcgcgccgatagagggtcccttctatcagcacgtagcgtttggagatgcgctggacgcgttcacttccttcgcggtcctcgggtagagtcttatctgtgaggtatgcttggatctcaatgatccaagcaatcaatctaagggagctgggagcgctcccctcgggtcccgaggcctggactccgacgggcctcgggggccggtcaggcgcgtccgtctcccctaaggggtcaggtcgcgccgacggctgggcaagcctttcttcaaaggcgcccggtggggtctgggctcgcgaggaagcgagccgtgagagttcgtcggcaatcgtgttatcccgtctgggcacgtgccgaagctctatcccgtcgaaatggcgctccatacgccgtacttggcgtacgtaagcatccatctgtgggtcagagcaccggtattccttacagatctggttaaccactagctgggagtcgcctaacaccaggaggcggcggatccccagtccagctgccaccctgagtcccgcaaggagtccctcgtactctgccatattattggtcgcccgaaagtcaaggcgaaccaggtatctgaggacgtctccgctcggtgaggtcaatatgacccccgcaccggcgccctgaagagtcagggagccgtcgaactgcatcacccagtgggcggtgtgaggcagctgcgaggggcccgagctggcctcggggactgagacgggctcgggagccggggtccattctgccacaaaatcggcgagggcctggctcttgatagcgtgacgtggttcaaagtgcaaatcgaactcagaaagttcaattgtccatttcaccacccgtcctgtaccctctcgattatgcaagatttgggcgagggggtaagacgtaaccaccgtgacccgatgcgcctggaaataatggcgcagtttcctcgaagccatcagaatagcgtaaagcatcttctgggcctgagggtatcgggtcttggcgtcccggagggcctcactaacaaagtagacgggccgctgcacctttcggtggggtcgatcctcttcgccaggggccgcatccctggggcgctcttcgtccaagcggcctcgcggggcgcacttgtcttctgtgctgacgacctcggggtcggaggacgacaggtgcggccttcccacagtggcctcagggccgtcctgggggtcgggggctcctggcgtcgtcggacaagcgggcaaagggtcaaccccggtcatcgggagccttaggccaccgttcggctcgggggcctcttctccctgctctctcccgggtcgagtcggcacagggttaacctcggggtcagagggcgataggtgcggccttcccgcagtggcccccgggccatcctgggggtcgggggcacctggcaccgtctgacaagcgggcagagggccagctccggtcgtcgggggccttgggccaccgttcggctcgggagcctctcctccctgctctctcccgggccaagccaacacagggtggggatgcgcggaatgagggttgtcctcatcgcgctccacaactaacgccgcactaactacctgcggggtcgccgctaagtagagtagcaagggttcacctggctccggggcgaccagaactgggggagagctaagatacgccttcaactgagtgagggcacgttcagcttcctccgtccaggtaaacggcccggagcgtttgaggagcttaaataagggtagcgccttctctcccagcctcgatatgaacagacttagggcggccatgcaaccggtgacgcattgcacatccctaagcttgctggggggggcgcatccgttctatagctcgtatcttctcggggttggcctcaatgcctcgggcagagaccaagaacccgagaagcttgcccgcaggtacaccgaacacgcacttatcggggttcagctttatgcgggtggagcggagactctcgaaagtttccgccagatctgaaagtaaagtttctcggtcgcgggtcttcacaaccaagtcatcgacataagcctcaacattacgtcctatttggctacccaaagaaattcgagtagtacgttgaaaagtaggacctgcattctttaacccgaatggcattgtcgtataacaataagttcctatgggggtaatgaacgcagttttttcctcatcctccctagccatgcgaatctgatggtaaccagagtatgcatctagaaaacacaaaaggtcacaccccgctgtggagtcgacaatctgatctatgcgaggaagggggtaagggtccttaggacatgccttgttaaggtcggtgtagtcgatgcacatccgaagcttgccgttcgccttgggaacgaccaccgggttcgccagccactccggatggatgacctcgcggatgaatccggcctccagaagtcgcgccacctcctcgcggatgaaagcttgacgttccggggcctgccggcgcactttctgccggaccggctttgcgcccggccgcacggcgagacggtgctcaatcacctccctggggaccccgggcatatccgccggtctccatgtgaagacgtcagcgtttgcccgcaggaaggagacgagcgcgtcttcctatttgccatccagaagaccaccgattcgtgtggtcttggacgggccgtcgcccagggcaacctccttgaccgggacctcatcgcacgtgactatccgctgcctcagggcggcggggacggaggtgccaagcctctcgtcgccatcctcgggcttggacgcagcggcgaggtggtccgcgcgctgctccatacaagcgagcgcgactttgaggtcgccatggacagagatggggccaccggggcccggcatcttcatctggaggtaggcgtaatggactgccgccatgaacttcaccaacgcgggcctccctaggaccgcgttgtagggcagactgaggtccgccacatcaaagttcacccgttccgtgcggaagttggcggatccaccgaaggtgaccgggaggtcgatatgacctagcggccaagtgtgccccggcgtcacaccgataatcggctgggacggccggagcaccatccccggggccttgatggcatcaaaggctgcgggggaaaggatgttgagggctgctcccccatcaatgaggacacgccccagcttcacgttgcaaacagtgggggaaaccaccattgcgacctgtcctccccgggcaacgcacgatgggtggtcggtctggtcgaaggtgagggcaacctccgaccaccgcgcccggcgcgtcgcctcatgagtaggggccgcggccagaagctctcgcttcatggccttgaggctccggcgagaaacgtgagcacacgctcccccatcgacagtggcaatggtggccccaggctcttggaaacccaggtcatcatcgccgtcatcgatgtcctcggcgggggccttctgtttggcctctcttcgccgattgccggaaggaaccgccgaggacttgccctctcggcgctcctgcctcctctcctcctcccacttcctcgtccgctcagccaaacttttgactacacggcagtccgcgaggtcgtgaagggaggtgttgtggacggtgcaccacttgccggttgggcgctccctgctgggagcgctggcctcctttttgtcgctcgcaggcctcccctttcgggtggcccgcgaagcaccctcgacggcgaggacatgaccctcgtcgtcggaatgggctgaccttttcttcctcctcctgtcacgccgccctgtccgagcagcggatccgggggcggccgaagctgccacaccggaaccggaggggttccaggtccatgactcctccttacgagccactcggtccgcgagctgaaaaagctctgcggtagtctggggctccttggaggcgatcttttcgagcatgcggttgtgccgcacaccccccctaaacgcgtagatcaccgcgtgtgcagggatgcatggtatggtgttgcggacttgacagaaccgctgaatatatgagcgaagtgactcatcatcccttcgctgtactgcgtgcaagtccgcttcctcacctggacgcggatatgtgccttgaaagttcatggtgaactgttggcacaagtcctcccaagagtggacggacgcgggtggcaagttcattagccaaccccgcgcctgtcccttcagggccatgggaaagaaattcgccatgaccctgtcgtcacccccggcggcctcgatcccggtcgtgtagacctggagaaactcggcggggttgacgctcccgtcatatttttcggcgatggtgggccggaaccttgggggccaacggacgttccgaaggctcgccacaaaggctctacagccgacaccaccaaccgggggcacggagggctgatccccgcgtccgtgttgaggtgacactccggacgaggaggcgccctccgttgcgtgggcagcacgtcggccattatgccggcgctcgatactgatgcgggcatccggccccccacgaagatcttcccgggtcggaggcgctgacgaaggagtgacggccgaatagcgaacagcggccgctgctcgccgcgccctccgtcttgacgacgcggagccggtggtagcagtaccagaggtcttggtggcggaggaccgcccaccagcatctaggcgctgctgcgccgtcatgaccaagttggccatgtcgtccagccaacgttgggctggagactccgggtcagggacaatgggcgggtgacgtaggagcgcgccctggggcgtgctgccgtcgccgtagacgaggaggcgacgctccccatctcgccgcccttccccatcacccgtggatgtcgaagtcgcggatccttcgaccctctcgagcgcctcctcccgcctaggactttggcgtggagggggcggtggagtacgagctcgacggcgtgggttcggctccccgtcgtcaccgctaacactcggagagaggttgtgcgcctttgcttgttcggccattgggctgaacaggaaaagcttggcgcacacgaaagaatgcgagagcttagaaaaacacacgcagagccccctacctggcgcgccagatgacggagcgtggggctcctcaccgggagaccgcgcaggcccccctttgccggttcggccgggggccctgggtgagattctaagctcctagtctgtggaaagttcgcgagaatggaaaaagcacaagacacgggcgatgtatacaggttcgggccgctgagaagcgtaataccctactcctgtgttctggtggatctgtgtatgaagaagctaccaagagctggagagtcagagagctcttattctaaaaaccctcttctccttttcttttttttttctcgtgggatctcctctccagatcatccccccttccagcctctcctcttaagtgggcaaggtcctccttttatatctcaaggggataccacatgcaccacttctccctctctctctttttgggtgggggcccatcctatctatagtaaaacttggcttgccttctcttggaagctgaaacactgcctgtttttgagtgtggccacgcgtcctcgttcgtctgacctcggggatcaccctgtcatcccttcataaatgggcggagatttgcaacggctgctgcccgagtgacccttctgatgggacggcccatacctacgtccactccgccggaagcaggtgcaacgtgggaacacggttgtcttccggcgacataaccagtgtcagaccggtcacctttgtccaccacgtgtcagtttagcaatctgcatgttcgcccttcttcatacaacgtcttgcttataatggttgggataaagcctggcatacatctgaccaggaccaacgtgccatctccaggagctagcacgctggctccggctagggacgagtgcctagagactctcatcctgatgggacggggcgaggcgtgtgtcagatcgcctgttgcctcctaacccgcaatctgaccgatctgtgaccggtcacagaccggataaatgagcgtgccatactgcgctacatgtggcgtgacgcgctcgtccaaaccgcaataaatgcggttaggtgagccccgctatgctcacctaccccatatacgcggcgcaaaacccacaaggggtcggggcgcctcggccctcggggccgagacgggagcggtccgacccctcggggagacaaagagaagggcggccgtatcaccctcgagcccgacccccccccccccgagggggttaggccacgtgggtgatcgtgtctgcctcaagtctctaagtcatgatactcccggtcccatgtcaccgacaatgtgatttgtagaattttctaaatctctaccgaaaataggtgtcatttgtgtgtcatttcttaaaatagacgtaactttctcatacgaactcggaatcaggcaaataatataaccacaaaaatctacagaaaaagttacatccgattctcccccgttttgctgggttcggcgaaattaaaatatccaaatttttcttgcaagattgtgttttcgaggcgataagcttttcgacggagctttggaaaattctacatgccacatatttcgtccgtttgagtttatttttttagggttcgttcttgtgggttcctaactgtgaaaaaaaatatcaaaaaaataaaagaaaaataaaaaaaaaagttgcacatctctctcctctacactagagaggatagaagagaaaaattctgcaggtcacatattttatctatttgagtttggtttgtatatcgttggttcttgtatgctcctaatcgtggaaaaaaaatcaaaaaataaaagaaaaataaaaaaagttgcatctctagactgtttaagtaacttatggctatcattttcatgtggttatattttgagttagattaagcaatttcatctagtggtagagtgcattatgtttaacatgctgaccgaagggttttgctaaaagagttatggtataatttggtgaaggtccaaaatttggtatgttgtttccagacttttagctaagttgaaggatttattacatattccattcgagtttaatttttttttgtggtttgcatgtatgtatcgtgattctaagtgtaaaaaaatatcaaaaaaataaataaataaaaagggtcaagattggaaacgaggtgttgggggggggagccatggtggcgcctccccctgccacctcagcaccaccccgccacgttggcaggaggacggtgccagagtgcctggcgccgttcagttagaggacggtgccagccactctggtgccctaaaagaaaccatttgtaggataaatttttttagaggtctattttgcgaaataatttttttaaaaggacttaaatgtgaaaaatccaggccggcgtgccggtctggggaccggacagtgatgagttaaagccggtgagatccgcgtgatggattcgtacaatcgtactcgggtgaaatggagtaaatcctgtggtggatacaggagttgagtacagggtacaggcctacagggtgagtccgaaaggagaggttaaggagctcactaatgaaagtggccaagtgcgtcggttaggtccatatgccaccggaaccggatcgtatacggatgcacctaactctaaacggggtgttatcgtgttggagaatggagtttttttttttttaagaacttggagaacggagttaatcttttatttctgaggtcaaacaggagccgccatgtgcgttcgcgatgtaattaagacgcactaacagctccctcgagtgcactcgtgcttaatacttgcaggcttgcatgctgccagtcaatgcagagcatagtgcgttcacagatccaaatgttatactccctcccctttcattttaattaacgctgtgacaataacacgctctacaagatatacctttgaccttattttttattataatatatataataaataaatgcatgtttacttttattatagtgttttgaaagacaaatctatatatgtttttctagtttctttaaactatatatttttaaagttattgatggtcaaaattataaaagtttaacatcaaccttatccaaacgtcaattaatatagaaccatagggattatttatcctgtcaggtgtatcaacaggttaggttatgcataatcaaatggcctcccccggaaaatccattcggagacagctatactagcatctcgtgatcttgcattgtgtttacaaaggactaatgatatacagtatcgatcttcctttttcttttctcctttccaaacatatcttcttcttggcatttttatcgtacaacccaattcatgaaaaagaacactatcatggtgagttggatggtgtattgtcccacggtggtatgaccatgactttcggtgttatgctaacatgtagcttcgcagcattgatcgtgatttaatgatagatcgttggatggtcaccgtcgccaaatcgtgcttcaattcgtcaatgagccaacgccctgaaaaaagtaagacgtacagatatcaccgtacggccgcttcattagctttcacacaatcagatatcattgttgctttaatccacttcttgaaatcatcgtttaattaatacgatcagcctccatttttctcatgtggtagtgtcactttgtatcacaaggtattaggagtacatccagcaatcgattatcggtagtcactcacttttggtcgtttcaatcgtcggattttattgtgttaatgtccgggcaataacacgtaaagtgagccgtccaacttctggtggatttggcctgacgcgtcgcctttttttgtatgacgtgggttagtctccacgctaagctaccggacgatctacagttcaaccctgcagtttttttttttaagataatggaataaaccctccagatttatgacaatgttttttccgatttctgattcctccaatagttcgacgctggtgggctcgtttatcacttgggcggctattctccttcccgtcgttaattaagctgcatccggaagcacagcaccggatgtacgcgccagattgacgtgcatgttccctctacctggcactttcaccggtagcctgtaaccctttttacccctttcgtctacaacggtagctcgtgagccatacacgtatacacatacgaatgccgtggtgtcaatcacctttgaagccaagttttctgtgacatctcgtctcccccggccggtcgctgcaccaccggagatccagtcgtagggttcaccaaaccgttttaagtgtgttactatcactttatagtttggtggttatagtaagattgatatactgtgattttaaaaacttaaaaaaaattactatacatgataaaccagccggtccaaagtactgaccccgccacgagcacggcacgggaaggaattcggaataacggaagaaagaaaggcgccgagtcgtttcgttgcgcggatgcgccagctgccgcgttgatttcgcggggggcgtccgcgtgtggtgcggggtcgcgtcgtcctcgcgcgcgcgcgcgagcgagagacgagagagggtggattcgtcggtgactcggtgtcggtcggtggtttcgtccgctgcggttgccgagacgggagcgagcgaacaccgtgcgtgcgtgcgtgcgcacctggttctcgtgagcaataagctggctacggcctacgggcagcgcacacatgacgcattcttggttttgttggtttttgctagcgagaccaccacctgcgctgcgctgcggacgcacatggagtggagttcactgggttgaggttttgatctggggagatcattgtcatgtgaggggctaatctccgcgaaatgcttgatgccaaagttaaagaatcacgaatcacgcatgggacaattctgaggaactctgatcatcatgaaagcgagggcatttggatggcagatttttcttttcagaatgttcacgtgctagtactgttttttgtattgtggactaccccagcttgtagagaccttaaatatttccagggtgttcaacagtaaaaaaaggagaggggaagaaaatgaaacaagcatgtccagcgcagggaaaaggtaggtagatgcagtacaagggatgcacttctgtgtgattactcacaaacttatgtgtgatcactgcgaacttccgtgaaaatttatgtgtctcatacagaaacgtatcacttatatgcttgtgattactgcgaactcctgtgtacatggcaaatttcctcataggccaaatttgcatataagcttgattactcacaagcataggcaaagcacaacaggggtgataagtgacgaactgatgaatgaccgtacccttgatttatagggataccaacaagaatttcacaatcgacattcgttctgttgtgaatgataacgattacaattcgtaacgtcccgtgatctgaacgcaagagcttccaacgacttttgaagcacacaaagatgatgaaggcatgaagcatcgctggatatctcaggtgctccgaacaagcggcttttctctctggacctgacgaaagtgaaattggcggcggttagagaaacttatgaaggctgagtttagttccaaactttttttttcaaactttcaacttttccatcacatcaaaactttcctacacacaaacttctaacttttccgtcacatcatttcaatttcaaccaaacttccaattttagcgtgaactaaacacacccaaaggaaaaatgtttgtttcatcctctacaggatcgaacactcctctaaaaagaattgactggacgccattacatacatcatctacccgtgtagcattttgccccaattcctgtcttcagtcttcacggccaagaactactgtaggataacgcaacaatcccggacctcccctccttacttcaaagctaagaactactgtgggaaaatacctttcattccatcttgtgcgtactcgttgttttagacctggcattctaatgaatgcccataaaatgcatatattcaatgtgaaggtgctttcaggagttggagattacttcgttgaagctgatagctaacaagatctcaacacgtcagagaaaagctacaaatcagatggtcctactgtatctttattacaggtgtagattggttttcagaggtcctgattaaaatcgacatacaacgacagtaaatctcttgaaaggaaaatcatgtaaacatagtaccataggtagtaggaaatagtacctgttcatgttcattgctctatcaccaattcaccacgtagagatggatcggtagctgtgagcctacaatggccatctcttctaccatgatgggaaattgagggtgcgaagttcagcatggtagaagagataatgcgcaagcggccaactgctgtataatgcgctcgccaagttcagcatcatcagctcctacaggtacctgaaatcagaagggaatgcgtcaatagaactgcatggtacaagggctacctccagggtgcaaacaggccactgcacaaagtcgcaaagattatgaaaatatcaaatggtagcaatataatcgccaaatcaccaactgctggatgatgaaaaattatcaggaggtttgaagcggttagcttgcatattcctctctcttgttcagtctcagtagttcttggctgcatacattaaaaaaaaacaaaacaaaacgagaaccacctaaagggtgtgtttggataatgggaaatggagtgtgagattgagattgggaaatgaatgaagggttaggattaaatgaaagaggaagaatgaatggttaggatttaaagatgtcttttggtgagcgggaaatcatttccatttccaattagccaaacattgccaaaaggtacatcagctcactaaggagatgcagaaaaggtacatcatgtattcatgttctcacaccgattcatccggtgtctctaccaagtaatgcaggcaaagacaatcactagtctttagataagaaaaggcaagcatttaccagaatcttcagagaaaaacttacaaggatttgcaaaattattaaatccataaaagatgcacacacaaatgatgaagcttttaacccatgggatgctgcgatctttactcaagattaagattctgtcagaaacagtagcaagaacaacgaacaaaacaaaccctcctatacacagaagattttggtgttcaagtatgattttttttcctgccgtaagacacacctatacacacctgcttatattgcccacctgatttactactcatttttaaacaaaataaaacaaccatatgtggatggccccagcagagtctatcacctctagaccgtgtttcagtatcatgagatcaatctttcctgtctactggcagcgtgtgaattgcgatcgctggccaaggatgccaaccatttggcatgctgcttctagcaatttgcctgcagtattttaaaaggaacaaagtataagaatactatggaatggttaacaaaatgatttaagaatatgagtctagggagtcagaagattattgtcatattacatttaacagacaccctgtcaaaaagaacagcaacgggtgtcaggaaaatcttggcatttttgttgtagtatgagatacgacaatggcttgaggtaacttaaactcaaatgtaaaaccgtacaagcagtaaaagggtaaagcccaaataatttatctatgccacaaaggcacatcctatgtcacaaaattgcagtcacaactgaaaacataggccataaatatccaaagaacttatataagtttgtaatcagcattgttgcaatcctaaaattgattaatcaagaaaaggaatcaccaagggagcaagattcacaatccatggtcagctaacaattgcacaaggaatactatatgcttgctgctcactatcatccaatcttgtaacgagcactcttgttcgttccctatagattggacagctttgatttacccactactgcactttacttggctattcctagtatccaaatccagcttcatcgccactattcgtagcatcaacatgcatggacttaaacaatttcagaaagaacaaaaaaacatcgactaacctcccgaatctaggatgtgaactgtaaatttctgaggaaatttttgtacgattaggaaattcaagttcagatctaaagacattggctgacctctccggtgtttaatcttgctgacgccggtgatagcgggcgccgtcctgatccgggcggtggccggcttcgtcttcgtcttcgtctcagccggcgggaacagcacggcgtcaatgccctgcactgagatcctgccgtcggcgaagatgtccgggtcgaagagatacgccgagccctcgccatggccaaacttgactgagccgtcggcctcgcgcgccaccaccttgtgcggcagccgcagcgtgtcgtagcgcaccttgccgaaccgccgcaccgcgttgtacatgctctcctcggtctggtactccgggatcatgtggtagtacaggatgttctccggcgagccgggctcgctgagctggtcggcggtgagccgcgccatggcctcgtcgttgggcgcgagcacggtgagcgcgtacccttcggagacgagctgggctaactcggtggcgagcgaggtgaggttgacgaagatgtcggcgagctcgttgtagccgccgtacttgagcagggtctgaatgaagtccttcacctggctgtcgccgtcgtagtggtcactgggctccgacgccagcgcgacggagggatcgggaacagtcgcgtcggagatcgggagcacaggagaatcgccgggtggcgccggcttcttgaggcgatccgtcctcggatccacctcgggcgcggccgtcggcggcatggcggagatgtcggcgaggctgcggcggcggttgaattcgtcctggacggagcgcggcacgaggaggcggtcgatcccgtggatgacgccatccgtcctgaccaccgcgtccgggcgcgagacggcggcgtgggcgacgcgcatgccgccgccgccgtcggccgcggcgagctcaacatcctcgccggcgagcgtcgggtgggtggccgcggcgggccaggaaccggaggggaggcgggcggggaggacgtggaagaggagcagcgactggagcgagttgagattccgcggctcgagcaggaagcgcttgaactccgggtcgatgtcccgctccagcgcctcgttccgcggcgcgaggatggtgacgttgtgctcggcgacggcgtcctccagcgcctggagcagcagggccttctccaccagctccgccatctccgtgtagcgcgagtccagcaacgccaccagcaccgagtttgacacgatccctcctcccacggcgccggcgccggcagctttgcccgcaccagcacgagcgccgttgccattaccgtcgatggcgacgtcggctgagggcaatgtgggacgttccaccggcgccgtctccgcggccgcacgggcaacgaggagaacgaagaagcacacgagtgcgccacaaaccggcgcgcccatcgctgcggcctgcggccacttctctcctgcgcgaattgcttgtgctgctgctaccgcgccctcgtcggcgagggatccttctgcggcactactactccggcgatggactcggggaaggagaagggagtagcaaagtaaatggagtagtggaggtggggttgtcgtgccagcgtcgtgcgcccgcgccgccgcgcagtgcgcacacaaggtcggcacgccgtaagcgaggaaaggcaaggcctcgccgcagggatcgcgggaacgccgccggtttcgttttggcccccgccatgcctgcgttgccagcactccagcacagcaccgactcgactcacactgggggcgcctagtttcccgcaggaagaagacgacgcgttgtttggtttcctgcagaaaaccgtgggccgactctagcaaggccctgagagaggcatgcatagctggctccagcccaagaatgtgggcctcatatgcagcccaatgtttagcttgcaggacagcttatgtgcttagaatattgagctcactattgttaaggattaatccctccgtcccatgatataaggaattttgagtggatataacacatcctagtacaataaatctgaacagacgacctgttcagattcattatattaggatgtgtcacatccatccaaaatcccttgtattatgggatggagtatctactaaattctgagaataaatttagtattttaaaaacaaacttaacaaatatcttagaacaattagtctaaacaatacagtagaaatggaattttgagaaaatgtattttttgaagagtggagcaaataactgaaagttttctgatatcagaaattaccccagcaaagttgtatcagataaactaagggtgagattatgagtgtgaagattgagtactcacaagtcaagcgacgaactgatgactcatgacgcccttggtgcactacatttatagggatatcaacaagaatttcacaaccgacattctttatgttgcaatttacagcgattatgatttcataacaaccttgcatatatattacacaaggtaaaaaaatgtaaaggttcatccgcaagcacaagtcttatgtcccgcgatctggatgcaaatgcttcagcgaacttcctgaagcacacagacctaccaaagatcatgaagcatcgctggatctcaggtggctccgaacaaacggcgtttctctctggacctgatccaagtgaatttgacagcggtttcagaaactactaaaggaaaatgtttcttgtgacattttgccaccccaaaaccttaaaaattttaaagctttctcgtgcacaagaagagcatatatacctgtcttcacagtgtatccaattcttcaacgaacatggagtgggctcattgagagccagatcctgacgcacaagtcgtggaagaagtttcatttacaacagcagcatggttgggggataccgtcctttgattatttgcgtctgaaggagagcaagcactagctgcaggaacagcagatggtccagtatcgtcctttgtttctagccgttccatcatgcgagataccgcagcaatcccagcgttgacctccctccttacttcagtgccaagacctgatatagtgttactccgagaaaaccatctttccttccatccacgcgtactctttgttatagaatctttatacctggcattgtaaagaatgcccacaagtaagacactgatgcatacgttcaatgtgtaaggcattttcaggagtttgagatattacttcatcgaagctgactgtaggcgagatctcagcgtgtcagagaatgactgcaaatcagatggtcctgctgtatcttgattgacaggtgcagattgattttcagatgtcctgattaacatcaagatacaaagagagtaaacctcttgaatttggataggaatagcatgcaaatatataccgtaagttgtaggaaatacctgctcattgctctctcatcatgcagagatggatttgaagcaccctggtcagaatgacccacgtatagctgcgaaccaccactcatatgtccttggtctacagcagcaagagcagcaaaaggatgagcagaacctaagtcagaagattgttcatggtcttcatcttggcctgaacttgcatgcagggagccaccaggaatagcctcattccttgaaaacaccacgatttgtgggcggctatgagatccagatcggctacgatgtccatctcttctaccatgtctgtgtgacctacgcattgcagcagcagcagccaagtgttgtataatgcgctcctcaagttcagcatcatcagctcctacagggacctgaaatcagaaaacggtacatcaatatagttgtatgaattaagcctacctccagggtgcaaagaggaatcatcgcaaatatccaaatgatagcaataaaacgtgctgcacctcaaaatcacccaatactggatggtgaaaaacagcggcagtgttcaaacggttagctcgaatgttcctctcttgctcaacagcctcaagtagttcttggctgcacagttcaaatataaaatgagaaccactaaattggttcactagggagatacacaggatgcaagttctacctcataggatccttcatgctgataggctgccaacacatgggacactgagagcttctctggcacctagatatcaaacagtgagaagcacacatcaaaaattaatattgtcgaggacagtacagtattttgacaaattttcactacatatcgattggatattgactttatatacagcattatccttgatcacatgagctcaccctcaaaatcgttcgtattcataaaaagaaagcatgagaatatattatatcctccatttcagattgatcgcacataaattatttttttgtacatctctagtatctgcaagctcgtatagaataaatatttagaatatgtccccatcagtccataatagacaccagaagggcaacgatagttttatgagcatactgcagaagaactgcacgctcacaactactacgacaaagctatcgttctagactgcttgcacagatgaaggaaatcttccagctgggcagctcagaagccttacaacccctgccccacctgatggaggctggtattgctgaaataatgaaagtctgtggatcatatgctccttaatggcttattgagtctcatatgctggagaatttctgtatggttattcactgcttaaagtgcaggtgatcatcattaaccttcatatacaagtcgatcatggttgaagagcattgcgatgcctaacacatgatctgtttctggaatgtaagatcccattttcgtcttataaatcatgtggtagttccactttactgacagcatttcagcacgacaacaagcatagattcaaatagtgtaagcagataatcaccatcaccttaaaaacaaatattttttgcaaccctagcaaattagatgtagttcccacagcacagttaaattgaaccatcgatgtgtagtcacaattgccagacaaacactaacttcctttatcaccttgcagctaaaagcacggccgtttattttactttatctaggtggaaaagaagatacagaaacaaaacaaacaatcagggattgcatcatataaaactgaggtacacaagcaaactagtcatggtgatatcggatagtttgctttgtggaaacaagagcaaccttaaatttagaataaattatgcaatatgcatgattcaattaccgtaatttacatctatatcgattgcaatgcatcaccagctccacaaagaagtacagaaaaagaaaaataccacacaacaatatcgttccaataggccagaaaggaaacattaccattcaagaatgcactgcagatggtactcatgcttgcaactcgtcacctgcaagagaaaacgccaacatccacaccaagaaaacaaatgagcgactcgatcacaatcatatcgaatccaaaattttcgcctcggcggatgcagaccgtggaggggtcgttgtcgcagaaggcctcgaggcagatgctgcaggcgtcgtcgcaggcgtcctgcacacctccctccacgaacgccgccgcggaggacagcttgctctccatcttcaccttctcatccatctccgtacagcccaaccgattcgattagcccttcccgcgcaagattcctacgcctgatgaccaaagaaaaaacgaattctatgagcaaaaaattccacggattaagccaaaccaagccaatcaacgatcgaaacaggagtctcttgctcaataatccccccatccacgatacgaaatccaccgaaatgaccataaacacaccacgaaatcgccccgcccccatgtccccaatccaaccaaaacgatacggataaatcaaaagaaaaacaccaaaaaaaactatccagaaaggaaaggcggatggattgcgaggctaccttatcccgattgctcaaggggaatttcaggattcggccggattaatcagcgaactccccgcggaattgttccgcctcggcggcgaaggcgagacgacgacgacgacgacgacgaggggaggaggagacggagtcgggaaggctttctcttaataaaaaaaaatacagataaaagaaaatcctaaataaaaatcccccctcccgctctctcccttcccctcacgccaatgacgggtggggccggagagcggtgggtcccccttatctagtgaggctattgcgggggtgtgggggcattggcgcgttgctaaaatcgaccggcgcgcgtagggggagggggagtgggtgcgcacgaaacgtcccactgcggcgtgggccccactcgcgatttcgggggcccacctgcgagtgagacgtgcatttcggggcccctcccctcgcctcgggttccgagatattatttttagacccgcatttcggtcaagggtgcgataaatgcgtgtgtaagagcaagttcaataatatagtcaattactagctccaatttatctatagtcaatctaatagcttattcatacaatatttacatactacactattaatatttggtcccacatgtcataaacatattgtgtcttagagtctatgctacagctggctacaaatctgtagcccgctgctcttctctctccttatttatctccttaaaatatgtttacagctggcttatagcctactattgtacctgctctatgggcctccaatggctgatcgtctcgtctcaaagaaagtacggtgtcgtccaaacgtctgaccaagaattggcgttcaagatcaaacaggggttgatgagcagagtggttggaaaactttgcgataagttttacttttccggttcgatccgttcatgtacacaaagtggcccacgtctataattgtattttaaattaataaaaaatagtgagaattgtgagatcattaatatatcattgttgtttttctttcatttaagcgtgtgttaagaaaagtattcaagtgatacatgtgtgatattgtgtacttcttccgtccaaaaaaaatgaatgatatgacattgtaatgcaacgtatctgaacaaaggtacgtccaaattcgtagtattagaatatgtcaaatccagtattatattgattttttatgggactgagagagaaaatatgcccatcttcagtttgataaaagaaaacgatgatggctagagctcttaaaaaatactactaccaaaacatgattgggtacgagtaaatgtggtgagcatgatttaatctatgacatactactaattgttgattaaaatatactctctctttttttagttagtgttacatgtcacatgttatactggatttatttattcgagaatagagagagtgagtgttatttatgacgagaacaatatttgtgttttatttttacggagtagcgtatctactacttcaaagacttagtacagttagtacaattatgtgatacatctactttgcatcaacacttatataaagttacagacaatagtcataaattgtggttagtgcctctaatcacaaaaggttaaatgtagtgcgtatttgtcgacggaagctgaaatcactataaagtgcgaactcatttttacgatgttatgcctaccagacacaaatgccttcgtacaacaaacacatgcttcatccaattgatttggaaagcttgagcgccgggagaatgtaagtcctatacatgactaatcatctagaatagggtcttgaacctcggactgcctgacgacgagagggtggcaaaacaatatacattgtcctctctgacgtaaagaaaacgaaacaaccctctatctcctggtgggaagctatagaaaatgtacaagcttggtggaaaaaccttacaaacatgacatgtgtgccaaagtagggattgcgctccctaatccttctcgtcgtctgggagatacagaagaagtggaaccaacgaatttttgagcacaacgagagcatgacaatcaccctcctagcaaaaattaaggaagaagccaaaatttaaccctaggaggagctaaaccacagttaattcctaagagcgtataatctgtaaagacgggcttttcccttctttttttttttcgttaccaggggtgtatttttttcctctctatctaacgaaagataaagcacaatctcacgctgtctccttttaaaaaacactttctttacgctgttcattggctgtagcgggtagaattcgcaaggaatatgaattaaatttggttataaatgaacgtacttttgtaatcacaacaaagggtccatagctcagtggtagagcaattgactgcagatcaataggtcaccggttcgaacccggttgggcccttatttatttatttttttaaaaaactgaattgggttgctatttaagaccgaatataatttatttgaattggataactgtttttgaagaccgaattattcatttcattttaaaaaaactgaattggattactgtttttgaagactgaattatttatttcatttttaaaactgaaatggattattgtttttgaagaccgaattggattaatactgctacataatttcacatttttaaaatttgttggaaaaacaactgaattggattattgtttttgaagaccgaaatggattagtactcctacattatttcacattttttaaaaacatttgaaaattgaattggatcaatactcctgctttaattttaccaatgcttttgagttgactcctacaatcatttatcggtgacccttttgagtggtcaggaaacatcttttgagttttgatacatgatcctgaaaaggatgcctcttgattttatttttttttgacgtaaaggtaaaaagcctttgagttttcacttttcatacataaaatatgatcctaaaaaataattttgttttttcttccttttgcacaattgcctttatttatctttaaaatagcgagatatgtaacgaaaggaatcacataaccttccaacagaaggagctttcagctacctcccttttatccaagatcaaggaagaggccaaaacttgggccttagcaggaggcgagaagtgttaatagctggctttttttagttagctcggaccaaaggtcctagctattttttttcctttcgctttataaagttctcattctctattcaatgaaattggcgctcgtcgattcattaaaaaaaaatagcgagacaaaactgtaagaaggtatcagcgctacgcaccatccaccaaatccaccactcggtttcaccacacaaatagtctttttggatgcttggttgcttttaacttccctgtcaatgtcgtgaaaaattcagcaccagccggcggcggcggtggcagcaacagtaaacggccggcacgccgccggcacaagacgcagccggcaacatgaaacttcaaacaatcgtcatcatcaagatcaattaatttggtctcttccattcttcttacatacaccaatagaccggacaaaattaacggagaagattcgtttcattggtcagacctatagtacaaagcctattcttacacgcatgacaacagctaaaactgctaaccaattaaacaagaagaataaaatgtaacaaattaactggaattctactcaggaacgctgatgccttcctgtcgctgtggtcttcagacttcaggttgggaaaggagcagcaagaaacgaaccttgcctgctctcatgtgctttccctacttacaaatgcatatacaaagaagatgagctacagcgtattttgccaatgaagatgggctacaaagatggactccatacttaatggaggcaagtcaaaaattgctgcattgttcggtctattgacagttaactgtgagattgaagcctaggaaatgttgatgctcaggcatgtggtagctttgcttgagagatccaaaacttagcttgcggtgcgatggtagtttgacatcgtgatattctgatgttgggttatagccattgtctgaaatggcaacttcacttagcagcacctgtaaagaaaccagaacaaccagtgagtttacactatcttaatgagcgtgttcaatcagttaccctgatgagaatgaccaaagttctaacagaagatcgtggtgatttttctcattcagagcatgcatgatccaaatcaggagttactttaaactgcattacataagtactgcaaatgtttttttttttactagctactacaaatgttttagtttagaagaagcgcaaaagtttgttttcaggcctatttcacaaaatttgaagttttgggctactgcagatggtactctatagaggaaattcttattttaaattcacaattaccgtcataagtagttcgttgcccaatttttatcataagataaatgattatagactgaaacaaataatcctggttccaagtaaggcaaccgaaatcatacacttttgaaagaatatctaatattgtcaaaggataggaaagaaaaggtagagaaaacaacaattaccttttaccgaagttttagcgcttccccgaggccaaagtttccggtactatgctgacccattttacccattgcattatttcccttctgcatcatttcgacaaactcattgtagtcgatccgtccatcctgcacaaatgatagtcaaatgagacaaaattgttgtttgtcaatttatcatgaaatacttagcattttctactcacattgtcctgatcaatgtctccaataatatcctcaatacgggtatcacctataccgaattcctcacatgccttttgaagctcatcttgagtaatgtaaccgctgccatctttatcaaagtatgagaaagctgcaaacagcttatcctccttctctactttgtttatatgcaaagttgcagcaatgaattctccataatcaattgttccgctgttgtcaatatctgcctgacatattcaagaaaaggagcttcatttgagaaacaatccaaaagtccagtggatattcatcataaatgtaaagcgacactgatatccaaacttcccagaatgttccgcatttaggaaacagttaatcctcctcactacaagctattttcactcaacaaaattaccatatattacaaatgctgataaaaattcaacatgaagcaagctcacgtttcaaaaaagaagtgtatgccagtactttcgtggtcaacactttacaaccaagaaaaggagccggtgggtacttgtaaaaattgattaaaaaaacttaataaaatggaaatttgtttgcaagatacaattacagatcagaacaaaatcttgtttactaatttcagtataaatgatgaatagatgcgcagaaaccttcttagaatacttactgcctccattagagcatcaatttccgagtccatcaaattagcaccaactctctgcaagcctgtttttagttcttccagtgtaatatgaccgctgttgtcagtgtctagcattttgaacatctcttttaatcctgcaatttcttcttctgataaactctcagcaataacctgcagtcacataccagttcatattaaaacatcaacatgaaagcagcctatatattactaattagaaaaatatgctgctcaccctaagcgccattttctttagtttgttcattgcagaaaattgttttaaccgactcaagacagcggaatcaagaggcttgtcaggagcaactccatcaacacagacccaaggatgacctagaaaataattggataaatttggttggaagtaaaactagatgactagcaacaaattatttacaaatcattgcatacttccaaactactcacatagggcttcatgggcagtcaatctcttttttggatcacgaataagcatttttctgaccaaatcctttgcgctctctgagatattaggccaaggctcagatgagaagtccagatcacctttcaaaacttgttcaaatatcccttgctcactttctgctccagaagccaatttatcaattgcattagtattgcaaatattacaaggaaaatatatttcactaaaatacatatgatctcaccatcccaaaatggaggaaccccactcaacaaaatgtagattatcacaccagcactccagacgtcaacctcacgaccataatgtttcataagaacctcaggtgcaacatagtacgggcttccaacaacatccgtaaatgtctcacctgtcaaagcatttttttttccaattaatatgacacatgaagaatggtatttataattacatgtgcggcatatacaggattatgtcaaacacatagtacctcccatgcttggttgtctatagctactttaagactgtcattttgggccaacatatagacggttctgtttcatattttatatagctaggagtttgtgtaagcggagctagaaatataaacctgtggggtcaattactaatagcttgtatttaagagatgtcaattttctaacttttttggatttatacatgaaaatcaggggtattttttaaaaagctgtgaggtcagctgtccccacagcttgtacatacatccgccagttcacatatagctgtggagaaaatttgacttaaatatccaggtgtaagctctcaacttcacgtatatatgctcatgagtattagttggcacctaaaaaattaagttctggagcaatttttatgagcaaaccacaatgacatggtctacctacaatcaacgtcaacaatcagtaagatatactctaattggcaccagattgtttaggacttagcatcgagactataacaaatgtgtgcaatgaggtgcacaacaagattaacccatggaaatggaactaatccccacagccatctcaaagtataaatacattttttaaaaaatcttctgattagattaatcatagcaccaatgctaatgctatcatcacatatacagtctcccattttgcagtcaccacaaatgctcacattattattaaagtctgaaactaaagtatatatttttgcagaaaattgcattgttaagagtcccagaagggggagggcgccatacctggcttgaagaagatggagaggccgaaatcgatggccttgagaggcgaatcctccttctggtggatgaagaggaaattctccggcttgagatccctgtgcatcacgccgagggagtggcacgcctcgatgacgccgacgatcacccgcgcgagctgcgccgcggccttctcggagtaatgccccctctggatgatcctgtcgaacagctccccgccggcgcagagctccatgacgagctgcaccgcgacggcgtcctcgtaggccccgacgatggagacgacgttggcgtggcccgcgaggtggtgcatgatctggatctcgcggcgcacgtcctcgacgtcctcctgcgtgagcagcttcctcttggcgatggacttgcaggcgaactcccgacctgtggccttctcgacgcagaggtaggtggtgccgaactgcccctgccctagcttcttcccgatcgtgtatagatccttgaggcgggcggtgttgacgtcgcgcttgaggacggaatcggcgagcagcccggcgctctggacgcgcttgaccttgggcgccgccttgttcgccggctgctccgcggcggaggtgggggtcgacgggtcggtggagcgggaggagtggtgggaggagtgctccgatggggggattgtgacgggctcgggcgcctggtcggacggcgcggaggagggcggcgggagggcggggggagccgcgtcggcgggcctgggtcgccagagggcgacgttggcgaagaacccgttctggccggcggcgctggggccgacgcagttgttgcccatcgccggcgggatgcccctaccctacgcggacgacggcggcggcggctgcggctgcggcggcggtggcattggagacgggcggtggaggggcggcgcgcgacgaggccggcgggcgcttggttggttgggtggatcggaggaagacagagaggagagcgaggaaggaccttcctgggaccaaatgaggtgggccccctggaacggaccctctatcactgacgtgtgggccatcctcccgtgtggggcaacttgtcagtgggtgatgagggatagcggtgaggcgacggcgcgggatgcggatcgggtttctgcgcgccaaatcggacggtctggatcgcccggtttacttgtgcaggcccgaatttggaatgcctttgtgtattactttgggctttggcccatttacataggacttccatagttcccttccattggagcatgagattgtttggtttcaatgcaaaactttatcgattttgttatatctcactcgaaagatttcttcttatctctcacttgattttctcactcaaatttacagtgtgttttcttgtaaattatagtgtaatttatgaaatttacagtgtaacttttgtaagttacagtgtaatttttgaatctttgcatgtaagttttgaaatatatattagatttggtttttttcttgaagatatggtaatttagtgtccattatggtgttttttagttgcttttttgcattttactgtgcccattagattttaatctaaagattaaaaatctgtgtgatatgatcataaaaatctttcgaaagatgcataggtactcccaaactttattactagatttttttattacgcagaaaatatatgcgcacacatatgtttgtgtccaccactccacccccctaacacaaccgaagagtgaagtaccttgatgtcactagattcctatgaagtatcgtgtgtgcacaatatttatgggcttttctgttagaggaacttttgggttgcgttttctcctttgaatccaaagctccataaacttttttttttcagattatgagaagttgtgattgtagaataaaaaataaactaggaaagaaaaattggtttttacaacttctccatattctcaccagttgaattcctacccatgtttctcgtaatctaaagctcctccaaacaaaaatcatgcactcacaactccactctctacattaacattctggatgagattattgggcctgtttggcaattggcacaggagctccagctccacctcttctgtaactgaagctcagccaaacagtttcatctctacctaaaataagagcggagttaggtagagtgctcttacaaaataaactaaagagttgaagctgaatttagactttagacagttccgcaactccactctagactcaactcctgaaactaaatttagaagttggagctctaccacaaacatgctaggagtagtgttgctctaccatgcatgtttcttcacagccgacgagtgtagcaatcctacgcggtacacaaagcctttcacgagaaaccgtagtgacacgcaaaattcttgtgttcaaaacggtggttgcattgcagggtcaaaggctcatgcgtcatggcgaccacgatgcctgcttaaacaaatccgtgaatcgtcaacttagttttaaccccgagtagaattcaactgctttgattttgattttgacggtgcaatcagatcccgagtactgtactactgtatgcatccctcgtttataggggcgccgtatttcatttggccgcgtaatcaatgcgtttcctactctgaaagtctgaatttctcaaggactgaaaacgaacagaggcatttctactcgtcagttgacctgctccttcaacttcaaacaggcctggtaaaatggtactagtagtacatggtgttctcgatcttccagttaattaattaagaaacatcaaaattcatgttacatgatgtcactaattaagaaacttaaacggtcttactggtacatatatatggatatcggatgtcatgatcttctcgacctcccgattaattaagagacgatacgtcgacggtggactcaactgtgccgtggaaatatatgcagtcccatagtcgaattctgctcggattgaagtcgtacgtaattaagcccttgaattttgtcaaattgagtggttagttaggacaagcagctagccaaatcgatcaacaggacgcctttttcagcttcatatcccaagtgggattgcaattggggttctaggttaaatttccaagtaaacgatcaatcaaaggacgtgcagagaattcagagtcttagctagggattcttgtggtcggcttgggttctttctgaagaactgtcagagattgaagataaaattaaaccagagctatatctgaacactcgattaaaagttcattcttgtcccgttcaaacaatggagaaaagttcattcttgtcgctgcaaacttgcaaccccacagcttgagattaccacattacgcatcagacaaaagtgtttgacatcgtagtaaagtatagctaggtaggtttggcgtttgaacgccttgactgatcaactgtggacgcgagctgataatccataccgatttggtcaacgttgggctgcagccgaaagtaatactagttatcatcaagccaataagtgaaaactatcgctaaccacttctaacctaccttggcttgccttccaaatggaagtgtgtaacgcgtctgactttttcgctagctaactaataatcgtaatcgatcgaaaaaaaaagtcagcagtcatgaatctgccgtacttgaccgacgacttttgacattgtattgctactatatccatgtctttgctactagtagcatgtgaaagtgtttgctactctctatctataaaagcattgtgcaaagtgcaatccattatagttgtcaaagcattgcaactttacaagaagctactctttactcgtagcgagttgagcaaggagagctaggtagctgccatgaccatgacagtggccatgccgtcgtcgtcgtcgtcgaggagaggtgggctgcgagggccgaggccgctgccgctgaaggtgtcgtcgtcgtcgtcgagggggtcgtcgccgtcgtcgtcggcgtcaaagggggcatccaagaagtcggcggcggcgccggtgatcgtgtacgagcacacgcccaaggtggtgcacgcgcggccgcaggagttcatgaccgtcgtgcagcggctgacgggcaagccaccggcggcgccgccggtgatgatgccggcgtacgacgcgccggcgatggtcgagcagggcgcggcggcagcatgcggcgccggcggcgacccgctgctcctcaccctcggccagcgccaggccgcggcgtcggcgccggcgcagcctccggcggtgccgtcgccgatgatggccgccggcatgctgctgtcgccgggcttcgtcttctccccgaacaccatgcagtccatccaggagctcagccccttgttctaaatcaaaccgtgagttcacgtagaattcatctagaatgtacgatggtataattgtatagtgcacagctcacagcagattaaactgaagggagagtgtaagccagttaattatccgtgctgttcgtgcaaaattttgcaagcgaaattgaaattttgcacgcacagcggtttgcatggtggtacaaagctttgtaaattttcatcattctgtataagcagtagagcacttgtaaatttctgttaccatgcatgggagcttcctgatacaagttcatatatagggctgtttagatccctgacaaaattttttaccctgtcatataaaatgtttgtacacatgcatggagtattaaatataaacgaaaaaaataactagttacacatattgcgtgtaaattgcgagacggatattttgagcctaattgctccatgatttgacaatgtggtgctacaataaatatttgttaatgacatattaattaggcttaataaattcgtctcacaatttacaggcgaaatctctaatttgttttatttttagtctacgtttaatacttcaaatgtgtatccgtatatccgatgtgacacgccaaaaaatctaaacacaaccatagtatgtagacagtgtataataaatttcatatatgcccctaacatttaccaatttatcattcaccgcctgctgtctaactgacatgtggggccctgcgaaattttcagtggcaaacaagtaaaatacagtgttcttttttttttccgctttatgaaacagactcattttgtttgacctgctcccaaatgctcatggctatttgagatcacaccagtgaatggcgttgccggccctacgaggaaatcttgaaaaaatattgattacaagctttggcaccggctgtaagcatcgttgtcttcctccctggcatttatatatgttttgacttcttgaagcagatttcggaagtattcaatccagttgcacattgctgatagtaatgcgttcatcatgaccaaacaaaactgaaactgaattttttttttgtagaaatgttatcatttgagaaataggcctggctgtgaatttcggtgcaaatttgacaggctatttcaggataacaatggagcagctacgagggaaaacaatgacaaacgaaacataagaagtgcagtctgcagttcagcaacattcctattctgagtgcattgatcatatcacacaatcacaaagcatagagaaaatcccctatgtacccatgaaagttcatctaattccttctatacccctgaattttgctcaatcccttacatacccctgaattttagtttggatcccttccataccctttccgctagttgaccgttagttgaccgttaaattcttttgaaaaagtccattttgccctttgctatgaagaaacataataaattaatgaagtatattgttggaatgtaaaaatttattggatgagactattatatttatgagtatgtgatgcaccatattatttgtgacaaatttacttttacatatgatataaaaagttgatacttatttattagttattaaaagttcttttatgtagcatatgtgttttcatagtaatacaacatatttgtttattacttcagaacacataagctaaaatttttttaataactaataaataagtattaattttttatgtcatatctaaaagtatatttatcgcaaataatatggtgcataactatctcataaacataatagtctcatataacaaatttctatgctccaacaatatactctattaatttatatgcttctttataccaaagggcaaaatggacttttttataagaatttaacggtcaactaacggtcaactagcggaaagggcatagaagggatccaaactaaaattcaggggtatgtaagggattgagcaaaattcaggggtatagaagggattaggtgaactttcaagggtacacaggggattttctccaaagcatatgccactgtattcagactcacaggtagaagttgccattcaaaatacacaccatttagacagagcagacgtgcaaaccagatgcaacactccagcatttcggcaaccgcgcaaacaagatcagattccatagcttactatgatgtacactctacacagagcatgtcagttagctcctgattacaagctattcacgcctaggtttgaataaacacactataagacaagctcaaagcttccaaataaaaacatacagctcaaaaactgtgcttgggcaaaaaagaaaaaaaaaagaagaggaagaacatgtcaaagaatgcaatacacacacttacaatgaagctgtaaacaatgattccaggttctgatttatagacaatatgcccgggaaggtcgtttcattgccgtgggctaggcagacgacgccagggactcaacatggtggatctgtcgagcagcagtaggaagccaaggaacgtagttgacagaccgaaggtatacctgcgaaatatccatgggaacagatttggtctcgattcagaacaaaaaggataatgatatattcataaccaagccatcatatcaaatctacctggctgtggaacttctgtttctccaaaagattatcgagagcacccactgcggcaaagagatacaagactgttagtttctgatagataaacatagccaatgctattggtatggaacacagagagagagaactttagacaaatcgaaaaggatcaattattaactgcacgttacgttggaaagaaacaatctgaaatattttatagatttccttccaattacaacttcacatgttggcaagcacacattatagaattccagatatggaattgaggtagcatgcaacacatgttactgtggtcataactcccatacaaaactggggctcaagtttttagcagttgaccacatatagcacataagcaagtctacaaatgagtccagcgacagtaaatctagatatgccaaaggactaaaatgactgacaattagatctactcaactcaagtgtacaacataaggaaaaactttgataaccacaacttaaatttccattgttgtaccaaaagtaccaactacaaattgttgtgttactgctttaatctataacaatgcagttattctacccaccatataggttgatttcatctacagctaccacaagcaattgtcttacaaatgtaagaatgcaattttatatcccaaccgtcattgatttggtgacatttcatttggttttaggcagtagtagaaatgctccaactaaattcatcaatctaaactaatgaaactacaagttctctggatgtgctactctctaaatttagcataaatgtgtcaaatgtgaacaacttactaacagtgaccaatgtgagcaaacttaattataccttgcaaacccctagcaccgagaagcttcgtggtgaggcagccactttcttggctttctgttcagcaaccacctcccggcacagccgccgcgccatcgccctcgccatcaccagctgagctctctctgctcgcaatgctgcgatttccctccgcattgccgccctgtccgcctccagagcctccaccctggcgtacaatccccctgcagctgcattgccctcccccatgaactccccaacaaccaccgccccggataccttcgtcgtcgagctcgcgcacctcacatccaccgtgtactcgaactccttctccacaggggtgaattgctcttcctcatcatcgtcgaccatggctttcacctgcatgccaccgattgagtcgccgccgctgcttccatctgtctgtagcgcggccgtgtcgatctgttctacctcttcgccatcttcctcgtcgtgctgctcctcctcgccgtcgtcggagaaggaatcagggtcgatcccgtgggactggaggcgggagtggtaggaggcggcgaggtcggagagcgaggcgagctcttcctgtacctcacgctcgcgatcctcgcggccctcggcgtaccgccggaactggcgggcctccatctgcgcggccgccttctcccgctgcagccgctcgatcatgagcatggcctcgctggtcgccgtctccgccgacgcccgctccgcatccaactcggcctgcagctcccgcgccgcctcctccgcggcctccttctcgccccgcagccgcgccgccgcctcctccagctcctccagccgccggatcagctccggcgcctcccctccccacgccttcggcgacagctccggcgatcgcgcgggaggccgccgcttcaccgaccgccgggacgacggcgatgggtcgccgattggatccatggaggcatctatatatccagcgaggttcgatcccccaatccccaaccccaccctcaccgccgccgccgccaccgccgctgccgccggcgaacgaagcaaacgaagcgaagcgaagcggccgctgctgctcggaaggggaaaggcagtggcgtctggttggaagcgagtcgagccaggttggaatttgacgcgaaccggatcaaactaaattttaataaactaatcaaataacaattgaatttgtgtcgtactcgattaatttggcattagattggtgagctttccacgtcgtggttggataaacaaactgtttatgtatgtgtgtgtccttggaagcgaaaggctcggtgagattgaaacagcggctgttacgatccgttttgattaagcttggtgggcccgggattagggggggcgcaaaaggtgtagtaatactagttgggttgtgtgcgtgggtgggggttatgattctacgtgcgcggccactacccgtggaaatcgtggaagggaattttttgcggcgaaaaggtgggggaattagagcgaatttacctatgccgtgacagataacgataaaaagacacacgatttttcagtggaactgtggaagggagtttttctctcttttttttttttttttgaaaaccggaagggagtttttctgaccctacagagaccaaacagatcgctcgtgctcggtgctcccttcgcgttgacacggaaggaaacgacgcgacggctcgtttgtaccgagaaagctaatgaaagcccacggttgctgtttctttttttggcccacggttgcttctattttgggttaagcccatctttttttagcagcccaaatacaagaaagaggagaagccatgcacatgggcctcgcgggtcacatatacgttttcggttgtttttgaaattgtatttaaaatttattctcgaatttatatgtgcaaagtttatgcatacagggtttatacatgtacagttcatacgcacatgctatctatgactctatgtatttcaaagtttagggtctcgtttggtttgcaatatttttaaaacatagtaatagggaaaacatagaaatagaatgggaatacatgtgtaaacttaaggattaataaccatatgaaacttttctacagttgcgtactaaacgatcaaaggattaaaaacattagattggagtggagggatatgaaattttcctttgatttctttgaaacgaatgacaattaaaaaaacgtagatattagggaagtacctaatatcaaatatagaagtgaggctttgaatttagaccggctagtccaccatcttgtgaagctagccggaagacaacgggacgtttctctgaaaagaatgacaatttagtgtccattcctaaaagctgtatatgcctatacttttcctttacaattcctctaaaacgaacgaaccctatacgtataaagttttcaaatacaaatctcctgagctaaaaaacgagttgacccaaactcaaacaagcctaatgcaggcctataaatacggtactgatgcacctatgggctgagtgatgagaggaatatcacatgggtcaatataaacttgttttggatcgaggaacgtagactgcaactctgggtaggctaagagcaagtttaatagtagagcccactactatctccaattcatctatacccgatataatagctaatttatacaatagttgcttactatattattaatatatgatctcacctgttatacacacattgcgtctttaagtccgtgctgcagctggctataaatttgtagtccactgtttttctctctcatcttttatctcattaaaatatgtttatagctggctaatagtctgctattgtacccgctctaaatccacacgttatagccacacgtgggctttggctaatagtctgctattgtacctgctctgaatccacacgttataggcacacgtgggctttctcattgttttccacccgctaggctcacccggcatgaatcgtgtgtttccttatcggaattgtctatccatttgtcaggtgatttttaacaacacaaatcactaagatttttttctattattatatttgcattcaacggactaaaaaaaataacaaatacatatttacttacatattattttttatcaaaattacagtgcacttacatgccatatcaattaaatttacaaatgtaatattagttatattgaactgtaattttatattttaaagaaaataacaaatacatatttacttgcacattatttttatcaaaattacagtgcacttacatgttatataactgaatttataaatgtaattttaattatatatgactgcaattttatattttaaataaaataacaaatatatattacttacagatttttttatcaaaattatagtgcatttacatgtcatatcaactgaatttacaaatacaattttagttatatatgactgtaattttatataaaatgcaattttatattacaacgttaatagtgtcttatatatacagtcaaattctcctcatgctcaattagccaagagctgcacatggtaagcatctgatcgtgagattgaatcctaccgcccgaggtttggtggtaagctgcgttagtttttttggatgttgttagcacgaatctcactatgaattggagggttgaaacaacgagtgatttccaacgaaaaatctgtcaggcgaagatttagcaaaatcgtttccttcatgccatctgacgtgaaaatgcatagcgtttcgtacattattccatgcaaattctcattcttcttggacgttaaacagagttaaatcgaccgccgacgctgtatccgacaagatgcccttttactcctagaaatacatgcatgccagatgcttgaggaaatctatcttctatctatctattatataattaaaggaatagaaaaatgagcctccacgttcgctctcatagcctagaaattctcaaattaatcggagaaaaagaaaaaacagagtccatatagaaatacaatttagaaataaaaagaaaaagcagagtccatatagaaatacaatttagaaatagctgaaattcggaattaaaaaataaggaatattagaagaggggactagagtccatatagaaatacaatttagaaatagctgaaattcgaaattaaaaaataaggaatattagaaggggggaccagagtccatatagaaatacaattaggaaataactgaaattcggaattaaaaataaggaatattagaagtagagtatagagtctatatagaaatacaattaggaaataactgaaaattggaattaaaaataaggaatattagaggtagagtatagagtccatatagaaatacaattagaaaataactgaaattcggaattaaaaataaagaatattagaagtagagtatagagtccatatagaaatacaattaggaaaaaatagaaatttggaattaaaaataaggaatattagaagtagagtatagagtccatatagaaatacaattaagaaaaaaaatagaaattcggaattaaaaaataagaaatattagaagtagagtatagagtccatataggaatttaaaactaactaaaatttggaataaacataataaaattaaaaaaagtggagactagagtccatatagaaatacaattaggaaataactgaaattcggaactaaaaataaatattataagaggagtatagagtccatatagaaatacaattaggaaataactgaaattcgaaattaaaaattaaagaatattgaaagatgagtttagaatccacatagaaatacaattagaaataataaaaatttagaaataaaaataaataatattggaagaagaacatagagtctatatagcaatacaatttacagaaaattcggaatttaaaaaataaatattaaaagacgagtttagagtccatataggaatatatataatttacaaataaataaaatttgatattaaaaataattaataactaacacgtatataaaatgtaatatgaatattacatattagtagttttgtaaagttaatgcaaaatttaaaattatgttgtcattttaatatatttgaataatataatgagaaaacatatatgctattatatgagacaaaatataatgatgctagccgcgcaatctgcgcgggccaccatgctagttgatattatgccattataaaaaggcaaaattggttctatggcatcgaaagtactcgattttggttacatagcactaaaagtttatggttcattttaatagcactcaaaactggaaccgttactatttttagcattccgtcagcagttcgtctcctcaccccatcctacatctgtcttgttcctcctgcactctccctcctatggttgaccactcttcgattcaaggcagcaggtgagctcgaccacgacagtatagcgctgagcgagttggagccttggatggtggctggttctggcaagctagaggcggcggctcttgacttgggtcagcagacaacggatccagggtaaggaggagcaggtcggtactcaggcgagcccgcgacgagcgcgagggtggtgcttcgggggccgatggatgagctcaagagcagcatgtcggagcgagctcaagggtgccgacaataatctggaggacgttgcttcgcttcgggcattcatggatcggatgacgcatctaggggagagaccgagagcagtgcgcgcggacgaactcggaagcggcacagccgcatttgaacaagctctagcatggcggaatggcagatgagatcgatcgacgatggcgctgtccgggcaaagctagagcctagaaagtggatagatcacacctagcaagcgcggacgaatacagtggcttgcggatgatcagcttgtgaggctgggctcacgtacgtattacatgacgagcttgtggagccagcatcgatcctgtgttcgcaccatgactgaccgctctgagctcctgtacgactgctgtttggaggtgacaagcaagaggaagagggccaccattggggtttgatttagttttttgttgaagaataatactaattagaaaataaaactaacggaagtttggacggaatgctaaaaagaagcaacggatgtaacttctgatgctatcaaaatgagatgtgaactttggatgctataaaatcaaaatggacaactttcaatgctccagaaccaattttgtcttataaaaaatagtaaaagattaaagttgtgttctttccgaggggttgggaatgccctcccctccgcacggaaaatggagcaaggttggaaaccattcctctccacacggaaaatggagcgatagattaccatgtgataattaagtatcagctataaaaaattaaaaaatagattaatatgatttttttaaagtacttttctatataaattttttgtaaaacacatacaatttaacagtttgaaaaacgtgtacgtgaaaaacgaaggatatgagttgggaactcaggggaaagaagtcaaagaaccctggttcggaatcggagagatgcaggtgtagcgcatgggaacaattaaaatcgtgcagcataggtgcatacgtacgccaccctctcatccgatcggccggtcaccttttccttttccttttgggcattcatgcatgacgtctgggctgggtggacccgtttggacgcatgcatggaagcatgttggcaacgcggctgcgcgctgcgcctttcaccggaacggcactgcgagcgatagaccgggcggtcgtgtcgtgtgcctgcttctgtctcgctgcacctcgccgactctttcagctgaaacgatcttggcgaatctatttgcagagaagcgactactagtgtaatccaggaatccaaacctcaaacgcgccatatgatcattagtttaggggtgtttagatgttttagtccagtctcattggatgtttagacgctaatttggagtattaaacatagattaataattaaactaattgcatagatgagagctaatttgcgagacgaatttttaagcctaattaatccatagttagcaaaacttttactataaacttttgataattatgaattaattaggcttaaaaaattcgtctcgcaaattagttcttatttatgcaattagttttattattagtttatgttttaatactttaaattagtggaatttagtccatgtcttctaaacacctcattagctatagcgagtgcataaacattaaacatgcgcatgatgcgtgcatgcatgtattggtcattcttgtgcatcagactcttcttttcgttttggcttgctttgcacagagagagagagaggtgcgggattgtgtgcttttgtgaggtgggccgaggggaagcgagcgacggtgtcaggcggaagtgggtgttctgctcatctgctgcttttgtgcaacgtctctatacggtacggtttggtccttctcgaatgcgatcgaggttggagggagcagatatttgcatgccaaaagcaacatgggaaatggttgccttcgatcgacctccattttgcctcgtgtagactgtagacctcgcctcgtttcattttccccagggttatggttgccttcgatcgacctccattttgcctgtgtctggcacgtggcaccatactggagtacagtacatggtaaaaacaggacagggagagtaaaaaaaaaaaggggacattaatttacattgtcaaaacctagacttgagtagcaagtttgattagcttaatcactcttccgtacagacgagcatacagtcaccgagcggtaagatcaccaccccctcctggccttctcgatccttccaccggtttagggttttctcatcgcctcacctctcacttgcatcaccccccctcccctcccttcccttgcattcccataggatcacatcacccactccaccacccttccctcctccctttcaattctagcctcgtcaccaccctcccctctcgttcttgccttcctccacccctatgccatggcggcctactgcgacggaggcggtggccgcggcgaccccagcggtgggggaggcggcggcggcgttggagccccgccgtaccgtcccgctgctggctccgtgtggtcgctgccggggatgacgccgcggccgccagggcctcctccgaagtaccagcaacccgggcaccagccggccgtcgtctacagggcgccgtcggccaaggaggtcgagcagaagctgttcgtgtcggagaccgcgctagcgccacccgcagcggcggcgtccgcgtccgctggcgaggcgccggtgtcgaagaaggggctcgcccaccctacgcggcggccggggttcggaacggccgggaacgaggtgatgatccgcgcgaaccgcttcctcgtcaacgtcgccgacaacaaccactacagcagaacaagctagcagtgacgggctcaaaccctcaactgtgacggatagaccccctcgtcacagatcaatggtcactgatgacttaactcacctttgacgggtgtaggtccgtcagaggtgacagacacctttgacgggttgtgtcatgtggtcacatatgagaaaaatcacccaaagaaaaaaaaggaaaaaagagccacaaccacagctcaacacccgtcactgatgtagatttcgataaaaaaaaacaaaaaaaaagtgcttctgggtagttgccatcgcattcatcacacacaacatttcatcacacagaaaagtcttcacgaacatttcatcacacataaaacagccatggcaagcaagcaattcatcaatcacctgacgagcaacaaaaacgaagggaataaatggttgtgggttttgccgggcagggcttcttcataccacggtgggcttgaactccttggcgcgctagaccttcttgagctcggcctggaggcgaccttgctcctcctccttgcggatgacctcgtccctattactgctcctcgacgccgccctcttcgccttctgcacccggaagcagccgacgggggaatctgcagttctgcactcgtcagttggggacgcagccggcggacggaggagacgacgcccggtggccggatccgcgtcccctgaccttgtggaggacggatctagagccaggcggtcggaggtggcgcccgtcagttgggggatggaggtggcccccggcggtcggggatggaggccgcggcgccgccgttc

SEQ ID NO: 62461 - DNA, 659 bp, Oryza sativa
attataaggatttgcggcatatgcggccttaggattcccatagcctccgacgtacactgcaggatgggagcaccatgtctgatgaagttatattccagatgtgcaacacggaaagagatttaaactacatggtcaaccttacaaattatgccctttggttgacatgatctgatttcaaaacattaagtatccctacataacacagatggtcccgaaccactaaaaagagtactagagaaaaataagcatccagagtttgttaagtaccttgattgcctccagacacagcagctcgtgacctcttctcggcctcagctcgaagcttctccacttcagaagccactgatatcaatttcttctgcatctcttgtccctgctcatagctctcggcatatcctttcttctcaacctcaatgccagatctgcaggtcaaataatacaaccatataaggttgaaaaacataaggttattcttggaatttcactctctctactactccaggggtaactggaattcattttggacaaaaaaaaagtaagagctcattccatttcaaattttaattataatagatcgtaacttgaccagacaaaccaaaagagttcatagaaccaagagaatggcaaaacaaaacagcgatggattgttttctcacaag

SEQ ID NO: 62462 - DNA, 3587 bp, Oryza sativa
  unsure (1)..(3587): unsure at all n locations
tatttgctctatatgcttcattgacacgttaaatctgccctttatgtcaagatattattgcatccaagtatattaagcttctgtttgttatattctgcttgttttaacatcttaatatagagtcgtatcggagtattagccgatatatgctagatctatccgatcggctatggtacgaacatatatagtcctgttattaatatatatttcgatctaagtgatttatactgtctcggcacggcgaccgatctatcccaatcatttgatttaagtatatatcgatataataattgtatattgctaatatctacagccgatcaagtagatttaattctttattacctatttacaaacgccgatcgatttacatatgacatcggctcaaagataaatgatatgtcatcggcacctagccgatcggctatcgtttatagatttaaccgcggtttctttgtatctatttcttgttgattgcaggatcaaatcaactggcacgctaacacacccgaaggcgagctttggacctgcactggagttaagcagatctcccaggcctcgtgtttttcgtcaacacgcttttggcacgcccggtgggacagattaggagtcagataagcaattttcttcatggccgagaaactaccgccatcaccgtcctcgggtagcccaggatttgttaaagaaaaaatccaaaaggtatgttttacggacgttgatgaaaggaacattgtgaccatcaatccaaaaaagctcacacctgatcaaaagaaagattttgacgcgatgatgcaacaaggtgttcgcaaataaaacccgaacctccttgttagaccgacatgtcattcttttccccggcttgctgagtacgttaagtactcacccttgccccttataataatctatagagtttgaagatgaagacgtcgacctgacagctgaggagtatctccaggagcaagttgagtatgaagacttctagatgttttgtgcctagccccaagcctcgcctgtggaataagttagttgcctaagttctttgcctagtgcgtagtcgcttagttctccgcgctgttcgcttctgtgccgtcgattttatggttctctgtaatgctgtgttgctcatatgtgggcctgtccatgatggcaacgtttgtaaggactactacccagtgatgtaataaagcaatttactttgattccacatttattctgtgtataccagctagtgtatcctgggactggtactatatcacaggtaatgcataacaccccggtgtgagtttgctgtgtttatggctaacaaatgtcggggcgttacagtgaaatgaaaatttttttatgtcacatcggacgtttgactggatgtcgaaaggggttttcggacacgaatgaaaaaactaatttcataactcgcctggaaaccgcgagatgaatcttttgagcctaattaatccgtcattagtacatgtgaattactgtagcacttatgcctaatcatggtctaattaggttcaaagattcgtctcgcgatttgcatgcaaactgtgcaattattttttctttttatctatatttaatgctccatatatatgtccaaagattcgatatgatgtttttacgaaaagtttttttggaactaaacaggcccaaagaaaacacatgcgatgatagtgagggaaatatatataccttcctcactgcctcgctgacattcgtcgtcgcatctggatcgcgaaagtaggtccacccacgagcagccatagtgttgagttcatcgatgtatctctcccagtcaatggcagaacaatggcaatgcatacgcttgaactcttcatcagtaaagtctgcatatccgttagggccataagggatcgtccttggctctagtgcgttaaccttgtctgcccacagggtggcctccttgaatacttcgtagcggcgagccttctcctcctcagtgctgtatgaacggccatactccttcatcaagtcatggaacctggctttcatggtcgcctcatcgaccttcacctcctgctttttaatggcttcttggtagtctctcgcctctttagcaaatgcctcatcgtccgggagagtcttcccatgttcgacgtaattgagatagctagaccacaggatcttgccatctttgtccacgaaccctgcctcgattgctgcttccttgctcaggtaaggctccttgccggcgtcctgggcagctggtaacttcttcgtgacttcctccttatcctcctccctagctacaggttatgtacagatagtggtagtggctatggttaagttacatggatcagagctaaatattccctttgtttcatatcataagaccctttaagtttgatcaagtttataaaaaaaatatagtagtatttttaacacaaaataaatatattattaaaatatatttaatgttagatttaatgaaatcaatttgatactttaaatatttctaaatttttctataaactttatcaaacttgttaagtttgactaggaaaaaattactaacaaacaatgagaaatcttggccttttcaggattcagattggatgacatatggtaggcatgtcacaaggtgacatagctcagatctcagccctccaaaacaaatccaacggctgagattcgtccacgttntnncgagttaaaatttaactcgtaggagtaaaaattttacttggagtcaaattttattggagttaaattttaactcgtgatgacgtggacgaatctcagctgttggatttattttggagggctgagatctacgctatatcacctttaacatgcttatcctatgtcaccatctgaatccgctttttcaattcatacctcctgacttgtcagtgttttgcttgaaacacagaattgtggccgccaatccaaccaatgaagccgtggctacaacaacagagccaccaccaacggcgaaacccatctgtatcgcgtaacgagatgagagacatatgagctgcgagtgaacaaaagaaaagattttcgatttgagaaccgggtgagatgagagacgaacggagtggaaagagtgagctgctggcctccccgcccgagtgaggatacccagcgaggactccgcctgcgcacgggggatcccgcgtggcgagaaccccctccggcttcgggtgagaaggtaaccgatggcccggagcgacatggccgcgaccggagaagctccccttcttcctcctcctccgcccgcctccaatctcgcctagtcgccgagattcgattctagggttttctctctcgtgacttcccttcccgatcgacgtacgcacactacagttacggcccagtttgtaaggcccgcatatagatcccagcccaatagggctcaactataatgggcccgttccaatcgaacgagtaccacgcgtgcgtgtgggccctgtcgtcgagaaccaccgtcactacctgcacctgcacgggcccgataataataataaaaaagaaaaaggaaaaaaaaaagagaaaaatccaactannnnnnnnnnnnnnnnnnnnnnnnnnnnnnngtggntgtgaggagcagctcacctgcacgc

SEQ ID NO: 62463 - DNA, 797 bp, Oryza sativa
  unsure (1)..(797): unsure at all n locations
aagcataagagcaaagtggggggcaatatacaatatgcaaaagaagcaaccatggtgcaccatctcaagccacattagagaagtctatgacaattaactcattcctcaacttgcaaaagcgggtttcatcaagaggcttggtaaagatgtcagctagttgatccttggttcttatgtggctaatgactatgtcacacttggcaacatggtctcttaggaagtgatggcgtattgtcaatatgcttggatctagaatgttggaccgggttattggctatctttatggcactatcattgtcacataggagtggggttttggtgaaggatatgccataatccaacaagatttgtttcatccaaagcaactgggcacaacaactacccgccgaaacatattccgcctcggcggtagagagggctacggagttttgtttcttggatgaccatgacacaagggatctaccaagcatttggaaactacaggatgtgctctttctatccactntgcaaccggcataatccgaatcggaatagccaacaagcttaaatttagcaccttttgggtaccacaagccaatagtagaggaatgcttaaaatatcttagaaatcttttcacggccactaagtgacacttcttaggagcggcttgaaaccgtgcacctcgggttcaaaggtctaaacttacacatggggcttgttttataggtaattaacgacataaccatcgatagggagaccactgccgcgttttataaatttcagaattgtgttaggatcactgagggtttatttgcaa

SEQ ID NO: 62464 - DNA, 1313 bp, Oryza sativa
gcgcttgttcaagctgtgctgctcggttttttgctcggctatgtgcacgaaaaaaaaatcccaaaaatttatattggtccattttatatcttcaaccagttgtaaacactaaacagctgtagtaataagtgggcttaaacctcaaaaatggctacacaagcccaagcgatccgcatcccaaaccattcgaaattcaaattattcccctcttccgctccatctccttcccgtctttctctctccacacagacagcgcacgcatccaccaccccccaacacgggagcggagagctcgccgccggcgatcgccgcaggattctgagggcttcttccggcggccacgggagatggttctgctcgaacgcacgccgttggtggtgcccgaggcagcagcagcagccgccgccgcctcaagccgcttcggaggccggtcgcctaggggtttgaaggaaggggcccccggccccccttgatcccatccttcccttacctcaggtaatggctagatccaggatccaaatcagcccctggtcccctcgaattaggttctaattggggggggtggaattcgcggaaccgtggcgtggaataaggttgggtttgccctcaagttgtgtgcgtacgcatcgtactgggattctgtcccttcctctgagttatgtagttaattgggcgtgtgatttagattttgacacttcgcctttgcgattcctgttcaattgctcagtggcagtgtgcagttgaatttggacgaacggaaatgtgagaaatgggggcgtgtgtgttccgaaaaaaaaaaaagaaaagcaaagggtatgaccaccactgtttgagtgtctggcaacgacagaagtgcattttgccgagacattgtgactggtcactcgtaatgtccagtgttgggacttgggaaggatttagttttggagctgatttgttttgtgcagctaggttgatttttcttgtgaaggattagcttgttcatgtggagacggttctcttattcctttatcagttcttgaactgtcaagtaatgtaatgtgcccactttctgtgctccttctgtactaatgtgctgctttctgataggtccttttggtaaaaactttgcatatataacttatttttatgttcctggtactattatatctattttataaggtaaatctaatctttcatgcacatgctggtattcatgcataatttatctatgtatcactgcggtttgtttgtcctggtcagggccccagtcctggtgtatgcattcgtttatgttagtttctgacttggtattcaggtctatcaacaaggct

SEQ ID NO: 62465 - DNA, 589 bp, Oryza sativa
cggtggggcgttgcaaaagcgcatggctgctgcctgtggcgtgtgggatccccatatgccgcgcgggacaagccatgtggggagataaattttgtactggagttggtgatccgagaaagcgtttgtgttcattaagaaaaagaaaaagggggggtggggggggggagaaaaaagaagagagttttgtgttagtgccgcgccggatagacggatgggatcatgggatctcctgtactgtgcgtgtcctctagtttgtggtagcgatcgagctgctgatgacggcagatggcccagtagtgcttgcaaagttgcaatataattttgttggctcgacctgctttgcttccctgatcagatcttcggcgtgtttggcatgcacatatttggacagttatcatgcaagaaaatgatagtgtattgtactactccatatcgggtcagcacgaagccaaaatagggtcgagctagcgtcagggtgggcagcaggggcctctggtattggagttagcatgcgacgcattgtgggatcggcatgtgctttgtagtcttgcgtacataaatgtttttggatgcatgcatatggtataca

SEQ ID NO: 62466 - DNA, 1812 bp, Oryza sativa
  unsure (1)..(1812): unsure at all n locations
cggcttgttgatagattcctnnnnnnnnnnnnnnnnnnnnnnnnnnnnnnnnnnnnnnnnnnnnnnnnnnnnnnnnnnnacacgggagatggacaggaatgcccctgggataattaggttgggttggaagggttatgtggctgatggctgtcacgtgtgtatgggacatgggacgccatcaactaataatgacctttcacctttgtgcaaaggaagattagtcctaagtgagatttttaataagattagtactttgaagctttggacaaaggactctagctagatggaagcttaactgacaagcatattagatccaggcttttgccaattttgaaacgattttttaaaaaaattcaggtttattcgcggttatgttagaatgtgcctctagcaaaagaaaaatattgatttttttaacttagcaaaaaagggtttcaaagtcagtaaaaccctgtttaaattctactattttcttttcaaaactttagtccctatttttgcattacaaaatgaaaaatcatagtccttaaaatgctccttaaggtaaaaaaaatattgatgtttaggaccagatttgattctcaaaatattataagtttaactaaatcttattctgaacattaaatatttatttatgatagaaatcaatgaaaaggataagtagtcaaagtcaatggacttgtttgttcgagcctatttgttgcggttcatattttcgttagtcgaaggcatgatataaaagtttacatttctacttttattggctctaaactaaaatcgaataccgggaaacctctaatgatgttatttcatctatcagagtttaaatcttgatgcacacgaatattacgcatattcaagtgagttttcaacaggattgcagttagatcagggatgtaacgttggtttccatttattagagcatgtgttaaggggacatattcgtgggagtgtgagtgtggcgttggtgtgtgtgcacgcgtttcgtgtaattaaaaaattaaatcaaatatagaaatgaacggaaaaaaaaatccaaaaatgaagtttgaaaatcttaaattgactacggcgccggatctgctacaccccaaaatcctgtggtgcacatgaacccaagagagtctcgaaccggcgaaaagtcaaaaattctctcgcggaatcggatagaaaccgaaggggcggcacggcgtcaacgcgtggcgcgagggggatattcgggtggcgacgatgaggtagacaacgcgcgtggggcgccgacgncggcgtcagcacgcggcgtggtcggctggagattacgatggctaaacatggtttttattaggggagattattattattattatcagtggaagccaaggaaatgatcccatcaatcgactcgtacacccaatcacagtccgagatttatatcgttagctgaccaagaacgggtagtcaagttgcgttgatttttttctgttatttaggtgcagctctttttattattattattttagattttcatttcaagcttgccaaccttgtaaaaagttaattcttcgtttatatattttctgtataaaattatctggaaatttttttgaataatatctttttagttttgtaaaagttacttcatacggtcatataataacccatcaattattcataaatttcaactatatcaaacttgtagtacaacgatatgatacgagtttatatcgatcagaaatgcaactgtcatagctagcagaggggcagagacaaaaatagnnnnnnnnnnnnnnnnnnnnnnnnnnnnnnnnnnncaaacacaagnttcattgacac

SEQ ID NO: 62467 - DNA, 598 bp, Oryza sativa
cctagttgacacccaccaagtttagggaccacccgtgcactttactctttgttgagttccttttgttcgagctatatagacttgatataccctgtctttgcccttttatttcgtagtaggtcataactaaacctattgaagctgctgtccttttattttatagcttatgtaaaagagcagtgctgttcttttgacttgaacagtaaagatgttaacaagtttgtcttcttacaggatctgaggcaatgtttgctgatttatgctatttctctgtcaaatctgttcaggtagtcctttctgttgttttaagagtcaatgttgcacttcatatccttgtacttactatgtctaatgtgttgcagcttacctttgtgtttcttgttcttccatgcctgctactgggttacctagggcaagctgcatttcttatggaaaatctaacagaaaatcagcaggtcttctttttatctatcccgagtaagataaactggttcatctatgtacctcttttaaatctgattttctgatgctatggattgttttcacacaaaatgaaatggaatctattatcccctaaattctaaatactttcattccg

SEQ ID NO: 62468 - DNA, 856 bp, Oryza sativa
tcaaaaaagaattattccttttcaggttataagttattttgactttggtcaaaataaaactcaagtttgtagaaaaaatagtaacatttttaaaccaagacaaatttattatgaaaatatatttaattattgatttgatgaaactaatttagtattaaaatattattatattttttatagaaacttagttaaacttgatcaaagttaaaacgacttataacctaaaataaatggagtaaactttagaaatgaatctgaatacacgtgttcatgtttaactctagagtttgactttttttttacggggagaattctcctttgcaatagcacaagcacggcaccggccgttcagcagaggagcaggtgcactaccatgcccctttccctgtgtgtacagtacaagtatacaggaagcaacccatcgataaaatggaaagcgaggttcagaaaacccctcgcctccaaaaataaaccaaacgaatcccgaccccttctccgcctcttcttcctcctcccctcccctcccctcccctccttccctttcctttctctcctctccaatcgccatacttcccgcttcccgctttgaccgcctccccttcccccatatcatctccccttcctctcctccacttcccgcccgcgcgattcacccaagagagatgtcaatgtggcgcttctcccgctccctcctccgcgccgccgccaccaccaccaccgccaccgcggcgtgtgcctccgcgtccacggcggggaagcatgccgcgtcgcggagtgggtgacgccgcgtgagctccagaggtgctggtacgcgttgctcccggcggcggcggcggccgggcccgggaaggacggg

SEQ ID NO: 62469 - DNA, 730 bp, Oryza sativa
  unsure (1)..(730): unsure at all n locations
gccgcttttgattgatacaatcnnnnnnnnnnnnnnnnnnnnnnnnnnnnnnnnnnnnnnnnnnnnnnnnnnnnnnnnnnnnnnnnttcgcttggctaatcactagccaactgcaccagcgcgacagatgcaaaactagttcacgccaaaattggaagtttggttgaaattggaacgatgcgatggaaaagttaaaagtttatgtgtgtaggaaagtttcgatgtgatagaaaagttggaagtttaaagaaaaagtttggaactaaacaaggcctaaacagggtacaggggtggggacttgggtgtgttgtggtggttaccttccgggttccggcgcatctcgacggcggcggcggaagactgcatcacccgcggtgagcactcatcgccgacggatctcactgaattcgcgctccccaactctacactctggtggaccgatttcatggttctaaccctggctagagattgggccacgtggcgccctgaaaatcaagtttgcctccctgcgaatttgccacgtgtctccttggctctcctcccgcattgtttgatcgagtatcgacggctaaaggctacagctcgctgtggtggtctggtggacctcgttagaaaactggaattttttttccatgaaagtgctccatcccttatccacccatctttcttccggacgcacgcaccgncgtccnncccgncgccaaccggattcttcaccaccttgcgcgcg

SEQ ID NO: 62470 - DNA, 9945 bp, Oryza sativa
cggaagaagccaagcagggtattccgcttgccaaccttgaaggccttaaaccgaaacctcgggaacggcaaggtaatcccttccccgaccttctgcgcgcgtgcgaggaggccgaacccgccagaaccgccccaaggccgcggccttcgccggccccctcaacaggccggcgtcgtcctgttcttcccgaacaaggtttacctccaccccaacagggtcagctcacccccctccccaacttacttgtttttttttccaaaattttttctctttctttttttggatttgtggcgtcgcccctcggcgattcgtgggacttggccgattcgaagtttggtgtgttcggccgacagcccatgttagcttcctgatcgattagatttcgtttttgttttttcggtgcaacccagagatttgtttggcgcatccccaattcggccggagaagcatatggtccactaggaacagatcactccgcggttaacggctaaagtacagatccttggccccctggtactgaatttgtgatgttgatatgcaacatttggtagatctcccgcgagcagaagtgcacttaaccatcggtggtccaatgctgcatgcatctcatgcaaactctggcccaagtttgacgccctaattttagtgggttttgcctaatggcatccaaatcgctctaatgagtaattaccccccatatttttaacaatttaatccatccatccatcttcagctttgttgtgtagtaccgtttaactgctgatgggaactgaccaaccatcgtggggactggccgtactgtttggacctcttggcaaatccacctgttgcaggaaaaggaaaggtctcgcttgcttctggacgcggttccaagtggtggcatctggtggctcactgcgtgcgtgcaagatgcaccgcgcaggtgtgcgcacgcggaccgcaccggtgtaaaagccgtcctcgtttcttcgatggagaggaattcttccgattaagtgtgctgataaagaatctattgaatgcttttctcttctacctttctttcctttgccctttcggtgtcatatgggatggtcgatggtgggtcactggctcattgccgtgtagaggctgatgcatattcattacagtgctttctagtcttgggctcttggcctctcgggtccctgttagttaattactgacttgttagtagaagtagatgagtgcctgctgggtctgactaggtttatccaacagttcttttcattatcatgtagtatgagacaaccaatctatcatgcataacacttgtttgatagcaagccccatttcttggtaatgagcaaactgattcactaaaaggtacttcctccgtttcaaaatataagactttctagcattatctacattcatatagatgttaatgaacctaagcgtatatgtgtgtctagattcattaacatttatatgaatgtgggtaatgctagaaaatcttacaatatgaaacggagtgagtaaattgttcgtctgtgcagtattctgtgttgtgtctagttgtgataagtatgaattagtttttacgattttgcatcaaatctatcagtgcaggctttaggtttgcagaagttctctacgcggttttactctaaacagcaagcaactttatctgatatttaactttgcattaacttgctagcaaaataataataataataataataataataataataaagaaacttagcactaactagttccttttgtttgtttcttatagatcgtggatcttgtaagaaaagctatgccactcgcgctgacacctgaggatgatccaagaaaggaagaactcaagaagctgcagacacagttggaagatataaacaagctcgcacacaagcaagttcgtagaatcctctggtctgggctagggttcttgatcacacaggttgggctctttttcaggctcaccttctgggagttctcgtgggatgtcatggaacccatcaccttcttcaccaccacgacaggcctggttgtagggtatgcctacttcctcatcacatcaagggatccaacttaccgagacttcatggagaggctgtttgagtctcggcagaagaagctgattcagaggcagaacttcaacctggataggtacctggagctccagaggcgctgtaaaggtcctttggagaagatgtgtggcacaaaccaaactcccaaccctgacatggctcaccttcacgagttgtccgttaacaaatgacaaccttcgctcaaacactaatctaccattgcttcttttcttgttcaattttcttggagtaatgatcaagaaaatactagcaaagctgatattttgcattgccgaggtggacatatttcttttgcgaccctttttatggtcttccattatgcaaatgtgtaggtttaatagctactataatccttttttgtaacaatgctgaagcacaagcacatgatagttggaaggaaagctttacatgtatgatcatatgaccagaagctttaccgagagctgtgtatctctgcagccactgctaatctactgtgcaatgtggacagattcattagctttatggtctttttggtcgatttcgaatacttgccatatattttctgtattgtgcctgatctgctagtgtgtgatggtgattactgttcaaaacaggacagaacgataccagggcattctgatggtgtgtttgatctcccatgagttgtaaactaccgtgacattaccatacaaatgcaccttttgaaaccaaagcaagagagaactgcgattcatttcaagagaatgcaccggccggtcctgaaggagaactccacaaatgggaaaaagaaaaagaaaagaaaatgagaactccacaaatggtcaaccagtctacatgcataagctgaaaataaaatagtctgatcgcaatcaggctgagattcattttctaatgaagggccttgcagttttgagccgatggttccatgtgatgaaagcaatggtccaaaagcagacagggtcgtcgagcctgaaacccgatgcccgcgcacggcggatgatccgctccgccacccacaattcttgaatataatgccggcgccggcgaggcgtaggccagcatgtcccgcgcctccacggctctagcctctagctctactgaggccgagtttagctccaaactttttcttcaaacttccaattttttttatcgcatcaaaacttttctacacacaaactttcaactttttcatcacatcgttacaatttcaaccaaactttcaattttaacgtgaactaaacacaccctgagactgagttcagaactccacctccccgtactgaaaatggtgttacccattaacacatttaattaagcattaacctaataaacttaaaaatagattaatataatttttttaaagcaactttactataatttttttttaaaaaaaacacaccgtttagcaatttgaaatgtatgtgcggaaaaataagaggtgagttagaaaagaatagggaagaactcagtctgagccgcctggccaggtgacccaagttgacatcagtttttggtttaagtcaagatacttaccctgtttgcgcacgaagatgcctggcatgatacggcggccgctgctgctaagcgggacgtcgctttcttggaatcaagatggcaagattcaggaatcaagaattccagatcgctgtgcctgtttctgcttggatttgtctgatagcgaccttcgtgtaatcgcattggattatgtttggctgtttgagtttgactgagatatgctcgagataatcaattttgcgctttctgcccactgctgtttggaacttcgtggtatgcttagaaaaaacaggggacgacgctcaaatgtgcaacacgtttaaaacatatcggttcctgaagactgcctttgggtgttttgggtggatcagatactcgaagttgactggccgaagttgtgttccaacagttacaaagaaaagagtacaagaacaggtcgtccttaaactgggaggcctgtgtgaaatttaaaccgagccctatttaagtggcaaaaataaatgataataattcatatgaattcatgatatattttatagcaacgtaaaatagaacaatattttacgatgcactgttgcacttatcaatccatactattttaaaagactttaatggtagtgaactgccaccaccatcctatcgtcgacgtgtgggtcctaattatcggtgtgtagcatgtgccctttagattcaaaaactgccttctgtctctcatgggaaccagtttctctgacgttactgcacagcgtgacatgaacactaacatgtgggatccattatctatggatccacatgtcagccaccaaatctctctaacatgtcagaggatctctctcctccctcgcgtaccttgctcacatttgtccgctcacagactgacaatggtaggcttaaggctagcagctagtccccttgctgaatgattttgttataggcactaatgttccaatcactctgtaccaaaatatatcatagccgaataaatattatttataaaatcaatttattttgaaagaccttagtacacattttctccatactcgagacaatcaaagtctacacagacgattgtagcactataatcatcggcaaggcaatcaactttattataatcaggagcctctaaagtgcaatgttcagtgacaaattgtcttcactgcgatatactgacaataatccgtcgcaacttatgtgtattcagctagtatctaataatttagtaacactaaagtattaaacgaaattaaaaacaaaggtggcgcttgccgctggcggccttgcgtgagtcgtattctccgtggtctatgcagtcacacggcactacatgacaacgtcatggagtatatgtagaaacaatcagatatggactggagcaggctgctattgcaaccagtctttaccttcgaatcataggttagtgacttaggccgagtttagttgcaaacttttttttttaactttcaacttttccatcacatcaaaactttcctacacacaaacttccaacttttctatcgcatcgttccaatttcaaccaaactttcaattttgacgtgaactaaacacacccttatcttttttgcaacacttcatctaacccggcgattccggcggcggccggtaggatgacaacaatagcagtggaggggccgagacaaatgtagtggtacacacgaattgtagcgatatttttttcaatttgataaagttttaatgatatgaatctaattaacccttaaatcatatatgtatggagcagaatacatattataaaaaatgtgtaatcttcttgctaagtacattttatttctaagttaacacaaactatgggattgccccacggcaccacgtgagctagataattcgagcccatttgataaggctccaacttctaaatttaacttcaggaatagggtctaaagtaaagttgcgaagaaacctaaattcagctccatctatctagtttattttgttagagcacttcagctagctccacttccttcttcggtgaagctaaacggttgggttccagctctaggagagatggagttgaaactagacccatgccaaacaagccttagatttaatatacaactctgaaattttatttctactagaaaaaatgctcgtgcgttgcaataggtgaagtctattttaatcttattattgttatatggtttagttaagatgaaattcactgtgggagtttgcttggatatatatatttttagaaaatcatgagctacagttaggagtccgatcgtctcaagttagcattcgagttttttttaaacagatttcttatatgattccttctgtattaccaaaagtgaatgatcttaaaaaccgacttaaatacggatatgtatttccaaaagcaaacgaacttaaaaacctaaacgaattaaaaaaccgactcatacacggatgatgtaccaaaataccggcaaaaacatcttcaatttttataatagtaaagatatagaaatcattatatgtagaaatatatttggatttcatatacaactattagcttctatttctatagacatagatttcatattaaacttttaacttctatttctgtagatataattgtattttatatacaattatattgtattttatatacaattatatcaagcaatccataccgttacaatccggacccaccatgatttaacgattaagatctttttttcttcgattaatgtggaaatatgtagtaaccacaatgaatatgatgcgctctttcaaagctgttttaataattcaacaaggaacttgagcaagagaacatctcaatattagctagcttgccagcacaaagaaaaaaaaaagaagatttagccaatcccagttctctgatctctcaaagcagtgagatcaccattttcatcttatcagtcatcaggtctatcatctcgacctcctcagcgcgataaagaacttttcagtgcaccaaattaaaaatgatttgtaaaggtaatattggtgggaaataaaccaatttcgatctaaatatcatgttgtttcttgtggtccaaagcaccgagcaaatatcagctaacaaagcggtaaaaaaaactctgatttttgaatggttagtgtttttggttggcataaaaaactcacggaaatccctgggattgatgcccattagctgggtggcccgcccaattgcgcggctaacacccaaacaaaatcatatatttttttaagtatgattttacttaaaatttattaaatagctatctcattgtcttaagactttgagagaccaaaccttatcatcctcgtgtttctaattatatagttcttaaaagtcacaccagttgctaccccttatgtcatctcctttatttgcttgctcgatctaccactatttttattcattctttttggaacctttaaaaattggattttatagtttttagagtttattgtcacgttgtgtttcatttttataatttctagatgtcccgtcaaacgttgccattatactcctctacgggctgtccactgtctcttctctttattgttattgagattttaaaaatcgaacataattatcgtttgggttcatttttactttctagaagtcctgccaaaccgtcagtagctttgccattgtactcctctacggctcgcccgctgtctaccttctttattgtcattgagattttaaaatcgaatatgattatcattgttttttttactttttagaagttctgaacctttaaaagttggacttgtagtttcattttttataatttttagaagtcctatcaaatgatgccactatgcccctctacagcatgttcgccgcctacttctttattgttattgtgattctaaaaatggaatataactatcgttgaaatttattttttattttctagaagtcccgtcaaccgtcggtggctctgcaactatactcttatacaccccgctcgctgcttctcctttttattgtcattgagattttaaaaatcgaatacgattatcaatgcggtttgtttttttactgtctaagaagtctcggcaaccgccttactcatttgcttcacggcctgcctgacgtctcttctttttaatcgtcattaggattctatttgatgttttattaacaatttttatatgtcgtatcaaccgccaccactccactcctttataggcctgttacttaatttatctcgtcatatgttttagatggtcttttctttcaataatctttatttttatcaaaaatttttagttatttataaattgtattcctaattgaaatcttatttttctttttctaatttcagtatttttttaaaaaaattagttaataccaatatgttcttttaatgtttttattttttattttcaatttcagttgtttcaaaattatattcctaattgaactctcttttaatttttccaattttagatattatttttatttttattctaaattttaattaatctcgtattgggttgttacgtagatttttcgttcaatattgcttatttttaattccgaatttaaactaattttaaattgtattcctacttgaactcttattttattttcttttgctaattttggatttatttatttttattccaaattttaattaatctcgtattgggttcttatatgaaactcttcttttaatatttcttatttttaatacctaatttcatctatttttaaattgtattcctacttggactctcatttccttttctaattttggattttattttatttttatttcgaattttgattaatttcgtattgggttcttatatggaaacttctttcaatattacttatttttaattccgaatttcagctatttttaaattgtattcctacttggactcccctttccttttctaattttggattttattttatttttatttcgaattttgattaatctcgtattgggttcttacatggaaacttctttcaacattgcttatttttaattccgaattttacctatttttaaattgtatttctacttggactctcttttttttttcctaattttggattttattttatttttatttcgaattttgattaatctcgtattgggttcttatatggaaacttctttcaatattgcttatttttaattttgaatttcagctatttttagattgtatttctacttggactctccttttctttttttttctttttctctgattaatgtgggaatttctagccccaacagcgaacgtggtgcctccttttctaaattttaattaatctcgtattgggttcttacgtggattcttcgttcaatattgcttatttttaattccgaatttcaactaattttaaattgtattcctacttgaactcttattttattttcttttgctaacttcggatttatttatttttattccaaattttaattaatctcgtattgggttcttatatgaactcttcttttaatattccttatttttaataccgaatttcagctatttttaaattgtattcctacttgtactctcatttccttttctaattttggattttattttatttttattttgaattttgattaatctcgtattgggttattatatggaaacttctttcaatattgcttatttttaattccgaatttcagctattttaaattgtattcctacttggactctcctttccttttataattttggattttattttatttttatttcgaattttgattaatctcgtattaggttcttatatggaaacttatttcaatattgcttatttttaattccgaatttcagctatttttagattgtatttctacttggactctccttttcttttttttttgtctgattaatgtggaaattttttgctcccacagcgaacgtggtgcctcctttcaaagctgttttaataactatttttagattgtatttctacttggactctcattttcttttttttttctttttctccgattaatgtgggaattattagcccccacagcgaacgtggtgcctcctttcaaagctgttttaataatataatagatagatagattaatacctgaagatgttgtccctaaaattcaaaaagcaaaaagatagagaagaagatatggtacatttatggattcctaagtaaccctgcagatgaggtacctctaccttttcgatcaaaggcttcgttcgagaagacagattggctaatctttttcgccgcatgcaaaacgagaataatcattagcatgactaattaagtgttaactattataaacttaaaaatatttttttcaaaaagagaacttttaaaatatacaattttgcacagaatatattgtttggcaatttgggaagcatatgctaatga

SEQ ID NO: 62471 - DNA, 851 bp, Oryza sativa
  unsure (1)..(851): unsure at all n locations
cgcgtgttgagaatcctagtgnnnnnnnnnnnnnnnnnnnnnnnnnnnnnnnnnnnnnnnnnnnnnnnnnnnnntggtgtatgacatcctccagaactgacgtggtgacggactcaacagcagtcgccttctcctcaacttgatgctccatgcgccagaacacatgaacgcgtggatcgtacatcacgcagctgtggccgatggcggcagcgaggcagtgttcgtcgtccggtggcgaagagagcgtcgcggccaccatgtccgtgagcgtctcgacgtcagcgaggggtaatttctcgtcgccgcggaggctgaggagcgcatagtccagggtgcggtagaagcagacgaagacccagccaccgtcgtaggcgccgaagtagcgcgcggcgcgtgcgtcggccgggagcgggtggccgaagccgtgggtggcgcagccggctagggcgcacgcgaaggacgtcctgtatgcgcgccggacgagtatcgacgggagcggcctcgtccccggcggcggctgcggctgcggcgcgacggcgacgcgccagttgtggcagactcgggccatgcggcggcggtcgacgaggcacgggaggcgcttgtggacgaggcggaggacgtcggcgttgaggtagaaccatggcgcgtccattggagagggctcgagaggcggaggcgcggcttgccggtggcgaggtgtgtgtgtgtggggaatgggttcctctgcttctggaaggaatttttttcggatttagatttttttttaaatatttacagaaataatctatcgnnnnnnnnnnnnnnnnnnnnnnnnnnnnggcgtntgaaacacgcgttcacctggacatgcg

SEQ ID NO: 62472 - DNA, 730 bp, Oryza sativa
  unsure (1)..(730): unsure at all n locations
cgcgcntttgtagacccngatatatcnnnnnnnnnnnnnnnnnnnnnnnnnnnnnnnnnnnnnnnnnnnnnnnnnnnnnnnnnnnnnnttcacatcaaaattaaaagtttagttgaaattgaaacgatgtaacggaaaagttaaaagtttgtgtgtagaaaagttttgatgtgattgaaaagttagaagtttgaagaaaaaatttataactaaggttgtgtttagttcctgaaattaggtagaagtttaaagttgagagtttatgtgtgtagaaaattttgaatataatgtgatgtgatggaaagttagaagttgagagaagtttggtgtgtaactaaacagggcctaaactcggccacagttacgggagtggagcgaggcgagtcgtgtcgaccgttggtatagcgctcgtgattcttggtgggacgacgacgatgagcgagcgagagagcgggcgggcgcacgggtccccatgggcaaatgcagtgccggcgccgcatgtggagaggagcctctggtggcgctgtccttcctgcgtgcggcagcagcagctgcttcctgcaaacggcagcctctgcggctctgacccacgcccgataaaagcgaggggaaagttgacgtgtgacgtttcactaccttggctcacttgcctacacgccccccttcttttccgcccattcaaccctccccctctacgagtagtatgccgtcaatataaagtttattgcca

SEQ ID NO: 62473 - DNA, 725 bp, Oryza sativa
  unsure (1)..(725): unsure at all n locations
tgagcacgaacgacgcgcatatcgctccggtgaactgcgccgcccagtagaacggaacctgtgtaagggagaaaaaaaataggttgaaaagatgtttcatttcaacgctttaaccctgcacctctagctggagatcgatctagagcagtcgcagtagtatctaactgcacattgcgagatgtctctgttgaagccgggacgaatcggaaatncggggttnccggggttcaaaaggccctcacnncgggtggtggtgttgctaaggtgaactatactnangatagagtatgatagcggactaatagcgagaatagcggcaactagcttagccccggattcggtgccgatcgatcggacgacggcgccacaggcgatcgatttccggcggatccctatcgatcgaccgaatatatggcacatgaaccaccacgcacgccaccgcctttacatgaattcttgcgtcgcgaccggttctcctgtactgtatcgctacggacacttgtccctgctagctttacgtgcagtggcaacaaaaaagcctcgaccacgatcatactcttgtcttctactagcagcagcagcagaagtgccctgtggattgcgatgtaaaaatagactatatggaatgtgatccgtggcaactaactcagcgtatcccagcttagtggcttcatctttaatttggctgtgctggggttttgacgcgtgattgctcgtgttcaatt

SEQ ID NO: 62474 - DNA, 16586 bp, Oryza sativa
aatcttgccatgttctttgcaccagagacaaaaatactactaaatctggactttgacccactaatgctgatatttttgccgatatgtgtacttcacattctttctttatgcgttcgtatagatttgcgcctagcttgtgtagacaaaggtcacctgcagcctatagtgaagaaaacaagttctaaataactaaagtgggatcatcaaatagaatagaagcaatataaaaattacctggtaaagtttttcaacatcgcacgaaagtttctgttttagaaatatagctgtaatagcatctttcaaaatagcccatgtatcctcctcaaagtttgttggcaattttggctgacctgatacatgaaaaacagatgggatataatgaacaaaacagaaaagggatgcaacaagagacgaattccggggtgggagtaaatctttagttcttgttcggcaaatgggttatgagaggtgggatcgggaaagggaaatgagtgaagggctacaatgaaatggagtggttagaatggatggctaggatgcagtgttgcattttttatgggtggatattatttcccaatctcatttgccaatcacgccaaagggttgcaaaaaatacatccagaagatcccaggggtctattatctaagaaagaacatatggccttctgaattttcttatacaggttactagttagttatggtgggtactgattagtgaatagtgactggtgcagggattattattatatatgactcagaaatgaatagatattaaaggttagagccactgcaacatccattgcacagaaacggattttcagctttctcctgaagactagagaaggtcacatactggagatgcgaagcaaagcttccaataaataccgacagttacacccaataaagagacaaaagagtgtcaacttttaagcaatctagctagaagccagctcatatggtgcaatacgaccaaatggggagcaggaagtcagaagaaccatacaactatgcccaagctcacttgtcaactgcattaaaaaaggcagaaatccttgatgcatattcacgcccaacaaagcaagccaagataaacaagcaattacaaggaattgaacatacatatatatctcaagagaaactagacggattgttgctgacgaaatcattagttaccctagcaattatcaatttcccccaaaatagtccaagtgtctagccaaattcctctttacaaatagacacgccaattagtaaatagaaaacagaagtgtgtgacgaagcgatccatttgacgaaagggctaacgaacaccacctcaatccctccctattattggaatttaagttaacgacgcaagcgggcaagtgaacacactgagaggaacaatagaattcccctcaatttacccccgaaacccctcgatgatgtattctcacatggaaaacgtgcaattacagtgaaagagagggacctattttgattcggaggggcttgcgggcggcggatggctgggggagtgtggccttcttccggaagaggttggcggcgacccccgccggggccgatgcgctcggagcggcgagctcctcctggtcggcgagcaccatctccgcatcctcctcgccgttggtgcgcccaccggtccgggcggcggcggccgtgggatcgacgtggagcccgttcttctcggtgaccccgggggcggcggcggaggaggaggaggaggaggagccggggaacttggccttcttcatgtgcggctgcgcgggggaggtcggggaggaggcggcggcggaggaggaggagaagtggccggggcgcttgggggcggtggcgtgggggtgagacatgaatcagatgccgaagcgcatggcgcggccgcaccggcggcggcggcgaggcccggggtaggatgggtggtaggtggcggcgcgccggggttttgggggtgaggccgccgcacgccggcgaggaggaggtgggggagtggagactagagagagagagatcgggttgggggaggaagggtttccccttttcttttcttttttttcttttttttcctttttctttttcttttttttattttttattaggtgggatttgcgaggccgtagcggcccaaattaagagtgagaatgtgggcctggagttccacgcggcccagtttccttttgttctcattagcccaattctgttgccgccgccttgccctcgccgcctctgccttctgtcgagaactcgagatcgagaattcgagatatccacgcgcagtcagatatggagaactataatcttcatccctttgacgggatcttctttcgtttgttcaaaaaattcatccaaacggttataaaaaaattagcaacacttgtactacatgcctactgtacaacctcacaaaatctcacgtacagactcaactcacgcatcgaaatgttaaaaaaaaaactcaactcacgcatcaaaatgttaaaaaaaaaagacaaattcaggtatgactaatagctattgtttacatctgatcgaatttaaacttaatttttatacccatagacaccgttatgtatgttgttaattccttttagaattttttgtaactatctacattaaatttggaagagagaagagaaagatataaattaagttgtgttcagggattagaatccattcacacgcaaataccctacctgtcttcgtcgtctttctgtctgattcgccggattcgcgatcattgcctcagcctttggtacagggaaggaatgcacccacagaagttacaaaaaggttcaggcagaagaataatacaaaatgaaacccgtccaatttaagcgcacaaaaaaaaaacaattgcattgcatcccatagtcttcacccgtttcctcaccatttctcgctcagcaggcacactgaataagcttggccagaagcgcaaaatatgacaacagatttttcgcgatcaaaattcattgctaaaaaccgtttagcaacacagctgatagatatacccatcagtcacaccctcaagaaaagtgaagcattacaaacatggaagaattgagtggtgaaagcgaaacgtgctcaggttcagtgacaattaaggttcggttgccaatccaacatcgccgtttttttggcgctttgttgaaggttcatcctcttcattcgttgcatctcctccggtttctgtcgttggattatttggctcggccaccttttcatcttcggtgctggcagcaccgttgataacacggttgacaacgtctggacctaacagagaagcatgtttacttgtaatcttccgaccagctctgattttgggaccccaatgacgttctgggttcggaaggaaccgcttgaccttctttgcttgagccctgctgagggcagcagccgctctagagaaatttgcctatgaaaacacaaaggaagttagaatgccatctaactgaaaggcataaaaggactgctgcacgttcaagaaatgcatacttcaagcttgggtgattttgaaaggatcgctgtccctacagagtcatgtggttgttcctttacaggatgattcttcacctgtatgcgaatgtcacaatattagtcagaatactaaaaaaaaacagcatttctagtaaactacccacaatttatactagcaaacacaatatgttaggaaagttatggcaaaaggaataaatgaatgtacccagcagcgcatgatgtcccaaataacatcccaaggggcatcagtttttagtccaagtggattcacatgtgtgctagaaatccgataacccgcatttaggactgcagatcggaacaatactgcagatggagatgtgcatttaacattagcacatatgttgtggagactgaagaacaatgggatgtcatgtaactcctgcatcacaataataacaaaatgaagtttaaagaaaattttaaagagttcgtaaactataaataatttctcaagagtaaatgagtgagccatgacaaacaaatgcagaactagatggccaactaatttattacttgtacatggtttaactaaattactgcacatttgggcaataattttcctgttgaagtgctttacatatctatgttctagtgagaaatggattaccaaaaagtcgtattcctttctgccattatttatttccatcagttgcatgccatgattaacaggtccacatatcgaggttgtattgataaaatggattagcaaaagtcgtattcctagccaccattatttattctcttcagttgcatgcaaatcgtgctttaggtcaatattctaaaaagaaaattatttaatgtgatgttaagaataggcaacagtttcacttcatagcaaatgcaccaaaacaggccattttaacttcatcacaaatgcaccaacaatgacaacttgataaaacacagataacagtcatagcaatacctctgatatggtagtcagaactgaagttatcttatcatatgcaggatatctatccttcattgacttaacttctgtcaaagtagacactacccactcttggtcatgtataggagcagaccatattggccctcctatagtaaatttcttcccacaggcactgcactcttgaggaacaacaggcccaatggcaggcgcattcttcacactgttgttcttcagttcggagaggacgcacaaggaaaagggaaagcttcagactcagcacagatagaattgaggttgtgtgtgtttgggggcttgggggggggggggcaagcataccttagttatggtcctaccaagacactgaagatgaaatgaatcgcaaccaacacattgatatacataagaaagcttttgaggagtcttctttacttcgtttgcagaactgcataagatttcattgtgtcaaatttagaaagaatatttcaaccaagtactgcacaaaagaacatagtcctgttgcataaaggaaaagatgaggggaaaaaggaactcacgtaaatactcggacaaaaacacggatgtagaaatccatagacacagagagaacaggcacaatatatcgtttgtatcgatttgcatgactctggtattgagaaatggaaaagataacaagaatcaagatacatgaaggatgaagcaatggaacttcagagtttatgggtcatttagcaaagcaaataattcaaacttaacacagttctcctgcgttttcgagaaaacttctaaaaacagattcttaaataggtattgaaatttgcacatcctttaataggaatatacttcatcttatgcagttttttaaaccaattatccagttatatattgatccaaactaataagttaactgagtgatataggtacctcaatactggcaaggaggattcgcaaagccatttcatggttatacttccctttggttggataggaaccatacctacaagaccgacttgatggttagaacaaaaaactagatttagatttttgcttcaaaccagtagtaatgtccatacttggagtggcaaacttcaccatttggcccacatagaaccgccatatcagtggcagtgcacattaatagcccaccatcagcaacagcctgtacagccgaatcaaggaaaatagaaggtgctccataggggtcaatatcaacctgaaaatgaggcaggtgtaagttgacatagaaagatacaaatggagtaactgtagtattcatcactttctaatgattaaaattcatttctttcaacttaataacatacaattgactgtttggcacaatcaacagtttgtcaataggggaaacaaatcgattaaaagggtaaagcatgaaaatctaccatttttatatagtaaaatgttgctaccaaaaacaatgctataaagatatcctcgtaactaccagaagagaaaggcttaccacatcaaactcttttggatgtgtgagcatataaactcgagcatcagtcaaatgaggctcgatcttactcatagcagaagcaccattaaactttatattccgcttgcaagcttcaatacaagctgaaaaggaagaacccacacagtataatgaatacaagcagagaagcatcattatttagaaaggaaaccagttcagaaaattgggccattacctttatcaatgtccagagcgaccaccttttctaacacgtctatttcacgagcataacggatagatctcaacccagaagcagccaaagcctgcatttagttttgttagccggtaaaaactgaaaaactattacatatcaggtcaggcaacattagtatggaaccgtaaaactgatgtaaacataacacagtaatgatttttttattgtcaaaactgcataacgtattatgacttgcagcacatagaaccaaatattatggtcctcaggttgcaaaatatcccagccctatttaaaattcgaacaatataacattcagagtacatatttaactaaaagtccaaactttcatgtcagagtgttttatgtatttttttaaatattgaattcttgattaagatgattaatttaactcttaattaatttgctaaaattaactgagatttgaacgaagggtggggctctatgaaacccgtagaccataaacctgggattatgtgccacaactcataatatccttgtttttctggaatgtcaaccattaaacctgcatttttttagatttactctatactattcatactatatgtctcacctcaagaacaactggtgccttaagctctctggctactttccgcgaaggtgtctttgttgcttctgttgacagatcttctgtttcatccgcaactttatttgtttccttttcagcatcaacatccatttcatcatgctgtcctgttgacccattctctccatttggaccagatgatttactctggctcactttgttatgcgccttgtccctcttatccatcattgccttatgttcttcctcacgcttggcaatgaaagtccttaaaagagcaactgacatatctctattgtggacctaatcaagcaataaaattgaattacagaaaagcacagtagctgataggagattagacataattttaggccaaatataattactctgcaacttttaaaagcgatagatacaggaaatattaactatgaataaactcatagtaatttgccgatgatatcacattcccataaccaccctttactcaattcctccatagcaaaagttcaggctgttagtgacttgaaaaagttatggctagagatactaattgttgagaatgcagcataaacaagcccgagtggctgttttgaagcttcacatatattctcctagcaactgcaagtctacaaccttaaactgattataacgtgtcgtgatgcgctaacacaaatgaccaacacaatgcaaacaagtcgtaaagaaaagcaaagcaactagtactctagtggctacaccagagaccactcacttgaaacgacccaatcacatacaaatcaaatagccaaaacccaaacttatagtcctacctatgcacgattggtgaagctcgcagctcacaccattcgatcaattcgaaacaaaccaaccactaatgatgcacgtattctaagaagatagaggagccgacaaatccatcatacagcatcaaataacccccaaaaaaatcgcatacagaacatatacacaacaatacctgcacgggattgtagaacacttcatttgctgctattttcttgttgatgatgatctccgcctcgccttccctcacaatctcatagtcctttagcttgttctccacatcctccatctctccgaatccaatccaatccaacaaaaacctcccgattcaagcgacctaacgagagacgcagaccgtaaagcataaggcgtgggcagagatagatgaggaaggaggagcgtgagaacggatgctcaccaccagatagacctctgatgcagcgggaggacgccggcgaagataggcggtgctcggcgcagaaggcggggcgagctcgcgaagaagagacggggaggggagtctatgccgaggcgacggcggcgtcgaactagggtatagggtagagaggaaggaaggagacaggatgggcccaattatgatgtgccgtgatcactatgggctttttgtatgaattaagttcactttaggtcccttcgtttatcgcctagtctaaaattcatcccacatgtcaatggtcagcactttcttcctcctctcttgccacctatcttcctctctctttccatcttcaggacgccgcctagcaagtggcgtggagagcgcgtggtggacgacgtggagaggggctgcgagagcgccacccctgctccaccttcctttctggcttgcacacgactggtgttcgactggtttgctatgataggctctcctagcttgcacttcgccccaatagcacggacatgttgccaaatgctataatcagcataaccagcaccccacacatacatcacacaatcaaagacgcgtactttttgggaataaatcagaaggatcactcggatcacaacgtttcaactagtagtaaacaagaggaggaggagagatataaaaggcacacctttaggacggaggttggccttattccctcgggacttgaacacggggcgatgattttgggaagcaagtctccgtgagcctgctaaagatggctagtccccagggccgctgctcgcgaggtggcggcggtggcggtggagaatgggcgaagcccgatcaaatctattacttgataaatagctatgcaaggacaaagagagagaggagaagcatgacgtgtggcgcctcggaggagaaccccccaccgtcaccgaagtcatcgaggatagtggcaatataatacggctcgtcggagagcttcgaggaacaccatgggggaaaagatcctacaaggtttgggtggtctagggtttttttggaagagtgagaagaaaaatgagctaaagtgggggcagcctgcgcccctatcctggcaatcgccaccaccaccaccgccgtatctactagcctgcgcggtcacctcgctctagctgttcctctccgctcctcctacccctcggacggatgccttggggctcgggcttagggctgtcaacgagccgagctcgagcgagctcgtctgcccaagctcgagctcgaacgagctcgagccgagcttgtctaaaagctcaaaggtagaataggctcagctcgagctcggctcgagctcggctcgagctcgtgtacctgctggaactggtcgccgtggacctggagctgtgccttcagtgagtctatctcactgcataaaccctaaaccctacaacttttagacctattctacctttgagctcgttctacctattctaccataacctagagctcggctcgagccgagcctattctacctttgagcttttagacaagctcggctcgagctcggctaccgagctcggtcataagtagtataatatatattttaatgataattttttgataagtataattattttctagttaatcacactaataaaagagtagaaaatgattaaaataaatatattatgctaacacatgctaatttattgtgtaaatagatactaatatatatatatatttacctattagtttattatatcaataaggtgaacatgcaatatgaactataaatagtcaagctcggccaggctcggcaaaagctcgagctcggctcggtaaagctcgcgagcttttgctcaggctcgggttcggctcgtttgaagctcgagccgagctcgaatcgagcctaggacgagccaagctcgagctgctcgcgagcctcgagcttttttgacagccctcccgggctctcctcgagcgggggtcgctaccagcaccgttgttgagaggggagaaggacgaggaagagagggaagaggtggatgctgatacgtggggctcacaggggtcccacgttgacttagcatagctaattggagtcaaagcgccaagtaggacgaaatcaagaactatattgccttgggacgaaagttgatacggatttgcgagttcgggacggtctatacatgctactgtggtttaagacgaattttagtctgggcgacaaattaggggaccaaaagtgaacttatttctctttagccgtcagaattgactacggcccaatagacccaatagcccaacaggaaacacattctgaacagcccgttaacccctaacccttccacgctgtcttctccactcccaccgccggcctcccaacccgccgccggcgacgattccggcgagatacctggtcggcggacaccggctcccgcgggtacgagccttctctagacgggctgcgtctctgtccatctcttcttcttctccaacatgaggcccctcgcgatacggcggcgggaggcgcggctcctcccacccctcgccgtcctcgtccggtccatggcgtacgtggacgtgaagatgcgatggaagaaggacgcctccttcgacgccgtccccgtgctgtcccaggcgcgggacctccgcccgctcgtgtccctcgccggcctcctctcgccgtcgccgacccccgtctccgcggtctccaagcttcgcatcccgctcgaggtccccgaccgccgcgtcatctccttcctgcggcggttccccgccgccttcgtggagtccgtcgggccggagcacaaccacccctggttccgcctctcgggctccgccgccggcctcctgcaggaggagcgggaggtcttcgccgcgcggcgcgcggacatcacctcccgcctcggccgcctcctcctcatggccccgcgccgccgcctcccgctccgcgccgcgcagggcatgctctggcacctcggcctcccggaggactacttcagatgccgggactatgacatcgcgcaagacggattccggattctcaccattggagacagtgtttgccgtgaggaggaggaggatgatgggagggagcttgtgctcattgataatggggaacaccaagaaatgccaaaatcagtgctccaaatggatgccataaggagatttgggtccatggagacggtgccgatccccctcttccagtcaaaggggctccggctgaagcagaagatcgaggcatggctggaggggtttcagaagctgccttatgtctctccctatgaggatttcagcggcatttatcgcgacagcgatgtttcggagaagcgggtggtcggggtgcttcatgagcttcttagtctgttcgtgacatgctctgccgagaggaggcggttactttgcctcaggcagcacctggggctgccacagaagtttcaccgtgtgtttgagcggcatccgcatgttttctacttgttgttgaaggagaaaacatgctttgttgtcctcaaagaggcatacctggctcggggagacactgcaattgaagaacatcccatgctggtggtgcggaggaagtatgcagggttgatggaggagtcgcgggagatcataaggtgccggcggagtgggaaaccttttccgtcgaagcataaagatcatgagcagattgaggattctgagggtgcaaattctgctccaattttgtcatagaaagctagaactttgcctggtcagaaaaaatgagggcatatgcagtatgattttcgtgataataccaagggggattctactcttggaagtatatggctgcttgttaggaatatttgtgtagaaagacaggagggtgtacaaacaggttggtgactgatgaaattaaattgcattatcattttatctgatctctgcaagtcattttggtttgtgcacagtagtacgcactggcggcactgcaaagccacatttacatcaagcctttgtaaagtccaactatatcatttagccaccacttactcacaatcttttcatcaaatcattgcaaatctcaatcacctttcttaaaagggcatagattgctgaatttgattttgtccatactttttacatataaaattcaccaagtatgctgcaacttgttgctgatttgaattttaattgtcaatggctcctgtatttatgtccatgcttatgcctcatggttggtattgcacttttacagttgtcgtaactcagtatctccctttttatggcatggagataactggatgcactacatttccttaggctgaggtcttcacttcttggctggcaaatgttttatggtgtttgtttggttaatgtggtagagttacaaaacagataacatgatttccattgctggaaactttttgtgtaacattatgcgtgcaattgtcagtttccagaatgagaatcaagctttcgtttgcatgcaccagtggattatttaacttaaatttctctgttgaagtacttgtcctgttttaacatctacacaatcggatgaacattagttgtttatattgcgccttaactaatttagataatcctagcttttttgtttgtttgtttttgttttttttccttggcagggagatcatagtttgttttggtgctgtctgtcttggtagtaagcagtatgacaatcgatcaattgcgagaaattagatagttgtgattggcagatgccatagtcagggcattagctctttgtgctattctgtttgttgtgattgctgaattagatcaagaccacattcagttatgtcaaccagggaagagtgttcgttgttgtcaatgtttctgtaacttgattttcttgtataaattttctccaactactgattagcactctctccactcgcttgcaaaaggtacagtgtgagattttctgatatcacatcttctccttcacattttctaaatttaaagctaacaataatttcttcatttcttgcttttgcagagattagtatatcactattcccaaactggtgtctactctttaccgtctttcctggagaataattgctgcaagctttggaatgtgtagtttttttttcatcgagtaattcatccacattttcaaaagcgcggtgcttctcttctttgaactggattatcgagttagcttgtgaacttgtcagaatcttgtatacgttccaatcatgggacacagatctatgtgaaatcgtaaattctgaatgtacacatttccaagctatctcgacattttcactttgaaatcttaaaccaaatcatttgaccaacttcacaaaattctacagaaaagataggagaatttgcacgccttcatagatgggccgatagcccatctgtattgcagcccactacaccggaaaaaagaaagaaaagaaaaaaaaaagaatggaaaggcaacaccgcctatccctccatttcccaaggcggcaacgcgcgtcgcacgccacgcggcaccatttcgcttcgccttccccggcaaaatctccccaaaaaaattcgaaaccgcgccgacgcctccgcttcacgaaaccccaaccggcgacgcggcgcgctcgctccgacgaccatgtccttccccgacgaggaggaggacgaggccttcctcctcgccgtagcggccacggaggaagcggcgctggcctcctccgactcctccaagcgccgccgcctctccatgacctcgtcgacctcctcgtcaccgacttcggccactcctccccccgccgccgtccccgaggggccctacctggccgcgctcaagggaagccacagctccgcctggaagcagcagcaggagacgctgagccaggcgcgcaagcgtcccggtgggtcccaaaccctagccaccccaggtagcggcagcggcagcggcggcgcgcaggtcgcgaggggcggcgcgtgcttcaagtgcggggactcttgccactgggcaagagaatgcccgcaatccgtgccagctactggcggcggaggaggaggcggggcctttggtggaagcggaggagggggtggtgggtatggggacgcgggtggggcggtggaggagaaggcttgcccctgcggcgccgggagttgcctagtgctcacatccaacacgcccaggaatccgggccgcaagttctacaggtgccccatgcgggtgagcattacgaatcccatcaccctgtactgtaattgggtagtatcgcttcaaatctatgtggtctgataacgatggttcgcaacacattggatcccacttaataaaaacatagagcctagacacacttgcaattatgtagaggggatatgagacctctagggggtttagtttttcatgatgttgtgccaaattgtcaaagtgataaactgattataccgttgccgttagtgaggcttgctggcttattggtcggtgttccccactctagtgatctttatttatcgtggcacatctgtatatgattgaaatcatactttaaaatatcttagcacacctcagacttctaatcagaatggtgatacatatttgcgatatgaaaccataaacatgataactattaaaaaaaccataaacatggtatgtgtctctgccttagtataatttcccattctgttgtcttaaggccagttcagcgtggtactgttgttttgtggagtgtaatctaattagagagaccggtcaaccaattgtactaggactagacaaatttcctgtgcaactgagtggagtttgattgtaatttattgaaagtagaattgtgtttgctatagaacacctgtttatttattctgaaaatacaattgtatatattatacagttaacatctgtagcagtgatctaatatatcatgtcaatctacaccattaatacagacccaccaagattagtagcataggtttttcttattttctatgattagcgtgtaaattctagccgctgagaatgaacgttgtggcttcttttgagttagttttaatagtataataactacctgggtcttatacagccagcttatatccatttactttatgttatatctattacgaattatagtcatacctagactgaatttgacatggactcttattcttagatctgaaaattcaattattttgaaattttatttttggcacgattcattttttttttcaacctaaactgttataatttggactaaccacaaaactaatggtgtatattttattccttttctcctatcaactgataagttttagaccttgagagcaagtgtatattatttgttactatttttatgagacaagcctgttgtgctctaaacaagaggttatgaatttgattgcatatcgaaggcagtaaacaaaaatgttgatctaaagccaccaggccattctaaaatactccctccatactcgtaaaggaagtcgtttaggacaatgtttaagtcaaaccttgggaatataaatcataaataactctcaagttattgagtttgaaaaggcaaaagttatatgaatagatttgtcttgaaaaatactttcataaaagtatacatatatcacttttaaataaatatttttatagaaataagaagtcaaagttgtgttttggagaccgtgtcgctgtcctaaacgacttcctttatgagtacggagggagtattgatttggagaggctatgaagttctgtttcaccaatcactacttgaccacattattactcgatcatctgtcttgatgggggaacttctattcagttggaacatgggatgcacatcagctccacatgcattcatgcataactactttgtatccttaatacgtaatcattgtttaatatttctgatgtgtatgcatgtaccgttgcacctccaaagccttacactgcatgatcatactctggtgttcatgtggctgatgccttgtgtaacctttggtagaatatgccagccaataaaggatttatgtcgtgtcggctgatacagtgtgcttggaattacatgtggttaatctaaaccggtcattttatttcttaggccagataactagttgtctagttactttttctcctttacttttttgcttttcctattttttttgatttatttcttttatgttatttttattgccattaggacaatggaggttgcaactactttgagtggtgtgataacccatctccaggtcctgcaaatgtcagtggcaatactgtttttcagtcagatacatcagttgcgcatatgctttgcccctgtggtgctggagcttgcttaattctcaccacaaagacaggaaagaatgttggaaggcagttttatcgttgcccagctaatcaggttcattcatgaccctgtttatcctcccaccctctctcttcctctcttctttcctcacccaacaaagcagggaaagttgttttactgtacaatattatgctgatatcccctataaaatgagttctggtactgtgttgattatctacagctgtctcattcttgctaaatgagtgcgtcatttgctaggcccagtatgattatcatcaataactatagtacctacagatggaagttactttagtgctttggattgtaccatgggaattttgaactgtttatcttgtgaataggaccaagatactgctcaccttatgttagtctagaagatgtggacagtatgatggttacagttgcacagcgcattcgtgaactaagattttttggatcagtt

SEQ ID NO: 62475 - DNA, 1096 bp, Oryza sativa
ttgtatttctacttggactctcattttcttttttttttctttttctccgattaatgtgggaattattagcccccacagcgaacgtggtgcctcctttcaaagctgttttaataatataatagatagatagattaatacctgaagatgttgtccctaaaattcaaaaagcaaaaagatagagaagaagatatggtacatttatggattcctaagtaaccctgcagatgaggtacctctaccttttcgatcaaaggcttcgttcgagaagacagattggctaatctttttcgccgcatgcaaaacgagaataatcattagcatgactaattaagtgttaactattataaacttaaaaatatttttttcaaaaagagaacttctatatatacaattttgcacagaatatattgtttggcaatttgggaagcatatgctaatgaaatacaagaaagatgtcgtttgtcgttttgatttgctgaaaagaactcatcctaagaaggtgcacaatatactttaaaattaacattcgaggcccaaccccaaaagggcaaaacctgcacctgaatacaacaaggttggaagtacaccctccgtagagagagagatatagctccaaacatttggatgtacaccctccgtaaaaaaaagagatttagagggagagatatccctccaaatattttttaaaaagaaaatgtgtgttttggggggagagatatccctccaaatattttttaaaaagaaaatgtgtgttttggagattgaacacatgattatagagttgaaaccacacatcttttaccatttcactatcaattgtatctcatcattgtttggatacacaggaagagggataaaagcagcatttgctagcataacaactttgagaatgttccctcgcgagtaacggtgaaatcacgttctacactatgggttgttttgtttttaagtcctatcaaatttttggttggattgtattgtttcaactctattgaattggcataatttggcctcaatccaaatagttagtaaatactattcaaaactatcaaataactggtagggcaagaattgaccacaatccaaacgacgtact

SEQ ID NO: 62476 - DNA, 17147 bp, Oryza sativa
cggcggtgaccagatcatggcgcttctcctcttggtggacggccgcatagggggatgacggcatgaggcgacctcctagacggcgcgctctccctcatccctctcctcgagtggttctgcctcgtcgtggggccacgcggtttcgaagtcgccgccgcggcctgcttctcccgcccgccgccattcccctcatcctcccactgctacgagccgccgccgccctcgcctgcccaccctcccgctgccacccacagccgccgcccgcgggctgccgcctctgccgctcggccgccgccgatgtctcgatgccgggcgccgggtggtgcgggtggtggtggtgcgagaggaacggcgacggcgtgacatggactccagcccgccgcttcagctccagcccacggtcgccgccgctccagctcccgcccgctcgctccccacggatggccgtaggggagagggagaaagaaagaaagaagggagggaaagaagaagaagaaagaaaaaagactgccatgtggggccacatgtcagtgggcccgacaattgtgtgcgtgaatgaaaaacgggccccactggtagcttttaatttgaaatgacacctaagcgccacgtcagcacacagactaggtcaataccggcacgtcagcgaaaccgccctccgaaaccaccgagggagtcaaattgcaccggttttcatactttgggggtcaagatatccggttttgtggtttagggtcacggattagatttcaatcacttttgagggtcaccaagtgaacttattcccaaagattaatggccttctctttttttagacaggctcttgaacgggacaggttgaaatggcccaagtatttgcttgccgctatctgatactctagcaattaggagggttcaggaatcaggacatagtttcctggtctctagcaagtcgtaaacagcagcttatccactgatttttgcactcctgataacgtgtctgtaatttcataccgcaatgaccttatctgattaccttatactatacaaaaccgcatatgtcctccatgacaggcagcctctctcggagcaacattgtcaacttcgtcagggaagaagattttgcttatgtgaaaaatcagggaactaatcaatgggaaattgtcaaaagatgtttatattattgctgtctagataagatattccctgctactctcttcgtcccattttaaatgcaaccatgatttttcgcgcataactttgatcgttcgtcttatttaaaaaacaatttaaaaaaaattaaaaacataagtcacgagtaaaacactattcgtgttttatcatctcataacaacaaaaatattaattataaaaaaattaaataagacgggcgatcaaagttggacacggaaattcatggctgcttttaaaatgggacggagagagtatatattagtaccagtgcaagcacttcaggttgcagcttagctaatcatacagcgcaccagccaaccacaaggagtactaagatatttgagaccatcagtccatcaccatatatttatttatctgttactacctgtacggctaaacgtgctatatatacaaacagtatggtggcccgcgtagattgtgcggctagcatcattatattttctctcaattaatagcatatatgttttctcattatattattaaaatatattacaatgacaacataattttaaattttgcaataactttacgaaaatattaatgtgtaatatttatattgtattttatatacgtgttagttattaattattttattaattatcaaattttagttatttgcaaattatatatattcctatatggacactagacttgtgttttaatatttgttttttttattctgaatttttattatttctaattatatttctatgtggactctaaactcatctttcaatattctttaatttttaatttcaaatttcagttacttctaaattgtattcctatattgactttaaactcttcttcccatgtttttcttaattttgaattttagttatttgtaaattgtatttttatacagactctaaactctacttttaattttattatgtttattacgaattttagttagtattaaattcatatatggactctatactctacttctaatattccttatttttttaattccgaatttctatttttttttcttaattgtatttctatatggactctatactctaattataatattctctatttttaattccgaatttcgattatttcctaattgtatttctatatgaactttgtactctagttctaatattccttatttttaattccaaaattcagttatttcctaattgtatttctatatggactctagtctactcttctaatattccttatttttttagttccgaatttcaactatttctaaattgtatttttatatggattctagtctcctattctaatattccttattttttaattccgaatttcaactatttctaaattttatttttatatggactctagtctcctcttctaatatttcttatttttttaattccgaatttcaacaatttctaaattgtatttctatatggactctagtctgctcttctaatattccttattttgcaattccgaatttctactatttctaaattgtatttctatatggactctgccttttccttttctccgattaatgtgagaatttctaggtcatgagagtgaacgtggaggctcctttttattccgatttttagttagttttaaattcctatatggactctgtacactacttctaatatttcttattttttaattttgaatttctattttttttcttaattgtatttctatatgaactatatactctacttctaaaattctttatttttaattccgaatttctattctttactaattgtattcctatataaactctagtctcctcttctaatattccttattttttaattccgaatttcagctatttctaaattgtatttctatatggactgtgtcttttctttttctttgattaatgtgagaatttctaggccatgagagcgaacgtgaagtctcttttttctattcctttaataatataatagatatgcgactgccttccattgctggacagccatcccgcgagttgaggaagaccaccctccaattctcaaatctcaaaaacctcggtctactcgatccactgatctactctatctaaccgaggaatgtttggcacaaattctgccgccattgtctcccacgtaacacttatgcaacgctcacgccatcctctccacacaaaaacacaatcctactatacatcccaacaacgtgtcgcacagtcgaccctagcgctaccagctcaagatcgaacatcatttttttatgatctgcataaactgtttgatcggcagagcatatatatgcatgcactagctagcacagtagtagcacacatcgtgctggacctccctctaagcatcgaagaaaaagcaacgtgccaccagccggccgtagatcgagccggagacgatcgagctggaaagcagcaccgatgatacgagaaggacggccgcgagatcgatcctcgatatgaagatcagcgtctggtcctgtaagaggaaaaaagatgcttcgttttacagactagggaccgtacggccggcgtcgtcgtcgttctcctcgatcaatcatctgcaattctccgccgctttacttccggttctcccgatcgatcgaactagaataatatgcctctctttttctcttttttttctgctcttccccactgctagccatgatcaggaccagcccatcaaaagcaccttataaccacgccgttctaattaattcggccccaaatatctgcaaaacgtggggggggacgacgatcaagaggaacagtacacgcgacggcgacgatgacgacgaagacggcagggacaaccctgcatgtaatgcatggccatgattgactttagaagcaagcaactgcacattggcatatggctgtgggcaacaaacaactggggctaccggaatcggggctcctccaggttcagagaacttctcccaaacagtgcaaggactaatggtcctccctcccttcctctttagaagcagtttagcgacggactgaacgaggtttgaccggtctaacccatcgataaattagccccgggagccatcatgcatgcacgcgtgcacacgggttaatacgattaaatgcagatgtatagtagtcctatcaccaagcacatgcgattgccttggggaaccacagacactgctttaattgattaagcagatcaagcaaggacgatcgtgtgcaatgcgaggagctgggtgcggccgaagcatgttgggttgttttttttcccttcccgacggatacatatatacatgttgtgttgttcgtttcctcttcctataaggacgcatacatatgttgcgtttttttttactgttgtcgatgtcgatacacggatgggctagcatctgcatcgaattccaccgggttcttctaccacgcagcaaaaaagcagctgatgggctcgtgcgacgcggtttccaccgggttggcttggcccagcagggagcatggcttctcgcctgggcctcggtctcggctacggatggtggaccagcgcttcgatccccaatcccaccccatcccaccaagcgccccacgtttttcctcctccatctcggcgtccgtcccgcggcgcgcggggcgtcgtggcggcgtgggcgacttggggcgaggatggccaagcccccgcgcttgctacccaccaccatcaccaacgttgcggtcgtcgcgacacgaggccgacccaccctacgctacgtcgctacacgggtagaagcaaaccgacagaaggaatgaacgacgcatcagccatccatgagcccatcacctactagctgagctttgtctccatcgatcgagccgtacgtaccaccctcctcagtacagtacagtacagtattattcccatcgagaacacgcgaagtggatcatcgcctacctatcggcgaaagcgagcgagcgagccacgccgatgctcatgcccatgccggcagccgcgcgcccagcgcggtagtgttcgttcacttcgtcgtcgtctctccagcgtgcgccgcggagtttggtgccacgaaaggatggggctcgcgcgcgcggttgactccaaatctatcatagagctagctaggctagcacagtagtagcacggtttcgatctcttgcttgcaccgcgatccgtctactgggatcttctacagggcagcgacgcggacgccactggacagaatgtacgcggctacagtgcacgttccatcgccacggcatctatccgcttgctgaacacgacggatcccagctactcgatcagggaccaacggccaacgggtgcggtttttgttttttttttctctgaagaaaaatgggtactagctttagtttgcgggtttcagtaggaacaatctttcgttccgggaaacaggcttcgatgggagctaatcttgggggagttttcacctgctccaggagcaaaatcccccgtttcatggatctagtagcaatgtgctacaaaccctactagcctacgattcgtaaacaaatacccgttggcttatgacaagctagagcatcacaaagctaacaataaagctaagtggtgggcagcagaacatttggaatctgggcgtacaaatgatatttgatcatctcctaaacaatatacaggccatgcatggccctttttctcttgagaaaacgcctcttctttctcgccattttttaactcgtttatcgtcgtagtggctctcatgttgggggcaccatatgcaagtgctcgtactcgtgcactttacagcgtctcgctggcccgtgcagtacatgctgtgctgggtaagtagggttttttcagccgataatggtacttggaattaattatgtgcacgtcgcgtaagcaggtccggtgggcccagggcatggaacctgttcaaagtttattcccacacagcaagagacaggataaaaggcttgcaattgcaagttttttaaggacagtatcaacaaaaatctgacatccggagcagcttttgtgggtattttaggagcacgctttagcattgttcatcgtccttttgctcttttgttaccgttaacaacaaagaggagccatgtggaggtaaaatgtgaaaggcaaaaacgcacaccacaactcttttttaaccgacaaattctgccattgaaaaaaagtttggaaccattaaacccatattacagctgaaccatccgacggtgaagcatgcacgcacgtgttggacagagtcagctttgagtgcttggatcaaagaagtgatcatcaaaaggttaacagaaaccgaaaaaaaatttctactccggttagaacagggtgatcctacaccgtccgtaaccgagatccaacggctgaaaataaatcttatgcttcgaaggagaaatcaaaaggttgcgacacaatggagctctttcttgtggcattcgttgtgctagactgccagtgcagcagacgatgatggcggggtgtggcatgcgcgggaacggaggcagcaggcgagcgtggccagggactttatcttcagctcgccctttttttagtcgccactaccaatcttcatgttccctgcctctttttacgatctactcctgctgttaaatatggccctgcgcactgttcaaagcacggcttcccgtgcagaaatggagaagtttgtggcaatttgtcgcacttggacttgtgtttttccctccaatggtaagctgggtgatctatctggtagccaggcaaaagaaaatgggaatagtatttgcgagcgttgaattaggtggagactagctagcatgtctgtgtttgcatttgcacgattagattatttgatctataacttagtatattgataaaaattactaaaatggagtactacttgatagaatgtttgtattggagtaaactttagcaaaagaaagatcagaattgaacattacgcaattcaatgatggaacaatcacaagcaacgccccctaactctgaattctaagcttttactaccgatgctacaatgtttaaatcgtggagtagtaatatcttttattttttccgtgatggctacaggattgaatttactctctggaaaatacacatgaaattccctcacttccaagttccaacttgtcctcagcaagctaccgcttgagctttcattgacttctatagctgcaagttattgccagtggaggagttgaaagatatggtggcgattggtccggatccgactaccgagttgccgtttcaggaatattcacatctacggtgcaggctagcactagcagattcctttctggatctgattttcgggacatttgtggtagttttgatggctcctttttcagattccgttaccgataacactcgagatttggcagaaacaaaaggcaaggacagggagctggcacgtcactgaccgccgtcccctatacggactgacgagcttctgtacgtacctcgaatccaataaaaacgggaattgattttgttcaccgagactttcagaggcgtaattcgattcaaagcgcccaatttacactccacgaagtcttaaagtctagcgccggaagcaatgtctctcatcactaaaaacaactgatcttaccagacaattcatatgcaaactccccccccccaccccctgagttagtcaaaaaaaaaaacaactgatctgaaattctgaatagtttgagccacagcgacaggaatgcatgacacagtcttgtaatttttgttcgtatttcctaacatggcgtggactattagtacgtcggtatggaccatgcatagtgtacgcaaataccgtatagtacttttcaatagtagtacaccacgcgaatcagccggcaaaagccctgtccgacccgggcgggggcgtatctatgtacgagccccatgaacaacagctcgatccatccacgcgcgcgtgacggctcggcggctgtcaccaacccggtcgccgggcggtctcgctcgatctgggttgggatacataccgcatacgggttgcagaacgcagatagtactaccagcacagcgcatcgcgatagataaaggcaagcaaacaagggatggtccaaaccgagctcgggccgcgctgccatctcgcctaaataaaaccgcgctacccatcgaccgatcctactcgcacgcgcacacacccaatcaaatgctcctcctccgccgcctcctctcgctgagctgagctgagctgtgaaatagtgccaccgagtgagcgctgagctgagctcgaagcaagagaggaagaggaggaggagggaagagggggggcgaagatgattacggcggcggacttctaccacgtgatgacggcgatggtgccgttgtacgtggcgatgatactggcgtacgggtcggtgaagtggtggcgcatcttcacgccggaccagtgctccgggatcaaccgcttcgtggcgctcttcgccgtgccgctgctgtcgttccacttcatctccaccaacaacccgtacacgatgaacctccggttcatcgccgccgacacgctgcagaagctgatggtgctggccatgctcacggcgtggagccacctcagccgccgggggagcctcgagtggaccatcacgctcttctccctctccacgctgcccaacacgctcgtcatggggatccctttgttaaagggcatgtacggggagttctccggcagcctcatggtgcagatcgtcgtgctgcagtgattctttgttacacgctcatgctcttcatgttcgagtaccgcggcgcccggatgctgatcaccgagcagttcccggacaccgccgccaacatcgcctccatcgtcgtcgacccggacgtcgtgtcgctggacggcaggagggacgccatcgagacggagacggaggtgaaggaggacggcaggatacacgtcaccgtgcgccgctccaacgcgtctcgctcggacatctactcccgccgctccatgggcttctccagcaccacgccgcggccgagcaacctcaccaacgccgagatctactcgctgcagtcgtcgcggaacccgacgccgaggggttcaagcttcaaccacaccgacttctactccatggtgggccgcagctccaacttcggcgcggccgacgcgttcggcgtccgcaccggcgccacgccgcgcccgtccaactacgaggacgacgcgtccaagcccaagtacccgctcccggcgtcgaatgcggcgcccatggcgggccactacccggcgccgaacccggccgtgtcgtcggcgcccaagggcgccaagaaggcggccacgaacgggcaggccaagggcgaggacctccacatgttcgtctggagctccagcgcgtcgcccgtgtccgacgtcttcggcggcggcgcgccagactacaacgacgccgcggcagtcaagtccccccgcaaaagtagcaatcttttatcttcaccgtgtactatttgcctgatttggggagcatttcttgggctaatttgtactgactcgtatatttcttttacgtcagtggatggagcgaaggacagggaggactacgtggagcgggacgatttcagcttcgggaacaggggcgtcatggacagggacgcggaggcaggggacgagaaggcggcggcggcggcgggcgccgaccccagcaaggccatggcggcgccgacggcgatgccgccgacgagcgtgatgacccgcctcatcctgatcatggtgtggcgcaagctcatccgcaacccgaacacctactccagcctcatcggcctcatctggtccctcgtctgcttcaggtgcgtacaccccgggcttctcgcaaacccaaacccatctgctcgtacgtgctgtggtggtgcggtgtggtggtctggttctgacaaggcgttcgtctcgttttggcgttgcaggtggaacttcgagatgccggccatcgtcctgaaatccatctcgatcctgtcggacgcggggctcggcatggccatgttcagtctcggtcggtattctcttgtttccatgctaacctcacctcacccccggcagtgtcacgagctgttcccctgagtttgcgatctcgccatgcatgcaggtctgttcatggcgctgcagccgcacatcatcgcgtgcgggaacaaggtggcgacgtacgccatggcggtgcggttcctggccgggccggccgtgatggcggcggcgtccttcgccgtcggactccgtggcacgctcctgcacgtcgccattgtccaggtaaaccggaacggaaaagaacagccatacgcacacactgtcacacgcacagtcacacaccgaaaataaaggtctccgtgtgggtgggcatgcaacctaccgcgcgcagccagccagcgtcgttcttttctcccagcccctcgtgctcgttcgcgtctgctttctctcctgccttttgctctccacggccgcggcactttctacgtttggccagcacgaaagccttttgctttggctaacctttttctctctgttgttcttttgtttggtccaaaccgaacgaacgaacaggcagctctgccccagggcattgtccccttcgtcttcgccaaggagtacagcgtgcaccctagcattctcagcacagcgtaagtactagattctctctcagtttgcactctgtcctgaatcgacgggccactgacattttttgcctttgctcctgctcgcagtgtcatctttggcatgctcatcgccttgcctatcaccctcgtctactacatcttgcttgggctgtaatcgagttgcatgcatgtaaattcctgctcctgacaaccagccatgttaagaagaggggagaagaagacagagctggtacactgtttgcaaagtcaggactctttgatttttcttttcttttctgtatttcttgaagtagaatttgggaggagggggattggaagggagtcaaacgagtcaaggggaggacaggatggtagctagcttagctaggacaatggtgagtcacaaaagagcaccaaaagcaagtacaagtacaaagcttggggggacacaggatccagttcaggtcacagaaacggttcggttttgggaggggattgtggagttttggttggctgcgctgcgctgacccttgtaaaaccggaccccgattctgacaagagatcgaccttgttttgttcgtgtcgtggtattgctgactactactttggaatgattaatctcctactactaattactccagtctttttgctgtaaattcactcttctttttacctatacgtcaaattggaactttgtgcacaactaaatggagagcacactgctgtctaatctactgctccaaaaatcgtttagcacagcgaccagaagagccgctttcgctttcgcctggccgagtcgaagccacagaaacgcatgggtgacgaggcctcactccctatcagcggttgctgatttgataagacatgtcggccgttagagctgtgtgccgccaattagtactagtacctgatgaggtcgcttacgtggagatggcaccaataagctagtgactctagctgtaatcatggagacggacgaatgcacagtaccgtagattcatggagatcagctgagctagttctaaccaagcatgaaactagatgatttcgcatgaaatggttcataatcagattaaggttcattctatacacatattagaggcaacaaatggacataaacggaattgttgacttgtatatgtagttcttcaagtagaaaatgtgtctgtccgcgctgtactattaactgactgattggattagttcattcgttctgaacatctgatggagaaaatattgcgaaggggttggtggccctacgtttggtgcagggcattatgcgctaatgtgggatttgatgtggaccggtggagcatatccagcgacaagcagggccctctaggttgctgtcgcatttaagtgccttgttggggtccctgtgctccccctgctcattttccgccactgttctgaatctgccgcctaacctcttggttgaatggttgttagacctgttcagttcgttccacggctagtgccttcatctcccctcttctccgggaaaaaagaaaaggcttgcatttacgtacggaaaaggattatctaatttaactattgtgcagttgagccactgatatatggaccttactaaagtggaacccacgtatcagtgactcaactatatgtgtagttaagtcataggatctgctttccacgtatctcattgtgttgcatccaccatgctcatacatagcaggactacttgaagcgaaatgcgagtttcagttcaggtgtagtttctccttaggctgtgttcgttaataggggttgggaacccatctcctccgcacgaaaaagggagcgatccattagcgtgtgattaattaagtattagctatttttttaaaaaaaatggattaatttgattttttaagcaactttcgtatagaaactttttgcaaaaaaatgcatcgtttagcagtttgaaaaagcgtgcatgcagaaaacgagggagaggggttgggaagaggctgaaacgaacgcagcctttgtctttctaaaggcatcttcatttttatacccaaatccttcacataggaagagccgtggtaatatgaaaaacatgcataggtttattgttgtaaaagagacattgacaatgacatgggggtcaatgtgaaagaatatcatataagttccaaacttgctaacagcaccgacacgatatttgtcaaactacatcccagagcattgattatggacggtccttaaaaaatagcatcatccttcgcaagcgaaccaatggcttcttgacttggacctgccagggactgcgggatggacgacagacctgattgatcaacttgtcggggtttggagcgccgttcaggctatacacctggtagagcacgaggaggacaatataacatggaagcttactaaccacgacgagtacacagcagcatcggcatataacgcgcaacttcttggaaccaccgctaccaacttcaacaggctaatctggaaaagcctgggcaccgcgtaagtgtaagaccttcgcctggctaatcatccaaaacagagtctggacctctgacaagctggcgacaagaggttggccaaacggttccatctgccccttatgtcgtcggatccagaaaatagctatgcacctcctcgcagaatgtagatacacaaaaagagtctgggcggcactagcgtagtgggcgacgtgcgagcaaataaatcctagcctatggcggcaaacttcaacggtgctagattggtgggaggctaccgcaaaaatacaagagacacctaagaaggcactctgcattttgatgttgttggtcgcctgggagatatggaacgaaaggaatcgcagaaccttccaacagaaggagctttcagctacctcccttttagccaagatcaaggaagaggccaaaacttgggccttagcaggagcgagaagtcttaataggtggctttcttttagttagctcggaccaaaggtcttagctcctttctttttttcctttcgctttgtaaagttctccttctctattcaataaaattggcgctcgttgattcgttaaaaaaaagaaggtatcgacaattcttgttaagttatgtcagggctaatcgttcgctcgcctatgttacaatgatcgtactgttataatatgtagtgcctctctatttaagagatagactaggataagaaatccaactctactgctattctaaatacctacactctccgtcccataaaaatccaacctaagaggggatgtaaccacttctaatacaacgaatctagacttgtcacaccgcctcctggattggtttttttttttggcgagggagtattacaattcaagtcatactttgtaaccaattttgtactatatttgatataaacactattcaaaacaaataatatcacgtataattttatattgatatagtaagagaaaaattacaaaactatagtggaggctataataaaaaaaactagcacctctatcaaaccacgtgaccgccaatgtataaaaaaagaaactagcatctgacctgtcgtcgcttagtgtgaccggatgccaagatgttaaaggcgcattacttaccggagattttagagctgggattccagatgaatttaccaagtctaatcagcatttttcttccctttcttttgaccaggtgagtctgatagagtgatagtgagcttgcgaatatggtatgccaatcctattcctacgaaaaatatgaggactcggcatttgttcctcgtggtttaataagagattagaaaagttcacggttcaatgaaccggatcaatgcctaatgctcgcatcgaaaggagaagggagagtggccaaatcactttgactatccttttaagacttttccgagacctgtgaaacgacagtagttgccattgatgcattgtttcgcgaaaaatggttttggtttgtggcttcacagttgcacgaaaaagtcggaagtgaccacaggctggccagctcgcggcatgcatgaagcatgatgcatgccgcgaataatcaccggccatctgcatcattcaagctgggctttctgtaatcaaacatgtgacccactttatcacgaaggaatcaccgctacatggtttctcataccagaggggatgcgtttaggtccaccaattacaggcgattgattagcactctacatgaggtaaccagcgtaacatttgtcattccaaagaggccataaattgttgtcaattcaattatttcggcccaagcacagttccagagctctcagaaaaagtggggaaaacaccacgttctacaaagatcaccggagctttccctggacatggacacgcacgatcgtctcatggctaccgatcgatagtccatctgatgaaactatctttcgcagcccagatgccaccagcaaaagtctggacttggacagttggaccggtcaagtcgtcaacagcaacggcgtactccctcccacctgcatctgcgtcggatatgcactggacagcacggccggctcagagattccagacacgagagacgagagctgaagagcgagtcctctgaagtctcagcttgtggtggtggtacgattcaaagggcagcggcgaccggccggcacgcatgcaaaagccatggatcgtccgccagagcgctcatgatggtgtgtgtgctcggaaggaggaacaaaagacgatcgagacgggtggtagcctagcctagcccaccacccccatcatggcgtcgcctcctcgaccatcgatggcaaaagagaaaaagggttcgatcggcacgaaagaagggaagcaaaggcatctctaggcacagccccggtcgacagacgagcgcaccagccgccgtacgatgcgtctcgctacacgcacgtacggcatctcgcgcgctgcgcaggcaggactcgctcctgtcaccggcagcatcagcgtgctccggcaaacgggggacgcaccggcgaggccgcgagggggaattggcacggcgcttctgccctctcggctttcctttcggcgggaggcatcgcgcgcgcaaagccgccgcgacgtgggggcgggccatgcgctggcacacgcgcgggcgaggggggccacgtacgagagtctacctggctggcgtcacgccacgccacgccacgccacgccacggtacacgcgaaaggtaggcgccgtgcaggacgagacgccgtgcgcgtacagctgacgcgcagtcatctgcgatctgcatgcatgcacgctccctctctcctcctccctcgtcttgttctccggtcgatccatcgaagaggctaaaaggctttaattgagccggtccgacccacgcatccgtccgagtccggcagccatctgatctgatctgacggtacggtgtgcgttgaacgatcgacgatggcgtctgacgcgcgcgcctgacatgtacgcggacgcgcatacatacacgtagtgccacgcaacgccacgccacgccatgccgcgccatgatgccatgcccgtttcctcgtgtcagcttccgccggaccggcagatttaactgtggcgtagcagtgaccgaaccggcgcccctgcgtgtggcagcttctgatcaccgtatcacggggcccggccccgcgaacgatcgatcctggaatcaccggccacacgcccgtgttccgtccaaccaaacgtaacctcgtcaccatgcgagaggtgccgtgccgacctgtgacatgtaaaatcagcatcagctagctggaacctgatcgcctaaacaatctggacgttttcgcttgtcccgggtcaggcttgcatcatggccacactatccggtccttgtacggcgtgatctatcgccggggcctctcatcatcccatgccgccaaaccacgtctccgtcacaggcgttgtggccttgtacgatgagatcgaccggggcgtgaatgctccgtgacacaggggccttcccgtgtaatgccaatggggctcactgctgcgccgaattgacggtgccggatgtggcgccaaggcggccactgcgccggtttggagtttgacgcgaacgggtggcctccagcagtagtagtctctggagcaggatggatcggtgagacgacgggagggcgacacgtgggcctgcaggggcgacggaggcttcagccttcagggaccggacaaagcaccacctccattttgagctacagttttgtgagcgactccagcgatttcatggcgtctcgcacttggcacgttgccctcggtgagacaccgaaagcaacagcgaaagagaacacacgtagaaaaaccacgggccatacgatttctgacctgagccgaaaggctttaaaaacggaaaaccaaaaatgtcagcagcgtttacgtcgtgtatactgcttgtagcagggcagaggtttcacctccgtttgcaggttgcagcgtgcagcggtcggtccccacgccggcttcgcttgccgcctcttgcacccctggcacttac

SEQ ID NO: 62477 - DNA, 31698 bp, Oryza sativa
cctggcggtggtgagcagcgggcgcgcgatgctggcggcgcccgaccagccgggcgccgggcgcgacgacatgatcgacatgctcaactggaggcgaggctcccacggccccaccgcctccgccgccgccaccacgccctccccggcaagcaccaccaccacgctcaccaccttcgccagcgccgacggcagcaacaacggcgaggagaacgaggagctcgacctcaacttgagcctctagctcccaccaccaccacctcctcctccgccgccgccgccgccgccgcgcaatccaagaaggcaaggtcaatcaatcgccatgttcttcttctccaagctccacctactcctcttccaattcctcctcgtgtgtgattaatccccctcttcttgctgcctgcgtacgtactccttaattaattagctcttagggacgttaattaatctcagttcttggctctcttctcctctcctctcctctcctctcatctcacttgtatgttaatgttagtactccttgtaatcgatcaatcagtcctctttttttgcatccttttttgtcttctttttcattttgccgtcgatttcttggcttctctcttcattttacctttcatgtttgcctctgctgctgtatatatctgtgactgtctctgtagtctgtacttggatggcacttgcaaccaaccgcattgcaatggcctgcagaggctcgatggtcacactgttcatctcatgctcgaatcgccattgacatgtccatctacttctacttcttctcatcgtatcaaagcgttttcttttcttttcttctctgaagccgtgagttttctctggttgcagctgcatctacgtgcctgtcaatccattcaactacgttcatatattctcctcgttgcaatttttttaatacgttttctcatactgttcatggacctggatagattaatatccgtatacatatactgtacatatttggtggtactagtgtatctatctatcgtctgctgcactaattcatcatatccaacggctgtgactgctagtactagctcttgtttgtttgttcgattctgtggctgcagaatagtagcagaaggatattagacaagaagttttcaatttttttttacatacgtcatgcaaggtgaacgtgcatactactacggtgtatggtaaagaaggtgaagtagttgctggtttttactactactgtactattttaatccttgtgtgtcccaaaactgttgctgctgtttggcgtacgtgtgcatgttgcgttttggtgacatgagatgagatgcaggtttgggagcggtgggtgttgaacagtgatgcaatcaatctcgctatgtatatactccttctcgtgctactgacatgtggggacatggcatgagtatacagtagtagtatactccatgtgtgtgaatgttcaggtcggtgtcccatcgcgtcggatcgtgtttcacagttgcgagagctttttctttatttttggctactgcaacgctttctctcttcttcctcttttctgccatgaaagcctactatacgactagtcatctcctgacttgaaaaaaaaaaccagaagaaaaggcgagagagagagagagagagagctcctgtttcgagttatggtgagaggtgacgcgactcacgcaccggacggacaaatccgcgccgtccaatagccagccagccagaccctctttgcgggccccacctgtcagcgccacggtccaatccccgtgccccggcccgagccggatcgtctgcgcgccaaagcccaaaacgacccttgggtggttcgaccggtcgggtcgggtcggcaaactcccacgtgagccgttagatcgggttgtcaggcgatcacgaccgtccatcgcgagggctctctgttctttccggcggttaacagtagccatccgggaaagctacgtcgacgtggaggaggaggaacatgtcgacacttgcatattccgagactcgtactcgcgtactagtaccgagtacagtactaatttttgttcgtacgtacacgtgggcgatacggccagctatacgtacactcgtaccgccgcaccgcgccaatacgtagacgtacggagtgccgggcccaccggtcggcgtgtgtgtgtgactgcggctgtttccggctgggggcaggaagcagcagacagcggcaaccgatctggttcctcgccgtctgcacaactggcggggacgacgacagcgtggacacgacacgcgcatgtgaccgcgccccaccctctggggcggcgggcccacctgtcagtgcctcctgctgttgcgagcgcgcgtataattaacttcggtactcctccgagccaatgctaaaaactcgtccgttaactttttacatcatgtttaaactataaacaaaattttatgaatattatttattttgttgtgatatattttactattgaagaaactagtatggcgtattttaatacacttattctatttatttaaataatataaatgatcaaagttgtttcacaagttaagatttttgtcgtgtactaaaatctggaggtagtactagtaaaattatggcgctgatgaatggtgatgactgccggagccacagctcagagctactgccaccagcagccattttcaactcagccgcagccaaagcgaacagcccgtacattaggaactttaaattaaatcataaagtttaagggcctactatttgtttgggaggaaaaccaagggactcaggggctgtttaggatccctcctatccaaacaccacctcatatttctatggattaatatctactagtgtcatttggttcataggaatgtagatataggaaaaccaaataaaaattttctttcctacaagttgtaaagagaaaacataggaaattttccattcactcaaacctattgaaaaattcctatatattgaagtgtgcatgttttcctattcctatatattaattcctccaaaacagataagtcttaaatgttggctattgctaataataatctactactccctccgtcttagaatatagtagtaatatagtaccgaatatgatgtaccctactactacggatacggatataggccagaatacgtctaatccgatactagattgctatactctgaaaattttatttttgataataatatttcaatccaacaatctatcatcttaatgactttctcggatttaatgtatgactcttcattcttccacataagattggctatacgggcatcgagaaatgtaaatattaatgaatcgcttgttcacgaggaatgactagtagcatgtttaaatggatgataagtagaattgcttatccttggtctgtgtggcaagatgaaatttaaccatgagcttttgttttcgtgtccaactttaatcgtccgtcttatataaattttttacggtttatatttttattgttattagatgataaaatatgaatattactttacacatgacttttttttaacttttaaaaaatcaagatgattaaagtttgacatgaaaactgatgaccacacttaggccccctttgaatcacaggaatgaaaaaacgggggaataggaaaaacataggattctgataggaatacaagtgtaaaacagaggattacaaaatacaggaaaaacatagaaatgaccgtttgattgagccgcatgaaaaacacaggaatttgaggagagagaaagactcaaaggattcttaacatgaggtagaacctcatgttaaatttccttcaaaatttgcatgggaagaggcattccataggaattttataggattccataggattcattcctttgattcaaagggctatataggaaaaattcctataggaattaaatcctttaaaattcctatgaatttactttgaatcaaagggggccttaaaatgggaccggagggagtaaaatgcagacgatgagactgacggtcacaggaccagccgcggcggtcccggctgcggcagccgtgttgtctctatgcgtgcgtagctgtgtgttggaacagccgccctgatgattctctgtggcgcaacatctgtgccacccaactccctcattggccgcctcagttatctcttgtcgcctagcgtcctcgggaaaggacagggatgaacagtcgatccaactaacaactgtttcaaaattatgtatgtacaaataaataaataaatttgttcttttttttaatcaaagaagcagataatttagcccactggatttggtaaaaacaaatatgggaaaataatatatgtatccgttcgtatctgagacgattgcaacagcagctctggtctgatacactgatgtgccatctgtgtgtgtgtgtgtgtttttcttggattgttgcttgactggcacggggcagctacttgctttaacttaattaagcaggaccatttctggataaactcgtaatttagcaaaccggtcttacttctttttgtgattgccgtgcttgtgtgtggtcatcaactcatcacgagtgcacaacaagttacatgagtataaatacaagttgtaacatctgtattaaaaaatgtcattattaatttattggtaggtcaacttacacgcagtgaagaaaatgagagagagagagagagagagagagagagagaggggctgcgtggtcttaaaataatttgtcagtttacggaaataaataaataaatgatgagcatgcagcgttggtcgtatgtactggttaattgcaattatacaaatggtataatcactatagcatggcataagaagaaaacaccatgcatttctctctctctaaataaagtacaaaccctctttaataattcgattgtgaaatacgatagtgaaacagtgattgtacgttagccgttgatgcacagtacccgtaatcctagtggagataatgtgatcatgtgcagagctactgttttgcatatgtatcttttaaatatttgcattatatgcatgaaattacattggtagattaatattaaaaaaatattccatatcatattgttttattaggttttagaaatacaccacaattaaaaaaaatacatggatttacattaattagtccatttgtatgctataaagaggacatacctaggtcatgtttgatagagcttaagacattcggttgtattttcttttggaatctatagctcatcaatctatattctaataataatttgtagatatagaattagaatccagaggatgaaaacttgatttttctatatttttaccatctaggcacctacttctcgaaaactccagctctccaaacacaatgaaaatgtagaggtttttcccacctaagaccttatttgattaattcccataaagctttattcgattaatcccactcacaacagaattaataaaaaattggaaggagataattctgcacctattaaggtatagaattaatctctctgatgagattaaccgaataaggctaaagaaaatggaggggattaagggaaaatagtttcacactaaaatatatgtgaaattatttccattcaaatatccctcaaacctggcgaacaaggtctaaactagatgatgaaatttcctgaatgggaagcgaagtagaggaggacatgcattatttagcaaagcgattggcatgatgccatcggttttaactatttttgtctctatatcgaagcgaattattaaagagatcagtgttgtgttctgctcgtgatcaatgaaactgtttatacacgcctgcatgtggaccgctgcttttatgtcctactcgtatcatctacttgcatggatcttattgcaaggacacataaattcgagacagaatggtttcgtttgtcattttctcccaaccacctctagatcttctccctcacactttctcccaactgcacataggtcccgatttaaatccaacatagctggaggcacaatgtttgaacaatttttccggatcgtaattaatcacgtcaatccatatactacccccacagccttaaatctggaattacaacgatttaggggcttgtttgaaacgcaagagcaacgcctcgctctcttcagcgagctaagtcgatgttaaaatttaaaacttcaatgcttagtatgtgttatagttatcattagactaatcgtggtctcctttaggataaagattgaaaaacacataatagaaaaaaaaaaggaatgtgaaaggaataaggcagggttgcgcatgaaaaaccaaggaataaaaaacagagaaatttttgtaggatatgatgtttgggtcacaagattatcttgaagacatgatttatcctccatcctattccaatgctagctagtaaaaaaaaaggatgaagtgaatgtttgaaatactttggaattcttgcgttttttattgcaatgcaagctacagtattcatccataatttcattgggcagttcctgctacgtacaatggtggacaaaccctttttagtcccggttcacaaccccctatagtctcggttatacaaccagaactacaaatccgggactaaaaatgggcatttttagtccgggttgaaataactggaactaaaaaaggatctttagtcccggttggagttactaaccgggactaaagatctagtcctggttagagttaccaaccgggactaatgttttttttctttttcttttcctgctgctcgcatgattttgagccccacaaatcattcatattatccacagatcattcgaacaccacagatcattcacaaaatccctaaatacatcaagctgcattttctatctccaaatacatcacaaatcattcacaaaatcacaaaatcatctctacaaattcattcacacatcacacatcacacagatcagaaaaagaaatcacatcgcacagatcggccatcagaaaaagaaatccacatcacacagatcggccgcacacatcgcacagatcaggaaaaaaccacatcgcagagatcgggtgccggccgtccaccgcctcgccagcctcccgcccggccgcctcgggctctgccgccgcctggggagcgtcgccgcccgccgcccgccgcctcggcggccggtgcctgcccgctgccgcctcgagctccaccgcccgccaggggagtgtcgccgcctcactggccgtctgctcggccgcccgcctcgggcctcgctggccgcttgcctcgcctgcctcgcgggccgccgcctcggccgcccgcagccggcctcgcaggccgcctgcccggccgcccgccgctccgcgccctccttaccgccgcgcgccgcccggcctcacatggtaggaggaggaggaggaggaagagaagagaagggagaggaatgggagaggagaagggatggaggaggataaggatggagaagggatggatgaggctatttaattaatgagaggggaggggaaaggaagggggagagaccgaggcggccgggcggggcagtggcgccagctcggttgattttttttttgtcctggttggtataaacaatcgggagtcctgttgtttataccaactgggactaaaaaagaattggggtctaactcggtccgataactttttgaaccggaactaaatttagtcccggttggtattaccaaccggggctaaagatcaaaaattttttaaccgggactaaaaataatctttagtcccgattcctattcgaaccgagactattgtgaattttggacgaccgagcaaaataatttctccaccagtggtagtaaattaaaggcacctgaccaatgacaaatcttaaaaggaccataaatcctaaagagaaaaaaaaaatctgtggaaacaatttgtttcaaagtaccccttaatttgcatgattttactcgaaacaatttgtgatgacacaatactttcacggattttaacatattttctcttcgaactcataagaaccacgcacatcaatatattacagagagagaaaatttcgtacaagtgcactctgctgtgacggtcacgagggttttacatggaatgaaaaggatagcaaagactggcttaagagtgaaaattttgtaagacattgcatccgcgcgttcaattccacgacaacggaaacgacgagagcgcaatccaagcatccacaacgatgtctctctcctcgcatttgtacgcgctgcatatgcaatctacacagcccatgatgatcgagagcactgcacaatcgtctgagagagagatccatcccgatcgtacgtacgattcgcacagggagattgtcgctggatcgaagggcacgcagcacgtgtagcacacagtccggtgactctctctctctctctctctgagctgttcatggactgatcgatcatcagctgcaccttctgcaagctagctgcctctctgcatatcgatatactgtagatatataagcagtgttgtgcttgttgcatctgcctggctgatagctggagtgtatctggtctcaggcccaaggcccgaacggattattatcgtggattatcaacatgatagtaatagggaaaagattaatttttgaaaaaaataaacataatgaatagtttaaaacaagctgcttaaacagtgcagcaaaagaacttttttttagaaaacatggtactagtaggattgagcaaataatatgtttcaataatccaattgataagtgaagtgagtgtagctcaacaactgattaggttccttttggtggaactagcctacccggatccaaatcctatatttgacatggtgctcgcatttacgcctaattattcttttagtggtaggtgacgtatatgttgacagcgaggcgcccgtgattattcatcggattagtagtgtggattatctattcgattataaagataaattaaacaatttaatatataaagtaaatataaatagcctaaaataagtggtccaaacaatgcaatagaagatttttttttttacaaaacatattatgttacatacgtggagcagataatctgtggcaatggtttggtgaagtaggttgtaggctatttacgtgcttctgacctacttatattgcatacccatttgttggtctgagttatttcattacaaaaatattacctccttctctaaaaaaaactttcatttaagtaatacaacgaacctgaatactgcatacgaacctagctaaaagaagtactccctccgtgccaaaaaaaaaaaagacaaaccctggtttccgtgtccaacgtttgaccgtccgtcttatttgaaaaaattatgaaaaaaaattaaaaagataagtcacgcataaagtattaatcatgttttatcatctaacaacaatagtaattataaaaaaaatcatataagatggacagtcaaatgttggcacgagaacccacggtttgtctttttctggacggagggagtagatgataaaatagccattgttgggctaacagcaacacatttgtatgtacatagtacgtttgtgctatgcagccacagagaatatgttggatggcaggttgacagtcaatgtctctaatactgtttgcaacaaagcccaacagagcactgacttttcctcacaaacaaacatgataatgtatgaaactgaacatacacatattgcaactacttaattatctatttatgtgcctgcacatatatagcaatacaacatgttgctatacatagcctggtcttttccaaaatccagggatgtactttgggcaaaaacaaaaggcctaaaaaaagcttttttttaagatgggactaaaactttaagtcgcccctatcacatcggatgtttggacactaattataaatattaaacgtaaactattaataaaacccatttataatcttggactaattcgcgagacgaatctattgagtctaattaatccataattagcctatgcgatgctatagtaaacattctctaattatcttaaaaaatttgtctcgcaaattagctttcatttatgtaattagttttataagtaatatattttaatactctaaattattagtgtctaaatatagagactaaagttaagtccctgatacaaacaccactagatagctagggtgtgttcacgttctcgattcccttctttcatgctctaccttacctacatcagtttcatgctacaccaaccagcgttgtaaattcatgaatagtcaagcaatcgatcgcctgtttccatgtgcgaacagggcgtcacatggactcgtgtgccccacggcggtcaacagcgccagcggcacagtctagtccggacgactaatggcgtttgatcaactaattattttttaatatagatgacattcggtattgaaatttgatcgaaatttatttttaattctatcatttcatgtacagccgattgaataagttgtggataaaaatgtcatatatatttctttaatgatttaaagcctaatgctgagaaataaactgcaatggatgaaaaccctaaaatcagctgtaaagttaagttttaaattttagcaaaggcttatatgacgaataatgtaaacaactgtttttttagtgtgaacaatccttggtggcagtagcttattattttaagttctcgtgctaaataaggatatcaaaataagtaagaaaaatattttatacgtacagactatctctgagagcgtgatccaattgggactataaaaaaatacagacaaaagggcaacattgcaggatagagacatgactgatatatatgaatttatatgactcaatctgctggtttgtattttcctggaatacattactatacacacatgcgtgccttgaactgttgaacatataattcctccaagttgcaaaggaacagaacattcatgtcatcctgcaagtgtgagcgtggtccaaactaataaatttattccccttcctgtcaaatgggtctcactggattttcagttagattttgttcaaccacccatcacaccaaactttgatttcgaatccgatccaatcctctctttccccctttttatgccttttttttaactgatggtgccttttctattctcttttcatctctgatggaagtgacgaagtagtagtactatgtataagtagaaaatgttgtaggttggggggtcccactaacaggctgatgaaaagaagaacatcaccaaccaaatagcaggaggtgagggtgacagtataataatctctctagcagcagctattgataagcaaaaaatatggagacaatggggcctagtaatagtgcatactgcacagtaaggctttacttcttttgaatggaggaatttccctttgaaccgttcatttcaatcacaggattgagaaaaaaagaaattgaaaacaatgattttagtaggaatgcaagtcacaaaacacacatgaatgattatttgaatagaccataaaaaacgtagagatcgaataagagaaataggctttaaggaaatttctaagaggttagagctttaactaactttcctccaaaatctatttgcatcaagtcaatccctaagaatttcacagaagttgagaagctccaatcatttatttcaaaggactaaggatttgaatgctaataaattcctccataattcccttgtttcatgggaattttgggaatcttatgaagaaaaaactcctatgtggtgatttgaatgaaagaaatagctatccaaaaatccaatgaaattcatctggattgactcaaaacataggaaattggaggaattctaacatgagcttcaacctctttaaaagaaaccgtttatgtttgtctctctcttatccaattcctacgtttttcctacactacatccaaacggtcattcatgcagttttcctataatttttcagtccataggatatatttcagatgttagggcacttcaatcatgcttttttttttctgttcctgcgtttcaaaggagcccgataatggagctgaaatgtcggagaattgaatgagatttcccactaaaattcaataaacctcttgtgttttgaaggagcccttaactatgactatgaaagcttactctctgaagtaggggctattcggtagtgcttgctgcactgagctacaccaggagagcaaagtttaactatcctggtgtcaaatgaagtaaaagtgacccctaactgttctgatgtcaaacgtagtataaaagtgtatcatatccggattccacagtctcacaaaagcggttatctcgttgggctgagaactacactctaatcgatcaatcacggatagcctagtttgctttcaggcagctggcctggcccattgctaaatatgggctaactgtagggtaaaatagaaataagtccactatatatccccaatctttttgtcaacattaaatgaaattcatgtccttcacaccgagaccacctgaatttctttggtcatttggtcaagccctaaggttgaagtggcatgcgaaatcactggaacagaaggataggccctggacgatggcgactttcaggcctgggaatgatgtggagaccatatttcgctcggcggctgttaacagtgaaatttggtaagctcggagtagtcatcggcttagagtcagcatcggcttcgaagtcctgagattagccgatgagagttgtcaagtcgtcagttgtcggattcttgctatattcggttaaggaaattgatctactaaaggaagcttatccaaaagagaccgagttcaaagagaatgtggcgtggcaagttatctattaattaggaatagtttgttagtttccttttatctttaggaaagtgtgtttagtatcctataaggactttatcttttccttttatctttaggaaagtttctttcttgtccgacaaggaattgtatcaacccgtgggtataaatatatacacctggggtctatgtaatctatcttcacgatcaatacaattcggcgcatcgccaccttttaccttttctactttattttatcgtccggcgggacttgacacttgacgcggggctgcatcggtgttcgatctctggctaaagggtaagtccaatgttccgccggcccgggcaattgtatcgtttacgtcggcgtcgttcaaggctgcatcagtacattcgacctcttggattgctctggtttggatgatatatttgctacctatttatcatgtctctgttaatctagtcttagcatatcaatttagctctatcggctgtctctcgctttagggtttctgccggtatcggctaaatcgccttgctagattagattagcctaggcatctaccaccctgaaaatttaacaagatgctgtttccggacgagctacaggacggattttgacagtgcattcatgctaatttgttggttgatttggaaggatcgtaatgcaagaatttttcaacatgtgcccaagacaccggaataacttgcggaggatattgaagaggaaattgctgtctggagggtggctgtttcgcgagtaatcgccatgactgtctgcggggtttagccctactttcttttctcgttcttggttggctggggtctttccctggcaaccacggtattgtaagtcgttgtaacattttactgtattttccccccaaatcttaatgaaattggtcggctaacttttggccgacccgttaaaacattaaatgaaatccataaacttaaagttcatctattttcactatatgtcctctcaatgcaaacttagacaactatatcagtttaaactcgatccaaagcatagtaaagtgagagagtagcactatttcgttcctgttcacatccatatctttcatgaagtaacttatatatatgttgaactccgttaattaaaaattaaaggagtatataaaccggttccgtaaatatcttaaggcgagatatacagatgccaaataggtgtacagtactcgaaattacaaagattataccagtataattaatcgttgggattaagagcatgaacgacccagttacgaggggtgcacggagtacgtgtgttgcttgcgcgcgtgtggatcgacgagattcttttgcaaaaattacctaattaattaatcggcgtgctctctggcgtcgtcgatattgtttattgtttggctagagttcgccggcggcggcggcggcgaggtcctcacaacctggggaaggggcgggcgaggcggtcggcgtcggtgtagatgtgggcgcgggtgatgtcggcgagcgaggtgcatccgctgagcgccatggtgagctcgaactcctcccgcatcatccgcagcacgttcctcaccccggcctccccctccgccgccagcgcgaacaccaccggcctcccgatctgcaaacgcaattcaatccatcaagacgacgacgacgacgatgacatgtatcacgccatagatcatcggctatcgatcgaaggacttacgaagacgccggcggcgccgagggcgagcgccttgaagacgtcggtgccgcggcggacgccgccgtcgaggtacaccgggatgcgccccgccgccgccgtgaccacctcctccagggcgctgatggtcgccgggacgtagtccagctgccgcgcgccgtggttcgacacgatgatccccgccgcgccggagtgcacggccagcctcgctgcgcacgcgcgcataaacgcatcagtttcctttgtgattttgtggatttcaaatcagtcaaatcagaagaaatgcaagaaacaggaagctatcctaccatcctccgcggtgatgacgcccttgacgaggatcggcagcgacgtgatgctctgcagccacttcacatcctgcatcatcatcaacaacacacaccgtcagaatttctcccgatcttagcatcaagaacagtaatttcgataagttaatttgctggtaagtttgttgtagcatcgatgagcattgatcattaccttccagctgagcgtgcgatcgatctgcccggcgacgtaggaggccagcccggaatcgttgctctgcaaatgccaacgaaatggttcaaattgctgcatagaacagaccattttttcttcagagaaaataactgtttttttttttggctgaattaaccgaccttgtccatctctgcgaggtccaggccttcgaaattcttcagtgtcaagtatggtggcagaacgaacctgcaacaacgcagccattgatcacatcacttaacatttacgacaactcgctgaaattcatttctagatcgtgccaaattcaggtggctagttaagaactcacctgttcttgatgtcagcttccctgcgtcccagtcgcggagtgtccacggtcagtgcgatcgccttgaacccagctctctcggctcttctgacaagctgctcaaccacattcctgtccttgtacacctgtagatgtatgcaagatcatacaagaaaatgagatacgaaaataaaatgtagccaaagtatgctacatgagcagagtgatatgatatggtttacgtatagctggaagaaacggattcctggtccagttgaggcgacctcctcaacacttgaagtagcccaagatgacagtgtctgaaacatgaaggcgataccaaattaacattggcgttcatgcaagtttgaatttctgttttggtttggtttcgttatgcatccaaggaaatgttgtttgctattgaacatgacaacatgtagatagcataccattatagttcctgctgctgaagctgccctggctgttgcatactctcctgaatacatatggtattttagttagcccaattctatgcaaagatcaatgtagatcatgtgcttgcttgttacatgctaacaacttcagtttattttcagtttttgtagtagtaatatgcttttttttaaaacaatataatatgctaatgttgatggatgaaattacttttggttttgagtttgggctaaatgtaaggctgtacaacaattaagcaacataattgaaatggcatatgtaccgtcagggtgagccatcttctgcatggcactgggagcaatcattatgggcattgatatcttgaacccaagaacagttgcggacatgtcgatctttgagacatcgatcaggatgcggggacgaaacctagccagaaaaggttacagtcagattgtgggctgaaaaattaacaaatgttcaacctaaggaatgtgattgaaaaatttaagtcatttgctaaagctttcgtaggagaaagtgataacgttagatgttgtatgatagatattctgggtctgggaataagattatgattagctgagagtttcactgattggcaattttactgaactaatgaaatgcccttaactctattttgaaaagaatacgatgtgctcatgctaaactagtctacctagtaaaaagaccgagtggtcaggattggacaactagtaatgttttgtcgatccatcctacttaactatgagctatcagattgaacttgtacatggtagactcatagggaggcatttacacagatgaaatattttgatgcacaatatggcatagggaggagtagtggtgcaattaatttgtaacatgtcaagcaatcaagtaattaagaattatggcttacaagatcctggagaatgcctccctgttctccttgagagtccactcatcctcagctccagaggcgtagtagtcgtagatcatcttcggaagcttctgcttcgcgatggcctggtactccatgacattggtgatctcccccattttctcctgccttgtgaaccctgcaccgctctacacccaaagaacagcactgtcaaaagaattgagctatagctttcctcctactaaaataacaatcatctacatgcatgatgataacttattcttttttttttctgatagaacacatgcaactatgcaagtctgctaaaagttcatagcaacaaggtaaacaaaaaaaaaaagactttccatcatcagagaaaccaagggactcctttctcttggagtgcatgcagatacccattttttttgtttctgcagaaaatatgtggtattcttttaacagaaatgataaacaaaaaaagaaatcttcatcatctgtaccaacgatcaaacgacgttggaactgaacaaatataaaaaaacctctcatcactcatacaaacaagagaactaaaaaatcaatcagaaacaaagatgacaacatgcaatagatcctaataatttggtcattttgaaactatgcgtgcaacaaattcttggccacgccagaagaactattacgactgaagaaatcacgaaagaaaagatgactcaaatcaaaccgatagaaaagcaaattctgtacactgatatgcatgtagcttatcttaccttgagagacactgggaggaaggagcaagaacaggaggagggagtggtcagtggtgttggtgcaggtaatataggtgagggagagagatctttgagtttctgcacatgaagacaaagatagggggggagacgtggagatttgttaggggagaagcgagagaaagggaagggaggaggttatggatgagcttttggaggttgagatgaaggatggctcctcctacactacttcctcatccacttgacatcaccactcccctcctcctgccatccaacatttctttctccttttctttatttaattttcaggagatgaacacacaaagaagtcattttttttctccagctgaattggagtggattatctccttccctagtcagggaagaaaaatgtatatataaattgttctccccttgtttagcaggataggggtgagtagaagccagaagagaacagtaggccagcaggggggtttctgttattaggtggggataagatggcaattttggtaattttgttggcatagcataggctgtactgcagatatgatgacttttaaagaccagacagatcatcgtccaacagagatggggattcagacagttatacaagattatcataacaagaccatgccatatataaatcgacacggcaaaaatacacaagagctctgagatatttaggctttgcaaccattttcaaagggcaaacacaacgcaaaagaaatgcacctgggacgaaccacgctcaataaggagagacaggtaaatctgatagatgaagtcaccggaaaatgtgtttattcagtaaggttttgaccaagcctcccaactttagctcacttcataccaggcaccacacaggctttacaattgccaagagtaccttctacaagaactgaaacaattgcaagggggtgcatgcagcgaactcttgatcggttcgcctgttgcaaaacaattagttaacccaacttggtaccaccattgcaaagcccgtgttagaactttcagttaaaaaaaaagaaagtctctttacttttcagtttaaaggaatacattatatttctgtctaccttttttaagacggtgatatttactacacagatattgctatattactagcactctggcatttccagggaggtgctttaacagcttgtttttacagagctacagatgttactagggaagagcattacatacaaaaagcattagtgattacttcttttttttctctctcattcaaatgcaaatagcatatgaacagatgtcaacagattatttctcccccataaacaaactcatcatgattctctcacaaaacactcactctgcacaaacattgccttacttcccactaccatcatcagtccagacactgtcccaggagttgttagcttttggtgcctcagcaaaatgatgccctggaccttcaaacgaagaagtttctgcgccctgaaccccacccttctttgcttttgttttgatcccaagcaagcgtagaacgaacctcgcaagttcaccataaagcattccagtccgatcacatagctacgatgaagacaacggtggatcaggaaggttataagtataaacttggatcaaattcaaatcaaattcagaagatacctgcaaaagagctgagataaacatgtggaatgcctgtgtgttctggctaaaaaggaaagcaactcgcccacaaaaattcacaacaccatgcatctgcaatcaatgagaaaaggttaggaaactgtgttctccactcccagcataccaatcacagggtaaagttcactttttactacaaccgatctttttttacttgccatttggaatgtcaacaagatcaacacatttgaccactgttttttttatatgctcgtcaacattaataaaaatataatgatataaagtgttgccaatgtttttgaaatggctacggcattctaaaatgacatttttttgagaacagagttagtaatgtatatgaggcaataaattaactacaagttagacaagaattgctacatggactttgaattccatctactaggcttcctacaatagaaataaaaaaaaatcatgaacttcatatgtaacaataacatggtgatagcaaatacatgttatggctgcaaattaagttccacagaaatttaaacgtggcaatcatgctctagtttgttaaagatcaattaaaaacaataatcggtatcaaatccaggagtgacttggtagaaaatgtgtattaccactcgcaggaaggacatccaaaaaccagggggtggtgctggtggcccaaatgaatttggaccttggttgtaagcacccatgcccataccatagccaccatagggacctcccatcccgctattatacatggacccaccgtacattccagaacttccatacatacccccataacctcctccataacttgaatacatgttatttccgtaaagtccgccgctactataaggtccaccaaacccaccaagcgaactatacatactggagccataacctgcattttgatcgagaggttaagattctgagccactaagtgtatctgattatgcgattacagaattaatgattacctccataagaatttccgtatccttgctgctgccaaggccgtgggggcacaggcctagagatggtgctgttcacattggaagcaacattgctctctgcggcagaaacaacttccccaggttttgctgtgccagaagcttcgacgatatcactagtgctacccccggatgggggcttgaaaggcgctggaccagatgaagttccagcacgttcccatggtttgggtggtggattacttcctgcaaacacattccctagtgaattaaggaattggcccaaggcctaccaggagaacaattactcttcttgtaaatctcaaaaggcaaaacagatggacacttatctatactaaaacactgatatttcaacttgacgtaaaatataccataagtttccctacaagaagtgtgcactcagacaaaacaacgtctcggaagcattaacagagaaatgatagtggataacttgcaagactaggggagaaactcataaagttatcttgcaaagataaatctactgcaagaacctggagtcacggatgctattacaatgttgattgtaagcaattgggaccagcaggcaggcaggaaataattcaatcccgataaaaactttgcaacaaatacttctagtaggatataattcgtaatcatggaagcgtacattgcaattactaagtccataactagtacacacaagaatatcacaaatgcagaatttgtgagctctgaatgattaagatcaacaaatccgattataggtcaactgaacaaatttaaacatagactgcatatttccgtatgagcataaacataataagccttcattccgcaccgtccgaatttctgataacactgcatttgcattccttacaactgagccacgatagttaggtttctcacaaattactccatttttaaaaaattagttcataaataaatccgactggaatcagttaacacctggatcatgggcccaattggatttgttccccgtcctacaaatacctattcattaccttataccctcccctgcacccaattgagtgcccaaccaatcatgcaaatgctgtcattaggatccccaaaattactgaggtgatctagcatgtagtcattgtgagaaaggaagcagtttcgttggcactacctcagcatatgctcacatctgcatgaaatcttggaataatttagaaattgaacgcatattgctcacaaacacatccaatagccaattctacggttcacaattgattagtccctaaaggacaattctacgtttcatgatcgtttagctgattagctcctagcctcctaccctaaccacagtcacaaaatccccaacataaatcaggaactcgaggaaccaaaatccccctccagaaacgaaccgagcagacgtaacccctcatgaatcgatcgatccctccctccttccttcccttctcccccggatcgagtcagcctaaccacccacccaaccggttccagaggggagaaacagcgcgaagagtcgcagaagcaagcgacgaacctgccatgggcgcggggttgcggaatccctcctccccacccccacccccttcccgccgccccctcagccgcgcgtcgccggcggcaaaatccggcgccgcttctcgatcgcgtcgccggaggaggagaggagacgaagccgcttgctattattgcaggtggcgctacacgcgtgggccttttcttcttctttttttttcttttttttttccgtttcctagttgggctcgagtcaggtcttggcgcgttgggggcggtcaagcgttgaccgttgactagccttcctgtgggtcattaatcttgtgttaatgggctgtgtatttggtccaaggccttcggtttaacgaggaataagaagaggcccataggagtactaaggtgggcttggggagaaaaaaccatgaaatttgtcaaccgcctaaatatttttttaaaaaaaataaatcagccatctaaaattacgatactatgtgatgaaccaaaatctaacttttttattttattgacttatcttttgtatctgaatgtttccttctttattagttttattgaattttaaagttatatgtctgggctataattctcaaaaaaaaaaggggcgaaaaagaggggacatttttatatagtaaatcaagcgatataacaagagtgattcaatcttttccccaaggatccccgcaacaaaaggacaacctttatccgaaggataagatagtcactagttcacctaacgaatagggaggtccaaaaggctaaaatgagatatactctactcattttctcattaaaagatatggaagtttaaccaggaaaaggggctggccatatgggtacccatattcatatccgttaggtgaagcctttttttttttccatactcatattcagttcatttcgtttaataaccatagtggtttatggtttaacaagcatccacccctagatttaactttatgatggaatgttgctcactatctagcattactcaataataatgatttacaaagagaaagaaatatttctaacatgcaccgtcatgtcattccagtggtggagtcaccgccgcccgtcaagcccgaatgactaaaagcgtttttttatgatcgactaattttaatatctattacatcggtggagcctggtcgatcgtccgatatgtttgggaggtggcttcgtcactatgtcattcatatccagttttctttcttagggtgcactcgttcccgcgggcaaccgctcccgccacctcgtttttcgcgcgcacgcttcctaaactgttaaacggtgtgtgtgtttttttaaaaaaagtttatatataaaagttgcttaaaaaattcatattgatctatttttgcaaaaaaaaatatttaatacttaattaatcatgtactaatggtcggcttcgttttccgtaccggaggaattatttcccgtctctcactctcgatcggggccttagcctatttcagtctatagcactgatagcgcgcgatagcgcattctggtagtatcgtaattcgtaagtgttttcttttgttgttaagttaccgtgtgattttgtaccagcctacatgtactaacatacacgaaaacactgagggcgatatcattaaagataagaacaagagaaggaggtgattgggttagcgtagcctatggagtgcattattttttttttacgccagccagtcactgccacggaatcgcacgaaaacggtcacgtgtgaaactgatcaccaccaactactgacctactgttgcgttgtgaaggtagttcgagacgtatccatgtgatgcacgtcgattcctgcaaaatccagtatatctagatccgagaaacaggcaaaaaaaaattgtatggtatacggagcaacatactccatacaaaaattgcacaattaattggcttaattacatcgcgatctttcttgcttcttcggcgtacaggagcggcagcgcgggcggccgccgccgccgcggcgtcatcccgtacgtatgtcgcacacttccgccccgcgaaatccccaatccgcgtgccgccgtgcgccggttgttattagcatcgcatccacgacgcccccaccacccgccgtcccgtccacctccctcgcagtcgcaggcccgcacgatgttgagagttagtacactttgttttagtgcattcgacttactgtctccctgcattttataacaagtttgttcttgccactatcgtttatctttacctatttatcgtttatctttacctattataaaaattgaagatgtttttgccacaaattttcgtacgtctttctaatccgattctgtttctgttttgcggcttcgtttattctgtttagccgtttcgtttattagcgagaagaaaaaaagggattagaccggtattgcaggtgagacggacagcgaaggggctgacgtcctcaatgcctacctaggcctcagcccaagtaacgtatcagcccataagagcacccgcaatggtaaagtaaggtgctatctataaaacatgtacatctcagcaatagactcgattaatagtaaaccaccttaatagtatgtctacattggtatctatagctctctcatgcattgcctcgtttttctctatagactatctctaagttagtagatagctttgctctctctcttcatttaatacattccaagtagaaaaatatgctgacatagatctcttgtagagagcctatagataaccattgtgggtgccctaatcttctaattgtgattggctatagagtatgctatttggtattttctccgtctcaaaatttaataattttagcctttagaatttattcccatttaatttcacaaattttattattaatacttgtgtccaactataaaactttttatgttttgattagtacggatgtagcaataaataaattaaactgaatttaaatttggtttctgtagaatttttcgtccatcgtcgcacacgctcacgctgtccgattccatcacctggcatcgaacgcgcgtcttccgcatcctgtgtaaaacacgcaaggccgacaaccgcaagcaatcaaacccacaagccaaatatgaaacccccgtttcaaaagttcccaaattagaactctaaattttcaaattaagatgatgaaaaacaccaaatcaacatgaaaggaagttggataaaatatatattcaaacgatttctcacagtaaatttcacctaaagtaaaacgtataataataataagattaaaataaccttcacccgttgcaacgcacgggcatttttctagtacaaaaaataaatttatcttttcagtaatcatttcgtattagagttttgtaaaataattgatataaatatactatgagtagataaagagaaaaataattatatcttgatctaataatatatatgtattaaatgggttgtttgattgatgccattttcaaccacactatttttggtaaaattgcaaaaagatataccaaaaagatatacctatatttagtttgttaccgaactttagtaaatatataagaaatcctatcattttttataatattgctaatttagtactattgataaattttgataaggtttattttgattataatttgaacgcccctgtcttttgacacgaaggaaaaataaacttgagtatactaataaacatgacggcgcccgtcttcactgacgcaagcagtgacacacgaattcgccggccggtgagctgctgcactgggcatgggttagtgtttcagttgttttgctccctaccctcgcaccatttgtgagctcatcacatacggcaacaacacacaccatcaaacctaccgagcacctgtcaggctgtcaccacccgaccattcccgaactcacgctcaacttctaacaccgtgtttagatccaaattttttctttaaacttctaacttttttattacattaaaacttttctacacacataaggtatatttggttgggtatttcaacttaccacacctcaagttagcacataccaaaagtgtggcgaacgaaattcttaacatagctttggctcaaaaatatgtggcaaagcagcaagaagctacctaactttctttggcaggctaaactatagaagcaaaacaaacaaaggataagcagttgtagctgactaacatgaggtgcggcattctatgggatggatccaaacagcctcataaactttaaacttttccgtcacatcattctaattttaaccaaacttctaattttagcgtgaactaaacacaacataaggaggtcgagtttagttccaaattttttcttcaaactttcaaatttttcatcacatcaaaactttcctacacacaaacttgcgactttttcatcacatcgtttcaatttcaaccaaatttttaattttaacgtgaactaaacacatcataaacggattgagatccttcgctgtcactgtatcatgtcctaaatgagtcccaagtgataaaggcgcgatgcagtcgaatgctgaggaatccatccattgctacctataaaagcgaccaacccactgatcgccctccactaccaaagaacaacacacaactcggtctctagttgaaaagctatagccatggcggaggagaaggagctggtgctgctcgatttctgggtgagcccgttcgggcagcggtgccggatcgccatggcggagaaggggctggagttcgagtaccgcgaggaggacctcggcaacaagagcgacctcctcctccgctccaaccccgtccacaggaagatccccgtcctcctccacgccggccgccccgtctccgagtccctcgtcatcctccagtacctcgacgacgcgttccccggcaccccccacctcctccctccggcgaactccggcgacgccgacgccgcgtacgcgcgcgccacggcgaggttctgggcggactacgtcgacaggaagctctacgactgcgggtccaggctgtggaggctcaagggtgagccgcaggcggcggcggggcgcgagatggcggagatcctccgcacgctggaggcggagctcggcgaccgggagttcttcggcggcggcggcggcggcaggctcgggttcgtcgacgtcgcgctcgtgccgttcacggcgtggttctacagctacgagaggtgcggcgggttcagcgtggaggaggtggcgccgaggctggcggcgtgggcgcggcggtgcggccggatcgactccgtcgtcaagcacctcccctcgccggagaaggtctacgacttcgtcggcgtcctcaagaagaagtacggcgtcgagtagatcggtggatgcgaagttgcagggatcgattggcggttgcgttcgctacgtgaacgattcgtccgttgtttcagtggccaagtgtgtgtgagtttgttgttaccgttgagtgcttgtgtgtgggatggttggtggcagcagagagttgcctccgattctctgagattgtcactaaataaagtttgtcctttgaaactaaaaaaagttggctttggttatgcggattgctgagtactcttatgcattatagaaatttaagttagtacgagtacttgtttagttgtttagccactaattcgggaattttctctccgtgtttctcaaggtgtcacgtgcaagaggacacacactccaaacgcctatatgggccgtgaggcccatgctatattgttgctgcctagcaggccatcacttagatttggccccatgtccacacggtgcaaggctaaaagggaaaaagctttgggaaaaaacacggtacaaacttagagtcacagcgtgatgtgcgcacactcatcttctgccacttaccgactatccttataaacacatactccctctgtttcataaaaaaacgaatctagcaccggatgagatatattataatacgatgaatctagacatatatatgttcagattcgtagtactatgatgtgtcatatccggtactagattgattttttagggagattttttagggacagagggagtatgaaaaaatacatattacttgtaaatgcaaacacccctgtctagtacatgaatgatgaatcctagttccactacaaagaacctatccataagctaatcagtcaccatactcataaaagaatctaattctaaagatgaaatatgaatatagtgtatgtcaagattcatctcctagattaggtctttttgcgggacggagaaagtacattttactatgtcctaacacacctctaacaatattggagaccaggcatcacgcaaaatgtctactccctcgcaaagtatattttaaagagagggactgctctctccgtcttaaaaaaaaataatcaaacttggactacatccttacctaggttggattttcttttgacaaatgtagtatgtagccatgtatgtatggaatttaaattcaatcctgaggaaataaacgggacgaaccacgagatgatcagatttatctcaactttatagcgcaaaccgcgagacagagagaacacaataatgccactccaataaccagaggcacatatgaatttcaattcactcgaaaaatatttctggaagggaaaggtttaacgctggctacgggacacgcttattcttgttcgaaactcacgtctcccacaaaaatttgtacagcagcttcatctaggaaaaagaaggaaattcacaagattgtctgagtgatggcaatggcaggtagcagcagcggcagggtgttcatgatggccaaaaaacagcatagcagaacgatgacccagctaaaagaacacgggcagtcatcgcaataaacttgtagcagctccccacggtgagctcttgctggaaaggtgacaacaattaatctgatgatgatatcttcagttcctgcaggttgacagacatggtgatgagatgcaaaattctgtagtaattaattactgtagtttgtactgcaaatgctactggtaagaaaattgtattgtaagatgtttcttgtagatgtcaacttgtgtagtgatatgaggacacctcaggcattatgtgaacagaaattaggatgccattgggggatactagtataataagatgagaatatttaacagaattatctaaaaaaaagaatattgaacagatgatgtagagtgacttgccggcagcttttactgcacacaacgaacggggggaaaagaacaactcgtgtctgaagaaaaatgaactcattttcaatttttgaaaacgttcttcatgtttggaagttggttgcagtgagaaccatgccagcatacagttaggaacggaacatccatcaagacctgaaactgtactacctccctgactgtttgtctctcagactacttcaatttactccctgttgatgagcatagcagtcacgccagaaaaatgtactactagtacttctactaaatagagtattaccttaatctagatgcccagcaagaaggtgtccatgcatacactgaatcaaaacatgctcctaattaattggctagcaaattaggaggtcagctgtctaggattttctaaacaatactactagtactggttaagatttgagtatgatgttttaatacttaacaatggtcaggtttgcacatgtaatcgtgtacactacctggttaggtcccccaccaggaacactacccatcagccaacatttttccaaatggacctgcactagatagtgcgaagttggaagtttgcaacatttgaaggaaaacaacgttctatccataagatgcaaggtgcctagctcactttggaagcttgcaaagcccaattaaaggaaaagcacaagagatacataagtcctacccttttcaggattttttttaattgattttcatttctaacactggtttgacaggctctaatgccaaagcaaaattgagctgaactttggttcatatatatcaagctttagttgagaaaatttgtatagaacaagtgtgaattgtgatgatggaataaataagatcaccaaacaattataacatatcaatagaagactatctaatactaccaaggttcataaagttgatcattcagagctgtactaactctatcttttcttcagataggagaacaagtactactaactaatcatgcacaggtagaaatgctttatggtactgtcaacactttcaaatatctaatgtcttttatactccaggtttccattatcatattcagagcaggcatacctctgttagtactaggaaaaatcttttattatggcatccttcttaaaaactaaggctgtgtttagttcacactgaagtttggaggtttggttgaaattggtacgatgtgatagaaaagttgtgtgtgtatgaaaggtttgatgtgatggaaagttggaagtttggaaaaaaactttgaaactaaacagggcctaaagtgggtctcactttactaaaatttattgtttgatccacaacccaccttgagatgttatatgctatatatgaccataaagtttttcacttctttaatttggcttttatgtggttgtaccaaagtgtcatttcaacatttcacttcagaaaaaaaaatatcataaagcactgttcctttagacatatagagcatttcttcaatttctaacttcctaattaaaccaattactacttggctaagtactgttcatcatgctttaataatctactagaactggtaagttctagtaatgagtacgcattgcaatgcaaataataaatgaaacaccttttcttactgtataaagatctcacttattttccataattttcttagaaggaactcttgtgatttgaacagtaacttgcttcattcaaggcttgctgcatatattgtcatacgaacagtatatacagcttgccagttcatgttgatgcaattcatactattaacttcgatcctttttccgtgtataatgcgacgtagagtagatatggcttcctacagtttattgcattaaaaatgcaaatccgtgcaactcagaacccatgtgattggcctgattcctacgaaatccttcccccagcgatgagcaatcgacacctgtttggcctgaatccatgcaaagcaaaatgcaggtatcccgcctcgaaagtttttggggacacacgtcgaatgcaacaaaagagtttttagtgggatttttcagggaacgaggccacctcgagcggcttccaagaagattgcaatcgaatcaagatgacgaaattgcgcgaacattagtcttagattacgaaatctagtctcttacctttggaggatgcgttgctgggatcgatcagttcttgctcttctccttcatgccggagtggcggaatccatcccacagctgcaacgcggcggtgctggtgatctggccctcggacgccgccgggtgcgccgccgcggcggcgtggccaagcaggaaggaaatggtggagccgtccagcctctggagctgctgctgatggtggtggtggtggtggccggacatgttcgacggcgaattggactgaagggtccccctattggcacccaagaaacccgaggacatggagaagttgaggttgtagtcgcctccggcaggaggcggaggcgccgccagctggtcctgggcgagcgagtagtgcgccgccatgtcggcgccgggggcggagaagttgaacggcggcgccggcaccatgccgatcggtggcgcgtcgccgaagctcgaggcggcggagaagccgtacgtggacgccccctccgcgcctcctttcccggggtgcgcgatgcccacgcagtcggcgccgttgccaatggcgccaccccccgccgacgacgccgccaccccagcaatgagcagctcagtgaacgacgcggcctgcgccggggcgctcgccacggtgacctccttgtccgaccccttgctggtctccgacgtgctactgcatccggacttgttgctgagctgctgctgctgctgctgcgaacgccgccgcgtgggcgcggcgtcggcggcggcgtggggaatggcggcgaaggcggcggggtcgagggacgggagggtgtcgatggcgggggaggcggcgttgatgagccactcgatggccttgctcggctggtcgaagccgaggcggtcctggaggtcgtagaactggatggcggtggcgacggagaggcggacgcggcggtcgcggattcccttcgccgtgtacaccttgctgtgcctgtccttccccc

SEQ ID NO: 62478 - DNA, 6547 bp, Oryza sativa
aaagtcaaaataacttagaacctgaaaaggaataatcttttttgacaaaagagtactattatttactccgtgttaatactaaaacaatgattctaaatattttaaaacatctatattctaatgttttggacctacaataaatttagtcgcatgtaggttataatatcttagaacaggttataatatcttagaacaaaagtactctatccatttcatttcatattataagatattttgactaaagtcaaactgctttaagtttgactaaatttgtagataaatatagttatatttatattatcaaattagttttattaaattaataattaaatctatttttaaaaaaattattttgggtcaaaaatattattattatttttttataaacttggtcaaacttgaagcagtttgactttgaccagacttaaaacatcttataacctgaaacggagggagtagtaataaatttcttccatatgccattatgcaaatagtggtaacaatatgctaaatagtcaaaacggtgacagagtatgacgatattgtttatgctcatggcaaaattcaactctaaaaacgtggcatccaccaaagggggaaaggaacaaaggcagacgatgtagtggtggaggttagttcttgtctttatttcagaaattttccgtttaatcccatatttgttttcttaatttttgtgggggagcccgtctttgtatctttattctgttttcaaaagtttagtattctgttttctttgtatggctctatctgttgatgtaatcgtctgaaattaataaaagcttcctttataaaaaagaatcgtattcgtccatatatgcaaatatacttgctgttgagtactcaacgccatcacaaattatataagagcatgtacaacggtttttattagtggtctctctctattaccatgcaagtaagtttggtaacatggaagaaagagaaaagaggaaagagaaatatagttgttatgcatgataataactgttcagcaaattttgttgcatggtggtgaaaaaaagaaaagaagagtaagaaaaagtattttgatacattaatagtagagaccatattatcttcaactgttgtaggacgttagtctctagatagtatagagcttatacctgtctatacctttgtacatgcttatgttcatatgcaaatagtgataacatagaataagcaataatgcaaatagtcaaaataattgcaggacactgttcatactcagaccaaaattcaacttaacgtgactcctactcagggaaggaaagaaagacaaacgtcatgatggcaggcgttaacactttgtcttcccttttatttcaaaattgtccttcgcccgtattcgtttctaaattttgtttcaaaacgctcaagactagagtttaaatcttatcataccagattttagaaaacataggtcacgtatggagagctagaaattggggttttagcacctacattctcctaaaatttacagctttctaaaccatttggattctcatcgaccatacaaaatatgtagtgtaaataacatataaggtgtatggcaaaatctattgaagagaaagtatctctacaatcagattctcattttttgtcaggtctcataaaggtcaaagataccttcttagatatgagttcttatattgtaaataataggaaacaaataaggttttgggaagataaatggctaggaaatctggcttttaaagacaaatatccatctttatactctattgtccgaaggaaaagttctactattgctaattttatgagatatgttccactcaatgtttcctttaggagatcattagttggttagaatcttgcatattggcatgaattgtgtgcttctattgtacatattcaattgaatcaatcctctgatagctttagatggaattatcatcagaatagaatattttctgttaggtcgatgtatctagctttaattaataatggttatattaagagaaacaagattatttggaagcttaagatgccacttaagattaagatttttatgtggtacttgcttaaaggggttgtgctaaccaaggataatttggcaagacgaaattggaatggcagtttaagatgttgtttttgtatgaaaaatgagactattcaacatctttttatagagtgtcattatgcaaaatttgtttggagagcagtacagttctctattggtttatagcttcctactaccatatctaatatgtttgatggttggctcttgggggtagacaagaagaagagtaaactcatacttgtaagagcttctgccatatgttgggctctgtggttgactaggaatgatatggtttttgacaaatcatcatctatctcatatatgcaggtaattttcagggcaacatattggctccgattttgggcacagctgcaaatgtgtgaagatgatcgagagcttatgaaggttgcatgtcgtaggcttgagacaatggtcatgcaactccttgcaaactatggatggagattcacaaatagacttgaataaatgtgctctccttatcttagtttgatcttttattttgtgggttgtgtttaattcatttgaactacactcagtgtttgggtgttacttttgtaataattgactgtaactctgatgagcaaaggccgggatgttttattccattatctaaaaacaataacttatatattgtggaaatttaaaaactatcgtagataggatgtgaaaattaaaacgtatgatatttttttacacgtcaccatgagtgaaaattaaaactgactcttgaatttacatcatactaagagttaatttcacttgtaatgatgtagacgaaatctcaatcattcaattttgcatcgtacagtagttttttaagtttctactacatataattttgatcacatattttgccctgccaaactttttccaggattgatttctatagctatctacgcgctttacctgaccatccggacgatgtttccacaaagaaagagaggggaaagcgagattcggaggccaaagaggaactaccattaacagcaggaggaaaaaaacttggaaagcgaaacgctcccggacggagtccactactggtcgacacgtctttgacgctgcgctcgcatgttccgcggctaaggcaaagctcacgcccaaacgcttggccattttttttctaccaccacacactgccactgccattgtcacccctaattgtcgaggaggtttcatcagatccactaccaaccccacaaaggcccgaagcaccaaactaccaatccacaggttttataacaagagcaaatgatttgattcgttcaaaaaaataacaaatgatttgcttatcgatccacgaaatgcacgtggaagtccacgaaaattgctgcaagttgccgacagttcgatagtacaatattactgtgtgtctgtaggtaagcagctccaagcgaggagtgacaatgctgttataagatagtgtacagttgcctggatggacgattaaaaagaggagaggttagaattattgtagtgactgcagtatgcaggctactctacaataaagttctcacactcgcaggcaattagaattgaaaagatatactactaatgaatagaaaacgcccaaatgtaatgtaagtacaaaggatgtttaactttgatttgtcgaaagttagacgcactaacaataaaagtgaacaaaacctccttccaccttccttgtaagttctactctgcctttccgttttcactttgctgtctccttttagacagggtcttcaacattcccttgaatatcttccagaaccaaaataggttcatcactgccagcgccggtggcaccgtcagtatactgtagaagcccagggggaagatggacttcacctgaaagtatggcatatgcgtacagagagcattagaacagaaatgtaacaagaaaaatattgccggtaaaatgtaaaggtagatgaatttaatagctatatttgatttgattatctgggaaacctggtaaagtcatgcatacctgatcaaaatggaagtacatgtgagtgaagaaatatatgaacaagattacccgagcaacctgcaaaccaaccaaaggtttgtaaatcacgtgtttcaaaagagcaataggagagctgaaaatttgattaattatttaaatcaagtcatcatgggttataccagccatccgacaaacagagccaatccattgtataagtaaaggttatgcgtcttcttaccagcaacctccaaatacctgcagcagaccatcatgaattcagaatgagcaaaagcttcatcaggataaacagatttaatagaactggacattaccatctaaggttcacaaagggagtggtggcttcagtaaagagaaccatgagtatgtacatgtgtgctttgccactcaacagagcaagacagattgcatacatcgaaagtccatgatgcaggagctgagataaaataaatcctggtcagggagaaactgagacaacaagttttacagatagccagtatattcacgtgcactcactctaacagtgtaatacttacatattcctttccacctaaagaggggaaataccacagaatcatcaccaaatctgtcaaaaagtaaccaatcgagacctgcacaatacatgaatttaaaatgatacattatacggttatcatttgcatgttgtgccacttgatgcaaagaacaatatgaagaacattttttagattttctttttattttgttctgaaaggtgtgcataattaaattatatgagaaaatttaactttctcagaacagagcaggaaatgaacagcttaccccaaacatggcatcagatagccatgagtttctatcaattattatgttgctatggaagaggtcagatatcacaaccaggtaaaaagaaacaacagctgcaaccaatgcatggaatgtagagaaacccctatcaacaagtggcatcatgtagttagactcaaaatggaaaacaagcaacaataatgacagcagataaataacaaaaattgtgttggagaatatcttacctattattccattcaacctttttcattgggcttatattgtcataacccttgaagcaatgagagctaaccttttgagttatgtcatatacctggaagggcaaaatgatgagtgttggtagcaagatacaatgaattctaaaagagataaaactatctgcttcaacattggtagcaagatatagaatatcattttcagtttaggagacagtagttaacgaaaataagaggcagctattgccaccattgactattgaatatatgatatgtaacctaagtaccactcttattcacataagacataacccataacagagcatatttttcacacacctttgatgtgaaggaggatggcgtatactatgaagaggatatcacgtctaatttcagcaatctgtacttttaaaaataaattagcactaccatgtgatctagggaacaaactccgcaacttctgcatacggataaatattcccctttgcagatggcatgtactcgtttatatgcttcatagaacttacattgagatctgtaaatctcaacaacacaaaggacaatgctcaacttggttaaataaatcgatacatgcatatatcttgagcagatttcttttgttaatgcgtgaatgtatctccaactaacctcacattggaggatgcatgtctaattgagggaaacatactaccttgcataaataaattgcagcataagttttcatgatattggtattaggcacattgagaaaaacaaatacttattccttttcgtgcaaaaaaaaatccttattcctaacagaactgaatgtgcccggccaatgtttccttcttttccttctatgaagtacagtgcagagaaacagaacagaacacgacaaatgacgagaaacagtgcagactactccaaaataactagagaacctttgccagagcacacgagttatactgactgcactaactagagaaattccaacaggagagcagtaattacacgaaaatgagatatttcgcttaagcgaaaactattcaacaatcaacactgtcttgctcagctcagcacggttgaatgtcacattcttgcattgaacctacggcctatcaataccaggcagccacacatcatgaatcagttatcaccaattgacaagtataagcaccatcatccagacttccagagctgtggccacccgcattaatttcaccagctactaacctcttatcttcctaacgatattgacactttaacagtagtatttggacaacctccatgcaacacagaaagcaacatgcacaactaatttcatagagaaaaaaaacaaagagtaaatttcacaaaactacatattttttttatggttcaagttgcagaaaaccacacatattttgacacttggcacttaagtacatatattttggtagtttatttcacaaaaccacactatcgataaatggattcacttgtgatatgacgacgtgg

SEQ ID NO: 62479 - DNA, 7806 bp, Oryza sativa
agcgttcaagctcgatgatcaaaccagctgcctgaacaagacgctactagcagattttctgaagaaactcaaggccctgaacaaaccatccacgcctgaacacatgtaaaggttagctagcgaaagcacgcgtcagggcgcagcatcaggcaagcgaccagcttttgcaagttgcgatgcgaagaatgaattattctgtgcgtgtgcagatgcaagaagacaaacccatgcgggaacagttggagcctgtagtgagacagaaagaggagcatagtgccatggtgggtttcagtgttctccacaacggaggcacatccactaatttgtagtattctatatgatgcctgaggtgaatatatgctgatgataatacagctcaggtagtaggcccggtgctgcaaacgtatgatgcgtatgtattgagcaagaggcaggggcacatacaaatactgcaccagatagcaatggcgagagaaatcagagagcgtaaattatgcttcctgtctctcacaagtgcgaagcagcgagtggacactaaccttggtggccacctagagctatcctagtacaaatatgtttgcttaaaaggtgcatatctctaaggtagagtacaagatcaccttgtaatttatcaactcaggtgctcttttggtcgggaggatccgaaagcacacagtgggaagtcagcaaaaataccaataaacatgcttacatgtaatgcattacctacttacctgatttctttatcttcaggtcgatccgttgatgtagatgatagtgtgatatcagacggcaaaagattgcaaaatctgcactgcgaaagctcacactttcagatgcatcaactgccggagaaaggatcgagagcgatgtatgtggattttttttccatcaatcattacttcatgagtgacaactgcaactttcctagcaatcgtttgctggcttagtatggaaatgccggcgataaaatatgatttggaggaaaaagaaattgcaacaaagaagtggaccatccactgaagtcccaactctgtttggaagttagtacgtcgagtaatactgcttgatagcatcttccgatcgagggaccaatctcaggaaggtccaaacgaatgcaacccaaagcctaaggttcattgtttctgcaaatgtcgtgttttaatcacaaggtagcaacctaactattccgacaatatggatcgatgcttatctttattcaccttctatcatatctgtatatatcacaatgccgacaagtcagtaataatatgcgtaacatggaacctgaacttttctgataagtttattgcaaagttttagtttgcatctaatcctcatactaaaaagaagtgaaggtaggttgctttccctctcctaatgaaaaaaaaaataaagaataagttgtctgaaatgcagaaggatcaatacatgaaacacgcatacctcactgctatgcagtggaaacacctttgttatgcatctcccatagcccaggacctctctgaacatctagaatcctatatcctttgaaagcccgatttcacctaaaagttagatcttagatggaggcatcacatgagaaatcattctatgaaagagaattaatggaacttatcaaatgcaaaaaaaaaagaaaaaaaaagaggaagaatgtgaacaacacctgtccaactggaaatgctttacatctcatggaaattgacacgagcaaatgatcgatgatggatcatgtctctgctacagatgctttcaaccattgaagattcctgcttctcctacaaacattcactaccagcttagatggaaaggcaaactgtcaaccagtggatcatgcaaacacagtgaaacagaaaagctactatatcgtgggctcagtaagtcagaaagatacacatcaacgttctggatggtctgcatggacaatcaatctatcaaaaagctagataacaattacatgcatgcagcacagcagtactgcccatgatctagacttatcttttacgctatgcagttattcctgaaaataaaaggcagtacggaccaatctatcaatgatcagaaatgacaagcaaagcattaaagtaatagacaatcattagttcacattttgaacagatgtactagatatgcattaaacgtacataatcttttcttgattctcatctgtaacaacctctgaacaattattagtggaaaccttaattctctaagcacgtatcttcgtacagttccacttcaagtatagaacagctgcaaaccttatgactgtactctggccggcccggcgaaaaaaaaaacccttatgactgaacaagccctgattcatttaatcaaaaacagcaaaaccgagtccaaatcagcctcagctatgttcctcttgcagttttaagaacaaataacagttgctccaatatatcagtactggatgttaaacacctaacggccatttgcttattgtctcggtattacctgcaatattgttctatagcactaaagtaagaaggccatatggccatatcatcatttacgaattttgaaaggggaagctatgatccttacctcaaccacattattctgatttgaggtgcgatggattacctggtggtcaaattccttgataagcataattaattccaatcagattgatccaagaaaaccgatcagcgatctgaccggtaacagaagccagaaggaacatcaaatcctgagatagcatgtacaagttactaactactcctaggtagtggaagattgatgtgcttcacttggagatgatatgagataaacatgatgtcatgatcttaggaacaggcgtcagcaggacgggcatcaggagccctatagtatgcactcaagaaagaataatatagttcgtaaactattttaccttgttaactagagagttgggatcctcaattgcaaaagtactacggagttttttttttctagccaacgtgaaaatcataaccaaacaataagccaacaaagttcggagatgctggacaatccggtctggcgatctccttactggcggttgcgatctggcaatctcccgtcttctgttaccgccatgatctccccgggctccggccgctgtctacatttgcaactcgaatccactatcgcgggagaggagagggagagagaacatacgcgcatacggcaaatcactggcgagtccagccgccggggtttcgccgccggtgagtcaccagcggacgatggctggggcttagcagttgggctcggttgcgctttcccgtggagtcgtccgccgtttactggatccacttgggtggcggcccgttggaagtttcatggtaggctttccgctagggcaatcggcttcttgttgggtttgtctcgggccttgaaatcatgggcctcttgccgtcttctatagtccgtaaccaagaccattttggacgcgcgctgctccgtctcatcatatggaactttcctagcgatcctctagaaggcagaacaaactctaaacgcggcctaggcgattaggatttataggcgggccagcgttcatgttccgtgtgatattacaggattcatgaagttcgtgaaattttcctccaaaaagaagtaaagtgcacggacggcatctaaacttgtgtacgtgtatcatctagattcctgaactcttataatatacttttgaatatcaaaatatcatacaggtccaaatagactagacccattccatgcgctaccgtgatatgctacggtgacgtctatgtctgttggtgggatccacgtgtcagtcaaatagtaaaaataaaattaaagagtgaggggaaaaaaagaatgttttgaaattttgaaaaaaaaatacaaagagaggagaggatatgagagagcgagaggagaaaatgatttatttatttatttaatatgagactaatatgtagatttcactgacacgtataaactatcatggcaagtcacatcagcagatatattggattgaagctcgtttgaatctatatgacacacacgataaatctgaaatccaaaaataaattttaaaagtttagataccaatatgacatatccacataaatttagacacacgtttgcactttactctttaaaaaaaaagttcgagaaaaggttatgttatttttccatgcttgttagtcacgtactcttcacgagtcaggaatgtcgttgggtttgtgatctcaaactcttttttttattattttcaaggatgccgttgagtttacggtctcaaactctcctttttttatttactagaaaaattgcccgtgcgttgcaacgggtggagactattttaatcttattattgttatacggtttaattaaggtgaaatttactatgagaattcgtctggatatatatatatttctatataaaaccatgtgatgtaattagaagtctgatcatctcaagttagcatgcgagtttttttaaagagatttcttatatgactcatgtatttacaaaagcgaacgaacttaaaacccgagtcaaatacggatttgtatttctaaaagcgaacaaacttataaaccgattctacacggatgacgtaccaaagtaccggcaaaaacatctttaatttttataatattagagatttatttttatctgactctagattgcttgaaaaacatgattttggaggaagagacatcattgcaaatatttttttagaagaaattgtaaatatgttatgaattaaatacgggaccttaggttaaaattatacaccccttaccactcccctgtcaaatgcatctccctagattgtttgaaagcaaccgtagatacggttcgcccgtgaacttgcagcgcagcgggagatcaccgcccaagtctccgaccattttcatttctggcttggcagagttcacatcagcaatggcacggtaccaaacttcaagcatcggagcatactttatccaaatttgatttttaaattttcaattgatttcagtcttcagaatggcggacagttcttgaaaacctgcagaaatcgtaaggttgacggctaatccatgacttgcgcctcaaaatgctgaggcgcacgcgttacatgcctgatcctctggccgcccaaccccaagtacccaacacttcctatccaaaaacacgcactttgcttccggatgatagctgcaacaaaccatgagccccacatattggacactgccttgaaggatcactattatgttgttggtttggtttgactgagccacggcctggagcaacctgcttgcttaatcctctcgataacacggttaacacctgcggattgccgtggggaaatgctcgtcctctttgtttattccagaacaccagatcacaaatagccaatcatgtacttcctgtttcggcgcaagaggtcgcctacctgcacaagttctgtgcagctgcctgctagctccagcttcgtggccctcgatctgtgctgtgcccgcgctgtccatcccgatcctgtcgttcaggtgatcccgtattcaagtcatcaatagttacgccaatgtaaaaaatacgttaagacacttttaaattgtaggaataaaaatacacagaaaatttgattaagatgcaagggaaaatcaaataattgcaaaacaagaaaaaacaaagaaaaaccattgattagaccgtaggaaaaaaacggatgaatttcggatgagagtgatgaactcaaagaaaatttttcaagaatttcaaatgacaataggaatttcaaagatccataggaaatttgttttaacttttaaaaacttctcctctaaaaaaattgtacttttacaacaaattttctacaaaattaaaattctttaaaattcatattttttttcctacgaatcaaaagggcatttttctatctagactgataacgcagaaatgacagtactgtattcactgcgaggtgcgaaaagaatattccataatattatgactggataaagttgtatgaaaatattttaataagattaatggcgtgttagggagtaatggaaccggagaagtaagcgtagaccgagttttagcgaacgttgcgagaggcgggcggcctacaaagcgggcccgcgtttcccggcccacgtcagcctgccgcgcctaccgttgactctccccagcccgatccgaaaccaccacctccccaataaaacccacgcgcggacacagcgcacgcaaaatcgcaaatccacccacccaaactcacgaattcgatggacaccgacctcggcggcggcggcggcgcgtcggggatggacgaagcggaggcggccttcttcgcgcggcgcgggcggcggtgctgctgcttcccctggccctcgtcggcgtcgtcccaccagcgggtcggcggggcggaggaggagagctggtggcagcgcgccgtggacgcggtgctcaaggtgcgggagtggtcggagctggtggccgggccgcggtggaagaccttcatccggcggttcggccgcggcggcggcggcggcggcggcggcggcggcccccggccgcacaactacggccggaagctcaactacgacgcgctcagctacgcgctcaacttcgacgagggccacggcgccagccccgagggcgactacaccggctaccgcgacttctccgcccgttttgccgccccgccggcctccgccaagtcgtccatggacctcggcggccgggacgccccgccgctcttcaacccgccgccgccccacgacggcgccggccgggcttgacctctcgttcctctcccccacaatcacttcaccggatcaaacgagaacacggcgtcctgtcctcgatttgcttcgggttgcaatgtcgtgatttggtgagaagcgagatcgatcgttgtttcggttcggttcccctctcatcttctgtttccttcaattgagttcgttcgttactgtacaaaaaagaacatagatttgtttaattcgttctctgtcatcgaattgtcgccgtgaattcgtcgatcgtgtcgtgccacagttttgtcccgattgaagcaaacacgtttgaagttttttgatcgatcaaattttactccctctgttttgcctggaaacttgcatgaatggtaagaaagaggaataatcaaacctaattccaatccaaactctgcaatctgaaatcatgccgtgttccagctgcgagtgattgcgacccaagaattgaatgtgaggagaccttgggaaagagccgtgcacgttggacttctggtcctacaagcaacttgagactagcaatagcaatggctacggtcttgttcccatcgatccttccgtgtgacgtccacttgttgctgagaatagcttcccattgcctctcacattccttcctaactggtaactgcggctgcagctgcgtgattaaaaggtgtctatttgttaatcacgggaattacgagctatcggttcagataatcacggaccatggtattgaattccaggcaggcaatcgtgattgatactagtcatatctaactatgaacaggtaggtacttgctgagcaatataggattatttgcgttgcatcaaatcataccagaaacagtttggtggattggatatagtactaccactttgatcatttgatgtctaataagagtgccagctcgtaaagcctacagacattcacagctactccaaccatccaatggatcataatgatttgttacaaaaaccacacgtaatccatgaaaataaagatcgaagatatagagtatgatacctgtgagcagaagcatatcatttcctcatttcatcctatcttggtctttacccatacgttactga

SEQ ID NO: 62480 - DNA, 2300 bp, Oryza sativa
gggtgaatctatacatcgatagtgtagttttgtgaaactacacgaccaaaatatatgtactcaagtgccaagtgtcaaagtgcgtgtggttttctgtaacttggaccacaaaatatgtagttttgtgaaatttactcaaaaacaaaaaaccgagaaaagcatgaacatggcatcaaactagcagatagggatgaaaacggtcggaaacgatcggaaaacagcctcaaccatttccgtaaccatatttttctcggaaacgaaatcggaaacggtaaagtcggaaatgaaaacgatatcggaaatatcggaaaaccggaaacggaacaatacggacggaaacatgtcggtacagatcggaaaccggtaacaaatacggaaacattaaactataaaaacatatatttaactttacataagtatgttatatatatacataaattcaagcttatactatataaattataaattaacttcattttagccatgtacaaaagttagagattttattgaagagtcattcaatctataagctgtgggtcaagtataaacatgtcctataatattgacatatttagaatacggtaattaccatattataagaaacggtaatttccgcaagaatacggtaaatacggaaacgatcggtataacagcaaaaccatttccgttttcatttccatattttttaccatttctatttttgtttcggtcgattaccatttccatatggctcggccggtagaaagtcgaaaatgaactccggtcggccggtaattaccgttaccgttttcacccctactagcagactaaaactgagcgattgaagtgctgaaaactaagccagaaaaagaaagagggttaacgggttaagtggacatcttaccgcggcgcacatggcgatgccggcaagaaccgacgccggccacagaatccgctcctcgctcccgaaattcccatccatccctcctctatccgctcaaatccaatctaacagagttaataaagagaagcgaaatttcaaaagagactcctccaagaaaacaacctgcactcccgaataatccggaaacacaccgctcgttctttagttctcttgcaaaagatagattcgccatgggcatcaagaatttggtgcgtacttacctggatgagattgggatggggagtgacccgcggcggtggtcgcgtctctcctcgtcgttcgcttttgcttctgtgcttgtgcttcgcgcgggttgggttttcttcctcgtcctgctcggctgctcctgcctcttcgttggggggttttaaaaggggaggagacacacacctcgaggcgagtggcacactagtacacgaccatctggtccatctcctaggcgctacgggggattgatttgtcctccttgactccttgtgcgtgcactcgtgctggacctggaccatgggagtcgtcattagaaatttaaacggaaataggatgtgacgtacggcagttttttttttttctctttcgacagagagtgatggtgcttttttttttccaatcttctttcacgtattttggtcgagctaagctagagcaattaagaggtgctttctaggttcatgtgcgatctcacctcctccatgtctgtcctaagtaaataaaagcacgtaatggtgaggtaccatatttagaattgaacataagagtgttgtgctagctagtgtcaccaactaaagcgcaatgcatcatagtatcataccatatgcagatatgctcttcgaagtcattaagggcctattcactttaatgccatttcaaatcatatccttttttttttttgctaaagttaacgaaaatgtgcatctgtttagtttcttatcaaactttggtaaatatactaaaaatttggcaactgcacagtaatgatcaaaatttagtagcatgtacgttggtaacaaagtgaacatattcaaaatagttatcttgccaaaatttgacaatattactaaccttactaaaattttattattgctttggtaaggtttgaaatggcatcaaagttaatacgccctaagccaaactaattgtcaaatggacctcttggcctcattcctcattttagcaatatacctggagagacgtgttagaggcatcagcatataaaaaataataataatgtatgacatgatgtgaaaaaaaatcattagtcaactatttcaccgaactctagaaagaacctttgcataattcaacatattataattattggcgtggtacagccgtacagactacaagattcacagaaaaaaaagggccattccaatgagta

SEQ ID NO: 62481 - DNA, 1750 bp, Oryza sativa
ccggtcgtcgttggattctgagctgcaagtctgcaacgtgggtggatcccagcgtgcgcgtgccgcagcgcatcctcaccgactacggtggaaaggtggtctagaaccctcaccaccggtggcactaggacgcccaggcgagctcggctccatgactccggcaacctcgtgctcgagaactacagcggcaacgcggtgtgtcggtgtagtagagctttgatttttccaccgttgccttggtactcaatatgtactagcttgcattcagattgcaatatgtaccactccaaataaatagatgcaagaaaaggcaacagcagcaagtggtcgtgctctagctgctccgggtggtggttaatgaacccatccataccggacctaaccctcttgtggccgggcatgacggatggtgccgagtgccgatgaagccaccatcggaggcactgggccgttgtcgttggagccggcgaagagcgaggagagatcgccatggccattggagctgttgcagcgctcacacgtcatatcgcggagggcggcgatgccggagatggtggtgcgtgccaactggagcgctcgctcgccatggggtagcgtccgtcgattaattgagataggggcaaaatagtacttttcttgttgtttctcactcaatccacactggatataataaaataaggtgtttggtgtccagtagctaattaacaggtttttgcagtgtcctatagctaattcacttatttgcagtgtctcacggccaattacacatcttttaagtgtcctatagcaaattttgcctttggaataacttcaccttaagtgtctatcatattttgatgtcggatttaaattacatcattaacccaatgtatttgagatcctagttgatttaaaacttttaattggcatggtgagttgacaacaaccaacacagctgagtcagcatgggctccatatgtcagtggccaactcttcttccccctatcccctctctaccccatttctcattcgaccatctctcacccaacctattgcttcttcttcgggtcccatctccagcttcgtcatcatcccatctggtgttgccgcctcctcggcttgctggtcaacacgaagaggaggtcaataaggagacggatgagctctgtaggccatggagcgcgagacgtgagagtagaggaagtgaatagctttttgttcccctcgtggatgtaatcagatggcagtgaatggaagcaatcagcacagcaaggagaaggggaaggggaagggccagctgccaccctccaacggaaccatcgctctagctcaagctcctcacttgttgctgccgcccttcaccggaaccactactccaactctagctcgagcttcccactcactgccatcgccgcccctttcctcttcggccatcgtctctatccacgcctctcatcctggatttatggatagagttgggaaaagaggggaaggagggaagaggaggaagaagaggctgctgacatgtggggcgcacgtggtcccacgctgactcaactgggttggctgcaaaatcaaaaactacactatcctgggacctcatgtataccgattttgtaagttgagagacacattttatctagtatcgcggtcaaaggacacaatttaaactggatttttcacatttttgtccttttgaaaaacttatttcgcaaatagacccctgaaaaaacttatcctagaaatggtcctttttggggcgccagagtgg

SEQ ID NO: 62482 - DNA, 746 bp, Oryza sativa
tagaccataactcctttagtaaaaccctttgatcagcatgttaaacataatgcactctaccactatatgaaattacttaatctaattcaaaatataaccacatgaaatgacatatataagtaaacaatacatagagatgcaatttttttatttttatttcatttttttgatatttttttcacacttaggagaacataggaaccaaccgtataaaaaataaactcaaacggacaaaatatgtgacatgcagaattttccaaaactctaccgaaacggacaaaatatgtcatctattaaaataggcgtaactttctcatacggactcggaatcaggcaaataatatatgcacggacatctacagaaaaagttacatccgattctcccccgctttgccgggttcggcgatattaaaaccgacaaattccgcttgcaagattgtgttttcgaggagagaagtttttcggtggagctttggaaaattccacgtgccacatatttcgttcatttgagtttattttttacatagttggttcctgtgagttcctaagtgtgaagaaaatatcaaaaaaataaaataaaaataaaaaagttgcacatctctctcctctgcactagttcggagagaggagaggagaggaaaaattctacatgtcacatattacgtccatttgagttcaatttttctatggttcttgtgtgtccctaagcgtgaaaaaaatatcaaacaaataaaacaaaaataaaa

SEQ ID NO: 62483 - DNA, 31511 bp, Oryza sativa
  unsure (1)..(31511): unsure at all n locations
tggtttttcacttcccccagctggacactgtcttttccccacactttggtgaaacctttggctagatccatttctgatcatacaccttgtgtggtccaaattggaactaatattcctagagctaatgtgttcagatttgagaatttttggattgaacatgaaggttttttcgacttggttcagtctatctgggataaccatggttcctcccatgattctgctaaaaatatttcttcaaagcttaaagctttaagaaagggactaaaaaaatggagtaagaatctttccagactccagaagcttatctctaactgtaataatgttatctcttttctggacagtattgaggaatacagatatctttctttgttggagtggaatttcagagtttttattagatctaagctgcttacttacttaagatataagcaagtttactggcaaaagagatgtaccattagatgggcaaaatttgggggagaaaacacgaaattttttcatgccatggcaactgagtcctacaggaaaaattctattgcttccttgatagatgttgatggtactataatctttgatcatgagggtaaagctcatgtggcttgggatacttttaaaggtagaatgggagtttcaaattttgtgtctatgccttttgatctctattctttaattacccctcaaaatggtctggaagttcttgaggctccttttcccaaatccgagatagataatcttgttaagaatcttccaactgatagagctcctgggcctgatggtttcaatggactttttatgaagaaatgttggcccataatttgtcatgattattataatctttgtcaagattttcattctgggtcacttgatttaaactccttgaaccactcttttatcactttggtccccaaaaagttgacccctgaaaccataaatgattacagacctatatctctcatgagtatctctctaaagtttttgacaaagttgttggcagatagattacaaaaggtaatcctttcagtcattcatcagaactagtatggttttcttagaaggcggaccatacaagattgtcttgcttggaactttgaatttctccatcaatgtcatcattccaaaagagagatagttttgttgaaattagactttgagaaggcttttgataccattgagcatgaggccattttgcaagtcatgaaggtgatggggttcactgataagtggttgaattggattcagaagattttctcctctgcttcttcatcggttcttcttaatggagtacctggaaaaaatttccattgtaaaaggggggggggggttagacaaggtgatccactttcccctcttctttttgttttaggggctgatctcttgcagactattctcaatagagctttctctttggggttgctctctaagccctttccctcaaatcaggatcagaatttccctatggttcaatatgcagatgatactctcctttatgctaaggctagtggaagagaactctttactttgaaagctttgctccaatattttgctcaaggcactggtttgaaagttaattaccataaatcctgcttaattcctataaacatatctgatgaaaaggctgatttgctggctggagtgtttggttataaggttggttctcttccttttacttatcttgggctacctttgggaaccactaagccgagggtaattgattttgcccctttggttgatagagttgaaagaaggttgtcggcaaatgctgctttcctctcttatggtgatagacttaccttggttaacacagttttttcctctctgcctacatattatatgtgtactcttttgttgcccaagactgtaattgacaatattgatagagcaagaaaacattgcttgtggagaggttcagaggtaaactctaatagaaagtcgttggctgcctgggataaagtatgcaaaccaaagatgaaaggaggtcttggagtcattaacctttcaatccagaatcaggctttactcctaaagtttcttgataaattttataataggagaaaggtgccttgggttgacctcatatggaattcttactactcaggttgtgcctcatttttcaacctcaaagggttctttttggtggagagacatttgtaagttgatggatttattcagaggtattgccaaatgttccatgggtaatggttattcttgttgtttttgggaggatgtttggtctgaaaatccaccattaacctttctaatgcctaggctgtattcttttgcaaatgacaaatgtttctgtacataaatatctctcgactgatatgtcagataatttgattcttcctctctcacagcaggcttataatgaatatttggaactgaccgagtttctcagcaacatcaacttgtctcatgagaatgatgtttggtcttacatttggggtggccttaagtatacctcccaaaaattctatgccctcaattttagatcactgcagcctccgaggcatttcctctggttatggaagagtaaggtttctcaaaggttaaggtttttggttggttgcttctgatggaaaaattaaataccaaatttatgcttgatcataagcactgtgcccctcccaattgtgatctcttttgtgtgctttgtcaacagaggtgtattgaaactcttgtgcacctcttcttttgctgtcctttttcggtagcctgctggaatcatattggcatctcatgggattcttctctcaatttggagagcatgcttctgttggctaaagctctttatctaggaaaatgttttatggagaaatttctcttaggtgcttggaatatttggaagcaaaggaatgggtttatttttttaggataaattgcctttgttctcttcttggaagcaacttcttaagggagatttgcttcttttgctgtttaggctcaatgcacaagatcaagatgtagtcagggactggatccgtctgctgtaatctctttgtaatttcatattttatttttattaataaaattattctaacagcggggccctcccctgctgtgttctcttcaaaaaaattctaattaacggagtgctcgatctgttgtttttatacttttattgtccgcactttgtaggaaaataacattggcgttgttcggctaccctagctataacaacaagcctgacaatagtgctccgtgccttttatagctgtaggatagccgcaacaatgtcaaccgaacactgccaatcatcatttcaaatctttacccttgattcaataatttaaaaacacaatagcccgtatagatgtatcagctgccgtttactctacgattatactactacaagtagaacgttgggcgtcaaatgctatccaaaacgggtgccaacgttcgaacggccccacatggaagcgtagcctgttcacacggggtgcaagaacgtcatttccctacgtttttgaattcgaaaccgcatccagagagccgaaggttcctgcggcgcataggccacgtccataggccacacgcatcctaggcactcaagccaagcaaccaacggtgatagatgcgggacgccccatgcaccgggtccacggaggcctcagacgctccgttccttgtcacgtgatgttaagcatggcctggaccgggtctatacgccacacgcggtagagaatgcctacggggcttagcgccactcacccacgggtctatagacacggtctatgcagacgataggctaaaacatttcgggcgtgtgccctatttttttcaatttcgccgggcgggcgcttctccctctcacccattcgtcatttcgcaaatctctctctctccctctccacgccaatctctctctcgaggagggcgatcaagccctaaccctaacgaagccccccgcgacgccgccatccagatccccggagccagaggcattgctcgtcgtgccgggagattcgccgatccgccagatcggcctgaccgaggtgagttttttgggggctaattttagatttctagggtatttttccgtgagctgttggtctgattcgttttgggggattcgtggttagggttccgatggagggttccgaggcagcgcagcagaaggacagcgtgaaggtggtcgtcaacatccgaccgctcatcacgccggagctcctcctcggctgcaccgactgcgtcaccgtcacgcccggcgagccgcaggtatcgatctgtttggggactagtttgtctggttgggtaggatcgagtggcctgggggacgcgatgcttctgggattttgaattgggtgcatatatgctagtataaattggcgaatgatgtgacaggccttggggtttttagctaattcgatgataatttgggtagagtggcttggcaagggccaacggtttctttgctgggatggatagtgaaagatctatgcttgcgctttgctgattctgagctagtttgaataatatctttaatattatagttttaccactcgcaactcctatccagatgtctaaatcctaatatgaatgctagttaagaatattgtaattttacctggacttttgtattgttaaagattgcttcaaggcccaactggtctgacgatgccttctgtgctattgtaggtccaaattggcccacatgtcttcacgtatgaccatgtattcggcagcacaggctctccttcctcgttaatatttgagcaatgtgtgcatcctctcattgattcattattccgtggatacaacgctacagtcctagcttatgggcaggtgcaaattctttagtatggtggcactaataatgatgctagaaatgtttttttagataattgttttgtgacttgtatttttcctctaacaaaattagactggctccggcaagacatatacaatgggtactaattatactggtgaagctaattgtggaggaataattcctcaagttatggagacaatattcaaaaaggccgatgcattgaaggatggcacagagtttttaattagggtgtccttcattgaggtatcatacatggtggcatctattgttgttttgccagttccaactgccatcagtttcattcgtgataacatttttgagatcttttgtgtgcactccagatcttcaaggaggaagtctttgatttgctagatgcaagtcatgctgccctcagacttgattcagggtctgtagccaaagcaactgcacctgccagagtgccaattcagattagagagactggtaatggcggcattacacttgctggtgtgacagaggctgaggtgaagacaaaggaagaaatggcctcatttttggcacgtggttcttcctcgcgtgcaacaggaagtacaaacatgaatagtcagtcaaggtaagttacaaaggaatgatagtatgcttatttaaatttacagattagtttatgcaatttctttatgcagagattatttttccttcattgcttctggggttcttgtgccatgtttttaccatttaaaaggttataaatacaatattagcacttcatgcataatgaaacttgcactcgttaagctgcatgcatgttctggttttgcattttgtatttctgcataataggtatagttttgcatgatatatttgcatcgacgtatagatgcccaaaagtatgtgtttttgttatcaacaaaaaggattgggtataactttattgtacttcttgacattattggagccaataatataattggttagcaatggtagtatgagacaagtaggtgttttttacaagtccatttactatttgaaaatttgccattaggtctgacaattctttctgttggaatgacaatttttctttgtagccggtctcatgctatctttacaatttcaatggatcaaaagaagacctcgagtgcctctgacaagttatctaacgatgactatgatattttgtcctcaaagtttcatctagttgaccttgcgggttctgaaagggctaaacgaacaggagctgacggattacggcttaaagaaggtaaggacggatttacctattaagttgagaatataattgggcatctgatctgaacagtgttctatatattttgtggctgcaggaatacacataaatagaggccttctagcccttggcaatgtcattagtgcattaggcgatgaaaagaagagaaaagaaggagcatttgtcccatatcgggacagtaaattaacacgtcttctgcaggtatggatcctagttatgtcacaagcatattaaatactcaaatccacgaattactggacataaaaatatgcgattactttggacctgattgctctgtcacagtggcacgtttgcatcatgctcattactatattcaattttttttgcaggattcgcttggaggaaacagtaaaactgctatgattggtaggtatatatgtcttgatagtaaatgttgtattggtagtatctttactaaaatccatcttctatgttgtttatttacctgtagcttgcattagtcctgccgattcaaatgcagaagaaaccataaacacactcaagtatgccaatcgtgcacggaacattcaaaataaagctgtggtatggtcattctccttaaaggtatgctcacagtattttttcagttgatataattttcccactgtgtcctatgtgtagataaaccgtgacccagttacagcagagatgcaaaaattaaggagtcagttggagcagttgcagactgagctcctgttctcccgcagtgggagtgctgctctagaagaactgcaggttggttttgcagatctgcaaggtctggttgaatttatcgatttattgtctaattttgtttatgcgtctttcagctgctgcaacaaaaagtgtctctacttgagctaaaaaactcagagcttaaccatgagcttaaggaaagggaattgtcatatgaacagttggcacaaagtgcacttgccgcccaggtatttatgattgattcctgtaccctggtttatctaagtgaagttccaatatacttgtgcataacattattttgtagtactacatatgagttcacattgctaggtgatgctgtatataggtgtattctagatcatgtaatatgtttctctggtaactattgcaattagtatgaaacacatgaaaattatctgtaacatctctagaacagaatgtagctagtaaactaacatgcaaactgtctaaagaaagtaggcgtgaataactctgctaacaataatatgttacagcttgaaaaggaccagttgatgttgaagattgaatcagcacgcaatgggaaatcatgggatgacattgagaatactgatactgaccaggtatgtccacccatctcctgctcttcagatttgtgggaatatttcttaaacaacgtaattgaacaaatttttacatatgcttttgttctgagcaggatgtggaggtcatgaagagatatattttgaaaattcagcagttggagagtgaactgacaaggcaaaagttctctagtacctgcaaaaatgatttacatgatcggtttgccatggacaaggatttgcttctcgatgacttgggttcaggttgtgaagtaggaacacctgatgcttcaagtaagtaaaaggaagtcagaattactttcataaaatgcggttgttatacttttttgaataagtagcttgttctaagtcacattttacaatctagtgacttctagcactatatctaggattatctgtatgacatgttgattcttcttttaacatgaccactttatgttgttttagctttacacttgttcacacgagattggtgttaatgcgtagaacattgaattgaaagcagggcttttgtgcatcacacagtcacttttgagtctgcgctctatgatattagcagtgaacttgcctgtggtgtgttcctgtgtacatcagtatagaataatataccactaattaacttactgaaattaacagttccaaagaactgtagaatttttcgcaccaaggactagggtttcaagtactggtttgtatggagttattggcccctagtgaaatacagtaacgggaaattggatcactaactggttactgcccggaaaactctaaaattaaaatttgaacattctaaatctaatataggtgccgtaaactttagaataactccagtacctgcaggtgaagccgatgaagaaaaggaaagagaccattcatccatgcaagacaaacttgataaggaactccaggaactagataaaagacttcagcaaaaggaggtacaatttccccttcttaacaagtgttgctgttcatagacaaggctacaacaatttgacttggtctaaacactttttacatgaatttgattattctaacactagcttttaagttatatgtatatgtatatgttttgatttatctcactcatccatgccatctgtacaccttttttttttcgaacaactgactttatatcacatctatgtgaaatttttttacgttattctattgtttgattcacggggagtgtaattatattccattttcaattccaaaaggcggagatgaaagaatttgcaaaaagtgacacctctgttctcaagcaacattacgagaagaagttaaatgagatggagcaagaaaagaaggctcttcaggtttatttgattaaaatggacaatttcttaacttctatctttaaagattagtaacccttttttttgttttcagaaagaaattgaggaacttcgtcatgcattaaccaatattacttcttctactgatgagagtgcacaaaaactgaaagaaaactaccttcagaagctgaatacacttgaatctcaggtgcgcacacactataactgccttttctcttcctcagatactgattgccattgttttgcaggtctctgagctaaaaaaaaagcaggaagctcaacagcagctaatacgacagaaacagagaagtgatgaggctgctaagcgcttgcaagaagatattcatcgtataaaatctcaaaaggttttctcctcacagtttcctagagacccaaacatagtttagctttatattctgacatatcctcaatatgtgttatgttaggttcaacttcaacaaaagattaagcaagaatctgagcaatttagatcttggaaggctgctcgggaaaaggaagttcttcaggtatttgctctttctgcttgcagtttgaattcttgggaaatccaaaattttcaaaagactggggtgatcacgtgatatttctgttaactagctcaagaaggaagggagaagaaatgaatatgagatgcataaactcctggccctaaatcagaggcagaaaatggttggatttctcagtcatctccctttctagactttctaggtaacatgaaagtaataccattcttcttcaaaacataggttttacagcggaaaactgaagaagcagcaatggctacgaaaagactgaaggagtcgcttgaagcaaaaaagtccacccgtgacacatatggtaataagctgaaaacatcgactaattttatttcccattcagattactgtgcacttgtgagcaagtaattcgtaaatactgcctcatggttgaaaatttatttattttttaaattttcaggaagtgcaagcggttctgggattcaggtattatcactgaaactttgattattttttgtttgcatatatagaaaataatgctttcccattgcatttcatctgaaatattctcttgatatgtcattaggctttaatgcgggccattgatgatgaacttgaagtgactgtaagggcatacgaattggttcgcactacgagcgacaaatgcaagagtaagtctttgtcttcatgatggatggacttccacagggtacatttattttttttaggtataacacattcatgtatcaaataaatgggtttcagtaccttaattacaaaaggtagcccctagaactcgacggtatggatacagcctgagttaggtcacatgatgttttttttttttttttgggggggggggggtgagcttaagctgccattgaagttagggtggttggtcttcttcgcacatccagttggacttcttttctcttaataatgcaatggcacacaaacttttgcatattctttttttttttttttggggggggtgagcttaagctgccattgaagttagggtggttggtcttcttcgcacatccagttggacttcttttctcttaataatgcaatggtacacaaacttttgcatattcctagaaaactgtcttgatcttttcatctaaattttaaccaaacttcttttgtttccaaaaaaaaaaaccttttgctttgagccaatccacaatacatcattctgatcagtgcagttcaaataattgttcctaactttcattctggttgagaaattgtttctcattattctcctctaatatcattttgtttttctttaacaggagagcagcaatctccaaggaaatagcaaagctgaaagagtgtcccaggctatgtctcctagtgctagaagttctaggatatcagcgctagaaaacatgctgtcatcatcatctagtgcaatggtgtctatggcttctcaactgtctgaagcggaggagcgagagcgtgcattcaatggtaaaggcagatggaaccatgtaaggtcccttcctgatgcgaagaacacaatgaattacctttttcagttggcatcatcttcaaggtatgtcatactttgctttctgaaatgtttaaatcctcttaacattttctttggtgtttcttttaatacgaataaacaaccctaatttattgatgctgtttttatttgatgcatgttgcctatagatgtcaacaacttgacaaagaggtgatgtgtaaagagaaagaacacctcatttgtgacctgaaggaaaaggtggttgcacttaatggtagaatcagacaattagaaactcaagtgaaggatttgaataaccaaaatatgctggtaaatattctgttaattttgcagtctggcaaatctgattacattatagcaattttcatgatgcatttcaccagtatatgtttgattgaatcgtgtgtgtgcttatactttttcaatccacagttatttactgctataagtgaagcaaaaaatcctgttggcacttccagaaagggtactgttggttctgaagatggtcaacattatgctatgcgaaaggtattttttttgtatcttggttcatctagattatatgtggtgatatccaaaatgcactagatccatataatccttgtaaagtgtgtctgacatcttcccttttgcatgtagagcattcgagcttcccatagtttacattatagtaagaacagcttcttgtggtctgatgacatggatatatcagattctgagaaatcggaaggatctgatgcagattgggaagcatctgatgcagactacggagcatctgatgcagattgggaatgttcgaagaaggtcagaagacgtcggcaaacagtgtccagccatctgaatcctaacccgggtagtggtactacacaaaaaagtgcaaaatcagaaatggccagtcaagaaaagtctacttcactggaccttgctccacagtgctgctcatgctcgaaatactcatcctgcaagacccaaaaatgcgaatgtagagcttcaggttcacattgtgggggtgattgtggatgtattacctccaggtgttctaatagggtggatatgaaggaagaaaaggaaggtggtggggtggttgaagtatcttcttcagatgatgtggatgatgcaaaagttcaggaaattgtgaaggagggcgtcatgcttcttgagaattctatgtcagagaaggaagctcaagagacaaaatcaagaaaaccactggctgatattggaaatggtgtggtatgtgctatgcttcactccaggccacattgtcttgttgattaaatttgcatatctttcaatggatataattaatcatcatcattatcgtgcagttttccatgtcacagaaatgcctcatattgcttcacactcctttcaggtgaaacaaactggggcaaaaccaaagcaaaggaagaattggcgcaagtctaccgttcagctcgtcccttcagcgccacctctcccacccacggcgccgcagaacaccgagccggttccacggaacagagacatacccctcaggctgccccgagcaatgtcctcaccagctgtggacagcatccctctcacggaccgcaacgccgcgaagcctgacgaatccatgagcagcaacaaggagaacgtcactgccgttcgtgcgagatctcctgctcggccgagaaagaacgccaacgagaaagagaatcacttgcgatgattagttgatcaattggctcactcgagcctgtgaagctgcaagcatccaacggctttgttgcgaagccttttgatgttacttggtggtggggatgctgcctcggtgtccctcggcatggccggctgcggaggcaaatagaagtgaacctctggagttcctgtgaactgacccgctcgtgatgcaccgttgtttcactttgttgtcttttgttaagctatggctgatcactcaacgttgaatgtagacactttgtacaactcttgttgagatgaattaagttggttaatttatctcatggtaatgggtaacatttccatcagttggctcgcacttcatcttcgctgccttagcctatcctagttccttttgaaaaaaagtttatttgttttcagttacttctttcagtatgggtaatctttgggctcgctgttttgccttggaccgtgtcctgggttaccatgttcctgtataattgcttagtggaatttaacttgcattacagtagtaaatgcgtaaccaatcccactaaaatgctgccaatgtaggagcaaattggctcaatctgctgatcaacaatggaattcaaaacatgataatttcaatattgatagaagaactaatagtgtgtagatacccaacacgagacattaagcgagcactctaaattcactcctctagaaattaaccagcaaatgctatgagtctgcaaaagattttttttttttgaaaaaaaaatccctcttaaccctatgtatctcatttttgattttttttcccttagtgttactccctttgttctttgttatagaataaacaaatctagtactaaaggatgtatcacatctcgtgctttatttatttgggaataaaggatgtatcacatctcgtgctttatttatttgggaatagatggagtaattgttaaagctatattaatgatgttgtcttggtcttagtttattcaaaagaaaataattaccttgtgagttttgattaaaaagccaattattttataaatgaaatcagtaatagtagattattgacatggagttgaacctacctactatcatctgtcatctgtgaccagtttctcgtaatataaggcagcagcgactagtggctgtggttcaacagatacatctcggacactgttttaaatcggcgattgaaatgaattccctcttgtttcagtttgtagggactaaagttgtcaatttcttttagcagaaagattatggtccttgaaaaaaagtactgagattcacatgatcatacatgtgcatgttattagggcattcctaatgtttgttacaaaagttggtagtaagataagtccatgtcagaagacaatagtagattgaaaataaatcacaaattcacaatgtatatatatgtagagtggataataaggacccacataaatgtagagtggataataaggacccacatatatgtagagtggataataaggacccacataaatgtatatatatgtagagtggacccacataaaaaacccaaaacatgagccatgccacaattaaaaaataggtagaacacaccacgaagtgacaagtcaaacatgtttaactttgatcattaatagcaataaaataataaaaaaagatcaatcatgcaaaattggtgttatttgatttattattaaaaaaactatcacaatatacaactctttttatttaaaacatcttacttttatagatattgttggtcaaagtagcattttagagactgtgtcaggatctaaaaatacttatattttgagacggatggattagtaattatttactactttcacaatatatcttatctggtggcaagaatactttaatccctatatacccaccttttcactatattatggatgcaacatattaaactatttggcactcttacaagtgctaattaagtatttgtcattggacccacatgtcttagacacttaaggacccaaactatgagtgataaatttttaattgctacatcttaaaagtggcaaatagttgaatacccctgtggatgcccttatatatggatagtatattcacccgtggaaatttatgcattattaaaaaaaacacacacaaaaagttggcaaattgcaagacgaggccatgggcggatctacattactagggctagtgtcaggcgacaccgacgacttttagcaaaacctataacaaaactgcttatctatatgttataacaaaatgatctaagtataattagcatactatgataccgatagacacgttatgataccaacgaatcgattttctggatccgccactcgacgaggcatatccgcctctcatgctggagtgctgggtccagtcacgggacgatacggatgaagtactactcctcgcccactgcatgctccctagtcccttccgtagagatgcacggtgcgccgtgccgccgcgcgctgtggccaggggcaacgccacgtttagcttgccgagtgcacaggcaccagggaaaaatttagtttttagttattagcatctaatctccatcttttatgcactccctagaaaaaaatatgtgtaccaccttcagctactgcacgcagcccatgaaggcctaatttcaaatattaaatcatctaattagcacttttttacaggttattatcgtctcattaaggactcagcttaattatatattttgcccattgctatgtagacatgtactaccagattttttattttggtaagcattttttgtcattgtatacattacatttacatttctattacatgcataaatgaagtgtgcactcgggtcctccgtgctctagattcgcccttggctgtggcgtcgactgatccgcgtgtgcttccctggctggctggctttctggccaggtgtcggtggacgaacgttttcattgtgctgttggcttccgcctcctcgcggcgccggcgccgtgaagagttgcaaacagcagggaggaaatatgtaatctgacatgttagacgagacgatggcaaggcgccaaggcagaagagtctgaactctgaaccagtacaaatcacctcgctggcgagttggctatgcaagacagcagagttcaatcacattaaacatgagaagctagaaggatgcacagtctcacattacattcgatccagtgcatcgaatagagactagaaatgccagtgccgcggctgcatgcacatttcacagacccgtacgagatcatgcacgatccatggagagccgatggaccgaacagttccacgacaaccaacatatgctgcccaaccacttaatttccgcagcttcttcctttgcccaacaatcagtcaagaccgggccacgccgcacagtaccacgtacgtacccggccatgttacgttccacctgcagatttcttcatcttccacacacgcccaacaaatcattgcccaggttgtttctttcggcgaaaaccctgtacactgaactcggacgacgaacgagttgacggctcacgacgctaacacgcgaacgaacccggtcatctgcgtgcatatgcagcgtgccctcgcggcgtgggcacggcgagctctcgctgatcctgtgcacgcaccgtgcggtcaaaggatacaaacatgtgtccatccatccacagggaccccggcccccccgtatcgtccatcatatcgtagtacgcatcgttgcagccacggtcagcgaaatatacggagatgaccatactgatcgtgtatggggacagtgatatatatgtatatggagtatgtagtaggggcgaactgtacacacaggtcgtggacgccattgcgagtaattatgaacgaattagcagtgcacaatggatgacggatcacagcacgtaatgtgtgtggtggtgtttggatacatggcctaaacattagtctatatagcatcgaatgtttgaacatagactacttacaaaaactaattacataaatgagagctaattcgcgagataaattttttaagcctaattattctataattagagaatgtttattctagcatcacataggctaatcatggattaattaggttcaataaattcgtctcatgaattagtccagggttatttatggaatgagttttgtcattaatctacgtttaatacttataattagtgtccaaacatccgatgtaatagggactaacaagttttagtcctatcaaaacaccccctaattatacttataattagattcgtctcgcgaattagtccagaattatagaatgggttttatcattaatctatatttaatacttataattattttgatatgaggaggagtcaaactcaacgatggcgatcgattgatgtgaaggactggatcgatcacggaacctttcacgtttcccaatgcatcgatcgatcgatccgtcgacagcgccgctgcatccgccgatgagtgaaacggacacactcctcccctttacaagttacaactcacatgacatcggccgtacgtgcatggatgcatcatgcatacatgcatgcgagcgtcgcatggacaaacatggtgaaacacacgacatcgaaggctcgaagctagccgtgggcggccggaggcatcgtatactggcagccagcgtaagagagtgacattgaatcgattccaactctgcaactcactgtgtctctgaaactggtgtggttcagtgaaacagtgaaatccgcacggttcattctagcatttttcacattcatattgatgttaatgaatctagataaatatatatgtctagattcattatcattaatatgaatgtgggacttacattgtaaaacgaaggaagtattaattaataagttcaacagtgttttaagttctttaaaagaattcttataaactccttactgataaaaaagtatactataaaagttttaaaaaaatcaagattcaactataatacaacacattagcatttgtaaaaagcttataaaaaaattgctatgcacccgatacatatgcacaacttacatccggctaattcatgtacaggtgatgctgcttacctggtctcgcatggtaaaacactaaacttaatgattgatggatgtggtagtcttatagcattactcttctctttataaaaagaatatttttatatcattttccagaggttaattgccttcgtaggtttggctgatgtgacatgcatgatcgagcaactgtcttgcagcagctgggttttcgtcatgatgggtagccctggtctagttgctttggtgcattggctttggaggcaaattgaattgatctggacatcagagacgtgaaccaatccgcaatgttcgcatcatcagggcaatgttgccgttaaaattctttcaatgaacttgtctcttgcccagttgcattacaaacttggccaattgtcatcctaggatatgattgaacgaaagggttattatcacgatgagtcatgaaacccataattctcgatcggtccataatggtgaacacttgaactatgaacccttagaacattaaaaagttggcaccctatgttgtgtgaggaaaatgtatcaaactttacgctatcaatatggcaccgctaatatctcaaaaagattgtaaaatcagttggtaataactactttataagtttaaggctctggcagaggttttataggattttctaaagaaaatcatatgaattggaaatgttccactatgggcgagatgatagggagtatcatttttttttcattttaaaaattattttaattatgtaactgatgtttaattaaaaagtggaggcaaacgaatttatacacgttcgtttaaattgtacttccataaaccaaaatataacacattatagtttcttaaatttattctaaaatataataattttttcacctacattatcttctcaaccaaaacaaaacaccttctactgttcaaattatgtatctatcttcttttttccaatcaatcacaatctttttctatttaattctattaaccaatttaatatatgtgtctaatcttaaaattttgagtaaatttcaaaaaactacaactttagtgacaaaactatcagtttgctgtaacattaatgacatgtttcagtttgctgcaacaatagcatagaaaattatcataaaactacaacttttacgctatatgatgctatagttgttacctatatgtactgtagcagcacataacgtaaaaggtttagttttgtaataattttccacgctattgttgcagcaatctgaaatatgtcgctaatgttgtagcaaattgatagttttgtttacagtttcctaaaatttactctaaaatttccgatattacgcaaaaatcaaacttgctggtaagaatgcagtacagtgtgattgatcgacagaatctgacgtacaggatatcgtatgtacgttgcagtacgacacctccaactagttcaaagcacgcagccgcacacatgattgggttaatatagaataatcatcacaatgcgacactagaagaaaaaaaagaaaagatgttacaacaaccgtgcgcgcacagcctcgagacggagacgtgcagagagagaggctaaaacactaaaacccctcgtcgggtttagccacgtctacgtagtacggcaccagcggcgtcgtggcggcgctggtgctctcgccgccgccgttgcccgccgcgtccatggcgtcgtccagctcctccttggccacagagccgccgccaatggcgccgcgaatggcgccgggcgccgccgtggggccgaccgacggcagcttcgagaggagcgcctccaggctgctcatcgacggcacgatgtggtgcatctgcgccgccgcggcatgggcgccgtagtaggggtcgtagaggtccatcgtcggcgacggcgcccaggccgcgtcctgcaggccgccggcgccggggaacgcggccgacgacgggtgcggcagcagcacgcccgggatgctctccaggtacccgaacttccgccgcagcgccaccacgtagctcaggtcctccgccacctgcagccatggacgcaacgcaacgcgacgcaccaatcgatcagcacggccatgccgacaccaacacggcggcgagctgtacgtaagggtgtaaatagttaacccgtaacctacttacaggttaaaataaataatttattttgatctataaataagtttacggttaactgcttatacccttagctataggcatacattgcccccttatttgtcgtgcatgcatgcagctacgcgaagccagtgagcgagcttgacatgatcagtgacaccaagtcacccacagtgcaactgccagggttgaaaatttcgaatcgaaatttcggtcatttcggtgaccctgatacgatattaatttggccgaaatttttgaattttttaatttattcatgaatttggataatatttttacaaattcaactaaattttgttcaaaatttcagaaatttcggaccgaaatttttgaaattttgggatttcggtgacccccgataaaaacccctgaaccgatagagtaaaccctggcaactgctgcacacagtagagtgggtgaagaggactgaagaacagagcagagaacgggcgtaccttcttcatggagcctaactgtacaacgccttctctgacggcgatcagagcaatggtctgccaaaaaagagagtaaaaagatcatcagctttggcattcacaaactctttcttggtaggtacgaggcgtacgtgtaccttgataccggactggaactgagcttcccatgtccttggatgctgcaatcagcagaaattatacggaacaaaaacatgttaattgttgttattgcaagcatcaatttaggagttttaaccgaactgattagataggtgagaagatgctgcagcttacagaatcggcagggttgttccatgaggtaaccaggttgatctcgtgctcattggcctcctgggacacccacttgtggccatggtcagctgcaactttcccaaccaaccttcaagatggatcatcgcatcatgagatcgtgcttcacgtgctgactaaagtgattagcgtaggttttcccaaagaacatagattactaattaagaaagacggccaatactatgacactaattaattaatgatgtttcaagccaaactgctaattaattagtactaccacatacccttccccatagttgtagatgtcatgggacatcttgaagaagagctcaggctggaggcccttcacctcatgcccagctgctgcatagtcagtgtacccggcagcagctggtgtgtcctcttggtcacaggcagaggctgcaaagttgcagaatccatcctcccatgccaggatcctaggcgagttttgtaaacccccaagatgaatcacaaacacgaattaatcaacaaacaaatacaaatgcataaggaaagaagatcctgcaccaaccagttcctcctgtttcctctactcctgtcataaacaccaccctgaagatcccatctgaccatattgaggaaaaaaaaacagcaactagcatcaatactaaatatggagcaaaatgctactgctaattcttttactgtcaaactaatcagtgtcatcaagtgagtattcagctaagctgggattagttgactcactttggaggagggtagtttcttgggaggattcgccagaagacggcgtacacccactgggagtcgccttgggtgcagaggccgcgcagcgtgtgctgcagtagctgtgtcacagccagtgggttcagctgctcctccattgcagctgagctgaagctgcttctgttgctagctgatgctgcacacacaagcttatagacggccaaggaatcaagaacaagatactctagatgcttgctctcattagctatccacagatcactgtgtatgtgatgaagctgccgcttgatttgaagctgaagggctagctagaaaaagttgatttgaagctatgagaagttttggggggcaggggccaggagtaggtgtaggcgtttcctttcttgcttgatagcttccactttgatctctctaataagctgcaaactggctgggactttgtgaggccaggccaccacagagggagcaaccatacttgcctgaatttatacacagccactcaaccgcacacactctgaagagagaggaaactctttcaatcactcggggatgccatctcgtttattcaaacacattacttaaactgttataagaaaatctttaaaaaatagcgcactatccaataaatatttagtctaaactctacttatacatggagaaataaaaaaacaaatctaacaaatgaacagtatttgtactatttacacttgaatttacttttgttcttaatgtatagatcgagtttaaatttgattttcgatagagtaatagatggaactctggtctacaccgtcaatttttcatatattttttataattatctattatattattaaaggaatagaaaaaggagcctccacgttcgttctcatggcctagaaattctcgcattaatcggagaaaaagaaaaagcaggacccatatagaaatacaatttagaaatagctgaaattcgaaattaaaaagtaaggaatatttgaagaggagactagagtccatatagaaatacaatttagaaatagttaaaattcgggattaaaaaataaggaatattagaagaggagactagagtccatatagaaatacaattaggaaataactgaaattcggaattaaaaataagaaatattagaagtagagtatagagtccatatagaaataaaattaggaaataatagaaattcagaattaaaaataaagaatattagaagtagagtatagagtccatataggaatttaaaactaactaaaattcggaataaacacaatagaattaaaagtagagctttgagtccgtataaaaatacaatttacaaataactaaaattcgaaattaagaaaaacatgggaagaagagtttaaagtcaatataggaaacaatttagaagtaactgaaatttgaaattaaaaaattaaagaatattgaaagataagtttagagttcacatagaaatacaattagaaataataaaaattcagaaataaaaataaataatattggaagaagagcctagagttaatatagaaatacaatttacagaaaattcggaagtaaaaaaaagaaaaatattaaaagacgagtctagagttcatataggaatatatataatttacaaataactaaaatttgatattaaaaataattaataactaacacgtatataaaatacaatataaatattacacatttgtagtttcgtaaagttattgcaaaatttaaaattatgatgttattttaatatattggaataatataatgagaaatcatatatgctattatatgagagaaaatataatgatgttagccgcgcaatctacgcgggccaccatgctattttatattgaatttgagagatgaaattagagacgttcgagattagaatctgttgctataaagagagtcatactactacagcgatgactttaatgtggtgcattgtttctctcttgtcatagctttagccgagtggctaccataccttgcatatatagctttcctttttccttatgaattctgctctctagtgtctgtctccttggtgcccgcatcaagctgatcgtacgtctgtgtgctgacggagcctttcttgcttcaattcttcttctgaaaagcttggctccgagcctccaaccactggctaaagaaaagtaaaaaaccaaatttcgcaaaagttcatatgatcttaaaggatcgcacttgagtaaattcccaagtgcaatggaccttacatagttacattcacctaggcactgttcaagatgaccaattcacagtggtttgcggtgcccagtttctcctccgtagtccgtatggtttggagttttgattcgcattgcgtcagtattaaatccggggtcaaatgccggacccagcaaagaacacttggatggagctgaatggctctgcaattctgcgttacaattggcaacacactgtatgagatgaaattatggacaggccctacattggtctctcattctgacactgcgtgagagagtgctcagggatttttgtcactcattccatttcttctaacgttcttgatcctgatttctgaataatggcactgcgacgccaatgtgggtggccctaagccaataaagatgcaaagtgtgctgctgccttgagcaggggaacgaggaaattgctagctgctgctccctcttgttctgacaacctggaccaccggtctctccgaataacagtgttgtagtagtatgaaattagtatatcagatctgtctatgtgaatgtgtgcagatgcatgccatacaaatttatgggcctttgaatattcttatttaacttttacaagttattcgttttcattatcgtaaggcaaacgaattgatgtgtaaatatgtgaaggaccgtgtagagaaatgtcattaacaaaaggcagattttctctaagaactccaaaaatgcaatcaatttgtaaataaagggttgaacagaacttgctgcatttgcgtattacttttccaggctttagctaatttttaggcactatgtgtcttttagcgcagatgtaccaccctagtgttaaatttgtcgatcattttgatccacacacgcgcactatatatgcatccgaatccatcggtcactcgcaccagaaagctaataccaagagtcgtaagcatgcatgattgcatgccactttgtctgagacttcaccttacctcgatctggaattggtgtcaaatggggagcaaagcaatccctgcagggagccaatgactccaatgagtgaaggttgtaccttctcgttgcccaggatgatcccagctcgctaacaaaaagcatggcaaggatataggcaccatgttcaactcaataaatttcattaccagtatgtttggtgtgaaattttacgttcttgagagagtacttataggtgttaaaattttacactaaaaattttaatacctcaatatgcgcagtaacccatttttggtggtgcgcatggcagtaggttagagagtttatgtgttcaacttcaaacttggtaggtcatattaggcacaagagaattcaaatggcacgtttttatggaggccctctgccatcgatacaatctattagattaaatgcctgagaccttatttggatagctcgagatttaaaataaaactagtgaaaatctggagaaactaggttttcctagtttctagcatatatttcaaacctatgtaactataattttttagattgtaagtgagattctaaaagaaaatgtagctgctaaaaactcctacaataaggttgaatttgacatggtaatacacacttaccttgtttttctatgactgaaattgaaactttgcaccacccttgaaaggaatataaacaggtagaaaagtgatgaaagaaaaaaaattgaagataggggggcagggatactcagagcacgtatctttgtctctatctctactattataaaaattaaagatgtttttgccggtattttggtacgtcatccatgtataagtcggtttttaagatcatttacttttggtaatatagaaggaatcatatgagaaatatgtttaaaaaaactcgcatgctaacatatccaagcgaactctcacagtgaatttcatcttaactaaaccatataacaataatgagattaaaataaattttcacccgttgcaatgcacgggcatttttctagtcagtaaaaagtgaaactttaaatgattcaagaataagccacatcatttcattaataatggccatcggatttataaggagacagaatagctaaaatcattatggaccatcggatgaaggatcgatgatgggaagggcctcatcgtttggcttttttttaataagccaaaacggcttattagataataaaaatgaatttgtaggtaaacttttatatatgtgttctcgatgacttaaaagccaatgctaaaaagaaactacgttgaaaatatctcaaaatcaatgtcaaaattaaatttaaaaatttaaattttagttttttctttgactgaataggccatccgataggagccaaaataaggttcgagagctatcacgagtgttcaagtgtcttcggctgaaaatctcatctgagcttttttattctcttgtcaattttacacatgcacccctataagatcatttattctagggtcctctaaataaacaatattttttcaaatatgcttttgctctgatccatttacttacttagaaactcttaggaattttgtattttaaaaagtgaccaatgatgcaggtggtggggttgatgacatacgcaaagtggtgggtttatttactgaacgcgtacagtaaacttgaattcaatacaacatacgcataacaaatttgatatgatgacatggcgatggtaaaatttctataaataaatttgcttcaactaaatatataagctttgtgatacagtttagaagtttgacataatcacatggttaattatttgttattatggtaataatgcttaattcatatcaataaatgacacatttaaaattttaacaatgatggaggtgtgggcgtgaaagtgtggtatattattagatgtgatcttaatattgttacttacaaatcaagataaatctgctaatattatttatgccaagtatattcttcaaacgcatctacttaagttgtaaattactataataattatagctaattactcaaaacaacaaaccacaagtaaacacatttaatataaagagaggttaaaggttgcgagaatacgtgaccctataagctagtattaagataaaggatatcgccgttcacaagagcatctcagttatgtacaaacaggataaaaagaaaaaaaagaaaaaggggtgctaaaggtgatgtgtcctaaagtccggtgcaacttttttcgggcggaggtggctagatgggcgtgcccgcctcacgccatagggcagtttctatcgttgcagcctctacaaaagtgatggaaggtgtacacatacaaattcactattgtgtcgtctctgtaccatattttcttttgttttatctaaccagattgacaaaaggtatgaaaaagtaaagaatatttctatttttcacgttaaacccaaatttatgaaagaacaccaatcaagattcaagaattgtttcaacagagtgaagtgatcatgcattcttcccatatgtatttcagtatccatctgcttgtctgttcccttgagagggacttgtgctgaaagaggcaagagctttgaaatgttgccatcgggctcatccgctcatgggcaaagcctatgccaacactagaatatgagacgacatgcttgcaatttctattccttgtttctgataggaattccaggacatgggatttaatgcagatgctgtgggagggaatgaaggtatgggcgtcagggatggcaagggatatgcatttgtgcatattgctactggattttctcattgtcctcatcccctgtacctcaaacaaatgcaacaatgccgaagaggtcaccaccagaaacagaagcagaaggctctcgaatgcaagaaacttcaaaaaccgaaagatgagaccctctgagccggctaacggctggggtgacagatatgaattttttttatacctaaaaacaatcacacctgttatttgcatgtgattaaaatagttataaaattatatgtgcatgcgacttaaatatatattaaagtttttaaaaaatagtaaaatcgattagaatgacataagtttgtacacaaacataacaggctaaatacgatctacaactaaaaataataattaattaaactagacaacaaatagtgctctatgcagcacaaatataatttattgttttttcttcatatgtagatcgaatttagactggcatgtgttgtgtagtgacttgtattatcataatttatactgttacaattttctctataattttttaagacacatgcataaatttaggtgtgattgtgtctaggtgtaaaagataatttatgttgtgatggcctctgattaatctcatgccgtgaggaggtgacattggaggaggcggcttccactgtggagtgagactaaaggagaaaaatatattgggagcgttcagcaggcggctaccacggctgcagctgcggctgctcacagtgagggtaatactattcgtgccggctgtgccgcagccacgaaaacggccgccgaacaggtctatttttacccatttaccagggagcagcacccagtaagcatggttgtggtatcgacaggtacccaatctcaatagttgctcgatttggatggattaacggcttagatttggtacctcacttcccgtcttccggatgataatacacttcaacagcctacattatagttcaaggatcacacgccaaaacctatactatgttattaacccatatttaatcaagcttgcagtaatgctagatatacgatcgcagatcgccgtacacatgaagcaaattgggccattggggggggggggggtgggtggttcagggttgcgttggtcaaaaccacgaatcgactagacagaagacagatcgtcccaagtgcagagaactgcagatcgcaaagccagcatttgattacttcatcaacactatccatgtttgcagcgaaacgatcaaacgaaaagctccaagacgatcacgtgaccgacacctcattttcgtagagtatattgctctgctcagtcattatctaaaaaaaattgctctgctcagtactgtggagagcagcagaagcggggagaatttagttggaaactcagcatacaaactgcatagtgcaagactcctttttttaaaagatttaactatttgtcactcttaaatttaacgtttaaccatttgtcatttatgtataaataatatatggatccttatatatctacgatatgtaattataggtggccacatttaacagttgcaaatagtgttttttttttggcgcattggtgaggtgtggggctcgaagagaatagtgcagaagtttgtttttacggggggaaaagggatcatggagacatcaagtcatcaacgaactgatcaagaaatgttgtgccttggcaagtagccctgtgagagttgttgattgatgagatatagtataatactatagcttttgccaactaagttagctttgtctttgcaggtgtcaacatttttggattaggattgtgcctctctttttcttcagatagggagcatcttttccatttgaatccaggaatgctagtagatcgattgccattggataagaacatgattccctggatgagttccaacaggttcagaggataatggtttgtatagatcgaaagagcacatcattagggaacataaaaatgataactttctgtcattgaatgatgccctccctaccgtaccccagtaaccttgtggtgcttacctccactgcaacagtgttcagctatcaaatcatatgcgttatccaatccagtggcaacttgcaagctgcgactgtgacacatagtcacatgcatgcagctttcattgacatgcatgaagttacattattcagaaaccaaagaaagatgtgtgtgcaggtgctactgctagtactgcatggacagatgcttccatgtgtaaatggacaaccattcacagctagtatgactttaacctctccaaattgcagtcgttgaaaaaagcaagatccaatgataacgttagacctgactgaagcatgcttccaaatgattaagcagagagttctctgaagatactgctccagtacagtagtagaagaatacagccgttcagtacagcacaccgttgcgcagtctcctgcagataggacagtcacagtacttgttacgtactcgtacttctccgtatgacaagttactgttccattaccttggcctgccccactggtgattaaacgaagattttatggcttgcaccgctgcactgacctttcttcactctgcttatgtacctggagactggcactgaaagtctgaattgatcactcaatccagcactgtatcctgtggttctccctgaccacgacatagaaggatgaacaatgtgttaactataatcaggagaatttattgtactattagtactccgcatatacagtaaagtagaaacagatgtcataaggtttatcaggcctctgattatcatgcctttacatctcctggcaaacagccagtcaaatgcacctcaatacacaaggggtctgcatttgcacatgacaccatcactaagtgtctgtgtctactaccactagactactcatgcagcatcaatcaagcactgacgcactgcaagttcttgttctcagttctcaccatctttacagaagggaaggcacatggaaaagctagaagaattataaggggggcatcaaaacttgttcttcctttaccatagggccagtctggcctatggattcttcatcaaacaccattgatggtcatatcatagggtgtgagagatgagaatgtgaaagtagctacttctaccactaaccaatttcttgagaaattagctgccatcaaatcagttaacctcttgcaaagttgaaacttgcaaggtggattgatgcgtggtcacttaactgaccacttattattgggaacagtgttcagtacagtagccaggagcacaagactgcatgtagggcagtgaccttgttttcactttgtgcaattgatgcttttacaaggtgcccagctgcagaacggagatggtaaggtaacgaaataaattacatatgaaagacaggaaagccaaaaaattattagacagtcgatttattagtaatctgaagcctatgcaaagtccatgaagcacaccgcttctgcttatacattctaacggattgacgaggaatagttgggctgttgcctgttgggccaagtcactcttaggattcaggtagaacagatcaattcagctacgacaagtgaggttccaattgtgaatttcagggtagtacgcatatgcatatgctttgcacgtgtggattgctgctaaaaccacactgtccataatgctaatcagttgaaataagatccacttctgatggactggttaagccaaataacatgcnntctactgttggacgtctgcaagcacatcaagcattgngtcattcatgaggtcatagtgttgatacaaactaggaaaggtcatggacattgacaggcttatgagtacacttagtactagtagtagtaatgcaggcaaagatgttgcttttcctgcattgaaacgacttcagaactcagaaatgatgtataactactcctggaaacttattgataacaaagttcaattcgaatgttcgatgctagtagtgtcttccagatctccctttcaacatatgtaaaaaaaaaggaaaaaagattgcagcatattggcaatcagctcgtgtagtttgtcatattaaaagtaaattcatataatggaagcatcaatcgatgtcatgtaggcaaagttaggcatatgtcatggtctgcatgatgaacgatgaaagaaataatagcccgagttgatattgtcttttgaacaagcatgcaaatcagccacagttaatattgatcatggactgtactttcagatacataattattgatcatgcagttacaagccttaaacggtcaatttcagaaaaaaaaaaggagcgtctcatttcaaattgtgaatttaaatggaaataaatctaacagaacaaatagaaatggtattaacatttgcccttcatctagtgagtagtcacaattgtttcagaaattgcacatgataagtttcagtttcagatatagcactataataatctaacctgtaatcatcataattccacaggcaaagtatatactacctccgttttttaatagatgacgccgttgactttttctcacatgtttgaccattcgttttattcaaaaattttatacaaatgtataagatataaatcac

SEQ ID NO: 62484 - DNA, 59666 bp, Oryza sativa
cgatctggtcctccgggttcgaattctgggggatcggtgctggtgttggtgttgccgttgcggttgagggatatcgagtagctcgttgtccggtttttgtttttgcgagagcggaggctgtcttatccgtgtgggctctgggaaaattctggggatttggatggatctggtaatccgatggatgatatactgttacaatcattcggagacgttaagggatttatgtgaaaaatgtagcattatgttcatggagagataattgaagatcgttactgttatatcttatgaagggtttgttatcgaagaattcgagtgaaatgttagagagtttctacttggtttcgtgcaacgttaggacagtgcgttattcctgtatgacaatgctgatatggtttgtgcagctgaaaaatggggaggataccgtctctgaaaaatttcaatgccttcccccatgcggaagaccacttactaaagaagacttactctggtgctatcggtatgggagatcctatttcttcatgattttgtcctgtgggtactgatgtttcatttggagatgtttggttgatttgtgcaactatggatatgtttgcagtcacgattttcggactaattataatggttacgttatttgccacgagctcaaattttatcttaccacctatactgttcatcaggtatggttggttgtttccttttcttctatgtctagcatgtgcaactttactgtaattttgcatataagttggttattttgccactcaataacagcttttaatgatatttcattagtaatgggaatatgtatgtaggtgatagctatcctgttttggtctatttaacaaaattgaccagagaatctgtatgatgacagaagggtatcttggagaacttaaccatgattttcattgaattacattattctaattgttttaaatatctactgattgctatttggatatgatgatttttcattccttgcttcggtccttaccaatgccaatttcatgggcctctcatatactccctccatccacaaaagttagacatatttcacatttgagtttttccaagtaagttgttcctatttgtagtctttatatgcattcaagacttgaatcaagagataaattaaatgtttgattagaacccaaagagtcatttaaatactcattggttgcatgcttgcatttactccttgattttgtaacatctaagatgatttaatttctccttggtcttagtgacaaaagtaataggtataacttttgtggatggagggagtatcttactaagaaatcatgacatgagccatcactatctaattgatgctgtctgcagatgtctgtagatctgaaacgaggagaaactctgccaattcatataaatatgtcatttccctctctaccatgtgaaggtcagttattgattaaatgcatccttatcagttcgatatgaggtttcttttcaacgttggtttgcaaggagattatggtttgacctttttcccctggctcttttgtttagtcttgagtgtggatgcaattgacatgtctggcaagcatgaagtggacttgcatacaaatatttggaaggtaccacctgacatgaacactttgttactctgtgacttagtgtatgttctataatagacaaattcagtagttgcactaattatcctcattgcttatgacgcggtaataataaatcccttaattatggataataacacatactcgctatccatggtgcagtcatagtattcatgcacctagaagggaacattttcttttagccgttgactggcagtgcatgccttgctctagtgcaagcagtattcttcatttttacaaaacaaatatattttttcccaacaaaagttgtaccatagtatttttctcaattcagtatctggcactcatataatgtttctaaccttacctcttctgctgaatgcagcttcgcttggataagtatggccatatcattggtacggagtatttaaatgatctagttgagaaggagcatgggactcacaatcatggtatactctgctgcttccataaagataaaactaatgtacactgaactgccatatgaattattgttgtttcagtccctagtgtgtacattgtttccttcttttgctcactgtaaattgcagctcgctagtaatagttgtttgcagttataattgtggtccaattatccaaacaatactttaagtaatatattaaggacacagatctagggaaacccttgagacaacaaattaactaaatctattgacaatatgttatagtcagaatgtcccatttgatgcgccaacatgctttatactgatttagttaaaatgtctgatgtgatggagaaatatgctttatttagaatgttccattaagtacgtagcctggaatgggttcaagcatggaaacagtgtttcttagtaatataatgtttgcctttcttagtatataagttcaagcaaaaaagaaaattgattgcaacaatgtgctatcgagcttgctttggtactttctggaaagatgtaccagccacccaaaaaaaatggttccaataattagctatttagcttgctgtcatggtcaaacattgtctttgctgaaaaattatcattggaaagaattaattctcgtttcgagtaacatatggattgtcatttgggaaggtgggaggagggatggtgatgtagaacttaccatcactgtcattaactcgaatacttttagtagagataaaaaacaatcaaatctagttattttattgggattatctacttaagtaaaaaaaaaccctaccttatcgcttcttaatgtgaaactttccccttgaaaacacagtttagttgacaatctcttggcgcttatttttctatacataataagctagtggtttaacagatcatgaccatgagcatgaagatgaacaaaagaagcaagagcacacctttaatgaagatgcagaaaaaatggttaagagtgtgaaacaagcaatggaaaatggtgaagggtgccgagtaagatatttctctaccagtatcctttaatttatggaatggtattattaaggctattatcatcaggcataccatgtacttgttaaaacattttgctttcaattttcacaggtttatggtgttctagatgtgcagagggttgctggtaacttccatatctcggttcatggtttgaacatttttgttgctgagaaggttattcatctaaaactgcatattttttttacttctgtgcttccatctgtatgctttttgctgtgaaatatgttaatttctttttgtatgaagttgccaggattattgtataagcttctaggttttcagtttatgacagatcatgttcacaagggtttaaaattattcaactaaaaatcccttcagaaactattgaaaccagccagctcctacttcctggtaatgccatattggacaagtgctttgtgcatcttgtacaagacttcctaaaactgtccacaattaggataatgttttaatggtaaacagatgctagtgattacgagagaaggaaaataacacaacctaatgataataataataataagttagccagtaaacaactcaatactcaccagtttggtgcacaccagatcaagctgggattggaacaaaaaaaaggacgtgggaagtatcttcttttggccatcacattatataattgtcagcttatatgaaccacaatattttctttacattggatgtgcttatgtctcttcgatttttatgaaaaatatgcattaaaaagcaaccacctaggtagctaggcggtgcactactgcctaaggcgcctaattgatttattatgccgcataggtggcttgctagccccgtcttatggtgtactacactctggtatgccgcctaactagcacataaaggcctcagtgatttcaacctctttttgtgctacctataaataagtgttttatgcttttatttgtattgttattactctctatgtaaattttcattttcatctgttgtatgtagatttttgatgggtcaagccatgtgaacgtcagtcatatcatccatgatctatcctttggtccaaaatatcctggaattcataatccactggatgagactacaaggatactccatgatacaagtgggaccttcaaatactatatcaaggtgagtttgagtagtcattcatttagtagttcatgtccagacagcaatttgcaagttccaacatggacaaggcttgcgaaagaggatgcaatcatgaaaatagaagttcacatatatgcataattcaaaatcatctatggatccttgtggaaaagaactccatccctcctccaacttttttgtccttttgctacaaacctatgtaaatcgttctttggagctgtttcaccatcagatcagatggaaatccatcacattatttgtttgagaagaagtgtcctcatctgttgtaattgatatgcagattgttccaaccgagtacagatacctctcaaagcaggtgttgccaacaaatcagttttctgtcaccgagtattttgttcctaaacgcgctactgataggtccgcgtggccaggtaactctcccttcactacaagcgtggtatattcatctgtttccaggactaatatgttttccttctgcagctgtgtacttcttgtatgatctctcaccaattacagtcacaatcaaagaagaaagaaggaacttcctgcatttcctcacccgactatgtgcagttcttggcggtacctttgcaatgacaggtatgcctccacagcctacaagaatgtgtgttttaaaagcatgctggtgttagggattggcgtcagtagcaatagttcattggtaatctcatatgcatgattttagagtgttattttttttaaaaaaaaagggagtaataataacaatttcactctaaaactgataccaattctgtcatcctacgatacaggaatgcttgaccgatggatgtaccggcttattgagtctgtcacaaaatcaaagaccagaagcgtactacggtaattgcgcatcacatgataagtggaggcaaactgtgacaaccctgtgtgttgtcactggtcatacaaatcagtcagagcatatcgtctcagatacggtcaaccccagtgggttttcatgttttgatatgctctatggctcgattgcttaaaatacttatgttgttagctttgtcattaatcactcatgttagactggcacggactcataacagttttgtaatcaatgattcccacaaatcggaggtgccaacgtcgtgtgatcatggagaaacaaatcccagtatagcctgataattccaaaaaagcagaaaaaaaatcaacatataaaactttgatactcttgcatcacggaccaactgaacgtttgtttcgtagacaaattgttagtcaagtatatttttaattccggtttatagaattaggttaatgatatttcagaatgttacgttacaaccttgaactcctgagtttataaaccttgttgggcaaacaaaaatacacaagcacgacatgcaactaaaacttgcaacatccaacatggaccaaagtttctcgttatacaggtaatctagctatacagttagttggcaatatgagttttgaaagatgaaaacagttacatagtggatgattacaaaacgtgtatctggctaaacaaagatgcgcctatcccgtctacccaaagacctgaacagtgtaatctgtacattaccaggccactggctgataattattctctacagaatgtcgttctgagtttctggcttgtacgtataactgcatgacctacaaacactacatggagctattttctgaacgtgtatatatatagctgcatatcagaaggtgagtgctacttcagctggttcgaaatacgcatcaacaatcaacatcctatgatatcgataattcagtctgagaatcctccacttgatctacaactggagcttcacatggctaattggttatgcacatgagcggatgagccaggatatcagtgtgtcagttgtaccctcctggcagtaggtcctcatgagtctactcttgagcatgcctgcactatttgtattcatcattcaatacccaacactggaaaattcaccacaattcatacataactataatatgaatataaacctatacggaaaatcatattgaaaatttgaagtcgatgatgattgcaaggatgacaggtgctgcaaagatttcttttaaagaaatgctattaatcaaaggctgcagttcacagttgagaaactcaaactactaattaaaaacatatttcttgttgtctcacctagttgccctttttatgctgtcgtatcatctttgttctgattacttctcaaacctgcaacaagcttgcatgtcttcaagaaagcatctagcaactgcatacagagcactcatattattactcagttgttgccactattaaactggtcattgcaggatacatcaatccaagcatgcaaactctttgcaaactaggagtactggagatcgaatgctctaagcagcatttatatcaggatataaaacacttaccccaggatattgctgtaatgtaggggagtagcgatcaagagttacatatatcttctgaagaaggtttaaatgtgaattaaccttgtcgcccaaaatgacaacctgaatcacatcggaaatatttcaacgttgtctctttgaatttatagcgatatatcacagttgtagtcaaacaaagcttaattaatcaatgaagtattccgtgtgaagaacagtctgaggtttacgcccaaaaaaggaaaaactgaggtgcgacttaagttgagattaggagttgttggatcatgataggatatgaggtgtttgtcgttagtccttaccagtactaaataagcctatgggctgtatttatgtatcagtttgtcaagaagaaactcactagaggaagcccctttaatggtatttccacaaatcttcaagttctcaaaggggagttagaatatacccttgatttgtgctttaaatttggtgtaatttccaaagggaaattggacaggcaaaaacaaagaattaccttggcttcagccttctggagctcagaacgccttgtttctagcatttgtttgtaccaaaggcctatttttgttagtacaacggcttgtctgaccatgtggttgcaatgatcactcaaatcctctgacctgaaagcaacaataatcgcatcgagttataatggagcatattcttaaaaaaaaaaggacagcagaagttgcaggtcaggttttggtaagagccaggctgcagttttcacaagcaacaagcgacaacatatacacttctaaatcaatcctatatgatgtattaaagatactaacaaaaccttgtgtttgatatgctgtagatgatatttgatatgccaaattggatttatatttttcaagtagtaagtcgatgcaattacagaaaaaacaagtggaaaggaagatagacaaacctgcttgcacttctttctactgataatttttgctcgatctccacaaattcctttgacaacttcataatagatattaaaatgcactccagttgcttttcttgctcatttttggtgaaaataccattataatcgatatttttattttcaacttccttcaatgcagctgaagcaatttctaaacttgagttaagtttgacaagttcatcatattgcatatcttgcttgggagtctcatgtgatcttcttggtgatatgtgaggcgccacctctatatcacgcaaaatgatctctgtactctcttgcttgatgacttctggatcttcctgtttatcttggatcaaacattgctctaactctgctattttttcttttaacattcggttttcttcatttgacaaacacaaagccttctccttttcagatatcatagcttcaagagaagacagttctgtactaaaattcgttgcagcatcatgcatgctgttcatagaatcatcaagcaactttcttgtaatagtttgatacactccatccctaacaccggcttcgatttggagatcctcatattcttctttaattttggcaatttgtctcaggagatcgtcttctgatgacaactgaatagacatttctttactggcttcagatagctgagatgataattccttgacatccttcatattatctgcaagcaaacctctaagatgctgattttcgtaatataaagaatcgattctttttgctgatatgcatctttcatccagtccatcattagtcatgcaaagtgaaggcatctttatgttcttcgaaatgatttggtccattctagaaataatctgtggaattttctttcttaacggctcaaattccacatcattcttgagagtaagcaatcccttctcccgtttgaatttgaagagctcctcggtcttctcctgcaaatccaattcatgcatcctcttcaatttgctcatttcggacttaaaataagttatgatctcctctttactcataccattcaggtgacggaagtcagatttttccaagacaaccatggacttctgtttcctgaaactcttattttcctccgcgcgagatgaatgatcctccttgtttttctttccaaagatgttgtacttccacctattgctcctgttgcttgaagtttcatgcttgctgtgagaaatatgtgattcttgtagtgagggcaacaatagcttagaaagagcacccagatcatcgcgcatgctggcaaattgagctatggcatcctgccaatttttactcatggagtttgtcatagaaatttgctcatacagcttcctctccatctcctcttgcaagccactgatgaattctcctattgtaatgttgatgacctccaattgcaactcatgctcccactgcagatcagacaccgacgagctgtccatctccctagccttccgaaacactgtggccagcagtaacttcaaggcattgaacctctcatcaatctcaatcagcatcacatcaagagacatgcccaggtgtgtaccaattatatacccattatccggcaacgcaaagttttccagcccagttacatcccccttgagcctatcaagttgggtatcaagctcctgttccatcaaatccatgaattctgcatagttgacctgcccatttggattgaaaacatgccggtctgaccacgataccgctcttttcgatccttcaaagcagttgtcagagctggagttggacttgatggacaaccatctcggcgtcagtgccggtgaatcttcagatgtcattgatccactgctaagcctgcccctggtgtcaataaaagatccactgccagcccggaacgctgtcaccatgatcttgaggctgcacaacactggctggaaaagctgatctgtggtggatcaacgggttcaatctgtcactcaacacctgcacccattttcacactcagtttgatcatgcaagcagataccgaattcaatcttgagattaaagtagataaaagatgacagaattgaaaccttgagcatcggaatgatgcgggtcaacttcttttgaaattgaattaaatgaatataaatatactgcgatctcacatgagtactgaattgtgaagagctagcaaataactgatcatcgaacacgtcagaaagcacacaggcgaaacccggaatatttctaaagaaatctcgatatagcgggatgatacaacagtacgaactacgaagtcactgcagagaatttaaccccgaaaaaaaaaacccaacccataaaaaggcaagccgacgaacccagttcccatcctcatgatcaagcataagaacaacaacaaaaattaaaaataaataaataagcacgaggcgcacgtatcagccgcgatcacatcacagcactcacaggagaggagaagagagagacggaatcgggccggatcgcttaccggcggctggacggcctccatggcgtccgacgactccggccgccgccgccacaacgctggcccagcaacttcccctcctccttcccgccactccctcctcccaactgacgagcctcgctattattagggcttgttggtgtacttacagctggtaacctccaactaatcactctcatggatgagagacacccaaaaaggccaagaaggggtcagtggaagagaagcggaggcggataaaacggacaagtcagtgctggcctgggcggagacgacggcgaccggggatggatggaagggagtgaagcggagcagcgcacgccgccgcggagggtgacggcgagattattacggtggtagtaattgcgatttcgagagtgattagtactaggcgaaagcaaatggagacgcgacgcgggtggatggtcacggcctgctgacgtggccgcggttggattaatcgggttgacgtcggcggggtggtggggccccccgcaggttgtgggccccacctgtgccaaaggccaaagaggaatggtggcaaactgacaatgactgacaatacgtaggccactgcgagagcatcagaacatgaccattaaattagcgttttcaacttccaaattctcacggagaaaagagagagggtacggaaattcagtttggctcttgtacataatttgtgatgaaaaatcttacatggtattccatccctccctaaaaaactaacatagtaatgaatgtgacgtattataaacaaatctggacgtacatttgtctaaatttatagtattaaaatgtgtcacatctagttttagatttactttttataggagtactatgatagtcatttatgatataaatatatatataaatgactaaaagaattatttaccatgctttctagttttgcgtaacactgttcttttagtttttttacggctcctttggaatgcaagaatttaacaggttttggatcaatttccgtgaaatctctgtaaattccattcacttgaaaagagaccttagtgctgtatagcgtcagatttcagatcttgttgggattgtgctgaggcacgttaacgtttgtggtggcgttaggtgattaaacagaaaaacagctcatgtaatctactagatacaagacaaagcatgtgggtgtcataaaatcgcaagggtagttcagagtttgtatattttgtatcaggaggatttagatttgcttcagcttgatctgaataacgtcattcaccaaacacaacgtggctggctgctgctggtgaattttgatcaccaatggtcggaaactctgaatgggccaaagcatagctcagcaacaaatgcaggtatttcatgactctcagacatttttctctgaagatttagtgagatcagataagagtgccatttccttcattctaaaatatagcaagctagcacttgattagacaccatctaatactgcaaaaatctggatagacagctgaaattcaagtttgacaataaaaaggttgtgctttgaggacgaaatttgctatagaacacttgaaatgataaacataaacagctcacaagccacaagatggctactccagcctccaagagcacgttttagtgattttttcggcggattatattttaatgatttgaatcaacgatatcccatcacttttatatgcatagacaatgacagattgacaggtacctgaaaatcagcttcagacaaaacaccttacagtatggtagatagcaaaggtaccagctgcaatagtgacaggcaaaagttacatgcttcctttcgttcatcatgtgatgcagaagcttatgaattacatgggtgattttatgattcatattcagaaaaaaaatgatgattttacaccaccctacaagaatcatcagatcatgcgttttgttttctctttttcactgcgcaacaatcataatccttggacacttagatcctagtagacctcaacgtgccattgcttgttcttcttgagctgggatagcttctgctcccagctctcccctctctgctccgccactttcttgagggtgtcttgaatcccaggcatcatccccttcaaaccacagaagtagatgtgcgcgccgccatccaagagcttgaagatctcgtcgctgtactcctcgatcttgtcctggacatacatcttgccagcgttcttgtttttctgctccctgcttagcgctttgtcatacctacaaattcaacacaattcaattatagcaatatgcacgaatatacttaacaaaaacagctcatttatgtggtactctcaaagtcaaagctcaataattctatgatggcatcagttgacagaggcatctatgttcattatgtggcgctgtttcagccaagtatgcatgtagtactaataattaatacgaagagtcaagacagatgatgtctagcaacctgaaattgtctggatactgcttaaggtagcttgtgaactcttcatcatagagaaggctgtcagtgttagccacaccaaggaagagccaggccaagccaccaaatctgtactttgggacatcttccatgaacatacggcgtaggtagccacggaatggagcaacaccagtgccagtagctatcatgatgtgagttgcatttggatcttcctcaggcaggagcattattttgcctgacggacctggtgttcagaaggaaatcactgtgagatacttggcatccatcatgtgccacaaaggacatgatgactaacaaagaaaagggtaaactaagatgcgattgcaaactttagtaagaaaggaaaagagcaagataagataatcatattgtagaaggggcataatcatattagaggagaggctattggaacctttgttgcagagaaccgtttatttgttgttggtatgtatgaactcagaaataggttgtctaccaaaggtgggtttcaggaaaaacgcaactaaaacaactaattttgctccgcttggaattagaagttaaacaacctcataggaaactcacaaagcctttgcattcatctgaagctgaaagaaatcaactaacctgtcactttaaccttgtcccctggttttgaattacataggaagttactgcagacaccattttttgaggggtcctccttgccagtttcaggatcataataaacggcacggcgcacacataaactagtggtccttccatcgaatgaatctccataccttgtagatgcaattgaataaagacggacattatgtggtgcaccaggcttcttcgggttctccccctaacaagcaaaaatgcacagggtttagagaacagtgaagagggtgatgcccatggagataccactggaactgtattaatagtgtgtgcacatactcaagtctcctatcaagagcaggttttctcacctaggtttacaattttaagccattgaatagaacattggaaacagtgtctacagaaataatcctaatatactaccgactatatctttgtaagttcttaattaatagtgtcaacgagacaatcgttcaatatccaatcagataaatagactatgaacgaaaccgacaaagcataagcataatgttctattttaaacaaggaaaatgattgaaagcaggaattacttactggaggaataatgccatagctttgcccctcccagtaaggcacattgccaccatgatcaataacaatgtggcatgtctctcctggagccttggggcctacgatcctctcaaccgagacaattgtggcggtgtaaggctcctttggtttgtatgtgttgagcggcggctcgttagcactctccaaatcaagaggcttgacagcaaccttgctttcgctcgcttgctgaactgacatgcagagcaccttgttcgcatgcctcggtcgcgtggccttgctctcccacgccaatgtggtgccaacccatgatttgttgctaaagctaatattgttgctaccctgaggaatcacacagaatgaaatccagcacatagtttagcaccaccattcaagaacgctgtgaattcaggataaacagcctactaaaccaaaaccctgaaccctgataattgatctgcacatcgaattaacaagcagcagcaatatctggcgttgcctagctctcaatagcgctcaatactgaaccaatctgagatatatcccatagatttgtatccacctactacacattgaccaatccaagcccgcggaatcctcacaggattccacccaaaaggaagcaagttctaccatcaggggcaccaaaccacgcacctggatcccagaactcctcaagccgcgatccgagccagccggagcagagacagcaacctgtgtcagaaacagccacaagaacccccatgaactcagcaccatcgcgcgcagcgcgacaaccaggggatccaaaaaaccgcgaggacggcgcgtacctgggacgcaacggcggtcgccatggccgatcctgagggaaagcaagggtcttttgatctggagaagggagatgagatgagttgagatgagatgggaggggaggaggcggggtttatagacagaatcagagaagggggaggagtgaggtgagctcttgaggtgctggaaggggcgacttaagctattagctgcttaattgcgtgattaacccggccgctcttggggttgatttaagctttagctgcttagtaatttcgttttagagtttgggtttggggtttgataatttaaaaaaaaagattttgtttttttcgtttttgatgttgattagattagggggtttgggttaggtggaggtagcagcagagggttgggttgcctggctgcttgactagcagaaatggtggctgcagcttgagtgctccagatggctgctgataaaaatggctttgtggtggcatcaagggtcacctttggcctgaagagatgcatgtatcccatggagctagccagatgcacatacaacttgtatattattagctttttagttttttggaacagtacatgagttggcagcgtgtgcatgtagtgcacaagccggtgtgtatctgttggacattttactgccaaaatgtgtcaaatcttggcgaaaaaaaaaacttttttaaggatagagggggaaaaaaaactttgtgatcaaagggctagatgtttgcccttgcaccaatgagccatcatgtgactgatcacattgcaaatttacccaaaaaaaattaaaaaaaagcaagaacaaaaggtagcaaatttatggcctactatgctcatcaaatgtaatcgggtcatgcaacaccacagaagagaaccatgtaagtctgatgtttttacctttgtttctccatttcggactgttcaccaaaagctgagaactacttgtgcagagagctgcgcaattctgttgcatttttacagcatcacaggatagcaagcagtaccttttaactacaaccaacacatttcttatccttcaatggcacacgccatttctttttaaaggtaaaactaaaagtataatccttttggtaggctaactacagatggactagtcctgagtcctgacttcaggcatatgatgagttgcaaacagccagcttcgtttcagatgatcacatccccatgatgtgatcaaggcctccatgaggagctcctcccatgccggccatagtcatgttgtgcagcagctgctggagccaacgccttgtgacatgatcatcctgcgcaagtaagatgaaggtggaatcaggaatcaattgaaacttttctgtgtaaattataatgtaaatattttgcggtaaagcgatggtaactggcaatgtcgtgagttgagagttgagacacacacctggaggaagttgttgagggttccatctttcagcgcgttggggaggcagctgttcagcgcggtacatgccctgcatgagatgaaaaaacgaattataggaggccccaggtctattttgaatttacgcattgaccagttttctgcattttgtaatctgtacagatgatggaatgaacctggaattttctgacagcctgaggtagcagcgaattatgtgcttcagcagtcttggagaaggttgatcagcaagtgcctgaaccatctgtgatagaacactggctacggcaaagaaacgttcagcagtagcacatatgtagcgaagcccaacatcatcaagcagaatcttttgaacaataaaggtggcaacctgcaaaaatacgttgattggattagcaaaaatgaagcaccaaatccatctaatacagtactacagcctattgctaccaggtacaagtgcatcattattcccgaacaaatatttgttttccctcttttaactcacacatatagcagcttagaaaattgtcaaaagaaactacgacttccttataagatcaaaccaaacaaaaaggaagcaaactacaaagccaactatgatgcataatctaagcggttcatgaccattgtaatattaggttccaacatgacttggttacataaagtgtaagataatctgacttaacagggatagagaaagaagagttttgctctatgtaaatttcagtctagaataattaaacataccaaagaacatgtgaagtgttgtcaagagctgaaaacagtggaagaactacaagagagaaaggaggcaggtagctacacaccgttttcgaaagttcactgcccatctccatagtacggagacacagaggaattatttcagtttgcagcagaaacccaatgacttcagaatcatcaacctgcatatattgcaaaacaaaaccgaattaacttattgagtatgctcattgacaaaatcaaagtctggtaaaagcaacttgatcattaataaatcatcgaattgtttggctcaaactctgtaaaactgttgatggttttaccatcttattttataaaattaactacagggcttaaacctggtagtatgcccataaaaaaaacatcatcgagttgtttggctcaaactttgcagttcacatagggatatttggggatccaaacccaaatcaggccatttgatcagcatgactagataagtatccagtgtccacaagaactgtcatgaagaaagggaaagttctacccatagtccataccatttgcaccatcttttcttttttctttcaccccctccctctcaacatagtttgagaactggaccaaaccaccattcaagaacagagaaaaaattgaacaagcagcttgtccagaagtaaacccagaaggaaaataacaggcaaagaatataatatactagatataccaaataagtagttcaaactcacagcttctcttatacaagagggcttgccacccgaagtgtatcaattgtgaagttgttggaataaggaaagttatagactcatattagatatacgtgaacacaatgatactcttataaattcaggccaaaatatttcccaaaaagtcatgtagaagggagtcaaaagaggaacatgtagaagctgaagtgcccaccccaccagcataggtaaggttaaattgaaccacatgtcaatcacctgaacagctgaatagggatcttagtagatcagaaaatggtctagctttaaaaatctacgcttccactcaagaaacacacccatatccctcataattttcataaagttctggcttgcaattaccttcacaagtgcgccaatgacacccaagctggtaagcctcaagtactcaaaaggccttgtcttgctagtagtattcaagaaagggtacagatacagtgggatgtgagctgaaaagaagaagggaaaaatcaagagaggaaacaggtcactcacaatagccaactggaagcataaagccacatacagatgaacattcctatgcgcaaaactaactagatgtgattagtattatctgaaattttcagcattgggactgccatagtccataagtaggtcatattgctcacagctgaaactaaatagatgcaatcagcattatctgttacatggttttttttaataaatacaataatagtgtgaacatagtatattgggcaagaggggaaatattcttgaacaatgagtatcatcatggaaatatttaatacttggaataaaaatggcagcacttattaccattcaagaaaggaatccttgtgtcactgtgtgaggcaacacactgcaataaaaatacaatgaagtttagaaagcaacatgttgtattaaatcagtttagggatcctaagctgatactacctccatcctcaaatataaggattttgcctatgtaattacataggcaaagtcccttatatttggggatagaggtagtagcattttatcaatcccccttttatgcattgcaacatgctgaaaaaatagccttctctcatcccatcatgaggcaccagtgtcataagtagagatttctcactgtcgtaaggtttctttctttctcatgtaaaggtgtacctgaagaagtgcaagtgcattgcagacacggtttgaagcccctggagataatgttgggggtgaaagtgatggatagattgacacaatctcctgcattatccaaaccacaaataaactgaatgagaaaaccatgaaagactcaaatgaatttcttttcggaagaactaacattcgtactcaaccacactgacttaaacaacatgaagaattgtaacctacctggagtagtgcagcaattgttccataagagtgccacaggagtggagcaagatcctgaaaaatctctcgcttctggaaaaagaagtccatgaaaatcgttaggcaacaaaatctctattcccaaaatggtcaggcgtgacgagaaaccaacaatgatttatgaatttctttgctgaacagcaaaacggaaaaactaatcaactaccaaataggagaatcttcaagaagctatatgccataaagcactgaattggtaagattccactccatagatagaaacagtccccaatacacttgcacacaaaagcacaatcacacatttaactcttgtatcagaccattcagggtgtgtaaccacaggatgccaaacagtacatttaggagtactatgaaagcatcaaaataaggaaagttacgcctaaattcataaacgaaaaatgagttgtgagttactgttttcattgtctcgtctagggtggagcagattgcaaatttcattcaccgctcctatgcccaagcaaatcttcgtactcataggctgcatggattcaattcagcaaagtgtacctacagtcctagacaaggataagtttgtcggggtctgactcagatttgggtgttcacacttgtgaggtacttactagtcagaatcagacaggtgttgccatgtcggaatccgactcagacacgatgtccgatttggcaaaatagttttgggcctgggtttccaggcgcagcctggacctcaccattttacttgggccacggcccctttacatctacgtggatcatgtcggaaacagtgggcacctggatcaatttgtccaatccactatacctgcaggccgacccttttcgtttttatggaaggcaaacccatgaactaaagaggactagggaacactgcaagtggggcttgggcttcaaaggagatctgctaacaccatgcatctggaggctggcccaggatttgaatgcaaacccaagctattggaactcccaaggtcccacgccaccaagaacacaatttggcgggaagttgacttgatggagaaaaatttcaacaagtcatatatttttaactgcttagcaactctggattcataggtattcaatttttcattgttacagttgtcaaattaaaattttaaaaaagaatgatgtattctatatttgttgcctatgacttcaaacattaaaaagcaaaataagcaatttcacatattaaaatccaatttgggctactattaatgttctgttaagcaaaaagtagttgtttatgttagtggttacgattggtttgctctttacactcatgctatagcgacaaagaaaatatctagtgaatatgtaacttatcaagattaaatgaaaaaaagtacagagcatggtgattctgacttaatatatatatatatatatatatatatatatatgtatatcttctagttcttagattaattggtactcttaataaatcatgggctgtgccttctgctgtccaatcctaacagaacgtagaatacaaccacagcactatccattttaataagaacaaccctaagtagaacaaactaagtgacctaacacagacacagacacagaaacagaaatcccaagtgacctaacacagacacagaaacagaaatcgcaagctgaggatgccctctggagataattaactcttttgcaaccaggagatatgaacatgtatagcagataaacagaacaaatattctgaatatgcatcatcacagcatagacatcaaaacaaaacgcaaattcccactcacaaataaagcttatatgattcacctaactaaaattaattgaaggattgcacaaaatctctagattctcgtcattgccggatatggggaaggcagaatgtaatgaaactaataagctaccacatctgcataccacgaactcccagagaagaaccctccgtacaaaaaaaaaggactggtttttcccataccaaacactgatcaaacagtagatggagcaagctatttacccctggatgagtagcatgtgagccgatctgcgttcagaacagactactagcatcagatgatcaagtcccaacctacttttgcctagacagagcattacatcacaaaggctgcaactttcgtaggcaccacatggcacgtacagattcccccccccccccccccccgaatccaaccataaaatccccctcgccggagcccacagcgatcgatcgagagagaggaggataaaaaaaatgaaaattgaggaagaggagagaaaacgcatagcttctcgcgacaaggggagaccttggagaggtcgaggagggcgttctcccgcagctcggggtcgcagaggtcgagcacgagctgctccgcggacgccatcttccggtccttggcggcccccggagccgccgccgccgccgccgacgacgacgaggaggcgccaggcgagggcggcgggggcgagggcgcggcgaaggaggcggcgccgatggagagcgacggcggcagattcgccatttcgcggaggcggcggcggcggtggagtggagaggggagacaggacaggaggaaccgagcaaggccgagagagtgtatatacgaggagacaaagccggcttttttactaactacaccctccactaaagtagttttgttgtttttagaggtacgttttagacaaaataatatggagtattttgtagtaaggattgtaaaaatattgttacactaagtgtttggcttagggtgtcaacaatggcatgatgttagggtatacgagtaggtgacacaagtaagaacttttacgtaaagggaagttttgttgtttagagggtacattttagacaaaataatatggagtattttgtagtaaggattgtaaaatattattactaagtgtttggcttagggcatcaataatggcatgatgttagggggtttgcgaacttttatgtagagggaagagcgagagagaaaaaagagtaccttcaaacagcctagtagatagcttaatactctctccatctacttttgatagtcatattttcaaatctggaaattttatttttgataggcatatttcaattcaacaatctatcatcttaatgactttctcggatttaatgcatgactctccattctttcacacatgattggctacatgggcattgagaaatgtaaatattaatgaatcgtttatttacaaagaatgactagtagcatgtttaaatggatgataagtagaattacttattcttggtctgtgtgccaagatgaaatatgactatcaaaagtagatggagatggagggagtaccatctatactcgtctataaaaataaggttattaattatttaattttatttgaaatagttcaattgattatttgtcgtctgagtcgtatgtagtcccttcatccgcgattggtcatcatattgctaaaaacaataaaaaaaagatccatgtttgatcgtcgcaagacgttgggagctggcagaaatcaagtggaagacgctaatgatgcttttgtatggtgtgttgcggaaatcaatttgggagtagttcgtatgcatggattttatgcgatcacaataaattggcgcgacgcgcgggcgaggccaatgcgccatgcagatcatgatggcgtgcatggatacgaaacgtcaacacacgttgatcaatactgattaagtgtcatggggggttgtattggtaccgggcacaaagcaaatatgacaaccaatcaaaaaatggaaggtgtatatgttttttatatataacgcacaatggtcatttaaaccatttatgctagttttttttttaagaaaaccgatcatactttttaaagcgacatgcttggtaggtacttttttcctggcttataaattgaaaaataggcatagctgtacttctactggtaatcttagcaacataacgcccaatgcttaaaaggagaaaaagaaaaccttaaataaatttaaaagtaagttataatactaaaatttggccttaactgataagccaacgaggagctctacgggtagactttacctcttgagttatatggttctagattttcacaatactcaatctaatttaatctcaaacaactacaaaaacacatatttactcgactttgctaccataaaaaaacttgtcgaccattgaagattattgcatcattttgatataatatgtttgctgttttgggcaaatacaatttcataggactgtaaaattttacatggaagggttcttttgtcaaaccttaaaatccaagaaatatggggggccataagccagacttgaatcaacaaaaattagggttttctaaacctatactagtatagtgtttaatttcatttcagttactattgttatttttccttttttttttatcttcccaaatacatccctaaaactcagcccatccatgtatacgagcccgtaagttttctactcatgaatgggccacaatttagtagaaaagggccaaaaattcaggcccacaatattctcagatgcggatatgcggcccagctgagcaaccagcctccgcccccctaaaccccaggaggcggcaccgccgcggcggcggcggcggcgctgagctctgctcccctcatcggcgcatccccatccgctctcagatcactgcgcgctcgaagcctgagattttctttagctccttagccgcgtgttgctgctggtgccacgcgtcttgatgtttctgtatgtagccgtagaatcttgatgcgggttgtgtaatgttcgaagatggatctaggagtatggccggatatgatgcgattgtttcgttgtgctttagtttagagaaatggtgtatttgtagacggttgctagtatcagtatgattgagaatgtaaacctttgatatcaagcaacgttatacctactgtggcaatgttcttgcttgtattgccatgtttaatcgcgtagtttctttgtgtcaaattatatgtagcataatttgtggaggttgggtaaagtgatctttgcgaacgttttgtactgatgaattttctgggttgaaagatgggcatggtcttacccaaaatacctgagcaaagggctacaggtgttcgcggagattggttgtgcttgctttgaaatcaattgaactgtaacctgttgaatgtcgattgcggtcttgcagatcatatgcatggatggtgcatttgcatcctgtgcttttagcatgaattctaggaaggtaactgctgtgattaggatgttgtaatttcaacattctctcccagttttcacttttcagtgaactgacatttcattttcgcctaatcagggaggatatcccagccccagttcaggtagctgctccagttcttggagacaatggagagcccagcttgtgatgaagaagacgggtgctaaactgctcatgatgaccttgtcaagggtctccgtgaggcttgctaaagctgttttttcgaacggtcaagccattgccaacgttttatatacttcctccgtcccataaaaattacatttatagctaatttaggataaaacagtaggattggaaaatgatcacaatggccttatttaatgaacccattgcatgcacacattccatatatacaaatgattaaaaggaagtttgagagaattaaccatattattagcatgcttaattacatgcattagcagcccaaattacatgctttagcgccaaatggatttggcaccaaaaatttgctgcttgcattaggaatcttatctagatcaatcaatttgctggctctgaaagtgcattaatcctcctagtgggttttggtgattaatgacaaatgtggttaagggactaatgagctcattgagtagctttcaggtgcattagtccaaggtgtggaagatagatgcttggagaccccccaaaaagtacaaaatcaaagcggactggaactcgaaagtgcataggatagtttatcttttgaaatcgagtttttaggaaaaaccgtactattaagagggattccaagtgatgctctgagatatatcaagtgctcttagtgtgaaccaagtgtcaagtttccctaggagtcctttttttgcaaattctccatctgtccaaaattgcaagtccggaacttcctgtcttccaggtccagaagttccggtcttatgaaaaagattttcctaagtgtagtctggaagttccggtcttccaggtccggaacttcctatctagtttccagttcaaatttgtgagtaacgtctagatgacgtcacctagccgttatacatatacagctcgtttccagctcgttccttggccattccactttcacttttcgaacctagagctattgctagcctctcccaagtgtttcttgtcttttccactgaatctagagcctaattcttgtgtgaaagagagattgagagggagagaagaagatttggagaggtgtgaagactaggatcttgggtgagcatttggaatatcttgtgggctgtcatctcggtgcttattactcttggagatgatctcctagacggttaggtgtcacccacgagaatccgttgcatattgtggatgtcccgggtaagtttgtgaaggatttcctctcctccaaaagggaacgaggtaagttagtgaagttcttgtgctgagattctagaggctttccaagtagagcaacccacacttgtggtggatttctagaagtaggttgagttggatcttggtggtcactcaattctagaaatttgcctaggggtgtttggggttgaaggctgtggatttcctctggggtttttgcacaagtgaggcaaggagttaatcgagacccagctcttggagctcctcaacggagagtaggatcacaagatccgaacttcgggaaaaaatcgctcttgtgatgtttctgtggatgattctgtgatatatcctctgcttagaatacctgtgcaccatcttgtgaagattggcttagtctcttgtttcgaaatttaaatttcatctctgttctgttacccggaagtttctgtcttagaacaccggaagttccggagttccttaccaggaagttccgggtctgtttgaattttaccgccgcgatttgtttttaagttttcaggaacagcctattcacccccctccccgcctctagtcttcatcagcgctgttcaggctccacatggctacaaatacaatttttgtgggacaaaaccttggagctagaaatacgatttttttaggatggaggtagtaaaaaagaagacgttccattttaaggagaaaacaagaccaaccagttaataggcttgctaaagccacttggtcactgttcctagtacaagaactcttggcgaatgggctgggtttagtacctgcttctcttcttattcccaatattttaggtcctaaatatcagcatgagtgagaatttggttacatctacattagcaaagttctctgttgtgtcagttaatccagcgtgcatatcagtgtagtaatgtgtacatcttattgtaaaggtgcaatatcttgattctcaaaaatttccacttgctatatttgatgcagctttgcaaaattgattcatgtgtaaggctagagaggtggtcggctgctcatgtgtcgtcgtgaaggtaaagtatcgattccgttattgtacaaaggagaatctcattccgattatataaaatctaacattttcgttttgctttcctctaaccaggactatggtgaaggaatcagaatgctttaacatcggaatatgtcaagtcacactagggacagctctcaagtatctggagttttcaagatgctttttgtccctcatttaaatttgtatgaagtcttggaaatgattagattatgaaaaattttcatctctgaggatgccaactgaagatcttgtttctggtgttcttggcatcatggtctaattaccagaaatgaagatcaatataatttttctcggtgttatgcaagcataatccctttctaccggcaaaagttactacaacgaatcattaaaattgactttgcacgatcattaaaatttcatgcttgagcttgcatgatctattgtgctaaattgtgttctgatattgtgagcactacaatgttgacaaatccgtgttgatcactacaatgttaacaatatctgatgtactgatatctgatcactatgtgtgttttcccacatgttcagtttcagttggtttggtgtgtaaaactgattgcatatggtccgactataattgactgaaagatacattgatttggaaatcacaacgagatctgtagtgaatcatttcacatgaagcagcaaactgctggaaattttgcatcggttggctaatacctaccagccatctcaaattctctatgatatttgatatcttccctctgtcatattttgggacggaggatcccttatattctgggacgaaggaaatattatgggacggaggaaggacatatgcaaatagaatttcagttgtttcaaactgcattatgtgctaacaacgaattcttaatttctcattcacctgttaaaaaaacagcatccagaacagcacagcaggtcaatcactgagctgattcgcatagactgaagcttatttaacaggtcgaaaccagatacaactgattgtagtcatagctcaaagcacaccatcatattggatcagtacatacaaagcgtgcgtattgacaccgtctaattggattagtacattcgaagtggataagtaggctttggttcaccagtccatgcctaaattccttgaggtaaacagatcttcaacgtagagaattactggtccagatgctctgatgaaagtctgcatttgaacctttgccgaattttctgcagggggcaaaacgaaacagaggagcaaaatctcccaaggtcagaataatgtcataacatggttagaaaaactaatatatcttgttaatttgataactcatctattacattttctactcttttctggcacttgattagttcatatacacagatacactggataccaatatgtgtatttacgtattactagctctcttgtagcaaacagttatgcaaaaataacaaactatgtactttctaagatatcccaaaaacgatgtgatgcaatcatgtcaaccaaaaaatatatatgagttgcttgctgtcagcatggaagtttagagaaatcagacccgtcactcaccatcttcattcaatttcttcaggagctgcgattttgagggaagggcgtacattccagcagcaacggctttccttatggcccacccatggtgaggagcaaaaacctgagcataagccttagatgctgcatcccttaaggagttgcccctgaaattagtatgcaaacgttttggtcacatttactgaacatgcatccaagagtaccaactttagaataactgagaaggaaccaacaccaaaattcagtttatgactttaacttactctgtaaccagtatttgctcaaacagaattttaaccatatcaatcccacgcttaaccctcagcatattcctagtatggctcccagcttgcctgacggtgcccttctgaatgtccaactcaaccatctcaggcaattttgagattgacttggatgcctccagcaaatcatcaacctgcactcaattgagaggaactaaatcagacaacacacaacaaaagctcagaaaagcaagttatagttaaacaggttactcaagggatgcctagtgggggaaccaaggcggcattatcatcaattttgcagaagtacaaggtcctgataaacagaaaaactggtttgctaaatagtaaacttacgagtaactgctatactggataggattctaacacaaactactaagcatccaccaagtcaaagtcatcgcaacacggattaggtgatctgatcctgatgcgtgcagacattcctacctgacacttgatctagccatctaggtgataatttcagatcatttcgacataatcacctagcattaagcagctcagattcaggtgatcccctcaatctagccacaaccatgcagactacttcctccgtttcatattataagactttctagcattgtccacattcatatatatatatatatatatatatatgtgtgtgtgtgtgtgtgtgtgtgtgtgtgtgttaatgaatcatacatgtgtgcctagattcaatctatatgaatgtgggcaatgctagaaagtcttataacctgaaacggaggtagtagcaaacaattaatagccgacctaactcctaagcagcaaaaaaaactcatgtcaatattcagaatttggattgagtcatgtcaattcagatatatctgagttgcttgctctcagcatggaactgtactagatatgattctaacaccaactactaagcatccactaagtcaaagtcatcacaatttgggaggtgatctgatcctgatgcgtgctcacattcctacccttacagttgatctagccacccatctaggtgagaatttcagatcattttgacacaatctcctagcattaaagcagctcaagttgagataatcaatcccctcgaggtctcaacctaaccaaatccacacagactagccaacaattaagccgaggtaagcagcaaaaagaggtcaatctagtcaagcaattccgacgaaacctcgaggacaagggagagcgaagactagagagcgggggtggcggcgggggcttgccttggcgacgtagtccatctcggcgaacttgaaggcgatgccgaggcagccgaagaggacggagacgttggagcaggcgcgggcgaaggagcccacctccatggccgggccgggggcctgctgcttggccaccgcctcgagctcctcgaacgacgccgcgatccgccgcagcggcttgtccccgtcgctcgaccccatccccacctcccgctcccgcttgctccgccgctgcggctcgtcggcggcggcgtcaagctctccgcctccgggatggttggggtgggtgggtctctctctcgtgtgctttgcttttggttgtggttttacgcgtagaggtgaaggggaggaatcgagttcgctctgcagtgggccggaggaatatttgtatcgtctcggcccatcgaatgagaccgacgtgtcggctcgtcgatcctttctattcctaaacctgaacttttgcctcctctagaagaagctgaattttgctttgtccagaagaagctgaaaaccccgtattttacttcctctgaatgaagaaaaaacgaatctttgctgcattggactgaaatacctcgtgtagatcagagcgagtctgaactccaaaaaaaaaaaaaagtagagatcaaggagtctgaaactcttcggtagaacatactaggggactgtagagtgtaaacatggggctgttttggattaaaaccaaaacataccctaccaaaattttagtaactcaaatagtaaacatgaattttggtaacttaaatagtaaacatgctagtttggattggacccaaataattgatattactcatgtttaatttggtcacattcaaaaatttctcaccatactaccataactagctgggtggcccgcgcaattgcacggttagcacccaaacaaaatcatatattttttagtatgattttacttaaaatttattaaatagctatctcattgtttttaagactttgaaagactaaaccttatcatcctcgtgttttcaattatatagtttttagaagtcacaccagctgccccttatgtcatctccttctttatttgcttgcttgcttgatctaccattattcctattcattcttcttcgaacctttaaaaattggattttacagttttagagcttattgtcacgttgggtttcatttttataatttctagatgtcccgttaaacgttgccattatactcctctacggcctgtccactgtctcttctctttattgtcattgagattttaaaaatcgaacataattatcgtttgggttcatttttactttctaaaagtcctgccaaaccgtcagtagctttgccattatactcctctacagctcgcccgctgcctcccttctttattgtgattgaaattttaaaattgaacatgattattattggtgtttttttactttttagaagttccgaaactttaaatattggacttgtaatttcattttttataacttttagaagtcatatcaaacgatgccactatgcccctctacagcccgtccgccgcttactctctattgtcattgtgattctaaaaatcgaacataactatcgttgaaattcattttttgtattctagaagtcccgtcaaccgtcggtggctctgcaactatactcttatacaccccgcccactgcttatcctttttattgtcattgagattttaaaaatcgaatagaagtcccggcaaccgccttactcgtttgcttcacaacctgcctgacgtctttccttttaattgtcattaggattctatttggtgtttcattaataatttttatatgtcgtatcaaccaccaccactctactcctttataggcatgttacttaatttatctcgtcatttgttttagatggtcttttctttcaataatatttatttttatcacaaattttagttatttataaattgtatttctaactgaaatcttatttttctttttctaatttcagattttttttaaaaaatagttaatacagtattgtgttcttttatttattttttattttttttaattttcaatttcagttgtttcaaaattatattcctacttgaactctcttttaatttttctaattttggatattattttatttttttaattctaaattttaattaatctcatattgggttattatatggattcttctttcagtattgcttatttttaattcctaattttaactaattttaaattgtattcctacttgaactcttcttttactttatttttctaattttggatttatttatttttattctgaattttaattaatctcatattgggttcttatatggactcttttttttaatattccttatttttaattcttaatttcagctattttaaaattgtatttctacttgaactctcctttcctttttaattttggatttattgggttcctatatagactcctctttccatattgcttttggactctcctttccttttctaattttggattttattttatttttattttgaattttgattaatgtcgtattggcttcctatatggactcctctttccatattgcttatttttaattctgaattttagctatttttagattgtacttatacttggactctccttttcttttttctttttctccgattaatgtgggaatttctagcccccacagcgaacgtgtacctcctttcaaagttgttttaataatataatagatttggcttcatattggtatcaaaccaaacattaattttgctctatcaaaaaaattggtagcgtcgaaatttatctaggttatggcactaccaatgaattggtagggtaaagagcactaccaataaattggtagggtaaagaaccaggcgcatcttgcaaatcataatcggttcatctcatcaaatctactagcgtagcgtagcagtttgactcttgaggaagctgcatcctttaggcctctcatagtgcaagctatggggcccgtacccccagcccaaaaaattggtcctaagacacccatcccacagtgcaagcacccatggcttaatcggatagaggcactggtaaagggtaccaagcccacagtgggcgtgaccctagcttccggaccggtggagcgaacgaaaatttatttcctccacctaccccttccaccccttcctctctcgcgtgagacttctcctctcctcgagtactactcttctcctctcacgccgggaggcgacggcgctagcagttgccgcctcgttgtcgtggtggcggcgccgccgccttgcctccttcccctccctctctatccctcgccgcacctccttctcctccctcaccgcgacgccgacgggaagccgcggcgaggaggcgtccccggcggcggcggctggcgcggtggcggaggctcgaccgggggacgcctccaccgcggcgacctcgccgagggagacctcgagcagccgccgttgccgcgaggaggagcgagtgggctgggccggcggcggatctggcggacgcggcgctcgtcggcgtgaggagcggcgagtgattcgagacagcggcgaggaggagtccccgagaaggcaccggcgcaacggttcccctccctaagaagaggcatggcggaagcggtgtggtagaagaggcggcgcggcctcctcctcccacgccgcggcggcacggcctcctccccgtcgaccgtgccgctgatcctgaccccaccggcgccgccgcggtcagctccgtcatcgatcgacgcggcggcggacggatccgcctttcccgacggcgggggcggcgagggcggcgggaacagacggcagcgagggcgaagcgggtacgggaacagtggactcttgtgtgattcctctctgtgttcttgtgtgattcctctcctctttgtgttcttgggtgattcatcttgtgtgatttctcttgtgttcttgtgtgattcctctcgtgttcttgtgtgattggcaacgaaatcggtggcgggaagaggagatttgggcgtgacttcttactgatttttcgagggcgaataggggatttcgtcaggggaatctcgcacaagagcatcgggcagcgagggaacaactcccacagcgcacgcgcctcacatcgattcctccgcgcgtcctcttttccaggcgaggttttgcgcccccagtttaggcacaagcgccctagctgagacgcgggtctaagcaatacggcagcaaaaatccgacatggcgcgactaaggcacagtccaggtcgacacactgtgaggccttacaacgtcgtcgccaatttcaccaccgacatgagcaagagcagaggcattcggttccagttccatgggaaatcttggtttcgttttgatcacatgatcccaccacaacgttaactcgtaaagctacacatttttacgtcttaatggattgatttccttgtgctatctcacgaattacagcactcttcctgtcccaatgttcctcacatttacgcgaattacagcattcttctttctagagtacagtcgatggaatcatggaaatttgatacaacaaattttcaaccggtcagggctcccagcgcattgagccacccacacaagcattcgcacgcatcaaacaaaaagcttgatgcataaaaagcgaataggtaaaacctctagtcaagatggaaagattcatagtttatctatgaagtatttttaggagaaagagtaagatttacatgtcaatcaacacacaccggattttggagttatacgagagagtcagatttacatgtcaatcaccacacatccgcgattacagcggatcataagactggggcgacaaatatcacatcatcatcctcaacatagaaccaatggaccaatccaatcagatgaaaaaagccacaacaaaacaacaaatcaagaactgcaaagcgaagaacatcgaagagcgcgaacgcattggctattgagtcagatctgataacatgtcaatcagcacaggcccggaatccggatcctaagactggggcgacaaatatcatatcatcacgctcctaataacgcatccgtgcatcagaaaattggaagtcgataagccaacaaaaagcagttgaaatatggaggaaatcttctgagaaaagaaggaaatgaagaggcgagaaagaatcaacagattcgcatcagagaagaacaacggcgtcggcaaagcacttcggcgaggagttggccgccgcggctgcatttatgggagggcaagagagagctagggtttcgttggatgggctgaaattttgtttgggcctcttgaccacgtaaggctggaactgggctttcgttagccttttagctagtacggagttgatgatagcttagtaaatataaatattcaccatccaaccaaaagacacacacatcaaactatccctataaaaattcggctaaattatttaagaaaaaaatatgtattttaatgtagggctataactttgtagacaaacggtacacgttatagggcttgttcgcttgagctacattgcacccagttaagactgtggctagcggtagtacaactttttctgtagatgttgtagttgtacagccacaactatgtccaccgaacacacccatagtgtttgatcggttgagttattgctataagccatataaaaattgaacaaagcgtctaatttgatttatggataataaattttatatatgtgttattagggatttaataggcaaggttggaaaatagaatacgatgaaaaataactcaaaataaacttcaaaatttagctgaaaaattcaaatttccgtttcggctaataagccaatcagatgatgagagctgattaatccatattgctagatggcaattgattcaataataatctctagcaatatcatctttgaatctttgatgatcattctgttttacacttcttggaacatactacagttgcagtcttgcggatcaccttgtttttcactagactctacttcatcttcattcacaagttcaacatacattgcaaaatcatatatacatttcatatacaactactttacaaattacaactaaattgacgaaagaagggggagaaaatggtaccatattttagtacgagtcaccaacggtgacaccaaataataatgtcaatagttatgtacaaatcatgcaactaatccagcttaattctaccatgatcaaatgcatgtacactcgccgctaattaaaactctggctaattaagctgcctgcttctgcagctcgatctccttgtcgagcatctccatgaactcttcgtcggtggccttgagcatgtccggcagcggcagcgagacgccggcgtcggcggcggcgcggtggcgcggcgcgatccgcttgtcgaggctgaaggtgaagtactgcgggaacgccttgatgtcgtggacgccgccgcccatctcggcgacgaggtactcgaacttgggcttgtagttgcgctcgatgctgaaggtgaagagcgccgggcagcggagcaccatggcgacggcgtcgtcgcggtgcatgccgagccccgcgaggaagtccagcttggggatcatggtgcgctcgacgctggagacgaggaggatggggtcctggaaggcgagggcgcgggcgtcgcggaagccgaggcggcggaggtagaggagcgccgggcggagctggtcgcggacgctgcaggcgaggacgcgggggcacttgacgacgacgcggcggtaggcggtgtccgggatgccgaggtcgtcggtgaggaaggcgaagaccgggcggaggtcggcgcggacgctggcggtgagcagcgacgggcacatgccgaacacgcggccgaggtccttgaagtggagcccccgcgactggaggaacgtcaccacggcgtggatggactccggcgccgcgtcgcggagcgccgggttcagcgccagcgcgcgcccgtagtccacccccatcagctcaaggctcaggatcttgtccttcacccgcgacggcagctcgggcaggtgcagcgacagcgccgccgccggcgccgacgccgacgccgccgtcggcgccggcgccggcgtggcggtgtagggcttggaggaggaggaggaggggagggagtggggcttggcgacggggagggaggtggaggcgtagaagctgcagagcggcattgctgcgcgggcgacctcgtcgtcgtcttccctccgattcgagcagagaagaagagagtgtgaagtggcatgtctcatccgcttctttatctggaggttggtgctgacgtggcactctgggcggcgctcattggatggtcggattcgggcaagaggaaaagatcacacaatgcatggaagcagaggccctcaggcccacaagccaggaaccgagcctgtttgcagtaataatcctgtaggaattcaaacatgttcatgcgttcaaattttacatacaagcaaaaaaaatagtaagaaataaaatcaatcgtaataaactttaatggattggtaagcttaacttgcacatgcgacatgttcatgtcaatctggggacaacttcattgaatcgactctttcagaataaatacagtactatgatattatcgtttggacaccacatcaaattgccggtttctgagcaacaactatataggtcacacggtgtaactaacatggattattaattagccggtttatcctgtctgatcatgggcagcgcaacatactggggatgatgtccaacccaacataattcagaaagaattacatgtaaatacgctcctcgatgtgccaaattggatctctggcgaatgttacttatgattgagaagctgtgtctttatttttttttctttttgattcggataagctgtgaaattactggtatagtattgctgcaaacttgggtgattagtaaaggctagcatgcgtggaagggcctcaaatcagcatttcccatggcttctgctcactgatgcccttctggcgagcttgtggttaggagttacatgatcatcctgcggtacacagatgatgagtttcgtcagtaaatttcagggccaaccaaatatggcatagacatgcatcaatataaactctaaattattattttgcgtcacaactcataagccagtatgactatctgttgccacaaacttccaaattttcatggtgaatttaaaagagggatgagcacgatcgaattttaccatatataacgaggctgcggaatcagatcgcatagcatgattttgagcttgaccaagagattggaatgtgtcaagtgcatcaactgttaattgccagccagaaagtggtgaactacttgagcttgattcagtgttgctacagcaagctgctgccacagttccatttacccatgggcagtaactgttgtgatgcttaacaggatcaaattctggaagtcctgattcaaaatcattttctccatttgttgctcctgagaaacaaataacaagattgagaagaatagaacctggatagaagaaaacagagatctaactaaagagaaaaagatcaatcgatgtagaatctcatccattccattggataaaaaaaaaattgtccagggagcaatcagtataaaagccatccatcctatttgaaacaaggacgcaatgcaaaactaccaatataacgaggatcaatacaactgtgctggaaatgaaatctagtcttcatcaagtatttgaatcttctgtgaaatgtataaaatatttgaatctggattacaaaaccagtcacgttgcaaaatccacagaacagaatatcacaagtcaagaataagtaccaacttcaaagaaagcatagctagcaagcagcaagtatctatgacaaatactgcattgtactagggaaaagaacatagcacgagacccacagaaaatggtgcaaaggacacattgcaaatatacacttagtttatatgtaacaaggaaaaaggttgatcataagtacctaatccattctgagggtcataatctaaccccattggcacatcaccagcgatcaatagtttgccagcctgtgtcacttcctctttagatacatccaaaccggtctgcatccctgcattgcaagaaagagaaggatgcatcctgcttgcatgaccaacagcatgccctcctatcttttctccactctcaacagaatcagctttagtggaaccataaatttttgagccactgtcagcttggccgactgactgagacaccatatcttggctatctccatgaggttcttgccgatcaacttcgtcaggtacaaactcatccattagtccaggtccaggaactgattcaccagtatgacccatcgtctctgttagctcagtattaggttctgcatcacctacaacactttcagccctttgcaaagaaacatcaattccatgaatttcagcttcatggctagcacccatgccaacactaccaccgctaattcctacactaagttgatcccttgcaaaagcaggggctgttactgcatcaaggacttcctccccttcatttgtactgcttcctcctatttcccttccatcacttccagaagcaggctgtacacatgcactttgctgtgcttggttactatagttcaggcccaagacatcatccatttcaatatttctgtgtgcactagatgagggcatgtcaatatcattaccatcacctggatagtattcaacgctctccatggagtcttcatcagcactatgaacagtatccattgcagctacagaagattccctcatagaatctctgtcaacagcggctagacctgcagctctagcatgactgaatttaccagcatccgcatcaggatcaaagcaaaagtttctactgggaccagctccagaagaagatggaagataggaaccaaatagatcaaacccacgtgaccttttattcgggatgtccgaatcttgcgcagcatcatcaacttcctcaccatcacgatctatcacacttccttctatgctatcagcatgctgaagcctgtcctgtggcttgtcaactgtgctcccaccttcctcatggttgcgcttccttgagcttggacctcgggactcgtatgaagttgcatgatcaccaacttcacttccagtaggttgtccaatcatcagatctcttcccaatcctccgttgaaacgctcagatgcaattggtatagaagattgaattgatggtaatcctccagccattgttagattcaggtccactccagcatttgataatgatttaccctcatttgttgcttcttcatcacgcccttcagcaggatctctttccatcccatcagtaacccattcattgatcccactggcagcgctaattccacgtgtcagagcaagcttcttgcctgtttcaggtgcatcaatgttatttggactaaaacgacaaggacgtgacacagatctaaagtcccagatcttgactgtagagccacaaaagctacaatctaacaaaggtgatctcatgctacatccagagtctttgagtggccttttgccttttcctttatcttttttggctgacccagagaatgaatttttttgatgttcagcaaaacggggaaaaaatggttccaccgaatctgcatttttagctgagtgggttgaattttcttcacagtcttgaacatttggaagccacctaggctcccatccacaaaggcttataagcttcctagcctagaaagcaaaagcaaatcagaagttatatcaacgaaagctaaagtctccaaagtcattgtaaactaataatgccaaaaccaagacatcacatgagaacatggaagaaaagtaaacatacttttgagtagctacaagaggaatcttgctggatatcaattcctgttgtgctctctgctttgtaactaagctctccagataaaaaggtaattgattgggataataagcggtcaatctgggaactcctggtcagcctcatgtgctcaattgctgatgaagcaatcactggaagggaagtaaactgcagaagtccatcacatcgatctttaaaacccccaataagggctgattgtgttaggtggagctgcaccaagctgtcagcacagctattgcctctccagggacagctattatggtgtgatgcatcaagctgctcggcaaaggcttctccagcatttgaaactaatacagaacatagaaagaaaggtttcatagctgagcaaaattcagtttgcaaagggagaggtaccaatttattttccagcctagcacaatggtgagatataagtaacatcagtcagacttgttatgcagtagaatactaagcatagagttttattgatgatgcgtaatgacattttacttcctttgttgacataatgttgggtgttaattcaagatatgacttagttgtaaagatgagattcatgcaacaaaagaaaagatgaatccttgttttccgctgtaaccccccaagttccttatgtcatctgaaacttgttattttcttttatgccaatagatcagattttctcaccctccctttggcactccagttacgtgagcaagccatttagagagcatggaaaagactagaatgcccttgatctcttctccctgtctgatgattggcttgagggcaaatcgacgaagaacgtagtgttgtcctttgaactccacaagatataccgacttctccacagtatggctcgacagcaaagaacccacaaaccagttttcccaccatgagctagtgctcagtgagtaacgctacttggggacacatccactaatatggagacacatacaaactgagatggggagaaattacgaccaaacaattcgtcaataaggagacatcaatttatcttgggacatgaacagatgcgtcaaataggagacactaatttacagagaatcacctcgtaataaagtaaatgcagccactgaatgcatgtaatcaaattacaatcaatgaaattatagcaagggtagtggcatggccaaggagagaaaatgctgcatcagccatgagctcagggccaagcagatcgacaacaaccacgtgaaaccaaagaagatgagatcgagatactcgagctgtactctacgctcttgaaatggacctgatgcacagcaggagacaagttgaaccatgtgcccaccttaatttgctaaccatacgcctcaagctcctcccctgctccccgctggaatagcaccaactggcgatccacatggagaagggccagcagagtgatgcgggttgaggcagcggtcagcggagaaaagcagaggaggaagaggaagaataataagagagaggaatagaagttgacacttgacaggtaggccaggggtagatcggggattttatcaaaatactgacaagccttccacccctaacagtagctttcgacctgaggtgacggcagtggcacatagaagatgtaaaattccataccatggcacataaaggaacagtcaaatttggtaggcaaataaggaagcccataaactatgaacggcaaataaataattctcaaaaaaaattcacaaaggcaatccgattttttatgaccatcacaattcacaagttttcaactattgttgattagttctgcacaaagaattttataatggtattatttgactacagtgaatggcattcacatcagcaaatgcacaaaccagaaagcataaatgtgttgctagtcacggcatggttaaggcattacatcataactaaaccatgtgaattgtaataagacatacaacttattttcagaagtttatgctctctaattaggtatgggcatttaaaataaaaatgttgtatgatttgttttccaccattaaaagatgccgaagcctgaagaaacttggtaaaccacacataatatcccccagaaacttttcaaactaacatattgtctacaaaagcttagttactgaaaacataccttcagctggagaccaggatgtcaatgtactgaatatgagatgtgcaccacatgactcgcattcaattttgtccatgtcaacgttaacccaacctctccgagcacaagccaaagaactagcagcctgcaatacatgtttttcttaaagtgtggtcaaatgagtatagaatattcctcaaaaataaatactgcagatggaaaccggaatttcttttgaacctaatatatacaataaaaaaaactgcatttccaacaagcacaagagacatgaaccagagtcaaatttcaatatatccaagagcctcaacgttccgcttatacttattataagcaaacagcttattagtgattaaaaaataatttatgggtaaaacttttatatgtgtaatcttagcgctttaaaagcagatgctggaaaataaactaagatgaaaaaaacccaatatgaactctaaaattatgttttaaaattcaaattttcgcttatgcttataagctgaagggctaaagatggggttgcaagcaacaaaattattattataaatgacacgaatgaagaaaagtctatgcatataagttgatttaccatgatcataatttcactataatacacaataacaaaaaaaaaagaaagcaaaaacatcaccctcaaagtatcggccatctgtgtcttcctaccattaacaacagaagtaagttatactaatagctctggtgagggaataaataaccttaggcctagaagcccaagttgtaggcttatatgttgccagtcgacgaagtaagtctccgcgttcccatggcctacatgacggtgcagaatccaaagcagttccagtggcatcgaaactatgagaaggctgatgggcatgcggagcaacatgtgatgaggaatcaactctggaagcttgtctgctacccgaccaatctatgctggcaacattagcttgcatagcaggtgacgagggtcctgcagaactgagaaacataacaaaaacatgagtttaagtgtgcccatgcaaggctcaagagctcccggagttgcagttctctagtcatccaatacccgcccaccatttccagttcataagttttccagctatatatttggaattagaattcaagcaactctgtcatcctactttccatgaatgagacagtgtgttaaatcaactcaccaaaaatcgcataaaaatatctcgtcggatagcaaaaccacgatataataaatcgcctgatctgcagctcgcttccgtcctagggtttaaccaaacatccacactctaccgcacctccttacgctcaccgtacacaagatcaaaattttccaactatacatttggaattggcattcaagcaactcctacttaccatgaatgagacagcgcgctaaatcaactcaccaaatatcgcccggtttccacctagagggatatatatctcgcccgagagcaaaaccgtgatggatgcaggccagtagctcgctcccgccctagggtttaaccaaacatctacactcaccgcctcactacgctcgccgtacacaagaccaaaatcccttcgagcaatcgccgccccagtaacaaatccaacgaacacctcgagaacccaaccacgacacaatcgatccaagcaccgagagcccgattcaccgaccacgcccaccgcgacccctgcgaatctaccgccaaaaatgagcgcccccccgcgatcgtaccttgcaaccggcgtaggaggcggctcggccgccgcccccgacgagctcctcacctcctcccgcatctcccctcccctctcctctcctcacctctccccctcgccgcgccgcgtcgccgcccctctcctcctcgccgcggcgtaattgggagagaaaaaaaaaattccccgaccgcgacgcgcagaggcagagttgggttccccggccgttacagccgttagccctcgccgtcaatcgcaaaccctcacacctcacgccgtcacttagatgggccgggctttaatcgagatcacatgggcccaaacgttgaggaggcccagattccgcggctcgcttcgtcgtctcgtctagctccgtctcctctcgcgaagtctcctcgggccattctctcgccggattcggatcccgcggcggcgagccgactcggcggggggatttgccggcgggatgatggaggaggcgagcacgtcggcgtccggtggtgggggggccgccgcgaacggcgggcagcggggcttcccgccggcgagatcgggaggtgagtccgtacacgtagcttagctctgacgacgggctcgcttcgatctggcgtcgttgaggtcataggctggaagtgttcatgatacttacatatgaattttggcgagcgtcatttagcatggtgttaatcggcggaggggaaatgaatagctatctctatcgttcctcctaaaccatgtaaatatggataattgaagcattttaggcagtattttgtatttatttgcgcttgctgaacttcgcatagatgatgaactatattagatgatgagagaatgatttgttttacagactacagatttaattttatttgcttctttattatatatgcaaatcctactttattacatggtcatacagttaatcgtgttggttttgcagtgttctataggttcactcagcagaacctcccagcttggaagccggcaatgacaccaggatgtgtaagttggcattgactcaactacatgctttctacagaatttaatttgttgtttaatgtatataatatggtattaccttcgttgtttcaggtgataactattttcttgatgatcggagttacttttgttcctgttgggcttgtttgccttcatgcttcaaatcatgtaaattgtttttcatttctgtccggtggatgttgaactaccatcagttggtggatcatactaatacacactaagttctccatattctgcgtgtgcaggttgcagaaattgctcaccgttatgatattgattgtgtacctaatgcttacaaaagaaataggcaggcgtatattaaagatagctcgatttcaaagaactgcactcaagaagtgaaggtattcctgtgagatctaacatcccttttttccataatgatttttctctccagttttatttgtattataattatctagggtttttttggcgcacagattacatcatgttgctgtttcttcctgtccatatcatgtgtaattgggccagaaattcatagtgtgtatctttgcaggttaaataccttatgagagcaccaatttatgtgtattatgaactcgacaacttctaccagaatcatcgcaggtgatgaactgatgatacaactttattcaatttcctgtcattgtatcgatgtatctggctctctctttctgaaaaagaatctctgtgtattattaacgaacaatggaatttgttgatgctgacaggtatgtcaaaagtagaagtgataagcaactacgctatgggcagaagtacacacatagttcatgtgatcctattgaaaggaatgatggccttccaattgttccatgtggcttgattgcctggagcttgttcaatgacacttatggatttacctgtggatccacggaaataaaggtcaacaggaagaatatttcatggaaaagtgaccgggagcataagtttggcaaggatgtatatccttttaactttcagaatggatccttaattgggggaggaaaacttgaccctgctttaccagtgagtacttgtatatctcaattattgtttataacttaatcatgcacagatttttttttttggtttgtcattagcaaaacacttgtttctctgccagctgaaccagcaggaagatcttatagtgtggatgcgtacggctgctcttccccaatttcgaaagctctatggtgtcattgaagaggatctacaggctgatgaaatcattacgatgcacatagcaaacaattacaatacctacagttttggcggcaagaaaagcctaattcttacaacatcaacctggctaggtggcaagaatgactttcttggatacgcatatcttatcactggctccttgagccttttcttaaccattctctttgctctgattcacgtgaaaaatccaaggtaattattaaggtttactttttaagtttatcctgtatgaatttatggtgttaccatctttctttcggagccaggcaataaatattcctcttgatctttttttttatttttcattaataacttaacttcctctgcacatacgtctggagtgttctgtaatctgtacatgcgcacatcaataaacaaaaatctccaattgattgctgtataattctacgtgtgttgctgtaaactttagtttgtctattaactagacttggtcctcatgttttgaataatgtgcaggccacacggtgatgccaattacctatcatggaataggccaaacagcaatagctaagctgcctacataactgtacgatatgtaaggtaaacatttgacaaatacagtgtagttgtttccctgtaaaaccaagactattcttctttcatatgataacatagagttcagactgaatttcgtggcagtgcaaatagaacaaccaattttgtcattgccttttcttttaagaatgcacacaatttgtgcatttgaaaagaactggtataattggcagtttttagttcatccaaacatttggtatgttgggataataaagtgctgatgaggattgactggcttcttcatgcattttaattggctctctacatgctcatgaagaaaacaaactaacaagaattgtatgtgcgtgtgccatactatttgagtgaccatgtatagtataaatgcgtttgtcataaggtttctgccactactgcccatatcttatttccatcgtccagtctaaccattgtgaagataaaagctgacttggatttcaagagatggacaagttcaatttaacagttgtgcaggtccgagaatttcctcagttcatgagcttcactatgcaagaagaaaggtccatcttatcccaatctctctcatcaacttttctgtttttcttctgggagatgtgtgagctttctcacgtcatacttgcctgaactatggaagttggcgattctaccaaggtgaaggttacattttgcaggtgcataagcatcaatgggcgacaccaatgcctcgactggttcattcattgacgacatgatgtcatacttttgaactgacttgctgctcatatgacgagctgttataatctcctttgttcatatgacctttacgtgtgaacaaatatgctgtgctggtttatagctgatttgacagacaactttgctttagtataagtagaaacctctcatgctcgagcatcattttcaacaaagctatttcattgtcttcccttattcctaatggtctatgacttgtctatatttatagcatcgttttttttttcatcgaagaaaccatcaaattttccgctgctctttttttttaaatttttttccttatctttgcttcttgtttgtactataaaatcaccaggcttgtttcttaaccagctaaaaatgttgtgttttcacctaaaacattttttcattgaaaaaaccatcaaattttctgctgctcattttttattttttttccttatctttgcttcttgttttgtactataaaatcaccagtcttgtttcttaaccagctaaaatgttgtgttttcacctaaaacaaggtagaacatatttataatccattcaaggactataattgtttagaatctgttgcagtctgtcgatgtttcgacatatatacataggataaatttgctgttcgatcatgactattaggctgtgttcattcctcgtggttcccagttaatctgcagtgcacgtaaaatgaagctatccattagcacgtgattaattaagtactagtttttttaaaaaaatgaatcaatatggtttttttaaaaaaaaaaacaactttcgtatagaaaattttcgcaaaaagcacaccattcaccccggacctcccctgtgaaaccaagtgatcttgggattcgacgacaacatgttcggcgatcacattgacaccaaatcgttgatgtgtcacgtcaagctccgagcgcttgtcaccgacgcgccaaatctatccttcctcacgctgaagctgggaggaggagacgagaggatcaaggcgtcgtctccggcatcgccaccatggacaggaatttgatcgtgttctacctcaacttcaccaagaggatcgttggcgtcaacctcatctacgacaccatcgacgagtccctctccatgatcccgatgttatcgagccacaaagcgacgatccataccactcaaatgctcgtcacgcgccgccgtaccaccaccgccattgatgatgatgaaggggactacgctctaacgtatctgggcaaaatggcagtggaagaaaaacccgcggacaagccgggggacatgccggtgatcagctggccagatgttgtctaccaatggcggccattgtcgtcgctcccgtcgtggaagatgatcaagagggccaaaccttcccggcgagtggatggtcgataagtggttctacgttgacacggccttcatgtctgatgatggccacgccttctgggtggatctcatgtggggtatcctgtttgaggacttttacggaagtatatatttgtagtatatgaaagggtagatttggtattgttaaaaatctgaaaggggttgtttagtcatttttaattgagattttttccaacaggatttattttccatcggtggtatttttcggatctcgtcatccgttcgtgatatcaatccagtctaccccctccgtcccaaaaaaaacccaatcctgagtttgaacttggagttcaaacccaggattgggtttttttttatggagggagtacgcggtacgccgggtagtcggcagctgccttcacgttgtctcgcgtgtggctcctcgtacgcaacgacgtcgtcgccgccgccggagccggaagcgacagtcttcgccaggagcaaagccaccgtactgccattgttgtgcgtagaactatcgccgccgtcgggcccagcagcagctgtccgcttccaggaacttgcttccgtcagtctctagcgatataagttctcttgagtgttaagcctgagcccgtgacaagatataactactgtatatgtgcattagacttgtttgatgattcaggcttcatccgcttcaatgaaaatggatacacaagcaataattaaacctatctagctctatctaattagttcaactcgaagtaattaagttaacaagtctaattctctacaaacacttgtgaattggtttacttgtgaacttttatggtggtcaaggtcagacaagagtccttgtctagtagaactattaatttgtgatttgtgcattacttatagtctatcgccgccgccaggcttccctgccctgctgctgccgcaatgccgcatgccgccctgctgcttccacctaccaccgccccgctgcccttgctgctgcgagctatcgcagctgcgcgcctatggcacggtcccccagtggcggctttgactgggcgcctatcgatcagatctgactaagtgaggaaatacgaatttataaaattacccccacgcaaatagatgaaaagacaaatatactctatttaatttatactgcagaataattttgagaaagatcagattaatttacaccgttagatcaaatatactggtagtatatacttgcagtacaatataccgtaaaatttctcatcatgttttgccgctgcgacgacctcctctcctcctccaacgacgtcgaaccggtacacttggactccatagatctaccgccagagccaccaagtgtcatggcttgcgatttcacaagctatctccctcctactcttgccgctgtccctcacgccagttgattgctatataattctaggtgtgttattgtatttgtatatgttatagactttagtttgtctattaatatgcagaccgcgatttagagttaagaaagagggtttcgaggccgacaattttgtctttgccttttcatttttttttaaagaaaatgcacacagtttgtgcgtatgcaaagaactagtataagtagcagtgttgagttcatccaaacatttggtggaagtgctgatgaagattgactggcttcttcgtgcattctaacaagaattgtacatgtgcgagtgccatactattttagtgatcgcgtatgaatgtgtgttcttcattgcgaagatgatagttgacttggatttcaagagaaggacacgaacaatttgacaattgtgcgggtccgagaattcatgaacttcactggtcattactaagcgagaagaaagctccgtatatacttactacctccgtcccaaaatatttgacgccgttgaattttttaaaaatgtttgacagttcgtcttattcaaaaaatttaagtaattgttaattctttttctatcatttgatttattgttaaatatacttttatgtatacatatagttttacacatatcacaaaagtttttgaataaaacgaacggtcaaaaatgtttaaaaaagtcaacggtgtcaaacatttagggaaggagggagtatcctaacctttctcatcaagttattatctgttttctactcgtatttgaaaaagtgtgtgagcttgctcacttcaaactactaatacttgattggattgttgtataattccatgtgtggaagcgtgaagatcacatatcgcaggtgcagagtaagcatcaatcggtgacaccaacgcctcaactggttcattcaatattgtcgacatgatgctatgatgccatacttttgaactgacttgctgctcatatgacgagctcttacgatctcctttaattgttcaaatgaccttcacatgtgaacaataattatgttgtacaccctccgtactatgaaaaacaaatttctatctataaatctatatttatattcagattcataattagaatttttttagacgagagagtactgatttatagctgatttgacagacaaccttgctttagtcatgataagtagaaacctcttatgctcgagcatcccttacaattgttggagtatttagttgtcttctcttatttctaatggtatgtgacacatttttcattaaaaaaaactatcaaatcatccgccgttaaatatgtgatccgaattttaggcccacaatatattcggattagtttcctatcaggacttcgagtctttgtctattaggactcctagatttctcctatatatatatcccttgtaagccgcatgcatgaggagggtgggacagcccaatatatctcttgcgtttgtatccaactcctcaatagtgatcattgccaatcagcgtccgtggttttttccgcaagggtttttcacgtaaaattcgtctccattgtgtatctattttcatattatctgctgctttttattattattattttccccttttctgtgcttcttgttttgtataaaatcgctatatttgtttcttcaccaactaatatgtttgtgttttcacctcggacaaggtagtagtacaatttatttatactatccagccaaggagtctaattacctgatacaaaacggagttttgtttagagcctgttgcaacctctcgatgtttaggcatctacagtatgcacataggccaaacttgccactgtaacttcatcttactgtatcatatgcatgccatgcatacagtgggaacttgtgctgaatcactggtacgttgttcaaaggtcagttgtccgtgctattcatacagtgcttgctttgagccgtacgactgtccctctgaagaatctactcctacgtactactcctacaactagggtacagtactctgttatgtcacggactcgcaggacgtgcaggatgtagggggtgtttaaaggtgggatgtcttttagttcacgctaaaattaaaaatttggttgaaattgaaataatgtgacggaaaaattgaaagtttgtgtgtgtatgaaacttttgatgtgatggaaaagttggaagtttgaagaaaaattttgcaactaaacacggcctttgtaaagttttggtgtgtcacatccaatattatatagggtatcgtatagagtgttcggacactaaaaaactaattacagaatctgtcagtaaaccgtgagacaaatttattaagcctaattaatccatcattagcaaatgtttactgtagcaccacattgtcaaatcatggagcaattaggcttaaaagattcatctcgcaaattagtcgcaatatgtgcaattagttattattttaatctatattaaatactttatatatgtgttcaaacattcgatgtgatatggtgtaaaattttgaggtaggatctaaacaaggtgtaattatggttttttgacatactcctaccgcagatcatatagttttcttcctttgtttttttgatggcaataggccggatcgggcacaggtagagcgaaaccatgtgaacaatgtgatggatgcgcaagcgcagcgcggagccaactccacataagttgtgtggccaccagagctccatcgcaacatcttttctacataattaccatccatgtatggaataattagtactaataaggagtatttatttcctatgaagatcaattttaaccatccccgctttctaacaggagaagggaaacgatatgcgtactaaactatttttataaactttttacacatatgaggtgtcacattgtgattgaatctttaaccttttattataacttctagttaactcaatcaaatgaattagatttctattagtaaaaagtttgtaagaaattttagtacatgtagcactaaaaaaagaagaagaattacacataaagtattgctactactagttattgctccctccgtcctagaatgtaagaagttttagaattagacacggttattaagaaagtatgtagaaatgagtggtggagggttgtaattggataagttttaaaagtgaatgtatgtgggagaagtgaatggtgaaaagctgtgattggttgtgaagagaatgtagatggaaaatttgttatattttatgataaattttacttcatccgtttcacaatgtaagactttatagcattgcccacattcatctagatgttaatgaatctagacatgcatatttgtttagattcattaacatatatatatatatatatatatatatatatatatatatatatatatatatatatatatatatatatatatatacacacacacacacacacacatatatatatacaaatttgaacttgttttttttagattttgattctaggtatatagcatccatacatataattagttaggtatgcaatcatggattgtgaaataaagttaattttgagttgttttgttgataggtataggtatgaatcgaattattataactaggtatatactcacaatttaaaaattatgaaaaatttaagtgattttatgcattagatatcatggtgccccatatgagtgtcatatatatatatgtgtgtgtgagcaatttaaaaaatcttatattatgaaacagatataataaaaaataaaagttattatattttaggacgtatgaagtaccatctataagcaaccagggttgtgttggttagccgcgaagtagtaggctcatagaaattgctcgaaaaagaaaagtccactctatcgtaaaaaaaggtcttaaaaaaaaggaaaaggtgcgcaataactgcaggcggcaggctctgtctaactgaattctgaaacgacatgtgcggtgtgcccttttcccagagattgtcagccgcgccgtcgtcaatgatggtgtcaattactagtcctactccgtctttttttttctttcttcattcagctcaagccacgccgttagttaaaaagcaccgaaaaggagaggttcgctactgatcgagcagctatttgacgtagcaggaacatgaaatgtcagggtcctagtggctcatggctttttttaattttttattttcaaataaattcttccaaaactcacatttaaggctgcgttcgtttgtgtgagataaggtgagaaaacacctcgttttccacatgcacgcttcccaaactactaaacggtgtgttttttgcaaaaaatttctataggaaagttgctttaaaaaatcatattaatcaatttttgaaatttaaaatagtttatactcaattaatcatgcgctaatgactcatctcgttttacgtatctttctaattttctcaatcccctatctctccaactcaccctaaatctgaacctcgtagcgaaacaatacagcacaaaacatggtagaggtttattattatgtaatggtagcgcacaacgatacaagcaatgtacctttgctcatgtaaagtcataagagcaaggttaatagtatagctaactactaacttcaatttatctatagctaatctaatagctaattcatacaatagttgcttactatactattagtatatggtcccactgtcatacacacattgtatcttggagtccgtgttgtagctggctacagatctgtagcccgctgttcttctctctcatcttttatcttattaaaatatgtttgtagctggctaatagtctgctattataactgctctaaggtcattcccaacccaatgactaggatgatgtccataacattaaataagctgccacataggatgaaaaatgatatggcaagtgaataaatgaggaaagagaaggaaaccatgtcttgcatgagacatggtttctacacaacatccaagacatcatgtgagataggtagcattaaatttaagtatggaatagtggtgtttgcattggaagagtagtgtctagtactagtttcttgatgatgtggagtttatgaaaactatgtctagtgtcttaggttgggaatggcctaagagaggcagaagtagacacaattaacctgatccggtaaaagtgtagtgcattttcgagtgacacacaactacggctacattgtgacaatgacacaaaacgatagtttgcgggacaattgggacagtaggtataacaattaaccaatatatatactccctccgtctcaatatgtagcaacctagctaggatgggattagacttgtagttctaggatgggtctaattccatcctaaattgctacatattgggacggatggagtaattacttactactattattatgtaaaaaaaatacttactactattgctatagctagtatatctagttagtatttgtacatatgtgtgtaggcgtgggagtgtgtataacggtgtatgtgtgtgcgtgtatgtgagcacatatatcatgccatgagaatcatatacattcatatgtatatctaggaagatgtaaaaccaatcgaattattcctaccatattcatatgtgtaatatcaatccatgtaaccaggaattgaacacaatcgaagatgactttgatgtcactcaaattgaacacaatgatagcttgactgtgtgttggtgtagggagattgaaagaggatgaaaatgaagaaggacgagggaatcaacaccttagatagaagagagcgatgagggatgtcaaggaagaaggagacgtcagcagcatgagagtgtctaaactcctaatggcatggtagcaactggcttgggcaatactacctctcatgtaagagattttgtccatatagttagattgaggtagtacttcatatacttaatcggaacctattatcaacatagtttgaggttaggtgggtagcggctagtgggttggaccatgttgcgagcccaacaaggaggaggtgagttggggtttagcccaaaattaacattgttgatttggaattcaataaacattttttgatatatttgaactgacttcgacttgaaaggctgtaaaaggagggaggaaaagaagcaatggagtgggggatgcactcggagggaaagaggaacatgcaagggctttaaaacatcttcacaaaaaaagatcacttatttgtttgtatttctatctgcagtgagctggcacgtttcgatgtctatcgacagtgagcttgcgtatgtttcgatgtatatctctcctggctttagctagggagattcgttctagcctggttaagctatagtgaagataaaccttgctagttgttagatttcagtagccgctaattcctgcctatatacgccaaactatcaatacccaataaacgggggcaaattatttgtggacatctatacccctacaattttctcgcgacgctggcttggcccacaaattaacattgttgatttggaatttaataaatattttctggtagatttgaactgaattcgacttgataggctctaaaagggagggaggaaaagaaacaggagagtggggaatgcactcgaagagaaagagaaacatgcaaaggcttcaaaacatcttcgcaaaaacaaatcatttattttggactttgatgcgaggtttgtttgtatttctatctatagtgagctggtacgtttcaatttctaccagtcgtgagcttgcacgtttcgatttctatcggtagtgagcttgcatacgtttcgatatatatctctcctggctttagtcggcgagattcattctaacctggttaagctacagtgaagataaatcttgctagtcgttagatttcagtagcagtcaatctgtgcctatgtatgtcaaactatcgacgaccaagaaacaggagcaaaatacttatagacatctataccctacaattttctcgcaacacaagcttgctagagatcaagagataaccgactttaaaaccagtagaccaatgttactttagcaaatgcataatctttgtctaggtagttaagactaccattgatctccacatcatgactatatatggattattaatgtagtagcatggttgcccaacttgtgtcaaagtaaatgtgccccccccccacaacacacacacacacctcaaaaaaaagtgtgtgctccacattggagtaacaagcaactacaacaatacatgcaggaatatgagcatccactgtttgcccccctggtcccttccatgcagtaacagttgtcgcatcctcgatgcgccatggagagtggcaggattggcaacccaagccaccaccacctcccgttactcgccgctaacaccgtatcctcgcagcggcaccctccccaagcatgatggcgtcaaggaagaaggagacatcaacaacatgatggtgtctgaactcctaacgacatggttgcaactggcttgggcaatactacctctgtccccataatataagaaattttgcccatatagttagactgaggtggtacttcaagcacttaatcggagcctagtatcaacatagtttgaggctaggtgggtagcggctagtgggttgggccatgttgcggacccaaaaaggaggaggtgagttggggtttggcccaaaattgacattgttgatttggaatttaataaacaattttttgatagatttgaactgaattcgacttgtcgagttataaaagggagggaggaaaagagtaagagaataggggatgcactcagagggaaagagaaacatgcaacggctttaaagcattttcacaaaaaaaagataacttgtttgtttgtatttctatctgtagtgagctggcacgtttcgatttctatcggcagcgagcttgcatacgtttcgatgtacatctctcctggctttagctggtgagatttgttccagcctggttaagctatagaaaagataaccctggctagccgttagattttagtagccattaattcctgcttatatatgccaaactatcgacggccaagaaacgggggcaaaaaatttgtgaacatccataccactataattttcttgcaacactggcttggcccaaaattaacattgatgatttggaatttaataaattttttggtagatttgaactaaattcgacttaacagactataaaagggagggaggaaaagaagcaagagagtgggggatgcactcggatagaaagaggaacatgcaaacgctttaaaatatattcgcaaaaaaaatcacttatttaggacgtgatgcaaggtttgtttgtatttctatatgcagtgagctggtacgtttcaatttctatcggtagtgagcttgcacatttcgatttctatcgacagtgagcttgtgtacgtttcgatatatatctctcatggctttagacggcgagattcgttccagcctggttaagctacaacaatgataaaccttgctagtcgttagatttcagtagcagttaattcgtgcctatgttcgccaaactatcgaaatgggagcaaaatacttacggacatctatacccctacaattttctcgcaacgcaggcttgctagagatcaaaaaattaaaaccagtagatcaatcttactttaccaaatgcataatctttgtctaggaatttaagctaggctacaattgatctccacatcataactaatggattgtgaatgtagtagcatggttgcccaacttgtgtcaaagtaaatatgtctccaaaaaaagtgtgcgctccacgttagaggaacaagcaagcactgtaatacgtgcaggaattgagcatccactgcttgcctccccccttgggtccctcccatgcagtaacagctgtcgcatcctcggagaaggggcaggatcggcaacccaacctaagtacccaacccaacccccttctcctcccgttatcccgcccgctaacgccgtagcctggcggcggcgcctccccaaggccgtccactgacaggtgacagctacaccagtgatgaggcagtgagctgccgctgccgctgccgccgccgcaggcagatctgacacacgccgcgccactccaaagcctacttccgctgctgctgcacggcacagctgcagccagcaggcagcagcagcagcagcaagcgccggcccgcgcgcgtgacgagagagagcgcgcgcgcgtgcgaggcgaggccaaaaatcacccacaaaagcaagcgaaaaacaccgcggaaaaaaagggagcctctctcgcggaacaaggcattgcccgccccggtcaccgcatttcgggatggaggcggcggtgggggacggggaaggcggtggcggcggcggcgggcgggggaagcgtgggcggggaggaggaggaggggagatggtgga

SEQ ID NO: 62485 - DNA, 671 bp, Oryza sativa
gttggtggtgatcatcatcggggagtagcagaccaccgagctggtggtcttggggcgcgccgcatcggtgatctgcgacgtcacgttcgtcggcaggtcgtcggcgatcagggccggtaccgtcgaggccatcttggcgcatggcacgtccgcacgcacgcacgggggcccctcaccggctcccctgctttgtgttttgccggtgttggtttcaggggagatggtggttgtggcgacgaggtcgagagatggcccgaatggagggaggaacaggtcagagggggggtcgatttcgacgtcgtgctgctttcttggccggtcgcccggggactttggagttgtggagggtctccgatttttcatgtccgcgttgcgtggtgctcgttgaggccggaaattgcatttgaagcccaaatctcgtgttatattttggcccatgcagcccacgcgttctgtacaaggcccataccatgcatgcatggattgaagacgtgccacatggcccaaaaacaaccctttgggccgtggtcttagggacacggaaaatgctgcgaatatgttcactttaggtcctatgtaggccgggtttaaattgctggatttttcacattttggtccttttgaaaaacttatttcgcaagtagacccctagaaaaacttatcccaaaaat

SEQ ID NO: 62486 - DNA, 1160 bp, Oryza sativa
tggaggaggagtttattttgttgtcttatcgatcagatagcatactgccagttactcaatttcaaagggaacaagttttttaattcgattatcaagttcagaacaaaacaaaccagtcagatattattggagtccgtcttgcacagagtatcaccaggaaacaaacatggtcaaaaaaatttgaaatctaatggtttcggaagagacacgatttgttcgtgttttacataattcacaaggaccgtatatgctcttggtttgctcggaatctgacgaagccgcattatgaaacaaagtaaattcgggtaagcctcaatcccacatccatgtgtgatcaatatttcgaactaaaatcccggcccattaacatagatgggccaagatggcccaaataaagtcagaaaatcatgaaacccatatgctcgaatatttttagggcccggtgaagtttttccggaccacttgcaagcccaccactatcggctcatccatcagctatcgcctatgggactagcttagcaaaatcgatcgcataccgggctaacgtgtgtttgtgaatggctcggagctgttaagctatcgattatcatgtcatacaagcatatataatgtttactgaccaacatcacagccttgctcggcgtaacattattcattgctgtttagctatagtaattaggaagcaagtttggccaagctcagtgcatgttcactttgattgccattttcaaccttaccaaattttgataatgttgtcaaaaaagtggctatatttagtttgctaccaaattttagtaactatataagaaatcctgccaaatttttggcaagtttgtcaaaattttggcaactataccaaaattttggtaaaatttggggcctgctcactttgctgccaaaaaaaccttactaaattttggcaatggcaactataccaaaactttggcatgatttcttatatagttatcaaaatttggcggcaaactaaatgtagccacttttttttttgacaactttaccaaaatttggtaaggttgaaaatggcaccaaagtgaacatgcctttggtaaggttttttttcatcaaagtgaacaagccctcagcgttacatcagcggattagacattgcccgctgaattaattaagttatagtaacattt

SEQ ID NO: 62487 - DNA, 37253 bp, Oryza sativa
acagttgcgcgcgcgtacccccatccaccgcgagtcgccgtcccgtcgtccggttcgcggtgtgcggcgcggtgcatgcatgcgatcgagcgatgggttgggcgtgtgagtgacggagagcgacggtgtcgggggacggaggctgtggccatggctttgtgggggttgggggacaggctgcctggttcgacgggggtaatccgaaagcgaaacgaaagcgtaccgcactgctgatcgatcgatcgatccgacccacactcgttttgatttaatcgcggctgggctcgctcgaacgccactgggacatcgaattaaggagagggattaagagagacgacaagaagacacaatgatgggattttttgcttagttggggtcctgcaatttggttgcccgcattaacccgcctgtcccctgccgccctcccaccatgtttgcacttgcaggcgatcgccctcgcccctatcggagtgtgaatgtgatcgatctcgcatttctcgcggtacgaccgtgttttggaccatgcatcatttgtcttaaccatgcaagcataggacccctgccgtgctggccgggacgtaccatagatgtctcccccagcactgcagagttcccagctgtttgggctagtttacctgctggagacgcctgcggcctgccatttgcgtacttcacaatggtcacattttctgtttcaatgtgtgctagtattatatatctatgcttggtaaaatatgatcaactcatcaacatgagaatctgagcaaaagaccctgctaattagttatatattttactatatagaggccactgtcgaaataaagatatatctttcgtctagtaggtttgatgataattgataaagtatttcttttccccctgttttatgaataaaacctgctactaattagatgtttagattttcctacagatgctacggtggaaataaaggtaggactatctttcttctccttttctttttttttttttgcaagaaaggactatctttgatcttagtactttcacgataaagtattttcttttcctttttctagattatgatgagcaggtctgcaggtgatcgaaagatgtttgcacgcattactagcagttgagagcagaagcaagtggggtgatgtgtgcactgagtcatgcaacctaaaaagtgtcagtttgaaaactacaaacaccattctaaaatccaaagatgaaaaaaagggagtgctgccactcatagaacttctcgagcgaagggtccgctggtatcgataacggcgagcaagggcttaatttcttaccccgtttgttgattgtgtctgtcctttagccatcgtctttctccatgaaaaaacaagactaatcattaatttatcagtgggtaagtgtgcgtgcctagctaattaatttatttgggttaaaataacggcatgaatattgtatccaaacaaaaaaaaatgtttcaaaatacatatagtacaagctttgccgaggttaagcagtgcgtacctttcttgagcaatgcaatgctggagtccactaattattgcaaatggaataacgtaattagcaccctaacagatatagatttttgctactgtatgctagttgttgtttggatttccagcttatttttcttgtcaaaagaaaatgtagcaaccttacttcaaatccatgatattttgcttagattcttcaatacacgtaccccccttatcgattacactacactattatacggtcctttagaagttgattgattaggccgggaattatggacaaaatcattgtgccataagcaccggtctcccccagtactgttcccaatcctaatcgagcatctcaccgagctaccaacggccgagggacagagggcctgattgctcaccggtttgatggacgcctcatcagcatgtatgtacatatactgctgcagactctgatgccccacctaaaccgatgtactacttctgtagaatgtacttgtatatgtataattaaatctcattgatagtattattaacataggaggaattaagtgggtagtttaatttgaagaatgtaaataccccttagaccatattcaaacggaactactattaaatcttcagaccaaggagtattaagtacaactactgtaagtcaggctttccgacctctcgtgccgcccctcccccacgggcgactgggaggcgacgacctcaccggcgctcgtctccccttccctcctcctctgcctcgccgccgcccgagcagccgccggcaaagccacgcggccacaaggacggcggcgacggggctttatcctcgcgctcaggcatgggagggggacctgctcgggggcggcggaaccggccagatccgtgccgcccggtaggatctggcggtggagcaaccggcggcggggctgaacggtgtggcggcggtgtctggtggtggtggcagcggcgtcaaggcgttggcggcagcggaggaaactgccagatccgcgcctggatctggcaggacggcggccggcggcgaggatagtgacggcggcaagggcggcgaggggatggcgtcggtgaggtgaacctggccgcgccggcggcggatccagcgcctggaggtctggcggtcgcgacggtggtggcgacgagttcgcggcgacagcggcgcgggctaccacggcgggccgtctgcgccgtgtgtcgtcggagctcgacgacggcgacaaggtgtgggaggatgacgagatggcggcggggatggaagggcaacaacggctattgtggtggcggcggaggtggcaaggggatggcgtcggtgaggtgaacctggccgcgacggcggcggatccagcgccggaggagtctggtggtcccggcgatggtggtgacgagttcgcggcgacggcggcgcgggctaccacgatgggcagtctgcgccgtgtgccatcggagctcgacgacgggagaaagggcgagaggatggtgagatggcggcggaatgaaagggcagcagtggctgcggtggtgccgaccgtcaccccggtaggggaaggcatggcaatctcgggtggctagccgggggcgtgccagacggccgcatccgccggcgcggcagtgtttggaggaggggttggaggccggcttggcgtagagaggcacaaccgatggcagcagaggccggctcggcgtgaggggcgcgagcggcggagatggaggccggcttggcgcgagaggcacggccggcggtggaggaggcgacctcggcgcgagggaggagctgccagtggatgtgggtggtctttgtcgctcgaaggctggccggcgggggggcgccggtgcagtgatcccacatggcggcagaggttgagtggtggtggattgttggtctagcagcggtcggtcacgcttagcggcagccggtccggtgctagccttctcccgggcttgtgtgttggcactgtcggtgtgtgggtggtggtatatttttttttcctggttacgaccctccagaattgtaatcttgtaatattttcctactctatcaatagaacttcgcaccgtctcgtacaagtcgttcaaaaaaaaatcttcagaccagattaactgactgtgtggcctagtgataaaacccggagatgtacactgtttgtattatctacagaaattaggtagcatagaaaagaagaataaacttcgtattagtaatacaagcttagctaacgtgtatcaaaatcgactgcacacaagcgtgggtgcacacttgattggttacagctaggacaaatcacacaagaaaatggcaaagtaatgttgcgaacaatttgatgaagtcaatcagtatacgtagtttctcaaattatggccacaaactaaaatacccacacttaccaaaattaatgaccaaaactttacctttctattttcttggcaaggtttgtattggctaattaaaaaccctaggtgtcttggtgcctggggtgaattgcaagtataaacccgctctcgtatactccctccgtccaaaaaaagacaaaccctgggtttccgtgtccaactttgactgtccgtcttatatgaaatttttttttataattcgtatttttattattgttagatgataaaacatgattaatattttatgcgtgacttgtctttttaatttttttcatatttttttctaaataagacggacggtcaaacattggacacggaaaccagcgtttgtcttttttttttgggacggagggagtacttgttgtcttattcaacttaactttaaattaaaattttaacacttaatttaaagtaaatgtgatgaattttttgtcgttgtttatttttaaaattttgtttttaaactgctaaaaagatggatttgttttgcccgtatatattttttgcgggttgtttagtctaattttccacatctcttcagccgtagagaaacaatcagagccctaaagattcatatcacacgttaaccttcttaaatatgttgagtcgaaatattaacatatataatcttcttagttgcgctcaactccattttttgtgctgaacatggccgtgctcacgtaagctcacaccagcttgttagtttatttatttatggcactatatctgcagctattatcgctaatactcaaatgccaggaatttctaatgattggctaaattacgaacgtacaattaatagtgatcctaatagcatgtacaatagtagactattagctggctataaatatattttaataagataaaagatgagagagaagagcagcgggctacaaatctgtagtcagctgcagcacggactccaagacatagtatgtgtatgacaggtgagaccatatactaataatatagtaaatagttattgtatgaattggctattagattggctacagataaattggagggctatactagtagttattgtatgattgctctaaatctctatattagtttagtttgaggagaccaaggcagccaatgaaggacatacagatggctctgatttactacaccgtactagtcagtctcaaactctgacttttttgcccccctccacatgaaagaaaaatcaagaacaaatacgacgtgcacagtcaactcccaaaacccggtctacaatcaaacaactgaaatgatcaacgtcgtctcgaatgcaaacaaaagaattgtatagctagctagctagctatagcagaggctggctcatcctcaaccaatcgatttgtgtctagtccaccagttaattaatcaccaaagataattaacatgacctaatttatccatcatcaatcacacattcacacgcgttccatatgtgatcagttcaccccactaatcatcgtgctgcttagctctgcaccaatagaactccttcaatctgcaataatcttaataatctttcgccgaccttacccttcaaggctctgcttctactcaaaatctacccacccaaagcctcgcgtctcgccgcgtgtcacagatccgggccccacccgttcatatttctacggcggtgcgttacgtatgcatggataacataaatagcgagaattattagggtcttaatcccggaccggtaatgcgtctacgtttgatgcgtagcccgccttatcgcccaaggagataaacccaacaaaaaaacgctaaataaacaggtatatgttcggtctcgtcgatcacacatgtgtagcacgcacaaaacgttttggtttgtaatctgtggatatatacatgatcggtggattgaacggtatactgcattacgtatgacatagagctatcctgcttgatatgcagagtggtaatgctccatatataaaaccaccgatattatattatctaagttacacaaaatcacaacgactttaacatatggcacatcattgacggtaacatagctttgcaaaaccatgccattgaccaatttggcttactaccttaccaaaaaataagaaatgatttattacttggatagctaaagcatgtatgcttggagatcaaagattttgtaaatttgagatttgattttagaactttcgtatgcagtggatcacattataattggtaagcagtatagttttgtgaaactctaaaatcataatacctatgccacatgctaaaacaactgtgattttgtgtaactcgagtcacaatatcagagttttataaaatttactttagcgtgagtttgaatctacatattcttatcttctacttcctcttttttcgggtatacgcttcccagactactaaacggtgcaaaaaaaaacataaaagttgctctacagacatattaatatattttaaagtcttttagctaacatttaattaatcatatactaataaaccattcctcttttttcttgcatataggagaggtttttaacccctgcttccgaacatatatttggattagaggatcttcacatgatttttggaggaatattaatgttgttcatatgattttttttcctttcctatcgtccggatcatgaaaattatttgtagaaaattcaaaggaaaatttcctccggtgctgatttcacagcagaagtataggaaaaatccatcaactcaagctcttttttagtttttgcttcctgcatgcaaatactagtcgatcaacttcatgtgatccaaatacctcaactttggtatttctttgtttttcattcttctactttacgcttaaattccttttctattcatatacattttatatcatatattttttaagtaaaatacatggccggtccttaaagttgagcgtgggtgtcacttacatccataatcttgtaaattgcacatctagacataccatcttgtttaagtgactcgttgaggtccaaacctcacttgaccggctctgaccgcagacgtggcatgccacacaagcaccaattttgcaaataagcccctccgcaacagtagcgccatgaacaacacaaaaatccccaaatcctccttctccgcgcgcgctcgccactggccaccccctcctcatcgcgcaccatggctgagggcggcggcgggtagagcagcggtgggcgagcgcatgggggcgtgcggcgaacggcggcgtcacggcaacgtcggaatcctgctgccgcgccgcccctcaccagctcaccagcacgacggcattgagaatggcgatggaggagtggaggacgacgacgaggacgacgctctggcgctgacggcggcggcagaggcggaagttgcttgggcggccgtcggcggagcggaggaggaggtagcaatttacaagattatggacctaaataacacccgcgttcaactttaaggaccggcagtatattttactttttttctatctaggtataatccgaacgagcccataattagcgtgcatgtaacgttgctatatgggtttctttgagctgaagcgtagtatatgtacgtgatggaattgattagaagccagccaggcaggggagggtcgttaagtagcatcccatgtcaccccctgcccccacacatgtcagagcaacatgcatttgcttccttggttttaattaattcaatttctcgcctcttttcttcctaggtgtacaagtgtacagcccctctctttttgcttatcacaattcagaaggtgtgtgtgtatatatatctctcctacctccagctacttcacttgtcaaatcccaaacacaaacacctagctagcctcctgagctcatcagcttagcttcgcctagctagctagcctgactgcaatcacctgattgatttggttgatttgtgggcgcgcgcgcgcatggcgaaggtacatcctaacgtggtgcccgtggcggcggcggcagggccggccggcggcgaacggcggggggaggaggaggaagaggcggcggcgctgacggtgtggcggaagtcgctgctgttcaactgcaaggggttcacggtgttcgacgccaaggggaacctggcgtaccgcgtcgacagctacgacacggagagcggcgacgaggtcgtcctcatggacgccgccggcgccccggccttcaccgtccgcaggaagaggcagctcagcctgcagggggagcagtggctcgtgttcgccggcgaggcggacggccggcggccgcccgtgtacgcggtcaggcggacgggccgcggcggcggcaagtcgctggcgcgcgtgacgccgtgcgcgggcgcggccgcggccggcgcgtcggcggcgtacgaggtggagggatcgtacgcgcggcggtgctgcgtggtgtacgacggcgagaggcgggcggtggcggaggtccggcccaaggaggcggtcggcactgacgtgttccggcttgttgtgcagcccggcgtcggcgtgtcgctcgccatggccgtcgtggtggcgctcgaccagatgttcgggaggccgtctctcctgaggagctggtcctcgtagacctctcctctcagtttttacttaaatttagtagctagtttctttctgtctgaattttttttgcccctatttcttggggttaatgaatatacatgagtgttcttgattcctacaaatgatcttatttttttttctatatacatggttaacatgaagtcccagatccggccttgtctatggcttttttggcagtagtactaatcaacttgaccaagacctctgtaaagatgttttacaggtgtgtatgtatatatgtacaaaaaaaaaagagaaatatcaagaattaacaatgggcagttattttttccccatacaattcttgggttcttgaaatgtcatcttatccattaacgctacagtgccatgttaatcatctcaacgcgtaaccatcgttcgcgatccatccagggatggggagtttgcgtcgtcttgtagtagccttattagccccagctctgaatgggggaagatggagatgggaatagcgcacttgatgagtcagtgttgtttgcatctgcatgtggactgtcaggatcgtgactccttgtctagctaagctcgggggaccatttgccatgcacatcgccatcctggagaaacgaactcgctgttttttttcagtcttttcgctcgcctatctgaagatttcagttattatgagaagggaaggagagaaagttgctgctgctttggtgcgttccaggtatcggggcgagtcagccccgctaggtaaaaatcccaggtggcaatgtgccagatccaatgcagcctgcaaatgaggtcgtgtgtgtgccgcccttgctttcttttgttctttgcatgtgcttgcgagctgggtcttttgcgtcactgcgtgtgaggcgtctgccaattggttatcatcagtagcatctcaccgttgacagcttacagaaatcagaggttcttgcgaggtctggccgtctggatgaagtactcctagttcatcttcgtctttggagggatgggatcgccagaaaaatggcttgtaacatcgtaaaaagacgagaacgatagtttacactacgttttgttgggctagaacagatgggccatatgtccagcaacacgtcccagccagaatacgtcaaagtttaatcggcatccttaatcgcaataccagaaattttaaacctttagtcacaaaaccggcttaaattagatcttccgagttccgatggtatagctgatagttttggctgacgtagcaagttgattcggtccactttgtaccgactaggtgattacgtggctaaaaaaagtaggtccaacatgccatcctcattctctcctcctcctcctcaacctctttctttccctcctttcctcatcgagtgcaccggccgctgagcctgagtgtttgcagcccccaaacacccaccgccacttctgccttcgagcagacgagcactcgtcgccgtcgtcgtttgcacctcggagcaactgccatccccgctcgtcatcgtcgtagtagcctgcacctcgttttttaaccaaagggcgcataagatttgtagtattgtgggttagggatgtcgattatactcgacgtaaagcataaggacaacaagtaaacttatttccatcccagccaaccagacatgggccgcatggccgacattgctccctaccaggcccaggatgtaccggccggcccaaagtagtagcaaggtaggctggccagagcccaagcgccaaatctgaccgactgccaccgtgccgcccgtgatgaacactggagtacccgtctcatggagagcgagaagaaagtacacagatgtcgatgtgcgagaagaaagcgagagcgccttcgggcgtatcgcacattccaactctaatggtttagcccccaggacgccggggcccgtggcggcgcggccaacacaacaccggagaggagcattcgttcggcgaggagggcttttcccattggaaaatctggagaaacccggcgaaaaatcccgtcgccgctgggaatatctcgatggaatatccaaacccagcgacggaattggactgggaccggactggacggtcacgatggagtctcgtcgctcccacgtgaccgccgccgccgccatcgcggccgtccaataccagcagcggccgtagtaataaaaaaaacaaaattggtggatcccgtcccccgtttgggctttgggatccaccaaatcaagacggagccacctatccgcgccgtcagatctctccatttctctccacgtggcgtcgagaggaccgtccgatggtaacgcgaccatcctaaacaaggtattcgcgtggaccctacacgtcgccgtcgcgctgcttattaatatcgcgccgcccacttcgtcatcctcctcgcgtactccgctctcgaaaaagaaaagaaaggctttcgtctcggtgggcaaaagcgcgagggcaaagcgaaggtaagggcctctctgatcttcctcatcgatggatgcgtcgttggttttgagcgcggtagcttgtttgtggttcggttgttcgccgatcgatcggtagatccgcctgtgcgaatctgatctgaggctcgaaatctgataaaattggcgagatttacagcgttgcttagtgttaattatgctcgattaggccacgagttggttcggattgctaaccctgatattagttgacttaattatgtgtagtttctgtacggatctgaggatttgctgcacctaactgttgtatctgagctttgcgttggtgtgatttggtaggtatagcatctagtaggcgatggcgagctccggtttctcatggacgctgcccgaccaccccaagctccccaaggggaagacggtagccctcgtcgtgcttgacggatggggcgaggccaacgccgacaagtacaactgcatccatgtcgcccagacgcccgtcatggattcgctcaagaatgtatgcttccttgccacatgattatgatttggggtcatgcaattttttctgcctttaatgttgttagtgattgcaaattgcttttcttgttttattttctgtagattaggcatcctgcttgtaactgtttggttatcccattgacaacagacagtttggctaagatgattaagtcgtaggtttagcctggacatatatttaatgaagttgcatccatgattccatgttgtgttgggttgcccttgtgctatgaatttacgcctttgcctgcactctagtttcagcagttaactctattttttttgtacattaaaagggtgctcccgagaggtggagattagtgaaggctcatggaacagctgttggtcttcctagcgaagatgacatgggcaacagcgaagtgggtcacaatgctcttggtgctggtcgcatttttgctcaggggtaagctgttgttgagttttgattcatttgggaactataggttggatcactctgcatgttttgtgacaagcgtgtttcattctcactgtagtgctaagcttgtggaccttgctcttgcctctgggaaaatttatgatggagaggggttcaattacatcaaagaatgttttgacaagggtaccctgcaccttattggtttgttgagtgatggaggcgttcactcccgtcttgatcaagtgcaggtttgttaagctctgatgaatggcgccttatattgcaatgtgttgtttatttactgtcaatttttaaattggtgtgttctgtttcactctatttcagctgcttctgaaaggtgccagtgagaggggagcaaaaagaattcgtgttcacattcttactgatggacgcgatgttttggatggcagcagtgttggttttgtagagacactagagagtgatctttctcagcttcgtgacaagggtattgatgcacggattgcatctggtggtggaaggatgtatgttaccatggaccgctatgaggtaaaatcttcatttagttatacgagttaaaccatcaacttttaatatttaactgtgcagatcgctatttttaagttgtttgatttcattatttctgaatttaataacatgttatatccatgctgaagtttaagtcttaaaaatgcacagaatgactgggatgtggtcaaacgtgggtgggatgcccaggtgcttggcgaagcaccctacaaattccaaaatgcagtcgaagcagtgaaaactctaagagcagagaccaaggctagtgatcagtatttgcctccatttgtgatcgtggatgagagtggcaaatctgttgggcctgttgtagatggtgatgcagttgtgactttcaatttccgagcggatcgtatggttatgcttgccaaagcactagagtatgcagactttgacaaatttgatcgtgttcgtgtaccaaaaatccggtacgctgggatgcttcagtatgatggtgagttgaagcttccgagccattaccttgtctccccaccagagatagagagaacatctggtgaatacttggtaaagaatggcgtccgcaccttcgcttgcaggcaagtacctggcttcccactctctttcctctgatactaaaaatattgactggtgacttagtaatttttgaggtacttaggccataagggagttgattcaaatcctctatactgagttttactttctgtgctaattttggtaccaagtttagcagggatatagtattttttgctttaattgtagtaataaaacaactcatttgatataaaacgactgcttgggtgcagaagaactgagggaattacctctggttgcctattagaccttccatgatgctattcgaccttaattgtggagtttatagttgtctattgtgcttatataaaataatattctgtcttagtccatttgtatttatgctgtaactcattgatttgtttttttacagtgagacagtgaagtttggccatgtcacatttttctggaacggaaaccgatctggatactttgatgaaactaaggaagagtacgttgaaattcctagtgatattggaatcacattcaatgttaaacccaacatgaaggcacttgaaattgcagagaaagccagggatgccattcttagtggaaagtttgatcaggtaggtaattgtttcgtcggtgctcagatgactgtttgcctatataaaatgttgcttaaaatttttattactcttttaggtacgtgtcaacctgccgaatggtgacatggttggtcacactggtgatattgaagccacggtagttgcttgcaaggcagctgacgaagccgttaaggtgagcacaaacaagacaaaatatatgcagacagttatttctgcaagtcgtcatgtaccgtaatggtaatccctcccctcctggaacagattattttggacgcgattgaacaagtcggtggtatttatcttgtcaccgctgatcatggaaatgctgaggatatggtgaaaagaaacaaatctggccagccacttctcgacaagaacggtggtatccagattcttacctcacatactcttcagccggtacgtgcaaatgttcatataatgctatgttttatgttgtgtgtttgttgattactgcgatgcaccttacatattcgccctgtaataccaagtagagtgctttttttttgttgttgttgatttgagtttttaatgcctatataaaacttgcaggtcccggttgctattggaggtcccggtcttcaccctggtgtgaaattccggtctgacattcagacccctgggctcgccaatgttgctgcaaccgtaatgaacttccatggtttcgaggctcctgctgactacgaaccaaccctcattgaagttgtggacaactaaaatagtaaaatcgcggtagcgaagttttgttcctatagtgttgagatgatcaagagtgatcatatcatttaataattgaataatttatgtttgcccgctcgctgctcaaactctactatggagagaaaagagtgtatttgacttgcagttctgctcttatctgtaactagacgttgtcgcgcaggctggcctgacgttttttcatccgctatatgcgataatgcgaggcgtcaaacatgctcttgtccagtatttaaagtttggatcgtgttaaaatcgcgtaatgttatgtgcaatgtgcttggttgcctcgctttgctccaagaaagcagcaaaaccggagctgcatcatttgatgacctttcgcttgtttatgcatcattttgacgcatcgcccatctgtacgcttcgccatcagaattcagaacacaaaacgacatctctgatcccgaagttgtacgcttcgccatcagaattcagaacagacaatgaatctcagattggaatcagatatatatagctcggggggtaagatggcacgctaacagtgacaaaccttccaaaacgatacatatggtaaacagtaaacacccttggagctacaccgatcaggcacgctagtatctccccgatgatgaactacggttgtagctagtatctccccgattatgccacgctaggtgaggattgctgttgcccgaaggaaagcttgactgcctgagcaactatcaatttgaccacacatggacaaggcctagtcggttgccggtgtatatctcctcacgctcttcatcgtagtacagagctgtgatgtcccccagtgcctcggaaggtgtactttggaacttagacaccctttgcttgttaaggttccctgcctttattttggccaagcattttccggttaagatctcactgatatttatggagcaagctgcaaaagaaccaaagtgaagatcatgttatgtggggacaatagatgcatcagcctcaattacctactgcagtaggtctgaaaaggacaaatttcttatcaactgcagcaagtctgaaaagcatacattttacgagcataaaaaataattaaaacgatacagtatataataagtgcatcagtatgtcaaccttttgaggcctcttatattttattgatattcaaagctgatatactcactccgtactcataaaggaagtcgtttaggacaaatttttaagtcaaaccttgggaatataaatcataaataactcttaagttgttgagtttgaaaatgtaaaaattatatgaatagatttgtcttgaaaaatactttcataaaagtatacatatatcacttttcaataaatatttttatagaaacaagaagtcaaagttgtgttttggagaccgtgtcgctgttctaaacgacttcctttatgagtatggagggagtatatcagaatgacaaagaggaatgcaataacaagaaatggcaacaaccaaaaaccagccaaatataagaggcagtagatctatcatcacttcactaataaataaacacacgggcaacacaagtttgattattaccattttcttctgaagaaggatcatttggatcagccttgcagtaagaaataataagatcttggttgctggtgatgtaaatactgttggtattgcaatcagggtgccacaacatatggtcctcaaaagatgtgactaattcaccacggaaattccaaacggatactgatctactacggaaggtcaggaacagctgcatctcatacagaaagataaacgcagaaggagtcacaaattcacttctgcttacttcaattgattggaagtttcttacctgcagcattgcacaaaaattaactacaattctacaaataaagagaggaaactgtgttgtttcatttgctgttatccataatctataccaagaaaaaaacttacatcaagaatttgaaggttctccccttcctgtttgatcagaagtttttcattgaattgctcaatgaaatcaacttttttattgcgatgaagaaggtgtttgaatgacttcaagcgtttaccatcttcaatagaaagaatgtcaaggggaatacagcccttttttcttgagtatatcaatagcattatgccagggctgttggaaggtagcaataagcaaaaaggtataaatttggaagctcgaaaatggaaatgacctccataagttacacatacaaaaatttcaatcaatccagccacatctcacttgacaaaaagcaatcaattcaccatatataggaggtcaccaagaataaacccatgatagctcaattggcaatagtatttctatgctctccacaaagctaaattacataaatgttcaatcagtaaagttgtcggtttagtaatcaacagttgccaatcaggccgaaaggtttgttttgaaagtatgctattcagcttttgcattttagcagaacttctgttcacctatagggaagcatttcacaaagtgcattgaagaaaagcctatgaactgctcaccattagtttcccatcaaacacaggcaaggtgtatagaaaacatgcagctctcctaaccattgaccaaatatattcgaagttttgggggcatagcacttcaaatcaatttttttaaaaaaatctcttccaatgaataaaaaggcaaagcataatttaggttgtacaaatgtgaaacttaatcatgatcagcaagcaagaaagattcccttacctgatctttatttcttgaacattcttatcagatattgtatacaacaaagtgtagtttttcaagtcaaacaccttgtaagtactggttggaatgagaaaggaatgtcacaattcgaatgaggttaatcttctcgccttcaaagaaattagagctagaatacctgtcttgggcagaataagtcagcaccttcccgttaacatcatcaaattccacaaaacctggccatttcaaggactctgtctcgaaaagagggaaaccagcatctggcttcccccgtcgtatataccttaaaagacaaaataataaaaagattcatataaacaatataacactaccgtagcagaatcacaggaagacaagcttactctattcgagttgtcctgcatcttaaggcactgaagttttcagaaccataaactgatacagtaatgagtgagtcattgttcttgttgtaaaacaaactgcgaatgacttcatctggtcttccattcagaaagcaaatccgctggtttgagactaaaacaaatacatctcagaattcaatggtaatttataacatcagtacatgaccaatcattatcgaaagttgtacctctgctgaatgcagcacatactcctgactgtgataaagcaaagatgatatcactggctccaactatctcaataatctcagaccttttcatcaagtaaggtagtagtgaacccatctccttgggatcatgagtatcaaactcttcctaattgtaagtgaaaagaatttgaagatgtgttataatcgtaaaaagaacaggtcatgctaactaaaagttagaaacaaaattttggtgaagatcggctgttctatgatatgaagggcactgaagtttcaaccttttccaaccgagttatgctccagagtatacttttatcacagtaaataccaaagagagcgaccacatctcaaaatatagcaccaaacacacctttcccctcttcctatcatcgtccataatgctaaaacagctgtactaatccagggattccgatatccgatggagaaactctccgcaaacagccaaagctatcaccatcattggggaatatttacgcctcgtgaattctttgaccgtaggcgaaagttcctcctcacaacacccacactacctatatgctctcgggctccaactcttcccgcaattgattcattcaaataatcattttttaaaaaaacaattatcctctctccaagccctaacctaccgacccactcctgccctctacgccatatcgatccagacctaaatgctgggagacagggtgtggggaggggggacgcgccgagcgggccggctgacctggagctggatgttgcggaaccgctcccgcgtggtgctcgcggagaacgcgcggcacggcagcgcggagatctcccgccgttgcagcttccgcgcgctgttcgccgtcgcctcgggcctccgccgcttccgcgcgagcaccctccgcacgcaggacggccgagggttcgcggagacccgcttggcttcaatccttggcggccccggcccccggcccaaccccacttggccgccgacgagcaaggttcagacgcgggtgggcatctcgccggaaatcgaatgggggttagggttcgaggcctcggctcgcgcggagtcgagctggcgcctcctcggtctcgtgctacactgtggttgccatcgaagtggagtagtaggtgtgcttcttttaatttggagtacagtgaaaccgagagcctaaatggaaaattaccttcgccgtacaatgtccgtccgacggtatggattccataccatggaagggctttttcgatgggtgagataaataaaatgaaatgtaaggtctttttccgaaaactcgtgtcatgcctcgatcttagccgcatatcgttcgtctgacggacaatgttagccatcaggaatacttgcaagttgaaggaatagaaaccttttgcactgttgaacatctttgtagaataagcgaaacgacatatttataaatgaaaaataatttgtgaataaaatttttataaatgtgtttttaacgatctaaaggcaaaggctgaaaaataaacttcgatggaaaaaacctcaaaatcaccttcaaatttaaggatggaaatttaaattttgactgataagtataagcataaacgaaaagatgaggtccttcttaacttgccatgtaaatgatgtagccttatatctaactcaggcctacctggaggaggttagcagttgtaacttattacaaaatcttcagctcttaaacaatgcataatatcatccatattccaaagaatcaaaagctaaagaatctataaaacaaactagaagctagaaaccggaaaaccaatttctctatattctaataatctggttaccgaccggttgattatcagctctccaaatatagcctcatttagatgatttgtgtttggattctgttgttttgtggactaacctactagagaagattagttccttttaaaacaaaaggcttaccgcgagaaggatcttaaatgtaaattttttgtttgcttttatacaattatcgttgcttttaatcaatataaatattaatactcattttatacactaaataattttaaatgacaaaaattataaacaacaaagttttagatctcatttagatctacagcttttatataaaacttgtcttcatcaaaggtcatttgaagtatatatttgagattttctaaaacaaactttagattttataacgaatatttggactctaaacgatcttaaatgaaaaagttgtgaaccacaaagctgtagatatcctcaactatgcaattttgatataaattttaatttcatccgatttcatatgacctattttcaaattatagaaatacaagttaacaacatatgcggtaaattttacatttaagccacttgccgctcttctagagggcgatttttttttagaaaaaatgccctcccaaagggcgggaagggtacagatctgtaattttgtaaacacaaaattatttttgtaaatattgtttaataaaaaattcaatgcgtcttcagtagtcattgaggctgaaggccttattgctttcagagtccacaaaatgggaccttcctgccaattggacttaaaagggccaataagatccaaacacatcgaaggcctaacaatttgctgggctttgactggaccttggaggaggctggaggcctggggcctacctacttataggctagcacaaaaggggttaatattcaatagagcaaatcctatttgtcaaaagttcacttaacttcagtattgctaccagtacagtcacagtaaccctctgaatctttgatagagaaaaaaaaagagagcgacaattctcatgttgtttacatcatataattaccaccacaaaaaattttcacattccttcaacgccacgtactacgtctgatttggtggtgcaagcttaaaatgctttaatcctgcctaagtcctaaccaaccgtgctgaccacagactctatattttactttactgcttattaatcctgctttattagcagtatattttactcaacaaacacagcatttacctagcccggttcatcgtcggcagccttcaaccagcccggttgtaacttacaaaagcttcgataggtgtactgttttctggagggatcgataattcgatgtagctccaggacaaattacgagacagtgatggcatttttgctacagacaacactgcagctgcacagagcttagttgcaaatcctcctatgccacagcgcacattttgtaagtatatagattaggtatacagttaacgatttctaaggctaagaacggtaggtagagtgcaggtggaacataaatttttttttccaaaagacttttagccttttttctatgaacatatatagtctctttttggaatggatcgaggtagtaagctatataaatggtgataaatctgaataatttctactgctaatagttagctgcttgatgtctgactgataaccaggtcactgcaaatttcccatttcgttgactgaaacagcgaaaaagttccagtaaccaaattgccattttcttcgaaaggccagttagatgaattgacccctggacgcctcaagtgccaatttagaagctgctactgctgaactaagctaaactctctgcgagattgcacaagctacgtacctaaaccactacttcttaggaaacagtaatccaaagtccttttctaggatcacctaactaacctctttaatttgtactacttcgtcagcgttactaaactctcttgcatgtcaaaattaaattaaagtagctacctggatcaggatgctagaagcctacaacagtcaatgttactagagatacttattactacatgctgctttcgttgatctccttgtgtcaatgttactgactcccaggtgtcaaagtacatcatccatctcaaaataagttaacattgtactaggacaacaaatctagacatactctatatccagatctattatattaagatgtagtatcacattctactacgatgggtgtgtttagttcacgctaaaattaaaagtttggttgaaattggaatgatgtgacggaaaagttgaaagtttgtgtgtgtacaaaagttttgatgtgatgaaaaagttaaaagtttaaagaaaaaatttggaactaaactcgatcgatgttggtttatttttggaccgagagagtacatgtcaaagtttctttttctgatctttttggccaagtgtaagaagttgctagctgcaggatcaggatgctactactcggcgccggatgcgcgtgcatcgcatggttaaaactgcgcgtgagagttggttaagacgcggccagctaaaaccagaactcggtggagcttaataattggccatacctgatgaccacctgtgagagtcttgatctttttcatacctcctgtatcgatcgagaagatgacaactttttttaaggcgatatgctgctgatttgggtgactaactgactatctgtccgtcttcccgaaggctgtactgtgtcgcacttgttcttaattcagcttgcctgacgactgtgtttgacaggtagactaatatgcaagatattacattgttttctttatatataacaaacgatgctagtttcttattctatacatacgcttctctaaaaaaagatcaaatatctttaagtttgtaatatttacaaaaattccagccaaaccgctggttggtctttattggtatactctctccgtataaagaaaatcgtttaggacagcgacacggtctccaaaacacaactttaacttcttgtttctataaaaaatatttattaaaaaatgatatatgtatacttttatgaaattattttttaagacaaatctattcatataatttttacattttcaaactcaataacttgagagttattcatgatttatattcccaaggtttgacttaaacattgttctaaacgaattcctttataagtacggaggaagtatatagcaagaataatcatggtatcatagcataacaatttgctattgggatagtataattttcattggtatagcatgaatcatgcttgcatatggcatggcataaacaatctccttttgggagcttgggatagaatagttaactacaccctcccgaagcaatttcttatttttgacccccctctttaagcaaccgaggtgaatcgttcctttcctggcgctttcgttgcggcgacggcgacatcttttgccatcttggaccttcgtcacagccatgcatccctttcagcgaagaaaatataaagacattctcacgatctgctcgagccggcttgggggagccaggtagtttaattatagccaaaccgcctgtacgcgcgtcccgttctcgtagctgcgccctatgctgtgatgatctgtgctacgtatacttgttactatgttatatatacgacgattgctttcgctaaattgtgccacctaattacacttaaggtttttttattgaaaccaatttataacctgccaaaattttaatagctgtaatagtattgtttgtatatttggggcatgtttaaattgtagccaaaataaatctcaccaacttttgacaatgctaaaattttagcaagatggcaatactaccaaaattttgacaggatttcttatgtattgactaaatttgagaacaaactaaacgtatactttttttttggtaactttacccaaaaatagtatggttgaaaataacatcaaagtgaacagacccttggtttaatgccaaattttacccatagtatatacacaaatctactaatgttttgtttcggcattatcaatattttagtatgacaagatgtaggcttcaaacgaaactaagcgttaatacctgtgatatgtatatccttgttatatatagtcaattaattttgctaaattgtgccacctagctacacttattgctagagatcctctagagtattacacactggtatatggttctgagggtttgtgggaaaatgcttcatgtcgtgcgtctgatcggaagacaaacatcgaacaccaactttctcctttgtactagtctcctctggacttggtttgattcaccttttccataactctaactttacatctgcacaattccttttctctctcaatgtctccttcttgcatgtagctagcatctattttgtttcttatagtctatgagtatatacatgcacgaagttctagttgtaagctttaaatgaatttttcttgaaaactatttatccaatttactatccgattgcacagttgtattcgttgcaattaaatctctataacaagatatcacatgattatattccgattaaaacatacatatgtttcaaccgataaacttggatgtttcacgtgtaagaaataaatgttttaatcagagtttggctatgttgcacattttaagttttatgttgccatgaatcttacaaaatgttccatgccatttgaagtttcaataaatatttttctgatgtttcactagtttatttgtgaatattgcacgttatattattggatatttcagtaagtattttctaatgtttcactaattcgtttataaatgtttgcacatgttgtttgggatgttgcaatgaatattttctaatgtttcgataattataactcgttgtttcacgtataatatataaatgtttcaattagtaatataatcatatttataaattttatcagaaatataaccaagtgagatcttattgtaaagatttaattataacgaacacaatgggtgaaatcggatggtagatcggataagtaatttagaagaaaaaatagtttaaagctctattggtagagaagatgaagagagagatttcatgcatgcatgcacgagagtagggtatagccttgcatcatagtagcttaactaggatggtttttttttacgcagttagacatgtgggtgaacaatgtccaatcttttgctaaatatcggacgtccgatatgtagcagtatccgagtttgtgggggctcagatataagtgagcagatgacccctgcatcccatatatctttatatactactccctccgtctcataataagtacagttttgcattattcacgttcaacatttgatcattcgtcttatttgaaaatttttttataattagtatttttattggtattagatgataaaatatgaatagtactttatgtgtgactaatttttttttattttttcataaaattttcaaataagacggacggtcaaatgttggacacggatatccacggctgttcttattttaggacggagttagtaatattaggttggatagttttagagaaaaccttataaaaaattagatagcaagatggctcgagttccataaatccgtacgaatggagaaaacaaccaactatctcatcaccatttaccaaaaattaccaatcgcgcgctatagtcaactggaacataactttgagattttattgctttgggtgtgtttagttcacactaaaattagaagtttgattgaaattagaacgatgtaacagaaaagttggtagtttgtgtgtgtaggaaagttttaatgtgatggaaaagttggaagtttgaataaaaagttgggaactaaaccatgcctttgtatagtgacgttgtcggagacactcacgcgcatactccaccgtctaaaaaaataaatataaaattggatgtgacatatcttaataaagtaaatctgaacaacgatctttccagatttactgtactacaatattctcatctaattctaagtttatttttttaaggacaaagaaagtatatatgtaggctatcagccattggccaagatccaatggcgatcctaggtacattttcccagtgtcctcggactcggaccctaggtaaattattcaattctaattaaattatatgatgataactattatataagtaaaaattagataattagtacgcattaaacccccggtaatttttttctgggttcgccactgtcaagatcggattcggacggagtagtagcagtgcatgtgaatggatgcaaatcagacagtctagatttacggagcgtaattactgtagcatttgatataaaccgtttatcatgcaaacggatggttaaaattgtgttcgtatcttgcatgtacaggtataactgcacctgatctcaatccgtagaatcctatgttcaggtactgacgtgataggtgaaaaatcaatcagtattacgaccatttagttcccatcaactatcccaatcaaaacgggaatctggattagtaattagtactacccccgtttgttcccattgcgatggcttagtcagaaataaaattattgtgatggctgcagcacgatcgatcgagacccaagagacccccaatcgttgttctcacaccgtcacacgttagcacatcgatataattcacagtgaacttaattcggcaggaagagaacttgacgagcgttcgctagatgaaggtgaaagcgaccagccgcttgttcacagtcaccacaccagaagcctcttttgattttctcggttttgtgcaagggagccttggaagaaaggatggtggcgggagaagcattcctgcgaagcttccctctcttttttttcctctccttttcctctggggtaattatattttcaactgcaattatacttttacacctaattttctaattatgtgtctttgtcctttctttttaaaattgaagctccgatttacccctacttcaaaattctgtgagatagacctaaattaagtgaggtaaagaaaaagaaagaaatatgactgaaaaacacaaaaggacctatctaccccccaaggcacttcgtccacccaccatgtgttgactcgcgctaccctgcatttttctaattttgttttcatttctccttttcttttcctgataatatgttcagcaatagcattaagtggtaattgtagatccatcaactcttgttctttataacgtgacaaggaatttaaaaagttaaagagaaaatgagtttcatttagatgaaaccatgcctatattgtttcccatacaatttatctctttcatgtattgtctataaaacaagaaaaataaaaccacattttgaaacataaaaacgataccacccattggaaatggccttatgcgattgtccttgctcaggattttgatcgaacaatcaaaggttattatttggaaacacattacattatttgcatttaaaatataaatatatcacattcctggaagaggtaagaaaataaggtgacaactttaagatggatatgtagtggtttttataatacgaagtagatcaagtggtaaaaaaagaatgtacttttatagaaaaaaaccaattcaaacaatccaagaacaacgatttccttttagattcggctaaaatggaaaaatgttgggtctatttgctaggattggtgcaaagtgtaatctacggaaacggaaactagtacttcagtcgatactactccctccttctctaaatgtttaacactattgactttttttaaacatgtttgaccattcgtcttattcaaaaacttttgtaaaatgtgtaaaactatatgtatacataaaagtatatttaacaataaatcaaatgataggaaaagaattaataattacttaaattttttgaataagacgaacggtcaaacattttttaaaaagtcaacggcatcaaacattttgggatggagggagtactctagctaggcagactctagctcatcaagatctctcttcctattgtcatttattttccaccacgtacaattttcttactgtgccatatttcctcgtctgtccagatagaaacaactaatttatcatttgcttccgttctttgtccaaaatatctttgacttctgcttctacttgttccacggttattgcccacggattctgacagaaatgtaagtgtaaaacagaggattgcaaaacataggaataacgtaggaatgaccgtttgattggaccacaggaaaaatataggaatttgaggagagataaagacttaaaaggattttttctatgaggttctacctcttgttaaaattcctccaaaacttgtatgggaaaaggcattccataggaattttataggattccatagggttcattcctttaattcaaagggctttgtaggaaaaattcctataggaatgaaatcctctaaaattcctatgaatttcctttgaatcaaaaggggcctaattgtcaaagtgccatattaatcactctctctgatcttaaatgctcatgttatcatcgggtactattcaaacctctaatttattttaagaacttcaaaatgtagctaattagctaattttatgaagtgggcgtagctcaactgattagatttctcgagatggaatcaaaccatctgatttaagtcctatacttaaacatgagtgttcgcatttacggctaattattcttttggtggtaaatgacgtacccgtgtgacggagctcgtagctcctcaccgggagaccgcgcaggcccccctttgccagttcggccgggggcttagggtgaaatctcaagctctctcggtgtgtggaaagatcatctgcccgcaagaaaacgcgagacaccggcgatgtatacaggttcgggccgctgagaagcgtaataccctactcctgtgttttggtgtatctgtggatgaaagagctacaaagtgtgagccggcttccccccccgttctaggctctcaatccggaaaagaatcaaccaaccccccactctaagggcaaggtcctccttttatacttcaaggggataccacatgcacccttctctttccaaactggactgttctttttctctttaatgggcggagatcggtatggcttccatccgggagcccttctgatgggacagcccacacctacctccactcccggcggagacaggcgcaacgtgggatcgtggctgcccgttgctgatgcgaccagtgtcagaccggtcattcttgtccaccacgtgtcagtttaacaacgtgcatgtttgcccttcttcgtgtaacaccttgcctgtaatggttaggatgaagcctggtataaatctgaccagggctaacgtgccatcttttaagagataacacgctagctccggcttgagacgagtgcctagaggctttcgtcttgacgggatggggcaaggcgtgcgtcagaccgccagtcgccacctaacccgtgatctgaccggtctgtgactggtcacagaccggataaaggaatgcgctgtgctgcgttgcatgcagcgtgacacgcttgaccagactgcaataaatgctgttaggtgagcacagctgtgctcacttatcccatatatgtggcgcagacttccttaaggggtcggggtgcctcggccctcggggccggggcaagcgcaacccgaccccccctcgggggaaatcaagaggagggcggacacctcaccctcgggcccgacgcccccgaaggtgccaggccacgtgggcgattatgtctgcctcaagcctctggtcatgatactcccggtcccatatcaccgacagtagcccccggcgttatgccagagcaatttcctttcccaagggaagcggtcaggtgtgacgccacccctaaagcctggtgacaggtgggaccggtctccgtagttgggcaaaatacccaacggtctcaatccatgcacatcggtattggtaactttggttgtccataatgggcggtctattcaagactgccacaccacttgagcagcgcgcgaatctgggtgagcagatttatctcgcccggagatacggtaacgccgcttcggtcggcaagcgggcctctggaaaggccagacgacggtgccccccaccaacctggaaggcctcgctccgcacctcaacaggatggcctgggttctcgaacaactccccgaggagcttgagaagaccatcaagtcatcctcgagggacctcgcgcggggagcggtcgaactcgtgctggcgagttaccaggcccgggaccccaacttctctccatggatggcgctggaggagttccctcccgggaccgaggacgacgcgcgcgcgcgcgtccgggatgccgccgaccacatcgtcaacggcttcgagggctcggcccctcggctcgcgttcgcccccgactccgacgaggaggggaacgccggcagtgcaagcgatggtggcaacgaggccggcgactcgggcgcgtcgggatgagcccccgagcccccgccaatctttacttttttctttttctttcttctaaggccttcatgcctcttttgtgtacaaattaacttaatctgcaatcagaaatgacgaaaaaatttttgtgttagttttattttgctatatatacacgatgaggatgatctgcgccatggtccttttgcgccttagcttgaaataagggctcgtgcccaagtcccagtcctcgaatggctcgggtcggggctagtgcctggggagatccacatgtcgagactggccaggccgggaacgtggtgaccgaggggtatgggtgacccgattgtgggtttttgccgattcccccccggagttcaccacgccccggggcacggctcggttctgggccccgtttggcgattttagctgaccgaaccgaaccccccgagggcaaggttgaatacgagtgaccttattttaagttaagattcttcagaaggaaaaacggcacagacacaacctctttgaaactgcttttattgaaatgctgaaataagaaaagtaagactgtgcatgtgtggtagcccccggctaaccctgcacacccgaggggggtgcggggttagcccgagcccgaaacctgacacccgacccccccttcccctcaggggtagaagcgacgaaggtgttcgatgttccacgggttcggcagttcagtgccgtcgcccgtggccagccgtacggagcccggccgggggacgccgatcactcgatacggaccctcccacattggtgagagtttgctcaatccagcacgcgtttggacgcggcgtaagacgaggtcgtcgacgcagagtgatcgggcccggacgtggcgctgatggtagcgccgcaagctctgctggtagcgcgcggctcggagggccgcgcgccgccttcgttcttctaaatagtcgaggtcatctctgtgaagctgatcttgatcagcctcgcagtacatggtggcccgaggagacctcagggtgagctcggatgggagaaccgcttctgcgccgtagacgaggaagaaaggcgtttccccggtcgctcggcttggtgtggttcggtttgcccagagcaccgctggcaactcctcgatccatgaatcgccgtgcttcttgagaatattgaaggtcttggttttaaggcctttgaggatttctgcattggcgcgctccacttggccattgcttctggggtgagcaggtgaggcgaagcagagcttgatgcccatgtcttcgcagtagtcgccgaagagttcactagtgaattgggtgccattatccgtaataatacggttaggcactccaaaacgggccgtgatgcccttaatgaatttaagagcagagtgcttatcgatcttgacaaccggataagcctcgggccacttagtgaacttgtcgatcgcaacatacagatactcaaacccgcccggggcccgtttgaacggtcccaggatatcaagcccccagacagcaaatggccatgacagtggtatgatctgcagggcctgggccggctgatggatttgcttggcgtggaactgacacgctctgcatcgccggaccagatcgactgcatcattgagagctgtcggccaataaaatccttgacgaaaggccttgccaaccagggtgcgcgaggcggaatgggctccgcactcgccctcatggatgtcagcaagaagctcaacgccttgttcctgaggaatgcacttcaggagaattccgttagccgcgcgccgatagagggtcccttctaccaacacgtagcgtttggaaatgcgttgtacgcgttcactcccttcgcggtcctcaggtagagtcttatctgtgaggtatgtttggatctcagagatccaagcaatcaatctaagggagcttgaagcgctcccttcgggtcccgaggcctggactccgacgggcctcgggggccggtcaggcgcatccgtctcccctaagggatcgggtcgcgccgacggctgggtaagcctttcttcaaaggcgcccggtggggtctgggctcgcgaggacgcgagccttgagagttcatcggcaactatgttatcccttctgggtacatgccgaagttctatcccatcgaaatggcgttccatacgccgcacttggcgtacgtaggcgtccatctgtgggtcagagcaccggtactccttacagacctggttaacgactagttgggagtcgcctaataccaagaggcggcggatccccagtccagctgccactctgagtccggcaaggagtccctcgtattctgccatattgttagtcgctcgaaagtcgagacggaccaagtatctgaggacgtctccgttcggagaggtcaacgtgacccctgcaccggcgccctggaaagacagagaaccgtcgaactgcatcacccagtgggcggtgtgaagcagctgagaggggttcgtgctggcctcggttattgagacggtctctggagccggggtccactctgccacaaaatcggcgagggcctggctcttgatagcgtggcgtggttcaaagtgcagatcgaactcagaaagctcgattgcccattttaccactcgtcctgtaccctctcgattatgcaagatttgaccgagggggtaagacgtaaccacagtgacccgatgcgcctggaaataatggcgcagtttcctcgaggccatcagaatagcgtaaagcatcttctgggcctgtgggtatcgggtcttggcgtcccggagggcctcactaacaaagtagacaggccgctgcacctttcggcggggccgatcctcttcgctaggggccgtacccccggggcgttcttcgtccaagtggcccctcgggtcgcactcgtcttctgtgccgatgacctcggggtcggaggacgacaggagcggccttcccacagtggcctcggggccgtcctgggggttgggggctcctggcatcgtcggacaagcgggcaaagggccaactccggtcgtcaggggcctctggcctccgttcggctcgggggcctcttctccctgctctttcccgggtcgaatcagcacagggctagcctcagggtcaaagggtggtaggtgcggccttcccgcagtggcctcggggccttcctgagggtcgggggcatccagcaccgtctgacaagcgggcagagggccgactccggtcgtcgggggccttaggccaccgttcgactcgggggcctctcctccctgcctgctcccgggccaagtcggcacagagtgggggtgcgcagaatgaggattgtcctcatcgcgctccacaaccaacgctgcactaactacttggggggtcgccgctaagtaaagtagcaggggctcatttggctccggggcgactagaactggaggagagctgagatacgccttcaactgggcgagggcattttcagcttcctccgtccgagtaaacggccccgagcgcttgaggagcttaaataagggtagcgccttctctcccagcctcgatttaaaacgacttagggcggccatgcaaccagtgacgcactgcacatccctaagtttgctgggggggcgcatccgctctatagctcgtatcttctcggggttggcctcaatgcctcgggcagagaccaagaacccgagaagcttgcccgcaggcacaccaaacacgcacttatcggggttcagttttatgcgggcggagcggagattttcaaaagtttccgctagatctgagagtaaggtctcttggctgcgcgtttttacaaccaagtcatcgacatacgcctcaacattacgtcctatttggctacccaaagaaattcgagtagtacgctgaaaagtaggacctgcattctttaacccaaagggcattgatgtataacaataggttcctacgggggtaatgaacgcagttttttcctcatcctccctagccatgcgaatctgatggtaaccagagtatgcgtctagaaaacacaaaaggtcgcaccccgcagtggagtcgacaatctgatctatgcgaggcagggggtaaggatccttaggacatgccttgttaaggtcggtgtagtcgatgcacatccgaagcttgccgttcgccttgggaacgaccaccgggttcgccagccactccggatggatgacttcacggatgaatccggcctccagaagtcttgccacctcctcgcggatgaaggcttgacgttccggggcctgccgccgcactttctgccggaccggccttgcgcccggccgcacggcgagacggtgctcaatcacctccctggggaccccgggcatgtccgctggtctccatgcaaagacgtcagcgtttgcccgcaggaaggagacgagcgcgtcttcctatttgccatccagaagaccaccgatccgtgtggtcttggacgggccgtcgcccaaggcaacctccttgaccgggacctcgtcgcatgtggcaatccgctgcctcggggcggtgggggcagaagggccaagcctctcgtcaccaccctcgggcttggacgctgcagcgaggcggtcggcgcgctgctccatgcaagcaagcgcgactttaagatcgccatggacagagatggggccaccggggcccggcatcttcatctggaggtaggcgtagtggaccgccgccatgaacttcaccaacgcgggcctccctaggaccgcgttgtagggcagaccgaggtccgccacatcgaagctcacccgctccgtgcggaagttggcgggtccaccgaaggtgaccggtaggtcgatgtgacctaatggccacgtgtgccccggcgtcacaccgataatcggctgggacggttggagcaccatccccggggccttgatagcatcaaaggccgcgggggaaaggatgttgagagccgctcctccatctatgaggacacgccccaacttcacattgcagatggtgggagaaaccaccatcgcaatctgccctccccgggcaacacacggtgggtggtcggtctggtcgaaagtgagagcaacctccgaccaccgcgcccgacgcatcgcctcatgagtaggggccatggccagaagctctcgcttcatagccttgaagctccggcgagagacgtgagcacatgctcctccatcgacggtggcaatggtggccccaggttcttggaaacctaggtcatcatcgccgtcatcgatgtcaacagcgggggccttctgcttggcctcacttcgccgtttgccagaaggaaccgccggggacttgccctcacggcgttcctgcctcctgtcctcctcccacttcctcgttcgctcagccaggtttttgactgcacgacagtccgcgagatcgtggagggaggtgttgtggacggagcaccacctgccggcggggcgctccctactgggagtaccagcctctttctttttgtcgctcgcaggcctcccctttcgagtggcccgcggagcgccctcgacggcgaggacatggccctcgtcgccggaacggtccgacctcttcttcctcctcctgtcacgccgccctgtctgagcggcggatccgggggcggccgaagctgccactccggaaccggaggagttccatgtccacgcttcctccttacgagccactcggtccgcgagctgaaaaagctccgcggtagtctggggctctttggaagcgatcttttcgagcatgcggttgtgccgcacgccccccctgaacgcgtagatcaccgcgtgtgcagggatgcatggtatagtattgcggacttggcaaaaccgctgaatgtacgagcgaagcgactcatcatcgcctcgctgtactgcatgcaagtccgcttcttcgcctgggcgcggatatgtgccttggaagttcatggtgaactgttggcacaaatcttcccaggagtggaccgacgcgggtggcaggttcattagccaaacccgcgcctgtccttttagggccatgggaaagaagttcgccatgaccctgtcgtcacccccagcggcctcgatcccggtcgtatagacctggagaaactcggtggggttgacgctcccatcgtacttctcggtgatggtgggccggaaccttgggggccaacggacattccgaagactcgccacaaaggctctacagccaacaccaccggccgggggcacggagggctgatcctcacgtccatgtcgaggtgacactctggacgaagaggcgccctccgttgcgcggggagtacgccggttattacgccggcgctcgatgtcgatgcgggcatccggctctccacgctgatcctcccgagttggaggtgtcgacgagggagtggcggccgaatggcgcgcagcagccgccgctcgccgtgccctccgccttgacgacacggagccggtggtagcggcgccggaggtcttggtggtggcggaccgtccaccagcacccaggcgctgctgtgccgtcatgaccaagttggccacgtcttccagccatcgttgggctggagactccgggtcatggacgacaggcgggtgtcgtaggagcgcgccagcagcctgaagcgcaccctgaggcgtgctgccgtcgccgtagacgaagaggcgacgctccccatctcgccgttctcctgcatcacctgcgactggtgatgccacggaattgtcgaccctctcaagcgcctccccctgctttgggctttggcccggaggaggtgggggagtacaagctcgacggcggggattcggctccccgtcgtcgccgctcacactcgaggagaggtcgtgcgcttttccttgctcggccattaggctgaacaagaaaaacttggcgcacacggaagagtctgagagctcagaaaacacacactgagtcccctacctggcgcgccagatgacggagctcgtagctcctcaccgggagaccgcgcaggcccccctttgccagttcggccgggggcttagggtgaaatctcaagctctctcggtgtgtggaaagatcatctgcccgcaagaaaacgcgagacaccggcgatgtatacaggttcgggccgctgagaagcgtaataccctactcctgtgttttggtgtatctgtggatgaaaaagctacaaagtgtgagccggcttccccccccgttctaggctctcaatccggaaaagaatcaaccaaccccccactctaaggcaaggttctccttttatacttcaaggggataccacatgcacccgtttcttttctaactggactggtttttttctctttaatgggcggagatcggtatggcttccatccgggagcccttttgatgggacaggccacacctacctccacttccggcggagacaggcgcaacgtgggatgtggtgcaagttgctgatgcgaccagtgtcagaccggtcatttttgtccacacgtgtcagtttaacaacggcaagtttgccctttttagtgtaacaccttgcctgccatggttaggatgaag

SEQ ID NO: 62488 - DNA, 510 bp, Oryza sativa
tgccaccgccgccaccaggcccaccaccaccatcaacaccacccaccacgacggcgtggatctggtggtggacaacctcgagctcttctctggtgacgcggatccggcggttggccggcggctacaaggggaaatcgacagtcgatggccggcggcgcggtggagttgatgtctctcccctcctcccttcaccgatgttgacgccggcgtgcctaaggtcgtcgccccgcggccctgcacctctctgctccagcgacgggagctccgactccaatggcggggataggagctccgactttggtgtggaaaggtgatgatgaggatggcgacttgacggggaggatggcgacgtgagataggaggacaaaaaaagtgacaggagtggcatggttccaattttataaattttcaatggcacccagctaataatgtgaagagtagtggcatattttcaataaggcatatttacgatgggcatggatccaattaaccctaaaatataagggattt

SEQ ID NO: 62489 - DNA, 934 bp, Oryza sativa
tattttccttaaaagaaaaattgactgatgctttttttaagggtacaagggaaacgtacacagcaccattactataatatcgaagtattgattaaaatatgtttggtttctagcctatcaaaatacggcactgaaaatatgtctatattatcaaattttgataaaattagaagcaccaacaatatgatctcataataaaatctagggccactagagaaaataccttgcactcagcgaataaagcctgtgcgggtcgccgcacagtggcagtgctaactggccacttcgatctcagcttgactgaaactccccccgaatacagaaatgtatgggtacgccatcgactcaatgcaatagagtgatactcggggagtagtattaagaaatgcttcatcgtggttatatgtgtgctaagagaaaacccaacgaaatgagtgcttggagcatacaaccaaccaatcatgtctgttaggtaatgtctagtgtagatgaaactaagattatcacatcataccatgccacatatggtttataatatcttctctctctccttaggctacattaggcgtgatctcataataaaatctagggccactagagaaaataccttgcactcagcgaataaagcctgtgcgggtcgccgcacagtggcagtgctaactggccacttcgatctcagcttgactgaaactccccccaaatacagaaatgtatgggtacgccatcgactcaatgcaatagagtgatactcggggagtagtattaagaaatgcttcatcgtggttatatgtgtgctaagagaaaacccaacgaaatgagtgcttggagcatacaaccaaccaatcatgtctgttaggtaatgtctagtgtagatgaaactaagattatcacatcataccatgccacatatggtttataatatcttctctctcct

SEQ ID NO: 62490 - DNA, 4850 bp, Oryza sativa
cgaaggcatatacaattggagtgtgctatcatctcttaattatagcctgaacacttcggtgggttcactgaagcttaatttagaaagtataaataaaaatgagctgctaagcagagaatgatgctacggaaatatataggggggaagcaatcctagttaggttacctttcaagcaatgtgacttccaattggagttgagtagttctttcctttccttcttccaggggcatcgaaatgcgcagtttatattcactgtctaccatcttctctcttatttccttgtcctataaaataggatataaaagcaacatattaaataataaaagggaaaaccacttgcagtttcaaatagttcaacataaccttaccctttttgcagcacattgtcggtaaaacacaatttcatcttggcaaaaaggctcgatgtcattgatttgcaggcctgtgccgtataatatttttgcaataatacttccacacacagagaaagagaaacacgattttaaatgtcacagaaacagttaactcacataagaaaagattcctgagtataccatcacagggctcaacaccttgaaggacatgcgaggcaatttcttttggtatggcaggggatggtggctcacgcatgagatcatcaccagtgagaatggtctcttccattgtttcctgtttatcgactattgggaaacagatatgaaacaatagcatcacgggcacaagcagaagccatacatgatcacaaagttagaatctaaggctggattctcttatctattacgtatgaatacacagcatattgggagattagttatgattgtaatgtcatgtaggtaagtagtatcttgcagatgctttattggttatgcagctagaagaggatttttaccagcattccaccaaacttgatatcatttacatgaatggaggggaaatagagcaaagacaccaactgagctaatcaacaaatctcgggtatcattgtgtgcagcaaatcagcacaacttccagaagttgaaagcccaatggaagattatactagagagaaaaaacttaagaggcacctgagaaaaagatactatacgatgagactgcaatactgaacatgtccggactgactctataagggctttgttcaccgtattttgattacatcctttcttacaatacaaagataacaacacaaattttattaaagttaccatcatattctgtaggatgatatggagttcatttttcaagacaagaaatggactggagagcttagtccttattgtcctccaaacccatataattggcaatctactcaggatgacaatgctgacaataatgaatttcaaagtgattttcacactgcacatcactataattcagatcgcctatcagtgcaaaaaaagagttctttccttgtagttgcagttgttaaatccaaaattaactcggcttaccactaaattgcctgtcatgcaactacaatcaacccaggtccgcactaatcaccaactgcacattctatcagctaagacacaaattatacccctaactaataaaaactgttctttctactccccccagactaacacataataaccagagagcagtaggagaaaggggattacaagagggcaagcgcgtgcataccgtccatgatgccctagtaagctttcacgccggcgagcaatccgacgcggcaaaatcgaatcaactccctccagcaacaagaggaacaaatacaatacaggttagcctccgacttcgggagcagaggcgtgaagcccgaaaagaacgaatcaaatgcagagatggataccaaaaatggatcggagaggagccggacggcggcggccggcgaccaacggcggcgcgccgtttgccggcgaggggatcggaggaggaggacgacgacgacctgagccctgaaccacctgtgggccttctgggcttttgttcgctactataggcccacacgtctgtgcccatgggcctggttttccggcccacgatccatcggccccgatcaacggctgtgattcgacgagggtgagctagggcaggagtccccgccttccgatggaaaacggacggcgcagatcgcgtcccgcggcggccgcgcgctgtataaatccgcggccccgcagcgcgagaaacccttcaccgcagaaaccctagagctcaccctagcgcgccgccgccgcagccatctccgccgccgctcgtcgggctctctccatctcccatccaggtaaacggcacaccccccttggatctctccctctcttaggttgccatttggtagagtttttcttgttgatggaatgatgacgggtgctggaaatgtgcttcgctaatgctagtgctgcgatctgtgatccttttgctgtgagataattggtcttgctgtcgttagtgttagcttctacgcgttggcagtaggttcttggatcgaatgcagcagcgggcgttgggtttacttgaaatgttctgtttttttaatgttacagtttcatgtgtgaatcatagaatatttgtttccgtattgatgaaatggacaaaagtatggttaggatctgaatatgtagttccacgtttacgggatgtgtacaaacttgtatatgttgcattctatctctcctgattggttgttacgctcatttacttgctttgtccttacatgctagtgttatatgttagattcattcttttgctgtgatagtttattttgtggctagttaatgccatttatctgtttagactttgcatcgcagtcttggtcattgtcacctatgttcgtcctttattcttaggagataacatgcttaccgatagttgttagtcaccttggttgtttagatacatgaggagtttctacaaatcatgatccatctgttaagttgaagttacatagtctgaccatatttcgtcctgatttgttcaggatgaagttcatttctgcctatctgatggcctatctggctggcaactccagccccactgcggaggatttgacaacgattctggagtcaggtaatttcatctccctgatttatgtccatatttgaaactgttcagaaaatgtaatctagccaataaatctgcttaactggtgtctacattttcttctgcttaatctggctaattccatggcttcagaaagcagtttttttggtctaaatttcttagcatttaatcgttaaattagaaggtaccattctaaggtttgcattcctttctaaatgttagactatatttagattgattggtttcgttcttatcttcttgggtgctttcattaaatataatattgaagtaatagtcatccacttatagctgtatgtactgtgaaatttgacctcaatctttgtctttgtggcagttggttgtgaaatcgacaatgcaaagatggaactcctgttgtctcaagtgagtggcaaggacatcactgagctcatcgcttgtggcagggagaagtttgcttcagttccatctggtggtggtggtgtagctgttgctgctgctgctcctgctgccggtggtgctggtggtgctcctgcagctgaggcgaagaaagaagataaggtcgaagagaaggaagaaagtgatgatgtaagaccaatgttcttatttgtctcaattagcatattttgctcattcattatgtctatggtagtttgacatgacttctattcaatgtataatatcgtatgatttgcaaaccgttgcttctgctatgcttcttattgccatttaacattcatgtttagtttattagaacaaatacacctaatggtaactaatttaactgtttgcaaatttatttacaggacatgggcttcagtttgtttgactgagtgatgcggtcacctcttctatcatcaataccagactttgcgcaggaaactagagtgatgatgtttgggattttagcttttcttctttagttaagttgaaaacacttgaggaaagactatgcttcctactatgttttgatatgtagtaacgcagccataggttgctggttacttcactggtgaaccatgcttttgctatcaaaattcaatgcttaatggaggatgaattgtgctcggcagtagtttttagctgtgttcaattatgtgtccctatttgttcggtgttatcagctcccaatttgattcatttgagctacgttatctgtctatcgttcatcttccgaagttgttttcctttgattttctgttttagagattacgataagccagaagttacatcagtaataataaaaaactttggcaattttaaacgagaaaaaaggctattttttgcatgcagatgcagtaaaaaatcatgtaaacaatttctggagtctggacatagcaaatgaaagattaaggacatgcgtagtggttaatttcaaagtagtgatagaatcatagaattgccatacaatctaatgatctctctcaaagagcaaaatatgtagatggaaattataggactggcatataatacgaaatgaaccaatcacgaaagagctactaataaatttgccagaattccatatctcaaagagcaaaatatggagatggaaattataggactatggcatataaatacgaaatgaaccaatcacgaaagagctactactaaatttgccagaatttatttttatgattactgcttcagaatgataagaaacagatctcttatatacccctgaaatacccctgaattttgcttactttcttgtataccccaaaaatttgattttgatcccttgcatactcctcccgttagttgaccgtatattttctataaaaatgaccattttacccttggatgaataaagaaattcataaatgggctgcaggaat

SEQ ID NO: 62491 - DNA, 60196 bp, Oryza sativa
ccacccctctttatatggcacagtgtgacgggggcccaccagccattgggctgggcgcccccgatcagggcgcgggtcaaggcccccttgagccgttgggctcaaggggagggagatccatctaacatgtggcattatcttccatgcattaatctggggataacgtgttatgtatcctgattttctatcccgaaacatataaacgtgtcaaatgtcgcattaatttgttcaaaaaaggacaaaatttcctttctttcaaaaaaagaaaaagaaaaattgctactccagttttctacattttcagatatatgtgttgctatgctagaaccccagcatttcacatctgtatagcgtgctctagagacaagttgaatctgtggttatacaaagttcttcagtcaacaatgatcagtagtacataattttgtcatggtacaaaataacaatactgatattgtttaactcgacgcaggacaccacctccttatattttggaaattaactatcaaactctacttataagtcattcgatctccgctcaccatccgtgcacctgattattataaaatattaaatacggaacatgtttgaatccacgataatgtatatagcttaaaccataataagtaattgcgcactaggccccaatcccccctccctgcgccataccatatttaatgcattcctgtcgtgctcattacgtaatctcgcacccacgcaaaaagaatatgcaaatgcgtgggaggatttttactacaaacccatgcatcgtcaacgagaaggggcgcgcgcgccaccacgtagattatcagaaacaaccacgtatacttcaactttattataaaaaaaacatacatatagcgaaatgccaaggtacgtagcagcagattgtggccgtagcaacgtagctcaaacgttggtcaatccatgtgcaattacattacctagtaaaataaaaggtaaaaaaaatgccaatcccaaacggcacaggcgcacagcatttgaatattacggtttagaataatccccaacacggctcatcccaacccgtacggaacagcttgacaacagcagagtacgcgccactcgtgtgtacaacccccgggtgacccaagccacgcacgccaacgacgacagcgccacctgtcacagaagaatctccctaccccctgtcactgccatgtgggcccatgacgcgcggccaccaccaaaccaccaccatcccgaccaatcaaacggagacgaggcgacggcgacgacagcgacagcgccgtggcagtatactccttgccagtagaagcatccgagacgtgacgtcacgtcaccccgcctttactcgctttctccgttctccctagccgcgtgagccgcggtttgcatctcatcttcactcgcttgctctctcttccacccgctttcctcttcctcctcgccgcgcttccgcgtgggcccccatccccgttacctatatatacccccccccttctcaccgtctccttcctccctccaagtccaagtgaccaaccatcatcaatcatcgctaagcccacctcggagatctcgagttcgatcgtcgtcgtcgtagctgtagaggtagttaattatctcgttttagatgagctcactgacggcggcgcagttccggtcgctgtttgagatggcaggaggggaggatatctcgtttctgtttggtgatgatgaggcggcggcggtggcggcgccggtggagttgcaggggaagagggggtgggaggaggtggatcaaggggaggggtctggggcggtggcggcgaagaggcagcggtcgccgacgagctcgagggagaatagtagcgggagtaatgagggtgggcaggaggaggtgtctgaggcggcggcggccatggcggcggcggtggggaggggtggggggaggaggctgtgggtgaaggagagggactcggagtggtgggacatggtgagtagcccggattacccggactcggagttcaggaaggcgttccgcatgtccaaagccacgttcgaggtggtctgcgacgagctcaccgcccccgtcgccaaggaggacaccatgctccgcgccgccatcccggtgcgcaagcgcgtccgccgtctgcgtctggcgcctcgccacgggggagcccctgaggctggtgtccaagcgcttcggcctcgggatctccacctgccacaagctcgtgctcgaggtatgcgccgcgctcaaggccatggtgatgcccaaggtggtgcgctggcccgaggccggagacgcgccggccatcgccgcgcacttcgaggccatctccgggatctccggcgtcgtcggcgcgatctacaccacccacatccccatcatcgcgcccaagtccaacgtcgcctcctactacaaccgccgccacacggagcgcaaccagaagacctcctactccatgaccgtccagtgcgtcgtcgactccaccggcgccttcaccgacgtctgcatcggctggccggggtccaactccgacgaggaggtgctcgagaagtcggcgctgtacctgcaccgcggcgttcccggcctgatccagggccagtgggtggtcggcggcgggagcttcccgctcatggactggatgctcgtgccctacacccaccagaacctgacgtgggcgcagcacatgctcaacgagaaggtcgccgccgtgcgcggcgtggcgcgcgacgcgttcgagcgcctcaagcgccggtggggctgcctccagaagcgcaccgaggtgaagctgctcgacctccccaccgtgctcggcgcctgctgcgtcctccacaacatctgcgagcgcagcggcgacgccgtcgtcgacgccgacgactgcgccttcgacctcttcgacgacgacatggtcgccgagaacgccgtccgctcctccgccgccgcgcaggcccgcgacgccatcgcccacaacctcctccacagcggcggcggcgcatccttcttctgatcaagcatcatcgccgttcttggtccgatcaacagcgataccaaacaaaccaccaaaaataaaaaagaaaaacaagattcagtttttaggtgtataggaggagcttctccattttttgtcggaaatggagcagtgaacagtttttcgctttatcgtcaggagggacaggaaagttcagagtcctagtagtctcaaagtaacattagtttcttggttggattttcgattgatttggttcttttagatcttgagagattgtttttcatggggttgtaattaattgcctgcataatcttgtatcccccagattatcaattaatcaaacctgaaaaagaaaatcatttttttgccaaccaaatgtatcagaatatctttcactctttctgcgtgggctcgtgcttggatcgattgtgctgttgtctgacggatatctttgaattgaccaaagtcagagcaagaataatcatccatctccttctttgtttaatgagaaatcctcaagatgtattaggtggcagcgtgccattcatagccgtactaatgacctctctctacctgataattggggatggattatgaaaagaaacagatggggcatgcccagtcaatgtacaagctggcaatgctgggataactagctttactattttactgaccttgaataattacaacgcagattacaaccactagtttactgccttgaataattacagcccaccttggataaggatgtgttcacagcttgttaccattagagaatggtaattaatgggggatctctacggtgattacacactgctattgtagctatggtaattaatattatttctctgttggttgaaaatggaaaggaggtatacacttatattacaggaaccagaaattcggggctcgaatctgaaatttgaaaaacgcaaaacctgctggcacatatatgctctgggctgtttaattcaagtatcctacaactgttaacaggtattccttccagacgaaattatttaacgtttcggacagtgaaaatggcttacacctagtagtatttagctgtcggaaaagtcagataaattcagggaatagaacaattgaagattaatcgcaggccaccctgatttgctgaatgtacaacctgctctttgcaatttcagtgtaccctgtcaatttcgtcttcaacaaactcgcaaacaaaagctataatcagaattggacttgaagatgttacaatcatggagaaaagaaacagtgcagccaagcatgtctctcatgtgactaaaatccatagatgtggatacacacgctgtaaagccatgtggatgcaatatgtttgagatcctaagaaatccgttgaccggattctataaggttgacctcttgaacacacacacaaacaaatacacaatgagattgtgtcactgtcagtctgtcactgatcactgctgatactgaagatctctcttgaagactagtactccacagtagtggatttcactcgagatttcagatcatggtttggtttggtagggtttgtgcactgttgagatgaaaaggaaagcgtttgctccctggaattaggcactgggaatggcatgccacggctgaggaaaccgtgccgaccaaggtgtgtatgaactcgcaatcaactttcagtgttcccttttggaaaaatgttacactgaagaagacgacgactggaagacggaattatatattagttaaaaattccatatcaatccaaaaggaggctacgtgtaagtgttgacgtttatgccaggtgaaaaagaaacgcgttgaccctacagattattatccagctagtggtcggcgtcctctgtgactctgtgttggcgagagttggtgtctggaattgggcttggtgagctttggaattttgggccggccttgtaatgccagtccaggtgttgtgcagcgagcacgggacatcaaaaaatttgttactgggccattttaaacgaaagataaagtccagtttgaacccctctggatgcatctggttcatatcctcaattcatctcctaccggtagatgaatagttgagggattatcgatggacattttccataatatagtactggaagaggcccaatcctaacgctaactttaataggcctccagtccatcaaggcccataatctctctctacaagtagaagagagtattttcctattttcggcgatttcgagtgcaatcagccaaagtaaaacgaaccctaggtttgctttcccctctcctctcgtgcgcgccttcgtcgtcgtcgtcgtcggcggcggcggcatggcggacgacggagacggcgactgcgtgaacctggagcctttcttctacgacgaggcagcgaccgtggccgaggcggcggcggcggcggagaggcgggagcgggaggagcaggagaaggcgcgggaggcggcggcgaacgccaggagatgggcggcgcacaacgccgccctcgccggcatccgcgagtacgaccccgccgaggagacgtacatctacacccgctaccactacgcggacctgtccgagttcgacctcgacgaggagtcccgcctccctcccatgcgccacaccgccgccacctacgccccgccggcgcgagccctccacttcctctgcgatatgatcaacgtcctcgccgtccgcatcatcctcccctcctccgatcgctctgatggtggtggtgtcggcttccccatcagcgtctacggttctgtcatcgccagagaccagcttgattacaaatgtgtacatctcttccgccgctgcagagacgatcctcagctaatcacctcagaggtacggtacttagcttgttaattcatccattcataaattaatcgcatagtgtacaacacagcatcaatcagtatgataattttaatttgagaaaatttcacatgcgacaaatttgtcgcaaaactatatatttaactcgatgtatcacaaaactatagatttaacatcaaatttatcacaaaactacacatttaaagtggcgcttcacaaaattatatatttagaaccaatttagtcacaaaaccacaatgtttatagcttcaacgtaacaatggtgctagggatttaaactctagaatacgtagttttataataacttcaatattaaatatgtagttttatgatacttggtcttgtatctatagttttataatacgatgacttaaatctgtagttttgtgaaacttactcttttaattaattataggatgaactgtcgttgatattgactgggcctcatcgaggacttgtgctgtatgacgctctgtacattgaggtcgatctcaagatgaaggtgaagggtgatcaacaacaaggctgcaaggacaagcgactcagtaaagggctgatagtgttggatggcgtactgctctcaacaaacttgagcgaccatttgcgtgctgcggttaaaaccgccactcttgataggagaagcaccatgccctgtgccgtgcaggtcacttacgcgtatgtcacgcgtgcagtggaggccaccgtctccgttgagcttctgcatgatcagggaggatgagctcatttctgtggggagatcactgcttgcaccagcactatccgagatagcattgtgctccatgatagcagattactagcagatgatggcattgtggctgatggatctactgtccggctattgcgccgcgtgattggcgtctgtttggatgaggtgctgatagtgacaattgttgctcaagatggtgaccttgcaaaggcaactaactactgcagacaaaccgttgattttacaccttgtgtcaatggtggagacgaagctcgagttgtgggtggtgtcggcagttttcttgtgaaggttatttggtcgttaatggacccagttattgacaagtagtttgttatctttatcatcacgaatgtaggcttttagttgtgtactgattgtctgcaatagttatgtactgttgagaggaaaaagaaaacgtttgctccctggaattaggcactagcaatagcatgccacggctgaggaaaccgtgccggccaaagatgtgtacgaaactacgaactcgcaatcaacgtttagtgttcccttttggaaaaatgttacactgaagacgacgactggaaggtggaactatatattggttaaaaattccatatcatccatatggcaccatttccagcgaagctgatgtgcttagtactccatgcacgacacgtccatgagagtggattctaatccccatagggatatccgctcatgtaatgcacatagctatcccctcatgtaatgcacatagctgtgaaaaagtgttaaatatgtgatccgaattttgggaccacaatatattcggattagttatctaataggactctactttataggattagtttcctattaggactcctagatttctcctatatatattctttataggattagtttcctattaggactcctagatttctcctatatatatcccttgtaagccgcatggggagggtgcgacagcccaatgtatcccctgcgtttgtatccaattcctctatagtgatcattgccggtcggcgcccgtggtttttttccgcaagggtttttccacgtaaaattcgtgttgccattgtgcatctatttttataacaagtggtatcagagcattggaaatcgatctactaccatctcggctgccgacgagttcgtctgcttggagatcccatctgcaagttttagctgccggtacgctcgtcgtaagatctgatcggcagtagtaggcgcgtgtcgtcgcgtcgttccatctatcgctgccgtcagattgatttgtttgccgagataagattagccggtacgaagcggagtcagccgtcgactccgatcgggatttggtgccgccgtgcagcgtgttggagaaaaagcagcaatccatctacttcagcacgttgatcaaggaaagaaaaatcagcagatgcactcagccttgttactgttcacgtgaattgaatttcacgttggttttttgctgcgtgcacatgcctcttcgtaccagggattcaattcaattgcggtgcttcggttctgtttgggtgaatcaaattcaggttcaattttgtgctacattcacaagccatgtttaccaggaggttgtatatggagatcaacttcgttttatacacccagagtgtttcgcgtttctgctagggtttgacaaattgtaccagcagattcaggactttattcccaaggcgagtttgaagtttgatctactgcttctggattgagatacaatattctcattatggcaagtgaagttttgcagcggggtatttacctaggaggagaagtatgctggaaaaaaaaagagaagcacattcaagtcgtcgagagggagcctcgctcctgtctagatcacaaggtgatcaaatttttccggcgaattttgctaccattgtacccaacataccatgaggttatcaggggatctaagtacttcgttttgtgcacaagaatttttcgcgtttctgtttagattccagaaattcatgccagcagattcaggattttattcccatggcgagtttgaagtttgtgcaccagtttcacgtctctgctaggttcagacaagttaatactagcagattcaggatttgttcccaatggcgagtttgaagtatggtctacctcttctggatcaaggatgttatggattatagtccaagtgactatttggcgcacattgatcttatcatcacgaggttgtttagagattgaagatttttatgctacaagggaaattcgtctcaaggtggagatcgttaaatatgtgatccaaattttgggcccacaatatattcggattagttatctaataggactctactttataggattagtttcctattaggactcctagattactcctatatatatcccttgtaagccgcacggggagggtgcgacagcctaatgtatcccctgcgtttgtatccaattcctctatagtgatcattgccggtcgacgcccatggttttttcccgcaagggtttttccacgtaaaattcgtgtctccgttgtgcatatattttcataacaaaaagtctaaaaaaaattaacaatgtagagtatagtaatatctaatagtccatcaaaaatcaagtttaaattcgacctacacagtgagaaaaataagacaaattaaaatgcgaatagtatgctactatttatacgttgaatttgtatgtttatattgttgcgccgccgtcagcaccagtagaggcggcgtcagtgtcgcctatgctaacgatgacgatgtggccaccatcaccgcagcgatcaccgcggtggctagagcgcaatgcggcaaagcacacctacccatctcgcaagcactgtgattgtgtctatgggctacctcttctctcgttttctgttgcgaagcgacgagatatgaattatgaagggtaggtgcgcgacgggcgaaatatgttcgttcctcgtggggagtgagaatgacacgtgggccctattattttttatttttttaagtgatatgtcggctcatggtttttattattttctaaatcaaattgccacgtaaacgcaacatcaatgccacgtgggataaagattagttaaattggtcacgtaggtttcacttcagtcaaaaccggaaacaataccgccgaggggttctcgtttgcactacttttgtaagttagaggatccgttctatctggtttttcggttgaagcaataaaatcggaatcggtttcaagttaaggtatctgaaaagaacttattctattttcttttgagttgatttctgagcaattattagggctggcctttttatgtcagtcaccggtccgtgcgccaattcgtccggccggcctctgggcctccgcttgcaaattgcaatcgcgcgcgaccatctcccatctctccgtcggctactcggctgctgctccgcgcccccgcgacgcaccaaccgagagaccgcgccgcaaacgctacgcctcgtgcacctgtacgcgcgcgcgggcgcggctgccacacgtacgggcgaggagggagcaatcggatcacaccgtaccgcgcgtgtcggccttgctgtcgctctcgctctcgccctcgccgcggcggatgcgcacttgcgcggtacgtacaagcgccgcgcgcgcggccgaacacgtacgtacacgccgtaggctatacgtacaatactacctacctggctgctccaccgcgagaccgtacgtgcacgctacgcccagtgcgcggtgcggcgtgcgtacgcgcgcgcgggggcaattcagctgaccgcgcgtcgcgcgcgttcccctgcgcgcacggtcgccgctgccacgcgcgcgcgacacgctgcattacaattaaacctgatcgatcgattgattacttgatcggatgaaggatgagtagatctatgacgatcgtggctgctgctgtttgagtttaatcgatctactgctccagaacacccagccagcaaagcaactatgcgcatcattggcatatatacatatgctacaattaattaactaaatcaactcacctggacacgtactactactacttgagagtatttgacccgactcttcgactttgtggctgcaagttagggccctttgaatgaaaggatcctttatgtaggaatttcataggattcaaattctatagaaaattttcttatttggccctttaattcaaatgactgaagcttttcaaatcctatgaaatccctatggaatggcacattgcatgtggattttagagaaaatttagcaagagctccaacctcttggaaaatttccttttagtctatctctctcatccgattcctgtgttttttcctacattacaatcaaacgaccattcctgtgtttttcctgtattttgcaatcctctgttttacacttcaattcctgtcagaatcctgtgttcttcctattcctcctttttttctaccctacgattcaaaggggcccaagcaataatgctatttcctccgtttcatattataactcgtttgatttttttttatacaatttattttagtttgatcaaatttatagaaaagaaaagcaacattcacaacactaaattagcttcgttagatttaatattagatatagtttgataatatatttgttttgtattagaaatatttactattatacgaacgatttttctatacgagggctcctctaggttcttaagaggcccacatgtaaaaacatattttgcaaacaaacctcttaaggagttgtatgtaaaaataaacttattttctcaggcggagctcttcgcatgggaaaatatttttttgcaggtggcctcttaaaaatccatcttaaagtctgacttacctcctctttcaccgctcagcacttcaaatttttcaagtaatccttatgtcctttcctctctcttgcatcctctcctcatattactcatccctctctctctcatttcccaccttctctcctctctctccctccctccactccctcaggagcggtttgcggcgagcggtagtgcccgaccctcctccacgcgttgaaggaggtgaggggcactgtggccctcccccgcccagatccggcggcgacggacgccaccccacacgcgctttgaaggaggcgagggggcaaggccgtccccgcgtggatccggtgatggcggtgggagaagctcgacggcaaaggaaccttgctagagttccaattttgggggatttttttcagatttttgcatgcggacaacataagcacccgcacgcgaaactctgatttttcgtgtacgggtgcgttacccacatgaaaaatagcaattttcgcagacaccttcgggcagacgggcaactcaactgcatgaaaaatcggttttgaccatttggaaaaaaaaaacatttttagtagtggttactttatttttctataaagtcaggaaatttaaagaagtttgactaagaaaaattaaaagttaaatgacttattataatataaatcggagggaatcctatgcaacggttagttctaccttatttcgtccaaatatataaaaaatgttaaatggctagctagctatatatatatgcgctcccgaccaaaatctcacttatgctagctaggagctagtagcaagtttaaacactgtactgactgagcaaggcatgtggcaatttgtgggaatatttgtccggccgtgcatgagatcaatcgatcgatacgcatcacctagccagacatgcatgtacatccatccaactagatggaacttcacacttttcacttaacctaatctatagactgaaataggctagctaggtatgagttgtctttagccaaaatggggcaggcattgcctgctgataaggatgttagccgtccatttctgatcattttttttcctcggttactctctctctctctctctctctctctctaaaaaatagactacgttattaatttttgaatatgtatttgagcattctacttattaaaaaaattatgtaaaaacatatgatataaatcatatttaaagtatttttagtgaaaaaacaactcatagaaaataataattacacagtttttttttaaatagaacgaatgatccgtatttaacaaagttaacggtgtcatctattataaagtaaaggtagctttaccatcaacgctgtctatttaaacgcttgtcgaaaaacgagcatttcatatatacacacttatgaaaacaccaaaatacttatttaaagaaaaggaagatagtacttaatttaatatattatagtactcctgtgtatatacatccatagttatatatcctccttatcaatcagctcgcaattgatcatatatatatatatatatatatatacctaatatattttaatttgatgtgacacattctagctagtcgtatctttgtaatggccgtgtttagttcagcgtaaagtttggattttagttgaaattgaagatgatgtgactgaaaagttgtgtgtgtatgacaggttgatgtgatggaaaagaactgaagtttagatctaaacacaaccaatgttaggatttgttaagtgtagtagcagatcactctcggcacatgcagtgaagctagtgaagtcggcggtgacaagatataagtcggcggaaaaagaagcatattcgagctaaataggctattgctagctcgtagctcctccacacgtatgttcactgaggatgcacattcttgtcttcgtcttctttcgcccgtcagctcgctgcaataattcaactcttcggttaatcaatttaattaattaatcgccgaagaatcatatcgccaggaataagatgcatattgcatgcgtgctagctatatatccatctctcttattagctaaagcacatacgcgattgttcaattcgttcaaatcagcccaactagcacagtagctagcagcttagctagcgccgatggagagatcagcactgcaaagagagagattccaaattctccaacttttgcaaaagccgatccatctaatctatctatagagctgcaaatattttatgtaagcatactgtacacaagagagctgcattatttccatccacataataaacaatgggaaagaaattagggaaagggctacctctccctatgggaagacgacacaccgtgtggatatcgtatttgcctttagctggtgttcatctagaaatatggtgcatgcatggtcccctatgcacgcgcatttcgttaatttatctcatgattattagctgatcatgcaactacaagatctagaattcgtattatttttttttggcggccaactgatttcttaactgatcatgcatgcatctactgtgtagtgatgctgacattacctcttaagtagagcatgtttgtttgagctgtgccttagtgtaagacacaaccaattttgaattaacataattatttagggtttctaattcgttttcatcatgtttgtttgagctgtgccttactataagacaaccattttgaattaacacaattatttagggtttttaaatcgttttcatcattgtatttatgttgggaaaatatgtagtacacaaacctgaaaactagttttcactggatacatagatgatcgtcttaaaatttgtccacatcctctaaacaaaaaagataactcatagattaatataggagtgaaaaaattactcacagttaaatctgaggtaaaatggtgatgtggacgtacacatctcatctatccatttgtatatctaacgatagtttctagatctgcactacatgttttcccttgattttgcaccactaagggcctctttgaatcgcagggttgaaaaaaatgaagaaataggaaaaacacatgattctggtaggaattgaagtgtaaaacagaggattgcaaaatacagaaaaaacacaggaatgatcgtttgattggagcgcagaaaaaacgcatgaatcgaatgaaagagatagactcaaaggaaatttttcaagagattggagctcttgctatattttctccaaaatccacatgcaatgtgccattccataggaatttcataggatttgaaaagcttcaatcctttgaatcaaaggaccaaataggaaaattttctataggatttgaatcctatgaaattcctacataaatcctttgattcaaaggggccttaagagtataactgtgtagaagtcttattatatagggaaaagtccattttacaccctcaaaatcttatgcttgtgtaatatacaccctcaaacttcaaaaccggatataatatacccctcacctgtaaataccggacattttacctccagagctgttttgcagtggtttttgtacatgtggatgacacttcagatgccacatcagtccttcgccaggtcggatgaaatagagtaatatatcctacgttctctcttatacattcgttctttctctctccctgttcattgttctttgaaacaacaaggaagcaggcacgtcatgcatctttgaagcaataaagaaggcatggggcggcggtggcggctggggttctcaccgccggctcaggtggtggctgagaccggctgaaaggaggcctccctgttgtgtctgacgaaagtactaacatgcatggattaacagaacatgcatgaattaacaggcttaattatactgaagaaccaactgaacttttatctttttgcactttgtcagtaattagagattcagaattcagaaatcatctgttgtgtttgcccatcctacactgaattttctactccaatgatgagcagggatttttgttggcaccagcacgatcccttcgccggagaactcatcgtcagtgttcgccaagattgttcagtctaagtagaccaagcatgtgcgcgtgttcagcagcggcacggaccatcagctgctacgatcgttggtgaaccccggagaggaggtcatcctcaccgtcccgaacgaacaactggagcatgtcgtgcggttcctcctggtgactaggatcacgcgcatcatgaccagcgacgacgtcctggttaggtccctcgggaatgcgtatttcctcgtccccacgatggttaacctccaccccacgctcgcggcggcgcgcctggacggccgcgtgaaggtgtcgagcgcgtgcggtgccgccaaagcttgttccgtcggccgactcagccgcaaatagcacctacttgctgtggcttcctccccgcgcggagctgcttccctactcagccatctccgctggcgcgcagacctcctccgccgatgaccacagcagcttgtcggagatgctccttcctcgcgccgctgccatcgcagctcatgagaaagttggtcaaaacatcctgtgcgctgatgtggcatccaaagtgtcatccacgtgtgcaaaaaccatcgcaaaaacaactctagggggtaaagtgtccggtattgacagttgagaggtatattatatccggttttggagtttgggggtgtattttagacaaacataagagttcgagggtgtaaaatgaacttttccctattatatatatactacctctggtctgtttttaatagataattacactgttgatttattaacaagcatttaaccattcatcttatttaaatatataatcattatttattttttaacgtagtttatcactaaaaagtactttaagtatgacttatgtattttcacaaaagttttgaataatacaaattgtcacacacacatatatgtatgtatgtatgtatgtatgtatgtatgtatgtatgtatgtatgtgtatgtgtatgtgtgtttaaaaatcaacggtatcatgagagagtaatttttatttgtatgagtcatgtgtcttccgtttataaaatatagtccataaataccttgcaaattaagtagacccttaatttgtgttccgtctatatatgtttgttaatttcttgctagtttcgtacctttagttcatctcactacaaggatcacgatttttctaagtggcacaaaccgtcaagggaagcatcaaaaccgccatgtaaatttgattttgtgggacaatcttttaggaatacctgtcaaatctacgggaaaactatcttaattggcggtttgcccgacaaaaaaaactatggccatatcaaactttccagtgtgacaagaaatcaacaaatactcgtcgacagacaacaccaactacatcgccaaggtaattaatttccattgcaccctttagcaataattcgtcttttctggattctagtagtgtctctccagtataatcaacaatatatgggagtggggatggttgctctttctggaaaagggaggccgccacaaaaggaaatctagatgcgaagcacgtgccttttccaattattcatccatttcttgatttttgtttagcattatgtcgctgttacaatttgttctgtggcacacacgaaacaaagccagccatcagtagatagcaacactatatataattaccaaaaacttttattaggcatatatgcagatgatttaaatatgctgaaaacacaacactcatatataatattgtgatacattcatgaatttgctttcgatcgaataattcatttgcataacttacagcaagctgttcggacacagctactgtaaaagtaattgttgcaagaatccagattgtttaacaaatgctactcaaatcttgtagttgaaatttgcaggcaataacaagatgattatattgtaaaagtggattcttgggatgcactacacgtatgatagataatttaatcgatcatcatatcgctatcggtgacatgatcaaccacatggttaatctagctgggaaaaaagagtttacaaagttaaccatatatatgttcgatcgaattgaagaaaattccgcagctttgcatccgcaacccactaaaaacatattgtaatgaagtaattaatcagcagccagcagcatatcgaatggcaagaggatgggaataatagttagtccttgtatatattaataatcctttatataggattatgtatagaatgatggtgattaattttgctgaggattcccaccaacggcgtcgttggtgatgcaagccactggcgtaagttagtttgtgtgaatctgacaattaaactcgatctctccacatgtcattacctaagaagaagtcgtcaaattgctgacagtgtggctaaatttgggaggggtgtgaaaaggcatgtggtctagtggttattttttttagataatggaaatgggttacatctccggtctctgcccataggcacatagccaaaaagtccagaagtgaatagaaaagaggttaaaaaaggcgagatgggacaaacccccaacttctgccgataatatgatatactaaaatcatgtttttttaaaaaaatcacgtagagtctatcacgaaattctgtaggtaccacgccatccaaactggagtaaaagttccttggctaccaatttcaagcgtgtagcaccattgctcatagtatcctgttgttcctgtaaaagcatcatacaccaagagtggagccaattggaacacatgaagataacctgcatgatgttaggtattttttatggttaaaaaccatatcattacggcaacgccaaattgaccaacatatagcactagctccaaataaaatcattttttatgggtctaggcactccccttagccagttaccaaaaatatcttatgcattgtggggagggggaatattgaaggcaaagaagacacatcgccaagaaaaacgtgcaacatgacagtcaaagaaaaaatgttggatggtctcttgtgtattacaaaaacagcattgcttgtttcccctccattttctctttatgaggttatctttcgtcaagattacttttttgtgaagaaaccacataaatactttgatttttagtggtacctttaccttccataagatcctcttgtggattattacattggaattgatgatcgcattatacatggatttgaccgaaaaatgaccatttttatatagcgaccaaataaagcaatccttttcatttgacagggttatgttagctagtcgagaaatcaaatcattccactcaactaactttggtcctacaattgatcgtcggaatgaaacattcaacggtgttgtgctcataacctctaccaaagtagaatgtctctttcgaaccacattgtacaaagaaggatattgatatttgagtggttgcaagcccaaccatgtgtcttcccaaaatcttatttccattccattaccaggtttaaaagatccatactgaaaaaattgatcttttactttcattaggccagcccaaaattgggatgttcctggtttgtgtgacatgtgggagaggggtttaccttttaagtacttgttgcgcaaaaggttttgccataggccttcaccattaagaagcttgaatagccatttgctcaacaaacatctattcatgatatcaagatttaggacacccagtccaccttgatcttttagccggtatatataatcccattttgttaacctatatttctttttctggctatcactgctccagaaaaagctcgatcggtagtaatccagtctttgaagtacacctcgaggtatttcaaaaaataataacatgaacatgggaaggctcgaaagaaccgagttaagaagaaccaatctcccaccataggagttatttttgcccttccatgtgctaagttttctttgaaacatatcctccacacatttccaatcagaatttctgagttttcgatagtgtatggggattcctaggtatctgaatggaaaggaaccagaattacaaccaaacagttgtctatattggtcctccatttccttagctcccccaaagcagaaaatttcacttttatgaaagtttattttcagccccgagagatgttcaaacacacaaagaatggccttcatgttttttgcttgttcaaaataccgcatatattcggttggatttagaggccaggtaaaaaaaaacctctctaaaaacaattttgggaggggtatattaaattgatttggttgtcaaaatatgttcctcggtctgtcctgctacaatatattaaccatgctaatgaagaactgaatgacttgtgaaatatgttcctcggtctgtcctataatatattaaccgtgctaatgaactgaatgacttgtgattattattggagggcacaaatgaattaattgaatactagtataaagctgaaaaatggaattgaaaatattagttcatccacaccgttctattcattggaaaagaacaaattgaatcctgaaaatttccgatggggagggagatctagataagaacaatagagaggtcagagaggaatggcgcatgacatggggtgattggatagaatcggcggtggggcagatatgcacatgtgtgttaggttaaatttggtttagaattacaaggcgcattgggagaagctactgcttgcaattgcaccgccgtttacatggcttttgatcagagattcagagcgtgcagctagcagagtactccatgcaggagtagtcatgactcatgactcatgagtagtcaagccttcagcaatggaccatgcatgtcccatatagctggaaagaagaaagattcttgcatataatgtcgacacagatagtgctatatgcgaattcatgatcaacttttgatcagtagttcattttatgtatatatataattatactccctccgtctcataattaatataagggattttaaagggatgtaacattttctagtactatgaatctggataaagagcttatctagatttatagtactaataaatattatatcccttcaaaattccttatattttaggacagatggagtatattgtatacacttttcttttttgctatatattaatcctatgtaatagtcgaaagattatattttagctgtgaattaacagaaagaagtttattttctgtaaagttgtggactgtatgatcgatgcatgcatatatatggtccatccaagctgtagtaggctccaaagcaagcttatctcgttcatgtgtcaagcttgtcccacataggagaagagatgtcgagatggaagagagaagctaggctataggcagctactacggtcgataccagtagctaggttggtgacaagaaaattaattaattaattattaattaattaattcgtcttctctgttgttacatcaatcggccaatggcggcatctccccgtttattccattcaaacggaaactgcccaagtaacccatcctttccatctcctataaataccgtaccatctcctccacagctcaccatccaaatcaacagtaatgttctacagttagtgagatgtagagagagatatggctagctaatccatgagagaggtctagatagagagagggagagatgatcagttcttcagaagaggctactactagctatctagcttcatgtttaactcttcttggtttgtgtttttgtgtgcttgttggagttgttaggaggaagagaggggtgagaggtgaggctgacagaagagagtgagcacacatggtgactttcttgcatgctgaatggactcatgcttgaagctatgtgtgctcacttctctctctgtcagccatttgatctctctttctctctttctccctcatgtgttatactgttctctcatatctatcttctttgaggtagtaatatacttgagcaaattaagctgcttaattatttgtgtatgatgatcagctgctgatccggcctcatttcttgcatatatgaccacaaccacatacatgcttgttcattttttttcacaaagaaagagaacagtttaatttaatttcttggggtttttggatcagttaatttgtcttgagaggggaagagatctctatgggttttggaggtctgacagaagagagtgagcacacacggtgctttcttagcatgcaagagccatgctgggagctgtgcgtgctcactctctatctgtcagccgttcaccatgcccaatatgattaatctccttctctcagttgacagtaatttctttgccagatctcctgttaaattttctgcctagctagctattatgcacatgcttattatgatgagcctgccaatatcatctccacggcaaaacacaaactagctatgatttgattcattatatttcttttcgctgtttaattaattatatgcaggcatacactagctagtttccagctagtacaaagacgagacgaggtcgttctgacgattttcatagtcgtcagaagaaggtgtgcattggtttaatttttgttcttggctgtcagactagatcatctctgaatgatcaagagccggatcaaataattattgtgagcaccgaaatcgatcatgcgtactctctctgtgaagtatttctgagaaataatatgagtgtagctagtatatatactcttgaagggtgtctaattaattggggtctctagctagctccttctctgaatctgtccatgaattgaatctactatgtatgtgctggtgcttactgttatttcatgtactacatataattgataaatcaatttaggctttcagtttctttaatttgtgagcacaagtttacattatattgtaattggaatctgttgcaagtactatatactgtttttttatgcatagcagttgagaaatagaatccaatatacttgtgcaatttattctatgccaccttaattaattacttcttcctagtaatgaagtgctagcttcgatctttcaatattacctgtcaatcttaatttatacttgtttaatttgactgtaatttgccagctagaattaaatgtacattaaattgaattcttcagtgttgttcttgtgaagttaaaataatttctgaacattcacccctctataatcatttgtctatatagaaaaagcatgaagcaattctaatcacaaaaatacatggagttgtctagatcaaacaattaattaatcaatcatcaatcaaaccaaagacgtgtaaggtcatataatacaaatttaacttgacaagttaatgagtagaagatgtatgcaacgatattttccccgtagcttatactactgtcgatatatgcgtgtgaccatagttcacaagccctgtattttatgatttcaaatgttcgttcatacatatacactactacaaaagcccttattgacaccgattgagaaccgaccataaataccgatcgattttccagccggtgtcaatttaacggtactaagggcacccacaatggttatctataggctctctataagatatccatgtcagcatattttcctacttgaaagagattaaatgaagagagagagagcaaagctatctactaacctggagatagtctatagagaaaaacgagacaatgtattagaaagctatagatacccatgtagacatactattgagatggtttactattaatctagtctattgctgagatgtacatgttttatagatagcaccttactttaccattgcgggtgctctaatgcacaaccatataggtaccgattttagaatcaacgcctatagagattatctgctatttgtgactatgtgctatttgctatttttgaaacatggagcaattaatctgttataataatcggatcggatgaacaagttgaaacaaaaagggtccaaattaagccatgcaggtttttgctatatagtcgagctgtgttgatagttgtaaaaaaaaaactgtgttgaaatcgtgaaagtacccaagtttgatctgaaaaaaaatcgaaaaagaagcccaagttggggcaatgcaggcacacgcacggcggatggatggtccggtccacatgtgtgagaagggaagctccacgttcctccggccaattcaggtaattgggccgtggtaattcatttcgcatgacagtaagtctattttgtctccctcttcttgcttctggttgaaccacatccctcaacagcaaaaccgggtacaacgtctcccccatcttcgaaatatggtggaaaggtgttacacccggttttgcagttgagagatgcaattcgatcagcagcaatagttcagagatgtataatggacttattcgtttctcaggaaaatatttcttctacttagcttcatctgggcttcatccttttggggcaatctctgtttgagccagcatctcagctatgcatgggccagcagcagctcagcataaaattggtccctgaaaagtgtaaaagttacaagtggttaaccggttacttgtccagcagaaatggtttggtttggtttgccatcatgtcgaatgtacttctggttcttaaatagtactctctccgtttttttaaattataagtcattttgttttttaattttttatttgataaatttatagaaaatattagcaatattcacaacgttaaattagcttcgtcattacatgtaactttgataacatttttgttttgtgtagaaaatgttgctttgtttgattaagaaaaaagtcaaatcaacttattatgatataaaatagagagagtgttcaccctcttaagtacaacactacgtaccaaagttataatcatggaattgcgtgctttttatggttgcgaatcacctaacatgtatcaaacacttttttcccctcctcgccaaatgatctttttaaaaactttttggtagacttttctggcctcggataaaagcgtgtaccttttacttgaagaaaaataatagctcagcatatttaaaacactatctaccttggccacgccctccatcattgtcatttcgatcccccgtcattcatgtagaattcgggttgaaaaaactacaagctccattttttatatatatgtttatcataatttgcatacgtccctttcatagatcatccttttgtcatcctagccgaaagggcggctgggctgacctccttggcaaggaaaatcaatcggatggaaaagaacattggatttgacctattgaaaatgagatcagaagaagcactcctaatggtgtcaatgtgatgttagtaccccttttctgcctaatctccaccccagattctctcccaggttgagaaaaagaagaaaacctagaaaaaaaaaagtggctttctgtgatggacggttttgtttggcgtgtttggctgtggccctctatatcactgctgctctatctatctatcattctatctctgcactgtgccactgtgctactgtgctcctgctttagccttaggggctaataaaaccttgtcaagttgcaatttgtgtggtgattatgctctgaaaatcttaacagtgcctggggtggcagggtcatgacaaggcacttttgctgtgtatcttggtgtggggttttcatgtccactcgtaatcagaaatatttccacatgtttctgcataaaaagcatgtgcttcattaattcttgagaaatgtcgagctaaaccaggctaataatttgtaacaacgcaatgttatttaacatgtgtccattgatgtatgatgcttatcagtcccaacgtttcatctacaattggttatcacaacattagtgacaaaaaataatttttgataaaaattttatatatgattttttgacgatttaaaagctaatattaaaaaaagctatgaaaaaaataaaaccaactctaaaattaagattttaaatcaaaattttggttgcagctaacaagctgcataggaaatgatgaagcaatatgtatatagtaatagtactatatatgctattgcaattaacactaatatccagttagcaagctattaactagtgtggaacatatgtgaatttatgatataccatgacgtcgaagtggaaataatacgatgacgttagagccattgtaacttatctaataatttacaaaatacatcaaaatgtacaagtacaacctaaatttcaacttgtttatggttgaccgacaacgttggatttgttaatcttgcctaaagccgaccttaactgcttcttgtaaatccagacaaactagtattccttggactgtgacatcttgagtcatccttgaaagctcaatgtatgacaagatgaacgacaaagtgcaaagcataatttccattttattctgtaatcaccttttctgcacgttggtgaaatcttaacttcgaattatcacaatttccatttctccctccatggatgaacataaaattggtggtccacaccacacgagtcatcaaagccatccaacatctaaaatttcgtctgaattctcacaatcctttgtagtgtttttttatacaaatcatagctaaatacacaatcatgcacagtacacaccatgcatctcttaataaaatttggccggggaacatttgttggctcagcaaaaaatcttgtttcattttccttttttttttctaaataccatggcctcctgaaacagatcttatcccaacattttctgatgtggtcttcttttagaacaacaaaaccatgagtaaatcacaatctccaaaaaggtgaaccgagcaatgtcaatataaaagcagccgtgcacaaactaaaaactgaaggaaaagaacaaattaaaagtgggaaaaatctatacgtactaactttttcttactaaatttttactaacattgacatgtcgtattatgagtgcatttagattttttatatcttccatctacttgaatcaaacagttgagatgattgttagtgcaaatttagtaagaaaattttagtacgtgtaacagtgctcttaaaagtgcatctatctgtcgtgtgcctgcatcactagatcactgctggtacacatatataggctgcccaattttttttcctgcatatattagcagaaaaaagaaaggagataaagcaccgtttacttctttcggccaccgatttctccaaaaacgcacgcttctttctgtctgaacttccttcagcatcaagccctttcttttcagaatatcttcagtctcactcttcaggcatctgtatatatcacaacaccacctggtgcttaggtttgttagagagaaaaaaaagtgtatttaattagtgttaattgcaagttatgatgcaatgttatatccttttggttttggaggcagcattaagttgatttgtgtaaatgatttgttttcttccaagaaaacttcatctgaaagtgttcttttcttcagagcagcagagcatgtgtgcagtgttcctgatcagtacttgtgtactattacctgtcaattgctaagagcctttaccaaaaagtttcaattatttggagagacaacacacttattgacaaagggaaataaagcattttttggcactagaaacaaaaagcaaattatatccagtttataataaggcaaagaaatggtgaaaaaagaaggtaataatacatgaatgtatctgcaaaaaacgtgatgactttctagatgtcttcctcttcaggcatcaaaccaccacctggtgcttaagtttgttagagaaaaaagtgtatttaattagcgttaattgcaagttatgatgcaatattccacccatttgatttgtaggcagcattaaggcccgttcttttctgattttgagatgctcattttcatttgcacgcttcgcctctaaacggtgtgtttttaaataaattatatataatttttttcttgaaataccttttaaaaacaacctttctgctctttagtggttaatttattttttataccctcaaacagctatcataaaatcaaattatccatcaatcaataaattttaggcatttttaaactggtttagtttccaactttttttttcaaacttctaacttttcaaacacatcaaaactttcctacacacacaaacttccaattttttcatcacatcgttccaatttcaatcaaacttctaattttgacgtgaactaaacacacccttagttaatttgtgtaaataattgttttctttccagaaaacttcatctggaagtatgcttttcttcagagcatgtgtgcagtgttccccagtgctacttgccaaatagtattgccaagagcctttacaaaaagtttaatttatttggacataacacgcttatttataagggaaataaagcatattttgcactagaaacaaaaagcaaatatacccagtttatactacaaggcaaagaaacggtgcaaaaaaataaaaacaacacaaacaaaaaagtagtactaatacaggaatggataagctggtgacctcattgcaaaaatagaggggcgtatttgcaaaacgtgaagactttctagatgtcttcctcgataaggttccagataagtccaataacttccatctttttatttttttcttttgaaaaagctcacctatgcactttcatcaagctaacatgtcattttaaactaaccaccaaactgttttgtgagctctgggcaaaagaaaaaaaaagacataaacaaaaacaaaatgtcaaccaaacatctacaggtactgtagatgataataattataggttttttactagacaacatatctgtctgaaatgagttaattaatgtaatagcagagcataaatgcaaaaaaacctctacaattctagatttatagagggataaataaaacagaataatccaacaataaatgtgctttttaaagctaaataaatctaatttaacacacttaagcaaagcagctgagaagaaaaaggtaggaaaaaaaaaaaccccggcgtcttctccagttctgctccacttgtccgtagtctctccactacagtccacacacaacgccgaaccctgcagtgcctacctacccgcacgaatctcaaagcaccatccgacgcctcccccagcttctccctccccctccccctcccccatcgagaagaagaggagaaaaagaagaggagagagaaagagaagagactagtagtagaggagagagaaactaaacccaacccaaatagggggaggaggaggaggaggcgcaaccaaacccaaccccgccgcctccgccgccgccgccgaggaggatctccgtcgaaggcccaccggagctcagcttgcggggaactcttctagcggctggagtctgatgcgtcccagcccatggcaccccacctccacctccggttgctgctggtcgtcggcgtggccctcgggagcgcggggctgggctgggggggaggaggaggggagggggaggcgacagatcgggaggcgccggacccgtactcgatcctgacgtggcacgactactcgccgccgtcgccgccgccgccgccgccgccgccggtggcgcccgcggccacctgcgagggggacctgcacgggaaggggaacttcagcacccgctgcgaggtctccgaggaggtggagctcggcggggacgtctacatcaccggggagggcagcctcgtgctcctcgccggcgccgccctcacctgccagaggcccggctgcgtcatctccgccaacctctccggcgaggtccgcctcggccgcggcgtccgcgtcatcgccgggagggtctccctcgccgcggccaacgtcacaatcgccgacacggtcgttgtcaacaccaccgcgctcgccggcgatccgcccgagcggaccagcggggtgcccacggggacgcacggcgacggcggcggccacggtggccgtggcgccagctgctacgtcaaggatgggcagacgcaggaggactcgtggggcggtgacgcctacgcgtggtccgacctcgagcacccgtttagctatggaagcaaagggggctctaccagcgttgagaaggactacggcggaagcggcggcggtatcgtgtggctgtatgccgatgacctgataatgaatggcacagtgctcgccgatggaggggatagcagcgagaagggcggtggtggttctgggggaagcatctatatcaagtctaagactatgtaagtgttcttagaattgcttcaaattccttcctgcttcctacatgtgctaattgaaatgatgcatgggcatttaaactgcctaacaaacttgcagattagaaacagtttccaaagctgaggtcacatatgaatatattggttcagtaggatttatttcgtatttatacctgtttttcattttgttattaatgagtcatggatgcggggaggtagtactaaacatattagggatttacagaggcttgctcggtctaatagatatgagaacaagatttcctgtcatgctgtttatatttttgttaataaacgattagccgccacaatggaattgcagcttcttcaacgaacaaaaagaacatgaagttattaaatgttcagtctggttgtaatttttcttaacacttgagaagttaaggactaatgtgataggaatgtatgagtttagcatatttagtatgtagtcatgagctcaagcttgactatggtactagacaattggatttgaggatttttttttgcactaggtgttaataagagaaattaatgtcacagtccagattagttcagtggttaaattatgcatataattgattgactaataaatgaatataggaatagtttcattttattgttaccaactttcacaattgcacatatttggtagttcaaaccaatccagctaaacactagaccaccaatgcagtaatgagtggcatttgagttgaggaatgctttcattagcttgaactagctgttattttggtttgttataaatctgttgactatgcgctctagtatattcaataagcccatgcagaattgcaaactttccccttctgatcttctgtttgcaacaggcatggtgctggcaagataagtgcttcaggagggaatggtctggctgggggtggtggaggacgcgtttctattaatgttttcagtagacatgatgacacccaagtttttgctcatggtattgtgcttggtcttatgcacactgtgacactgatcctttcttatatccctgaaatgcagattatcaaatagcaactatatatttgcaggcagcatgatcgtactgtattgtttgtcgcaaaatattctgagactcctttttattactgttaggcctcagtatgttattagtcttttgtttaatgagatgaagctcatattctgagtaactttctaatgatatatagaatatggatggagctatagtgtagacaattttattgttttgtttatgtttgaattaacgtttatacctttttcaggggggaagagttcgggctgtccagataatgcaggagctgccggaactctttatgaggctgtacctaagagtcttgttgttagcaacaacaacttgagtacacaaactgacactcttcttttagagttcccaaatcaaccactatggaccaatgtttttgtcaagaatcatgctaaagttgctgttcccttgctatggagtcgtgttcaggtatgaatctgtatctttcagatgttcattaattctctctctacagatcatggtttctttactctttagtatgatatttgccattttgctgtcataaattcattggtttctataatacttacatgcatatgcacttcaaattgtaagactgttaatctatacttactcttgttcctctttttgcatcagtggtagcacgttgaacaagtgtggataaatttgtactgttagtggtggatccacccattcggtaggttgggtcggctggcccagctatggtccatgtcaccccacactccccagaacccccttttagtactgggccgcccatattagccattatccaccagaccataagaagcccataaaattaattaagtactccagtccagtcatgagacaatcaatcgttgttccatctttcaatttcgtgatgatgtacctctttgccagagcacctgactattcatctttattgctcttgtcctcttcgctgtgccggttactatgctagctgccagagtcagtctgtgctaacactgtgccgtgcgcgggcccgtgggcacacgaccgcgcctctgccggtctgcccgatgccctagccagcagccagctatggagaggcgactctagaattatactctattgtgtatctttgatgttcttttgtgccttagtttattgactgtaatatgtttttttaatacaattacaatataaatatggtacagtatatgttgcgttttattatctttatcgagaatttttgcccccatttttattttatagctgcgtctgccactggtacagtatgataatttacactcaatcagtaaggtctatacatgttctttttctgagtttgaggctgtctctgcattttggcaagtcacatatttcttacagtttccattattttgcactgcacttccttcacgtacattatgcaaatgtgggagttgccattacctgataattaggaaaatgcttgtcaatattgctttgcgcaatatttaacgatagtccgcaactttttatttatactttcaggtccaagggcaacttagtcttctatccggtgctattctaacttttggtttgacccgttatccatactcggagtttgaattgatggctgaggagcttcttatgagtgactcaacaatcaaggtgttattttactatttgttcttgccatgtattgtgttgttttatggtattcaccttactatatgtgctaaacgcatgccaatttctatgcaccaatatgaattgttttcaggtgtttggtgccttgagaatgtctgtaaagatgcttcttatgtggaactccaaaatgttaattgatggtggtggagattcaatagttgcaacatcgttacttgatgctagcaatttgatagttctaaaggtaatgttcactgtcaatgactctttttctcttctctgccttaacacttcgcataaaagttctgctcatatatttgtcaggaatcatctgtaatacactctaatgctaatcttggagttcgtggtcaaggtctgttgaatttatctggagaaggagacataattgaagcacaacgacttattttatctctattctacagtataaaagtatgataaccctttgttctactgcattttgctttaattctccacagcttttctgtagttatttatttttatctaccacatggttgttgcaccttcaaaggaaaggcttttgactttaacatggtgggtctggattagcttctttgccttagttcccataaaggaaagaaagtaaagactacatttgctccttgaactctgctcggagtccactttccaccttgtaactaaaaaaatggttactttttactcccataacaaaactggacaactgtcactgacagacaggttttagttttagtggtggttttgccacatcactcttttgtgccatggtgctgacatgtttagggggtgtacgttgttctgactgtctcagtaaagagtggcagtgggggcgtgcacctgcgcatatttagagcagctcttgctggtgctggagtggtgaaatgtaaggtgatgttcttccaatgacagctggacaccattcataagtgtggtccacctcaatggaaaccaccattaaaactagtattgggtgatatttgccggatttggaagttacttttgtattttttgggggtgggtgggttgaaaatggctggattttggcttagattgaatattagactcctgccagagttagggggccaaaaaagtactttattttaaaaaggaaagacatgacagtgagacagacagccagctttctaaagaaacctgtctgtgatgtgatttgcttatgtatattggattattggataaaattttcttcacctgctgtgtgctattgcagaattaattatgacgtgatcacttctgcatactttctttgttttggtgtattattttgtattttccctgtacttgtagttttaggatctgtacttgtactattattaagaagaggttgtgataagcatttcttttgtaggttggacctggctccattttacggggtccacttgtaaatggaagtagcggtgacgtgtaaatactgccaccttcaacattgaattgaaattatcttttcttatgttttatatgccaaaagattcatctcatttattcttgtgtgcatctattagggcaccaaagctgaactgtgatgatgacatctgtcctgtggaaataatacacccaccagaagattgcaatctgaactcatcactgtcatttactcttcaggtgcattcagtttttgaaccttaccttgtgatgtgtcatggatgggttcctttgctagtgtaatgcaaaatttgaccacttctctttcaggtatgtcgtgttgaagatattgacatctggggtctcgtacaaggaactgtaattcatttcaatagagctagaagtgtcagtgtgcacacatctggtaccatcagtgcaacaggcttgggtaatttttgtaccttccttttgtttaccattctgtatcattggcttgttccctgcacttctggatcaatgctgcagaaatttgtagagttgctgggtttctaagcttaagagagtttaagcttctggatatggtgcacatgtactacgatgttgaaactcagagggctttgtcatctcaagttgcagtatactgtttacataccttgcagcttcttcagtggctaattcataaataatgatgagaggagctatatatttgttttattttctattttccttcataattcaaaaaaaatgctttagtatacttaactacatctggttgtaactatttcaccacaggatgatcttttgtttgatggtatgctgttggcaactgatcccagaattaattttcgtatcttctaatttcaggctgccgaagtggagtaggacaaggaaagatattaaacagtggtgtaagtggtggtggtggtcatggtggtagagggggggatggcttttataatgaaagccatgctgagggtggatctatgtacggtagtgctgatttaccatgtgaacttggcagtggcagtggtaatgacaccacaaagctttccaccgctggtggtggtataataggtaacacaattgttcaattagcttacctacgtttattattaagttcatagattttaggactcatgctattgctgtaactgcactccagtgatgggctcatgggagtattctctaccaagtctttccctctatggttcagtagaatcaaatggtcaaagttccactgatgtggtaacaaatgcttctattggaggacccggtggtggttctgggggcacaattcttctttttgtacgtgctttgtccctagcggagagctccatcctttcaagtgttggtggtcttggaaactttggcagtggtggaggtggagggggaaggattcacttccactggtcaaacattccaactggagatgagtatgttcctgttgcagctgttaaaggatcaatacgtacaaggtcggtctgattctttctcctatacatgttctagtattctagttctccaggggaatgttcaacactgtgatacaagtcgaatatggtttgtctcatacaatttgcttagttttagtatggacccttgtgatggctacgtattgtgacttgttcactacattgaagctttttctttataacattatcactcagttatcagggtatgaaacaccttaagcaataattactggtctgagggcaatgtaagatatgaaaaagcatcattacaggaaaatgtttgctttgataatttttttgacttttgaccctaatccgtaatgaccaaattgaaaatgttaagacggtatttatatgtagaaatactttgatcttatggaattctggcgtagaaacaagtcactgaattctgattgattatactattataaacgtgctgtgattgaaatttgaatctgtagctttcagcaaattccatgatgcagtgtaatttgaattctgtcctttcattgccagttgtttgtgcaaacaatagacatgtggcatgcctggaatttttatgtgttcctctcgtgcactgaccaaatatccttatacagtggaggaatcagcaaagggaaaggatttcctggcgagaacggaacagttacaggaaaagcttgcccaaagggtctctatggtacattttgcaaggtaacttgctaatatttcatagttccatctgccccttgtcttattatttagttgtaacttgcattgtaaaagttgattcaaatacaccaaacaacctactcaattgttctgtcattataatatttgatatattaccccatctagtggcattctgttgcttacatctgctgtaatgctgttgctacctaatgtggttgtaattatttctgtggaaaatgcaggaatgccccttgggaacgtataagaacgttactggatcttctaaatctctgtgcgttcaatgccctccagatgaactccctcatcgtgcgatttacacaagtgtccgaggtaattctttctctatgcagtttttgatgtgatatagcggaaatgcagccaaggacaaaattttaacttgtttatctaatttctaaatcaattaggtatcataaatctactgtttttagatttatcttttgtttttctcctttgtaacatgcagcttcatctatattactttgctattggccttgcatttacttaagtttcaatactgttgtgcaagcttcagaagatgctttaactttgcttgaacattctaatctctaacctagcttatgtttgacaggaggtgcttatgaaaccccatgcccatacaaatgtgtatcagatagatatcgtatgcctcactgttatactgctctggaagagttgatatacacttttgggggaccttggttatttggcctattactttcaggtcttcttgttttgttagctcttgttttaagtgttgccaggatgaaatttgttggtactgatgagttacctgggcccgcaccaactcaacaaggatcccaaattgatcattcttttcctttcctagaatctctaaatgaggtattttatacaccgcttccgtcatgttgtgtgccatatgaccatcatgggttctcatagaagttttttttgtttgttgcaggtcttggaaactaatagggctgaggaatcgcatgggcatgtacacaggatgtatttcatgggccccaacaccttcagtgaaccttggcatctcccacacaccccaccagaacagatttctgagattgtgtatgtgtacatgccctcacatagatctaactactacctgaacaaattcaatgtatcttctattttggtaattgcatatgttttatccgtgttacttttgcatgcaggtatgaggatgcatttaaccgatttgtcgatgagataaacactcttgcagcttaccagtggtgggaaggatcgattcacagtatcctctgtgtacttgcataccccttggcctggtcatggcaacagttccgtaggagaaagaaattgcaaagacttcgtgaatttgttcgctctgagtatgaccattcgtgcttacgttcttgccgttcacgtgcgctttatgaagggctcaaggtttgtagttctgttttaactatttctagattgctaccacatgcttatctctgaggtcatccttccctagcctaagaactgaaatcctttgatgtttcactctatgattttttttttttacacttcaatagcagagtacctactgcatgcttctataactgaatgctatcagaggattggagtgcaaagttaccagtcatagaagttgtatatcttaaatatgccatattgcatgaataagagttgtgttgaatgtataattagaaaataatatctataattagaaaatatcatgcatggttggttgaaccatttgtgagtgactctgctataaatctttcatgctcttttccattttggttctttggacaattatgaactcattacatgtttttaccttcccagaattgattatatcttggaataaaattattaaatgaatgtcatgtttgatagtgttgtgatgcttggaattaacatctgcctacttcataaatctttaggtgactgcaactcctgatcttatgctgggctatttagatttcttccttgggggagatgaaaaaaggcctgatcttccacctcgtcttcgccaaaggtttccaatgtgcttgatctttggaggtgatggaagttacatggctccattttcactccatagtgatagtgtactcactagccttatgagtcaggtatgattttaagatctttctaactgcattagttatgttctgaagctttttcttatacttctataacactattttaaacattacaggctgttccctcatcgatatggcaccgtcttgtagctggattgaatgcccagttgcgtttggttcgacgtggaagtctcagaggaacatttcttcctgtcctcgactggcttgaaacccatgctaatccctctctgggtgtgaatggtgttcgtgttgatcttgcctggttccaagctacagcattagggtattgccaacttggtcttgtcgtttatgctgttgaagaaccaatgagtgcagagcttgatggtagccctagaattaaaatagagcaacattcactgtgagttactatttttattcgtcctgatcatttgttttctttccctttttcattactatttattcctaatgacttgttgcatcatacagaacacagaacatgcatgctgatactcaactaggccattctagaattaaggaagctcttatgcgcaaaaggatcacaggcggaattcttgatagtaatagcttaaggacgcttaaagacaggagagatttgttttacccgttttctctcatcttgcacaacactaaaccagttggccatcaggtttttctctgccattattacataagactcttatgataaaattcctggcatttgcacttaccataattctcttgttcttaaatgcaggatcttgttggcttagtaatctcaatattgcttctcgcagattttagcttagtgttactgacttttctccagctatattcatactctatggccgatgttctcttagttttatttgttcttccacttgggatactatcaccttttcctgctggaataaatgctctttttagtcatggaccacggcgatcagcaggccttgctcgtgtgtatgcattatggaacattacttcactggtcaatgttgtaagtatgctatgtccatctgcatttcattgttgcatgcttatttgtctatattgtattttgagatcctaagacggctgtagttagtgtctgccattattcactggttttagctttccccgattttgttcttattgttgatttatcttcataatcctcttcccatgatattcaggttgtggcttttgcttgcggccttgtacactacaagtcatcaaccaaaagacatcctagtacgcagccatggaaccttggaacgtaagtgccatttccctttgcagttatatacaatacaactaaatgcaattaggatatggatgcatttttttcccctttgccttgtcttgatcctcctttcatctcatcggcgcattttcaattctatcacagggatgaaagtggctggtggctcttccctactggactcatgttgctgaaatgcatccaagctaggcttgtcgattggcatgtggctaatttagagattcaagaccgcgcagtatatagcaatgacccaagcatattttggcagtcatgacacttggcattactactactaaaggttcttttgggagctttttacaactcaattttttgggagttgataaaaggaagggtgggggtactcaaagcacggcctttctttattgacctttggccgaagaagaagcaactactacagtgggttatagatgcaatttccgcgtccctctgctaatcatatgtgcagtcacaaccaacctgtattttggtgttgtatatataaaaaaggtgtacttgatccattatttgtaggatttagacaccatagagtttataaacagttcccaagctaactgaagagatgtgattttgttgttgttgctactgctcttgttgtcggtgctatgtactttgcctctagatgttgagctgggcaaggcaggcattgactgtgaaacttgtactacctgattggataacacaagtgctaacttggctgatggttttcatccctcatcattaacccaatgcaatgctgataccaccgagttgtgacaatgtgttcgctcttggatgtgcaatgcgcgtggatgtgctatgtgtggttagtgtgttaatcttgttataaacgtgtgttctgacttgtgagtgtggtatatcaatctcttataagatgttattgttggaaatttggtcacaattcagcatattttaatccaaaatattaagataataaacatgacgcttataggatatgatctagtgcaattgataaattggagcatcatgaacatgtttaatactccctccgtttcaaaatgtttgacaccgttgattttttagtacgtgtttgaccattcgtcttattcaaaaaattaagtaattatttattcttttcatatcatttgatttattgttaaatatacttttatgtacacatatagttttacatatttcacaaatttttctaataagacgaacggttaaacatgtgctaaaaagtcaacggcgtcaaacattttaaaacggagggagtataaaataagcatcaccatacacaagacaatgcaataacattgcgactgatagtagcagaaaatggagaaccaacagtaacggtaaaaggttatacccaagaatggccaaaatggagaatcaacggtaacagtaaaataaaatgttatactccgagaatggctctccgctggagtttgagaaagtattgcatccccgagaatggccaaaatggataaccaatggtaatagtaaaaggttatactccgagaatggccctccgttggagtttgccaaagtattgcatctgttgatgttgttagagtttgagaaagtattgtaccagttggtgttgtcgttcccattcacctccttgtctccggtgttctccgtggacatgttggtgaaggcgcagatgaacaggagcagtcgcatgttggtgaaggtgcagatgaataggagcagtcgcgcgtagtgctcccaaaaacttgagcgcccgcctacccgtgcaagaacgtaagcggacgcagttccggaggtatgcgaaggtagcacaggaacagaagaacatccggaaagaaagtgcgagagttggaggaagaacagaagtgcaagctccctctgttcgtcccgttagcgaaagatttgtagcgcatgcgagagttcattcagagaattcaatcaacgcgattaacttgagccgttagcgaaggatttgtagcgcatgcgagagttacattcagagaattcaatccacgcgattaacccgagttaaagcgattaatcaccaatccgttacgtgagttaatacgcgcgattaatcaccgatccacgacttaatacaccggatttaatcaccgtccgttacaaaacgagagagagagagcagccgccttgcccagcccgctcggcgcgcgtgcgtgtggctgactgcccaccatctcaaccggtcacacagagactctctgctagcttcatttttaagttgaggcctctacgcttagttttccaatgtggtattaatacccatagcactaaatgtaggcaatggaatttattaggatttaattgggcctagcctattaatctaacagttatggcatatcaatctctcgtctagattcacttatgtacatatgaattttaacacatcaaatacacataaatccgcatgaacctatccaagacccaaaacttcttataagtaaaacagaggaagtaaaaattaaggcatgctaaaaacggatgaagcctcgattgatagcgatcagtatacatatattctacaatttccttcatttcaaattataagacatttcagattttgaatagattcatgcgcggatcaatatatgtgctccatatatatgtaaattcatatgtatgttaatgaatgtagacaaggattaagaggctaaaacgttttataatatgaaattgaggctgcatttttatttgttctagtcccatattttggttttgtggtttaagtaaaaaaaattatacttaatcatcaaattttaattttaaaaatttatatagtgtaacattgtaagatttaggtttttggattaaaaaaaaacttctatactagcagtaattgctagcataggatttttttgacacaagtagtaatactgccatttttaagtgtaactgtgccttttttttttccaaagtttgaccgtctatcttatttaaaattttttatgtttagtattttttactattattagatgataaaatatgaataaaactttatacgtgacttattattttttatttttataatttttagataagaggaacaatcaaacattatatatagaaacccacacacttaaaataggacggagaaagccgtactaattcactacatcggcggtttgtttagcaatttgaggaaaggggattgagagtttacacgagggaggaattccctcccaattccacccttacctcaatttcccatcccaattccacccttacctcaatttcccatccccatccctgttccaccaaaattctgatgtctccaaaccaaataaaacaattaatatctcacccctcacccaatccctcctaaggctgtgttcgctagagcctattcccaaccagaacagtgcacacagaaaacggaacggtctattaacgcgtgattaattaagtattagctattttttttttcaaaaatagattaatataattttttaagcaactttcatatggaaacattttgaaaaaacgcactatttaactgtttgaaaagcgtgcgcgcagaaaacgaggaagatgagtattccctctggtttcattttaattgacgttttggacaatgacacggtctacaagatacatttttgaccttatttttctattataatatatataataaataaatgcatgtttacttttattatagtattttaaaagacaaatctatatatgttgttctagttcctttaaactaaatatttttaaaagttattgatagtctaagttataaaagtttgacctcaaccttattcaaaacgttaattaatatgaaaccggagggagtaggtaactaggctggctgtgtccctagcacgcaaaacaagcagtgtttagcgcatgcttaatcaagtactctagctaaaacaaattttaaaaataaattaatgtgattttttagagtaatattcctataaaaaaacttttgtaaaaaatacatcatttattagtttaaaaaatatacgcgtgaaaaacgagaaaggtgagttgagaaagtgaagataataagaactcagtctaaaactccctcaaaactaactggccgcggctgtaaagaaaaaagaaaggaaaaattactacacctagtccgaccccgaccgcgtctcgtcggttccccgccacaagcccacaaatattatgcgagagagagagcacccgttaccgcctccctcacctcacgctgacgatcgccaccgcctcccccgcaaaaccgtcgcgccgactcactctcgccgccgccgccgccgccgccgcgagatccgatcgccatgacgatctcctagtccctcgcctcccgcctcggccccggcggccccacgaggtggagcccctacgcccgggcccccgatcccggccacggggcggggaggagctccgttcctcccggtggtggtggtaactcccgccctcccctccgcgtcgcccccgccacggcgaggctcctcggccaccccgcgcggaagggggccgcggcgccgcccggatcgaggtgccgcgcggaggcggaggcggaggccacagccgcctccgatgctgcctgccctaacccgccgcggcgtgggtgcgaagagacgaacccgaacccgaaccctaagagaaaccctaagccggcggagagaggggaggagccgcccgtccgcgccgtcggctgcggcggattcgccttcctctgcgccctcgctggccacaccgaggtgattattgtctccccccactcaactattttctgcgatgaatttgcgtcgattctataacctaatcatatgatgagtgaggattttgctatattctatataacctaatcatctgacgagtgaggaatttggtcgattctataacctaatcatctgatgagtgaggaatttgctcgattctataacctaatcatctgatgagtgaggaatttgctcgattctataacctaatcatctgattgagaggaatttgcgtcgattctataacctaatcttctgatgagtaattgtccaacgctgcaggctatcagtgggatctctctgcctgtgggttccgacaagctttactccggcagcgctgacggctccgtccgcgtctgggactgcaactctggcaaggtagctgggctctccgctctcggcactcccttcaggctctttacgcacgattcaagttgagtaaattcaagttgggggttgcatctgcgtcgattcctccgttgattgtggcggtctttgaagtgcttccatgagatcaattggggagtactatctgattgcttcctgtggtcagacatattggtaccaaatcagttttttctttgcaagattggggttatcggcatgccggaccgaattgttacgggaatcttttcgcctgcttgtgtactgttgatcagtatatcagggtcagtttgcgagcaaggcaatgaggctggtttggctgataagcaaggggctctctggaattacattacagttctctctggctgatggtccatacatggttttgtcaaaaaaaaagtagtgaaaaaaagaaagagaaagtaaaaaaaaaagaaaaaaaaagatgtgagatgattgatgattatattttcttggaaagagaagactgaacaaggaggaaaagataggtgtctggctgataaaaaaattctaatatttattacattgcattgttttcttaatgtttctgtcatagtgcgttgatgccatcaagatgggaggcaagattggttgcatgattacccatggcccatggatatttgttggaatcacgaagtccgtggaggtaatattttaatttcgttgatttttttttgtgggagtagtccattttgtgttacatattgcgatgttactattgtgcattgaactgttgatattgatccctacaatgaattgtaggcatggaacacacaaacagggatgaagtccagtctccgtgaaccttctggtctggtttgttccatgactatcaaggatgagatgttgtttgctggtaccggagatggtcgcatcatggcttggaaaattcctgacaagaagggtgactctggaccagtggcaatcctcagtggccatgagcgccaagtgatttcgctcggtgtctcagtaacaaggctttactctggctcacttgacaagaccatcaaagtatggtaatgctgcaaaacttgtgcaaacttgtgcttctgtgttggctactaaggagtattatgttagtactagtatttgaccataaaactctattcatcaggtatgggaccttaaaactctgcagtgtgtccaaacactctctgagcacaaagctgctgtaacatctgtgctttgttgggatgaaaaactattatcttgctctctggacaagactgtaaagatctgggctgcttcaaagtctggagaccttcaagtgatatatacccattctgaggagcatgtaagttctactctggcctgcatcctctgtagcaatggttgcacaagttttatagcattgaaatttcaggcacaaatttatttagctacttaaccagttaaaatagtcaataagatgacatttttgtgtatctaaactgcatattaggttgacatgttttttgaccggagggagtactattgtgcgtattttcttgtgttgaacattactattctccaacactcaaatagtttctggctgctaaatcacttagggcatttttatttcagatgatgtagtaactaaattaaacttagtttaagagttaagtcacattactttctgtttttaaactgcatttcaatgctaatgcagttatactatgttgaatgggagcactacgtagcttttgcacaattaaaaaaaagacactatgttgaaaccttctttttttggggtggtcgtgcctagcaccaaatatggtatataaactgcactgtttactatctactttacttttctatcttttatttatataaagtttttcttggcgtgttctatgcattgagcagctccttcctgttgtcgaatggcagcaaaatcccttcataagcacaattagttctcttaattgacttggaagatctttgctcaagagtagttttgttgccgcaattggtcttgtgttatttatgtctattaatgagtccatcttcattcagtcaagcaagggtaccttcaatatgtaggatttcagtgttctagacttattctgtactgtatgtaggggtggaaacgagccgagccggctcggcttgcagtggctcgcaaaaaactaggcttggcttggctcggcttggttagggaaacaagctaaaacttaagctcggctcggctcgtttcctggctcgagccagctcgagctggcttgcaagccttcctgttgaaacacctcttcatatatattttgtaattattaaaaaaagtaaaaacaaatcatcaacatgtaaaatttaaataagtttttatattcaattcttcaaaatcttgatgataaatttcaagttgacaaataataacactatataaagtaaaataatcaatataaacacacgatggcctaggctcgcgagctaaaacaagcggctcgcgagctagctcggctcagctcatttcagcaacgagctaaaaaggaggcttgggcttggcttgtttggcttacgagctgagccaagccaaccaagctcgagccaagcccgagctgagctcacgagcccgagctttttttccacccctaactgtatgggtggttcagtgttcttggttagctggtagtgaagagtgaacttataatgatcagcatatttcattgtggcatcaagaccaaggagagaccctctacccgttttctatttaatccttgtaattaatctccatattaatcggcttggagaaacgaaacgacgttactgccgctgcatgattgcacaggcaaggaatgttccatgctgcatgcagctcgaaaatcgcatggcctactcgatctccgtgataactagttaatccatccaacatgcacatgctaccagcgttaatatgctgatcaaatcggaatatctccactttcgttatgcgctgatcattatggaatggagggagtaataatttggttggctggtagtgaagagtgaacttaaagtaataaggactaaacatccgcttgggaaactttagaaggctgctcagttcatctggttcccttgaaagagtatcaataagggagtatgatgtaattgaggaagctattgatggaagtgtctcaggctctcagcaacaattgaatgatttgtacaatctgcatcaaagcatgaacaaatggggtcgtgaattgtcaattcttagttctggatattcttcttgcttttctgcccagtattgctaccaaccctctatatccaagtattctttaatccttttcaagatactgctctagaatctgttgatcgctttgggtgtttttgttgtggtgcttgttgtggagaaacattctgtatttattgtggtgcatggttatggaaaccatgtaagttcaatgctagtgtccagtttgcaagttcagttttctttggatgagaatgctctgcttctgaaccttactcctttcaacagtcttcagttgttcccctgttgctaaacatgcacttctgttgcagggagtacgcacgctctttggcatgcaccgtgttggaaagacgccagttctgttctgctccctccacaacagcaactgcatacgtctgttcgacctgccatcgtaagtgcataaaaaatctgtaggccatcgaagaacgtactgctcccttactggaagtctcaaaaatggtttggtcttggtctttcaggttcgacgagatgggcaagcttttctccaagaaggaagtgaggaccatcgagctcgcagccggcggcctcctcttcaccggcgacggcgccggcgagctgaaggtgtggaggtgggcgcccgaggaggagcctgcaaccccggcgctcgtgaaatcatcaatgtagaagcactgtagcgtcgttgagtaaagatagcagctcctgcgaattgtcgtgagctccatctcagaatccatgtagtaataacttatgacaatgctgatgtaaatatatttgcccaatcctgaggcctgattagcaatattatgttccattctcccatgcactgtctccattaattgatgcttgagttgcgtgccataccaagcctctacttcgaatgtccacaaatactctgaatgtacgacgacgaccattcattttactttagaaaaatatatataaatatgatttttttaaggtataaatattatttattttattgtgcctggtggttttatcataaaaaactataatattaacttacaccttcacatatttatagttttatactaaatttttaaataagataaattattaaacgttatatgataaatcacggtatcatatattcattacaggggagtatatataaatatgattattttaaggtataaatattatttattttattgtgactggttttatcataaaaaaatatagtattaacttacaccttcacatatttacaatatttacagttttatactaaatttttaaataagataaattattaaacgttgtatgataaatcatggtatcatatattcattacggaggtaatccatccgtttcaggttataagacgttttgactttggttaaagtcaaactactctgagcttgactaattatgtagaaaaaaatagtaatatttacaacactagcatagttttattataaatatataattgaataaatttttataatatactataaaaaatgtctgtgcgttgcaacgggtgaagtctattttaatcctattattgttatatggtttagttaagatgaaattcactgtgggagttcgcttggatatatatattttaagaaaatcagttaggagtccgatcgtctcaagttagcatgcacgttttttttaaacatatttcttatatgattccttctgaattatcaaaagtgaacgatagaactgactcaaatatggatatgtattttcaaaagcaaacgaacttaaaaaccgactcatacacggatgacgtaaaaaaatactggcaaaaacatcttcaatttttataattgtagagatttgtcttaggttaaaaatattactacttttttctataaaattaatcaaacctagagtagtttgactttgaccaaagtcaaaaacgtcatataacctgaaatggagggactagtatgtcattttcaacatttgaagtttgtacacaaatataagcatttcttatccaacttcatcttatgattttttgtatttactagcttattgcacttacgttgcaaccgggttttaatttaagaaaattattatcatatcttaattgttgtaaacatttgttacttacatgtgaaccttgttagctccacagttttttcctcccacaaaagtagttggtgggagtagttgacatgtgggtaaggcctggtttagttcccaaaacaaaaacttttcacccatcacatcgaatgtttgaacacatgcatagagtattaaatgtggacgaaaaaaaacaaattacacagttcgtcaggaaattgcgagactaatcttttaaacgtaatcgcgccatgatttgacaatgtggtgttatagtaaacatttactaatgacggattaattagtcttaataaattcgtctcgcagtttcttagcggaatctataatttgttttgttattagactacgtttaatactttaaatgtatatccgtatatttgatgtgacaaccaaacctaaaaattttccccaactaaacaaagcctaaacctcacatgtcgttttttttttaaaaaaaagaagatgggagttggcactaacactactctcttttataaggagtatggattgctacattgccgatgtatcaaaatagttttacctcagtcttaatctcttctaaaattgctataaatgattacatttgaactactagaaatgattgtgtttgtagatgaagggattgctctaccgatgcatacaaatctctgactgctagaaatgattatattaatttgctaaaaatgattgtatttgtagatgaagggagtacgctaccattataccaatacatacaaatctccactaaaactgctagaaatgattatatatttgtagatgaaggaatactctacctatgcacgcaagaaatggcatgctttggcaatgtggaccgtacactttgcaggtgcagtagcagcaacaccaaccgtgtggagctctcaaaatggctagacaaactaaagagcctctaattaatacaaccaatgttgtgtaacatcgctagctgctgcgttgctgccgaactcccattgaccccagccacatattaatctgacgctatgaaacaaacacgcccacagatcacacccacaaagcgatgtctttatctgttaatgacgcaaaggatcgattaattgtcgccgacatgatccatctcgtcgctgttcttgtaaacaaatgcaattaagtagcaagagtttgcatgttttcttgctcttgcttgtacggtcaaaatgttagtggtagtttattgcttgaaaaagaaagaatatttggatgttaactcgtacaatcaaacgataggctctagcctgggattgcgtataatcatggtaactaagtaataatctatgaccactggtatcttttatcgaggtcaactatatacggggctagcttatcacgtctggagaaaagaaaaacccaatgttgcttagctttgctggagtaaatctctctatatttgtgctcgaaaagtcaacgagcaaatggatgcatgtggtaaatgctgagcaaataagcaaaaagtcttgggtcaactattattttcttaattgcacagcacacaccactatacacgtaacaccacactcacaccccgcgaatgcatcccctaacacatactttaagagacggaaaccattaatacatcgttaatttcaaagtcagcgttgaaagctacttgcatgtgcgtaatatttgcggacattaagatttaaaccctggtgtatggagtcatatatccacgactccagcgccgccacaccacttatgcttccccttggggtcaactattatggttagcagccgacttgcaaatgatcattgccgatttagttacgtaacagccatgtagtttaatgagattcccagtaacatctacaagaatctcgtccatgctcatcatagatagagatgcatttttcaacccgtgtgaaacaaaggtctttgtttggaaggtgaaagtttcaaacataaaaatgtagaattgttttttctaacatgcacagtcctgcttataagaaacatatgcgctgctctcattaaatatgtgatcctcactaaatacgtggccacttattggatttgacaataagccccgtgcaaaggtttgaacacaaagataggatgcaacatgcatgtcatgagtttgaaaacaacggtcatgcaaatttttatcgactatgattaaagtttaacaataggatatgtggcgaaacaatgtgtctctatctattggtgtctggttttattttctcatatctattttttaatatataacaccgttgatttttaattgaccattcatcttatttattttttttgcaaatataaaaatatttgataataaattaagtcacaataaaataaataataattacattttttgaataagacgaatagtcaaatataatgtatttaaaaaatcaacgacgtcacacattaaaaaacagagtgaatactttaaaactacatactttgtaataatttattagctctttaaagtaaaggatggatttctcattatattttaaaaagtattctaccgcaataatgcacccacaaatttaccactatcaagtgtgttgtttctaaaatgtaatatttttttaatcaccaatcaatttagtctttgtactatgaattagggaaaaggagacccgaagtgcgggaaaaagtacattaacatgttacagcgatacgtctactataagtggcagttgtacatttttacaaacaaaggaacatgcgttaagttgtattactagtttcatcatcttcttttttattgcttgtaacccccatctcatccttccatcatacaagatgcgaggaggagctacacacttttgttttcaagtcacagtaactacttatcaacagtaagttctcgacaacattatgtttatttcattttttgactaaagttaaccgctgtaactaattaattaattaattaattaattaggcaacaattaattaattaattaatcaatcagttgaagatgtcctggccaggggagagcagcttcttggggtcgtacttgtccttcctctgcacgaagcgatcccatttggcgccaaaatgcctcacccagtcgccgcggctgtcgtagtgcgccaggtacgccttgtacccgatcccggcgaggtcgcagaacctcagtatcctcctgttctgcgcctccagcgccgccacgtcgttcgccaccgccgagaacagcagcgacaccacgtagaacacctcctcctccccctccggcgtcaccgccgacatcgccgcatcccacctacacccacccacatattgtacagtgcatcgtgacgatgatgatcttcgagaaaagtgacaatgtcggcgataatgtcaatgtgttgtgtttacttggatttgttgacggggtagatgatgagaggtccggcgatgtcggtggccgtctggaggatgcccttgaagacgccgcggtcgaagtcggcgatgcgggagcccgggacgaacaggttgagccacgggtgcgggacgcgccatagcccggccttctcgagggcctcctcctcgccgtacacccggtcgaggaactcctcgtaggtgacgtcgcgggagaaggagaacccctcctcgaagtggagatcgccgagcgccgccgccaccgccgcgtccacggacgacggcgtcgcgttcgcggcgtagttgagcgtcgcctcgatgctgtacacggcggtggcgttcctcgccgcggcgagcgcgacgacgcgcgcggcgtcggcgtcggagaagaacccgccggagctcttgagcgccacggcgaggccgcggccggcaaggtacaccgcgccctccacgtagctccatggcccgtgcgacccgtcgggccgcgccgcgacgaggcgctcctggtcggcggagaaggcggcgaagtcggcgtacacgaggcgcacccaccgcgcccgcgccggcgccggctcgacggcgacgcgcgcgcgcgtgatcacgccgaactggcccagcccgcccaggacggcgtcgaacaggtccgagttgaccgccttggagcacgtcaccgtctcgccatgccctgcatgcgccccgagtcaacgtcgtccatgtaaactttcaattaatcgcggaaattatttcaaagtcaaccccccttgttgcgagccgccaaatgtacttatcaaagacgtcgccggccaaccagccagccatggccggcgcagctagcattgagtgctggacactaacttgtacccactaattataagtaacctttaattatcatttaagaacaccgtattaaaaacacgaatattagggaatgacctaatatcaaattattagaaggggcaaggcttcaaaccaaaatcgtctagcccaccatcttgtggagctagccggaaggccctgggaggaaaaaatatgtatgtgggtaacaagattaaaattagttagttaacaatatgtaaaaaaaattctaattatgcatgtggacacattatttttgaacagattttttaaaaataatgaaaataatttacatctcctacctctattaatagatgtgtaggtaataaattagataaacataaaactcgaggttatgagacaaatgcatgtatcccttttgatcacagcatcctacttaaataccgaatagaaaacacgtagaataattctataggaatatcacatttcactctgatgtagtatagtatatttaaattttataaatgttgattgcacggttagttcttgatcacgaggtttgtatgtgtgaggattaattagctagcaaaaggagttgcagtgaggtgtacgtaattagctagctagaggcaggcggttgcttgctgtgattaccggtgatgacgtcgagctcgagcacgttggagatctgtggcccgtgccggtaagtctgcccgctgacgccggcgttggagagggtgccgccgacggtgaggtggaggtagtccgtccacgaccgcggcgccacgccgcgcgccagcgcggcgcggagcacgtcgacccacagctgctcgccgccggcgtccacgtacgcgccgtccgccgacacgttgatccgcggcgcgccgccgccgcccatggactgcatgtggacgacgacgccgccggcggcgagggcctggcccatggtggagtggccgcggccgcggaacgagacggtgaacggccgccccggggcggcgtaggcggcgcgcaggagctccgccacgtcgccgggggagcccgggaacagcacggccgccggcagcgccgccgtgatgttgccgaagtccatcgacgccggcacggtggcgttcgggtcggtccggagcttgccggacgcggcgaggtcgccggggaacgggagaggcgccgccgccgccaacggaacgccgccgccggcgccatgcgcggcgagtgcatgggaggaggcgatcagcgcggcgatcagcaggtaaatcgccgccattagcggcgcgtttaagctcgctaataccactttaattaatccgcgagatcgatcgatgagagtgtttggtaattagggattaataagggtgttgtgctcttgcacttgaacttgcacacctatatatatagatagatgatctatctaattatgcgtgtacatttatatccaggagattgttgccaaaattaaagcattaaatcacaatgggattctttgacgtataggtgatcttcagtttctatttctactgttgaccagagaaaaaaaaagtaatatgtatacgtgttgattgccgtagaatactggtatatataccacgtatttttacgttacatgtacatatttttaggtgtacacaattaatatttagctagatgtggatttggcagtatatgtacgtgtagttaatgtagtaaatatgtgcaataatgcactgaatatgatcgatgatcacattaatttaattttgtggtcttgtattaataggtatatatgactgaacattaattaattatttgtagaccagatacatcaaagtccttgtattaattgaaggtgccatatatactgcacaaataatttttctttgaaaaagcaaggagatagaataatatggtactaaaatttaattgcactgactttttttaagctttcatgtcactttaagtcatcttaacattcataagcaacgctacagaaaaggacacaaaattaacaacaattccatacctgattgtgacatatcctagtcaacaagtgatcatttattagatttaattacctgaggcaagaaaatgtgctcaaaatattccagaattgcagtcagttgggccgcctgttggatgacattttttttcagagactaatgatctggggtgttaacaagcaaatctgagtaaacattaattatatatagccattgctattaacgtttagttcatatacttgcctctggttttgcaaatgtactaagatgtatgactgcgtgtgcatgacacactcttttttgtccatttcagtaaaattaagaaaagaacatgttgatgactaggtgtggaattaaattgctagctgtttgactcttctgctgttttctcctagtaaatacttaacctacggtagatgtaaagaaaacacatattactttagcagagacgacatggatgtcaatttaattgatcaacactacataacaacatgtaatcgtaaaaagaacatcggttcttcggaagaatttcctacttggaattttggtgagcactcgatgacttaactattaagtgttactgatctgaaaaggacaaaataatatataggtcccagatcccttctgtaattctatatatatctagcatttttatgactttacatcactatcttttatagaatttattatattatcctcacaaaatttcgcaatatcataaacataaacaaaatcgtcaaatctagagtggtgtagttttaatatgtccaacttgggtaatttttacaaatataactagcacaaattaagtttatataactgttggtttgtactgatcaagcgttaaagataaaaggaaaaatatgtttagtgtgaaaatatatcttctagatgatgtgtgaagtgacatgaccaggttacacgatacacacgcgtgcgtgacgttttcataatattggaaacttctgaaccatgcatgtgaaaatttggtttaatttgcactaatttgacactttttaaagacattgctcccttgggtcgacagatgtatatgcaagtccccatcgatcagctaattagaacacatgcatgccaaagtacacgacaagggtttaattagatcaacatccacacgctgcaagttgcaacacgtcgtatctaatcaagttatttttagttatgccttacgttgcagtctgatcgatcgtgttttgttgaatgttgacccatattattccccttttgaatgtatgacatggttaatttttaatatacgtttgatgatttgtgttgttaaaataattagtgtaaatatatatgaatataagacaaaattaaattaccaataaaacaaatcataataaaaatagctatataattttttagtaagataaaatagtttgtcaaaaatcgacaatgttatatatgaaaaaacttacagaatactccctccgtccctaaatatttgacgccgttgattttttaaaacatgtttgaccgttcatcttatttaaaattttttaagtaattattaattctttttctatcatttgattcattgttaaatgtactactactactcaagtttttaaataatactcatagaagtttttgaataagacaaacgcttaaacatgtttaaaaaaattaacggcgtcaaatatttagaaaataagggagtataattaattatatactccatgaatacctgatcgatcgatgcacactgatcgatcgactggcgtatacgtgctgcctgcgtgtgtatgatgatcttggaaacatacctctcatcacgcgcaccgaagcaaattaagcagaagcagtagcgtgtcaggctatatagcttcctctgaatttctccatgatatgtacatgcatgtatgcatctgccaatgtaagctagctacatacaatgctaggtaaccaaccgtacgtgtgtcacccatgaagtttttttaggtcatcttctgccgtatttcagtcatctcttgtgcctgaagttttcagtcatcttctgcctaacgtgcgtgtcctcctagccgagatggtggattgattctgtggtcatagatcttagttgtttctcatgttggtgggatcagcatcctccaacatggcaacatatatatgcagtaggtttgtgcatcgaaagattttgtttctcgaaggttatattaaagatcttggttgaccatgaagggaaatgtagtaactttgatgaattaatggtacgattcgattatgatatatttgtagtatatttgtgcaatcgactttgtctttttacaaagactagtaatttttttttgcacattacaatggatcggaggtgtgatggtggagttgtgggtgtatgcatgactttatccatcataatttaaattctgctatccacgaatactatgcacacgtaaagtacgttttcaataggaattcaatgggactatggatatgtgagtgtgtgttagagggtgcactcgtggatgtgtgagtgtggtctgtgtgcgtgtacgttaatacactacccgtgtaataaaaaaagaaaagtgttgatgtaaaatccagcctagttggcttaggtgagaaaatggaggatcgattttcatgtgggaatacctaggtttaggcctgttttcacgtgggagtgggttagtttttttataggggtggttgcacgctatggttgatggttaggaggggttaacatgtgaaattcccttttatcgtagcagaggtttatgattgattttctattatttaatatatcgttataattactatttaattagttaggtcatcaatttatcggatacagggagcaactttgatgcgtacgttacttgactagtggagttgagcattactatgtgtatgtgtccatgatggtgtgtgcatctttcatataattgaaaaaaaaattaatatgatcctacggaatatgatagctatatatctaagctaggcaaacgccgggttagataaacgtccctaagcttggtcatgttatactatagttatatacctagtctagtttaattacttcctccatcgtaaaataagtgaatttctagttttttctttaagtcaaactatcataaagttgaattatagcaatcttatactagataagagtattaagtatttaccattctaattaaatgagtaaactataaaattatatttcggatttaatgatgctcattcttttttttcggggaagagggaatatatcactcaatcataatgttctcccgcactaaatgcgagataaaattacaactttcccccaaccaaaatccagagaaggattcagctctagccttatttgccaaataatggctgataatattcttacttcggcatattttattaacagagataaccctctccccaaccaagagcaactttgctcattcgatatcctattttttttttaaatgtgacaaaaccaggatatacacatatttgggactgagggagtatatatgtcatagaactcaaaaaggaaaaaaaaatacatatatcgatacatcgagtttataaagtgtgttattttttcatgacaagtttgcaaacactggtactagttgtattaattaattaatcaaatttgcattatcttacaacggggattgagtcgatcgaaggcagttacgtaacgaaatgttgaaaacagtgtgtggcgtatacgtacggcgcctacaagtgtacactagctagaagggcacagtgtcctagatcctctcttctcccaacttaaacagatcttgcagtatctttgcaagatattgatgaggacgataagagcaagtttaatagtatagccatctactaactccaattcatctatagccagtctaatagctcattcgtataataggtacatactacactattaatatctgatcccacctgttatacacacactgcgtcttggagttcgtgctacagctggctacaaatctatagcccgatgctcttctctctccttatttatcttcttaaaatcctgctattgtacctgctctaagcatgcatggcgatgaatcggagaccaggaatgcaagcaagctagctagacttcgatcagctcaattatattggccgtacatatatgcagacatcatcgtcgatatggtggttacattaatttgtgctgttctgcagtttgatcaagacttggttgaccccgttttaaatgtgaaattttgtacgtctgtgccgaatttttttagataatttgcgcctcaatgtacacttgcttcacaaattcgagttagtctctgtactttggtggccaaatccagggaatagtggctgactaataagtgtctcttcttgagttctttcctagcatatactccagatgacttaattaggtttagctcatgtttttttaacttttagtctatgttgcgatgcgcttcaaatctttttttatacacatctaatcagtggcggagccaagataaaattatagtgagggcttctcagccttttaggccttctaataatctcagacaaaatctattttagccctcttccaatagatatatggatttaaattttaggggggtgttaatagaggctctaatgattcattagggggtaggggg

SEQ ID NO: 62492 - DNA, 853 bp, Oryza sativa
gtacgcatagtgcgaacatattctcctttctgctcgccatgaagaggaaaatctctgcagacatgcagcctgtctcctcggcggagtgtagtctgagatgacgtgagctttcggtcgccatcgacgtatcatgggtggcatcgttgtggtgcagttggacgcttccgaaacaatcagagaaaacctcgagaagaaagaaagggagacatgcagagactctgtctgtgctgtccaggtttgccttcccttttcttcctttcatcagtctccaacctgcatgcatggatgatgatttggagagaaaaggggaaatggatgaatgatttgattgcacaagagcgaggtaaagctgtcatcatgtaccacgacctggatgcacctgtaacaagtttgtagccgtcacctacatcgggaaatattcagcctgtttttttttggcttaattatctgctgttccagcctgtatgattttcagaactactcggctgtttcagcgtatgagcagctatgattggctggctgagacagtaccactgatcactcatcattcgtgcttgcttagatcttaatggcgagtgattagcaccgagttagttaagggtttggtgaaagctactactagtgctgccggattaagatttaacggcgatggcaaggacggggacgtaccgggccgggtgtgtgcgcgggcaatgatcgtgtcgcgccgaggcggagcccagatggcgcgaatgattcgggcggcgaaaaacaaaccactgcacatgacctactacagtaccactccgtcctaaaaaaaaatactgctagctacgaatctgaacacacatatatatcaagttcgtatgtagga

SEQ ID NO: 62493 - DNA, 4019 bp, Oryza sativa
cgaccccccctcgggggaaatcaagaggagggcggacacctcaccctcgggcccgacgcccccgaaggtgccaggccacgtgggcgattatgtctgcctcaagcctctggtcatgatactcccggtcccatatcaccgacaccgtggacaacgagacgcccgtagcgacttcatcaatctcaaaatatactgacctagtcatccggaggtgctcataagagtagggtgtgtggtgctcatatggataggatatgcatatatgggtttaggggtgaaaacggccacagaaattcccgatcgacttagcgccgtttccgtataagtggtacgggctcataagagtagggtgtgtggtgctcatatggataggatatggatatatgggtttaggggtgaaaacggccacagaaatttccgatcgaccgagcgccgtttccgtataagtggtaccgtttccgaccataccatttttgggtttttttaattttttttatcacaattctttatgcattatattaatgtcgatactgagtagtttaaatgataaatatagtcatttaccgactaaccaaacatcgtttctgaagagatgctaccgattccgatagtttctgaccgttttcacccctatatgggttcatattgataagtatgtgcgtgttgcgatcgtctgtatatgtaccgtgtttctagaaaaaaatatgtagctaattttatttatgtatctagatcctaattttagccatattttggtattgagggatcaagtaaatcacgttctaaattcaacaatacaaatttttgtttgtcaatattcgataatttaaaaagttgcattcaagaacaaagcattgctcatattttcggctacttattctttttggtggtggacgatgtcctggtcaacaacaaaagacgtttgtggtaattaacttcatcaacctgaagacatgtcgatgtcgttttcggatgtgctagtacgggtaaggtgtgcatctgtgttgataggagttgagcgtacatgcataaaatttgtaatatgagcgcttgcatatgtactatgttttgagaaaaaaaatccccgtcatgcaaacaatcaattggtaatgctccttgtggtgaaatttggccacctgctagttcttaaacttgccacgagtacctgcattaacggttaattaattttagtgctaggcgcctgtatcaatgtcaacaatctcaaatatgctcgttcagtcttcaaattgttcaaagaagtagggtatgcatgcattgtgctcactgctcagcttttgaaggtatccatgggacatggtgtatccgtgtatgtgtgtgtttatacagtaaactaggtgaaaccccgtgcattactgtaagagtttagtatgatagtaataagtggaaataatgtgtaagataggtagacaacatgagcttacataaattgatatgatttatgataatttaagtagtatatagaatgatgataaggtgatgtgcctttataagagaagaaaagaagatcaggtaatttggaccatagcttaatcatctatgggataaaaaatgggatgatatggtctaatgagagaagaaaatgagaaaataacttggtccataaattaatgatctaatttgatgtgatatgccttaatgagataagaaagtaataacattaactaagtgatgatgaactatatatgtatataggatattataaaatatgattgagagatgtatttaaatattatttgaattatgtgggatgatgatttaacatctttatattttaaaactctaaaatttaatatattatagaattatagataatataatatgcttgcatcatgtttgagatttaataattgttagcgaataataatgtggtatctttgtatgttaagttttagaatctagtcgattgtaattctataagaaggtaggatgtggaaaatgcttgtgatctgtcgtccgatgtagacaaataaaatgaacgcagagacatctccccatgtgcatgtgcatgtatttctctctcctctcatccgtgagtatacagtacctatgatgcatacaatatctgctaattttatgtatgcatgagactataaacgtaagctttaaatatctttccctcaaaactacttatccaatttacgatataattgtaccattatatttgttgtaattaaatctttacaataagatcttagtcgattatattctaacaaaaaaataaaaaaatatgttttaggttgtgaaaatttaatgtttcatatgtcaaaaataagtgtttcaattgaaatttgattatgttgcacatttaagttttgtgttgcaattgattgttttttaagtgtttgcacatgatgttattcgtatgttttaataaatattttatgatgtttcactaattcatctgaaaaatgttgcatgtagtgttattaggctatttcaataagtatttttatgatgttttactgatttatttacacttgtttcacacggtgttatctagatgttttagcaagtattttgtgacgtgtcatcaattacagcttgttgtttcatttataatattaaaatattgcaataagtagtataatcatatctgtatatttatagtaaatataattgagtaaggtcttgttataaggatttaattataaaatataatggtgaaatcaaatcattgataggataagtaatttaaaataaaaatagttcaaaattttatttaaaatattgttaaaaaagaaatagagatgttacatgtagcatggtagttcatatggatatgcatgtaacctgcgtaagcgttcgtaccgcgtttgagaaaacctgtaacataaagtccaagttcctattttcatgaatagaattcaataagtcgtggtttttatgttggtgtgtccctcaatcaatttggttatgtccttcatatttcgttgtgatgtgattggtttggtctcaaattcgataataattggttctaactatatgagcagaggccgagattttatctagaaaaaaatcgctgtttttctatgctgctgaatattcgctgatctttgacctcgaagaaatacggagtagtagaaaataaaaagaaatcaggagaatatgatccaccattggcagccgagcacgtctcaacacgcacgggacgggacgccatcgtcggccttccgctgcggactccaaaacgcgtataaatcagcgtgcatcgacccacccatccggctcgactcgacccgactcaatcgatccatcccggctcggctcagctcggctcgagcgactcggctggtcgtcttctctccaggctccggagccaccaagccagatcccccacagtatcccacggtcccacccgccttgccttggccgcctccctccggtccacgaatcgccgccactttaaccaagcctccttgatcacactcctaatccgatagcttaatctcgagcgcttcgagttcgatctctcgtgaaggggacgacgagggcattgtctccctcctcgcgcgcgcggagtcgccgccgccgccgcctcgtcctcggccacgcggtgagtcctcgcgccgacctcgccgttttggttgcgtttttttttagttttctctgcagcgggatttggagacgatgggtgtcgctgtgtgtgctgtgaaatggggatttgtggtttttttttttggtttgtggagtacgagtacgcgggggaagtttcgaggtcggttgcatccggagctcccgctggagtggtctactctagtgcggatttggaagcggagaagttggagttggaggtggcgtgacggatcaagcggagtcgcgatcgctcgccggagccgtgcggattccggtgctagcgaacaacggcggcaccgtcggcgttttgtagcggtcaagctgctgctgctgctcggaatctagctaggtttttgttctgtcctaatccgggtttcccgattggatttgatggtcttctccccacgcatgagagttggttagcacgg

SEQ ID NO: 62494 - DNA, 69311 bp, Oryza sativa
attcctgcagcccgttcagagatctgggttgaatggtcaactgtaaaaagtacccttatcagacttagtgcaatgtattgtatactccattacatatcaaagagtaatcagtttacttgagaaaagttttgtcattgcatttaccttgtgtgatgtagctggcgatcatagtgtatgtattgggtccattttaaattattaaaattgtggacttgaagggtcaatttattttatattcttctatgtaactgattattcattaaccatctcttccttatcaggcttggtgaagcaatagacaggacattacttagtcatcttctgaagatgtttactgctcttggaatgtattctgagagttttgaaaagccctttctggagtgtacatctgaattttatgctactgaaggtgttaaatatttgcagcagtctgatattccagactatctcaagcatgtggaggtattgataaacctcttgtatttccccttgcattttgttcacacaaaattcaggtatacttatgcaattggtggtatttcacatgaattattcagacaaggttgcaagaagaacatgaaaggtgtattctatatttggaagctaacactaggaagccgcttataacagctacagaaaagcaattattgcagcggcacacatctgcaattcttgagaaggtgattatctgctcttacaactgtaggatttgttatctggccagaataagaatgtgatggtgcattttctagttgacccattagatcaatatatagaaaagaggtgtttactttatcaatatattatatttgttggccactaatttagtttagccactgtctcattcatgacctggcatatgatgttttactgttcagggattcacaatgcttatggaagcaaatcgtgtaaaagacctctcgaggatgtacacactcttccagagggttgatgccattgagttgctaaagcaagcacttagttcatatattcggggcacaggccagggcattatcatggatgaagaaaaggacaaagaactggtgccctttcttctggaatttaaggcatcgcttgatagaatattggaggaaagttttgccaaaaatgaggctttctccaatacaataaaagagtcattcgaacatcttatcaatttacgccaggtaggccatatttatgattctgcttgacaatattttttttcctttcttgtgtactgagttcatatcttatatcacaatattttgtaatttgctttcctactacagtcagtcttcccttttatagcctgctaaactgtttgattctttgatttttgacttgctgggacatgttgatattggccatttgtttaagaactgtgctgtccttgtacatattgctttatgttggtttcctatcgcagtccagtttggctgtgatacttgataaacagaaagctcaattcttagatttgagatatgctggtaccaatacattttgtttctgatgttcattgttatctagttgcttttttgtacttaagtagatgtgtaatttatcctgcattttctttctttgtactatgttttattttatgaaagatcagctcaagcccttttttccaacagaatcgacctgctgaattgattgcgaagtttcttgatgagaaacttcgagctggaaataaaggtacctccgaagaagagctggagggaatattggataaagttttggttctgttccgatttatacaagtaagtcactaggttattttatatcactaagtttcttctttgtcagcatcttgttctttcaatttcagttatacatgtgggacacctcctttttcaactagtcaactgtataaaatagtaaaactccctatatggtgatcatattaaagaaaaacaatttccatgagcatgtgggcggatggtttaagcattgcattgaagatgatgctataggtctggtccttcacaaacatggttataatatgtcattcttatagagtcctatagacctatagtcctctgtatgaagcttctgggagaagctaatgcacataaaatttactagtacgtagtaacaaataaaagattgaagaaggttaatattcttaattatgttcagggaaaagatgtatttgaggcattctacaagaaggatctggctaagaggttgctgctggggaagagtgcatcgatagatgctgaaaaatcaatgataacaaaggtaattatttatttgctgatggtttaaaataatattttacatgccatccaacttgctgacatacttgagtttttttttttctgtttgcagctcaaaactgagtgtggaagtcaatttaccaacaagctggagggaatgttcaaggtagcaatttgctatagaagaaatgacttttgctagtatactagcctttttgcgaactcttgccctatgtatatttagctcaaatgttgctaacttatatatgctctatgcctctatccattggtggcgtacacgatatcatcaatttcttttatttggatttaatactcttgtaaaataaaatgactttggtgctgttctcaggacattgaattatccaaagaaataaatgagtctttcaagcaatcatctcaagcaaggacaaagcttccatctggcattgaaatgagtgttcacgtgcttacaacagggtaggtaacatgtgccttgccatttttacatgtgtgctggtttactgagtagcatgttctgtttacacaacacttgtctaaacctaatactgatagataggcttcttagtccatgacatgtagctggaatatgggcaatggattatataactttataataggcgtttgctgagcatgttaacatgcaacttgatattttctatcataaatgtgcatttctgattaaatatgttgcattgcagctattggccaacatatccaccaatggatgtgaaactcccccatgaacttaatgtctatcaggtcaggccatgttctcaaaactatgtttgttggcagtaaatatttatattaactgcctggaaattaatttagttttctatttttctgataggatatatttaaagaattctatttgagcaagtatagtggaaggcgtttgatgtggcaaaactcattgggtcactgtgtattaaaagcagagttcccaaaaggtaaaaaggaacttgcggtgtcactatttcaggtagggttatttttcccaatttctttggtggtttattgtagctgtaactgtctgatcaataattagaaaatcactgatttattctgtttttcagagtgtggttttgatgttgttcaatgatgcacaaaaactaagcttcctcgatatcaaggaatcgactggtattgaggataaagaattgcgaagaacgctgcaatcacttgcatgcggtaaagttcgggttctccaaaaggtgtggctctttattttatccaaatgtctaactaattttcagtagcagcttgttcagttgtcacttttattttcagatgccaaaagggcgagacgtagaagataaggacgaatttgtatttaatgaagaatttagtgcccctctctatcgcataaaggtaatattcgtcatctaatttgtgtggggtggggtgggtacgtcgagtttgggtgtgtcatcaggcttaactaaggtaatgctgtgtgtttccaggtgaatgctattcagatgaaggagacggttgaagaaaacacaagcacaactgagagagtattccaggacagacagtatcaggtgcattaaccatctaaacttgcaaacaagaacatcctttgaggacttctagttacacttgtccccgtttagttatcctcgatttttggtataagatgttagctaaactagtatgctgtgcttatgcttcctctggttcttatgtgacgccgtagaagttttaccctctatttgcactcagcacatggtagctagtttctaatctcacatgctttttattcattgaagcaacacattattgttagttcatattgttatcttacatgctatttttcttgcttaattaatgtctgcatcttttaggtttaacgtcaccattccaaacaaatttattctggaatgtttttggtgcaaatctaatgatgaattcaatcacgggagagtaatgccacaagttccttttcttgttccgtgcaggtggatgctgccatagttcgaataatgaagacacgtaaaaccctcagccacacgcttctaataactgagctttttcagcaggttagacatgttttcaacgcatgcattccattttgcgcactccacaattttgatatcttaaaatatatcgttttcttttctttcagctcaagttcccaatcaagccatcggatatcaagaaaagaatagagagcctaatcgacagggagtacctggagagagacaggagtaacccccagatctacaattacctggcttgacagcgcttgccatcataacatgaaagctcgtcgtcttcatttcattgtcagagacattgtaaagtagtaattgaatatgtctacctcttgtttttccgacctttttctccttggaagctgtagcaatcgcaacatttctgtatacaagaaaaatgaattttcgataatatcagccatgcatcatgcatacatgtgttcctgatgagtgatgaacagccaatattttatgccagggtctgttttggggccctgccagaaaaaaaaacatcgttgaaacgaggaatttttcttgaaccctgtgaaagttgaatcgaatttcgggaaaatctgataaagtttatgtaaggacctgttcactttgatgttattttcaatcttaccaaattttggtaatgttgctaaaaaagtggctacatttagtttgttatcaaattttgatagctatataagaaatcttgccaaaatttggtaacaaagtgaacatgccttaaaattccaacaatttaaagctatatggctcggccttacgaattttccacccaatatacatgcccagatatagcccagcccatccccatgtttaagcctacccaaactaggcttaattgggcttcatactttgggcttcaagtttgcagcccattaaacgggcccacccaagcccagtctcccctccccctccacacagtcgagcagacgcagtcgagccagctacacggtacgcctctagtcgccgtctcctcccctgtctctgggcgccctcctcctcccagatcagatcaccaccggcgcccgcttccaccgccgcctcgccccgtcgccgggggacccctctccggcgacccccttcgccgcaggcaccggcgaaggtgggggaatacctctatacccgccctagatcgcgctcctgcgattacgcttcgcctgcgcgcgcgcctgccacaccggcttgggtttttggcgcgatggatccgctcaggagctacctcgggaggctcctcctcgaggagatcaccccggtggtgatggtgctcaccaccccgctcgccgaggccgcctgccgcaagagcggcctcagcgtcgtcgacatgctctcgccgttctccctcttcaaaaaaatcgacggtgattcacctccccgatgctctccgcttccgataattgtgtgtatgacgcttgtcgcatttcattcgattgggttctgtgacctcatggggaatcccctgtatgcagtgcccgtgcggacggcgagtgaccagccttacaggctgcagatgtttaagattcggatggtctacgcttccgacgtccggaagcaggactacgaggtgattctcgaactttctggaagcttctgggttgtgctgtgggcttgttcagtatggatgcctatggtttatgaatctcttgatggacattggctgttttggagcaggtggcggatcagaggatcaagccagtagtttctgaggccaatgagagtgctcttccagatctgctttcagacccaccacagctagaagatgtacttagcagtgagatcccttactgcttcattttgttatgttctcacctgtgggcatatttactttgagcaaaattatggagccgtagttggaattctatggatcacttaaagtagcgtaatccgatcaccttgacattagaagcaaactgtgacttactatgagcagcaataatcttctattcagattgtttaatttgcagaataattttaggttataattttgcgctggtagtggaagtatctttacaaagtgatcataccaaacgagcgtgtgcattatattttggatagctcaaagttcctgtaaatggtgtgaatatgcgatgtgtttctcagtggctgtgagtgtaaataacaagggatatttgggtggttacaaacatagtgtttctttgccttcgtcatgtcttagagttgatatgaaactgaaataatagtattattgtttgctgtttgttcggtgcatcttacatatggttctttctttgctcttgattccagagcctgaagctgaactgtgccctttgtggattaagaaattcaacagagctctgatgcgtacactctcattttcagagcatgaaacattcgaccaccctgtggcatgtgagatttggaactttcgtcttatttggtgttttttttaaggatatgttcttgctcatgctttgactattgttaacaggtctgttagttgtatcatcaaaggacaatgaaccaatcagcaagtttgttgatctcttcaacacaaatcagttaccttctcttttaaatgaaggcataatggatccccagattcttaagcactatcttatacttcatgatcaacaagatggaccacaagagatgtatattcttcactcagttattatgtttacattagttcttgcatagcctagcaacctgttactaatgaacatgttctctcagttttatagtgttctctagccaaacaatgatataatgtcatatgccaaatgccaacattttacagtgtcatgtatgcaattttccccttcttttttgctgaccttcttttttcttttggtgaagagctatgaacattttagcggaaatgaagagcactcttggtttgaatgattgtaaattgttgtgtattaattcttctacagaagcagatggtgcagatgctgagaattcatggttaccttatgtaagtacagagaactacttcagattaaattgcattagtgtttacgtagtgcagccgatatgcaatctagttacagtattttcttgactaaactacagaaatctcatggtttgcacaaccaagacggagcttgttggcttaacacggatgatttgaatgaggtattgccccatttgatgaatatcatgtcatctgcttatccgtcttcttgggcatattgaatgtcatgaaaccattgtccaacattttgtagcacctaatgattcatctgttccctggtaggtattgttgggaagattagtagcctacttggtagtttttactcagtgtatgcaaggttttcatgggtatcgatgctaagaatacaaaatgaatatttctcgcagatgtatggtattagatcaatgaactttagttattcctctgtagtatccagtgtcacatgcaattattgatttctgagagccaacccatacaagatacttactagataagccgttttttttcagataaaggacttcatgcaagatttggcttctaatcatataattccctacatggagcaaaagatccgtgtcctcaatcagcaggtattttctttattccattactttttttttacctctctcaacaagattaaccattctgtttttgaaaataataataataataataataatattaagcatttttctaggtagccacaacaaggaagggctttaggaatcaaataaagaacttgtggtggagaaaaagagatgatgttccagaagctgcaaatggcccaatgcaagtggttacttacatcttgcccttttccctatataaaaattctgtagtttgctgtaacacttttttttttcttcaacaggtatacgttcacctccatagagtcacagattagagttctaggtgactatgctttcatgttacgggactatgagcttgctttgtccaattatagattactctcaacagattataagcttgacaaagcttggaagcgctttgctggtgtgcaggtgctttatacttgttttaacttcttgccttgatttacatatgacattacttatgtagtgttgttgagtttgaaataaagtagcaatcaaggtggcgattcttaaggaatatcctgggaccagctacgttaacagcctaacatacttttcacctcaaacacgagtttagaccttcttacttgtacaccatatcagaatcatactgtatgcttccaaatttaaagcacatggttcctgaatttgttttgatgattgattgagtactgaatcaagcttgagtgcagtggccaaatattcaagtaggtagtcacttcatgataatgtctgtgtcttttgcaggaaatgagtggactgtgctatttcatgttggaccagtcaaggaaggatgctgaatattgcctggacagtgcctttagtacatatctggtattcatctctatgtccacttctagtttctcagactaaattaaatggttctctttctaaattgtaacctaacatgctagctccatcgatataaatttgtgttctgtgtactgtccaatatgtcatacacaaagagaaaaggagttcctatttagttttgtatgaagcagttttccatgtctattaaatacagttgcatctgattttcaggactattgatattaacattgacttagcaaggagtgatcatatgtcattgatcttactgcgcaaatgctagtctgttgcattgttttatagtcattcatatgatatcaacagtagactcagttaattttatggagttccccagtcattaaattcctgtgtgctctgttcttacccgaattagtgccatgcttcacctagcactgttctaatccaagttgtcattggtggcatctctaggatagatgacttcctttattcccattatttttgggagctgatagttgggtgtgctttgtggcatataataaagaatgcgtgaaactagatatcaagaattgaagaattcataatttgcgattaagggctataaaggggcaggatgattccaaataattaatgctactcttatgtgtaatttcaacttttgaagttaattaaatttggaatgattgatatccttcgtgcttctctgttctttcttgatattgctctcgtttattctattcatatttgtagagaattggatcttctgggaagagaaatgctactagatgtggcatttggtgggcagaaatgcttaaaacaagaggacagtatagggaggcatcaagtgtatactaccgcgtttctaatgaggtagatctagcatcaagcatacattgataaaattttactcatattttttgcaggaagaatttttagtttattacacaacattgatggaattttctaatgttcaggaaccttcattgcattctgctgtactgcttgagcaagccgcttgttgctatgtgttatctaaaccacctatgcttcggaagtatggatttcacctagtgttagctggaaatagttattacatatccgatcaggtgtactataattatatttactgctgtgatatttaattaatgctttagaagtatattatatctttgttgagtctgaaaattcaatctttgagtgcagaagcaacatgctgttcgggcatacagaaatgctctgtttgtttacaaacaacatccttggagttatatcaatgatcatgtacattttaatgttggaaggtagttgtgtgttttagctcctatccatatatttttcttgtctataaactattattaactctggtgactgtaaactaggtggtatggagtccttgggatatttgatgtagccataaagcacttgctggaggtcattgcttgcagccatcagtccctgacaacgcaaagcatgttcctcaatgattttttccattttgttcaggttcttgaccagctccatttgtgctctcattttggtgaaccaaacttctattgcaatgttcatcttgtgttttgtaccaacagagtatggggaagaaatttgatgtctacaagcttcaacttcctgttatcaacatgccatcactcagagttatatatgaagatcatcgtacttatgcatcagatgcagatgtaagtactttccactgctgtaggactatatctagtttatttaccattcagttttccagagtaatcagacattttatttaccattgagttttccggagtaatcagacattgaatttatgatatttcctctaatactcccttcgtcccaaaatatatcaagtttttagtctttggcacgggtattaaagcgagggggaataagacttggttgtctccttgggattggtgaggtataggtccggacaagttggactataataaagccaaggggtactgtgggtagtttagcggtaaaatttacattttacaagtactgttgctatatttgggacaaaatttggactcggttgttatattttgggacggagggtgtagaatatatcttatttcttgtggggctactgaaactgaaataaaagaacaccaaaatgaatcgatgtattgagcatttctgatgatagacaattaaataataactatgagattcaaccactccttttgtttctctaacaataaatgtatctgtctttgtgatctagaaattaaagcagtctaattctaacttgtataagttgccttcaataacaggttaatgttagtgaaagcatttggcaggagctggaggaagaaatgatcccatcatcatctattgttagaactaactggcttgaaaaatctcctgacttgagaaaatacaaggattcctgtgtttgtgttgtgggaggtaatacatcttcaatatccataaatctgctcctaagtggatcaacttaacttcatctgaattttcctggagttaagctgctttcagctggaaaccagcaaaatggcaaagtaaatccaacattattagcaatggactcatggggcatatctagcgcagcttgagtgtaattgtggaagctttccacgtggaccactcgatgagatgaacagactagtttgggtgactcgtatcccctttgtcggttggaaatattaattccaagcatccatgcccatgcatttcgactttcgagagatacaaatatatatgctatatgatgtagagttaaaacaagcaataatattgattaaaactaaaaattagatacactatttcataaggcacaatcaattacatatgcacatgtgcaaagaatgtaatgtttcctaagaaatggatattgcaaagaacacttatgtctacatttatgcagccccaaatgatcttgagttgagtggtaggtgtagagagtgccatcatccagcttctccttttaaaagagtataaagattaggcctaccttctcatgacccagaagaatctgatccatccatatcacatccaacagtccaaatggaggtttgtgtgattgcagccaaatatgagttcaaactcgatctgccccaagtcactttaaaggattaaggaaaataatttatttatcaaaatagaaacgtcaacggacaatagagggaaatatggatgcatctcttatatagtgtttcaattattgcttttttgtcaattgcagaagcagtaaaagtgaggattgagcttaggaatcctctacaaattcctgttgttgtttcttgcatctctctaatatgtcagctttccaccagtttggatgcttcaagtgctggtacttcttttttctctgatctaaaattttatcttaagaaccccatatccagaaaattatgttgatcattgatttctttaatggatcacattactgtgcagtcaatagtgtgctgaccacaggtgctggggaagatatagctaacacaaagcctgcgatatcaacgtaatatttcttttttgctaattattgaggctttatttatgtatgtctttggatcccaaccttaattctcatgggtaccgatgatgtttctggtttaacactacagatttgaggatgatggaaataatttcacagtttcaaagctggacattgtgttaggaggaagtgaaactaaaagtgtatgccttctttgtcattccactttactcagtattatcgccttacaaaagttctgttaggttgcttcccattttcctagtaaatctaatttctacccttggtaaaatgatttggcgctagcaaatactgtttcaactatttctatttgtaaccatattgatcaatggtatattaggcgatcaaacaaaaaggaggaaagctttatgtgtcactttgtcatttgtcttctttgctgtttcaattactccttaccgagtggttattgtatccaaaaaagatataatagaagttctcttgtaaagccaatagtatttccattcaggacgatctgcattttatcttttggcctgatattgcttcaaactattcatacttgtggctttcctcaatttaattttcatttgcttcaattattaagtctgatgttataaattataataatacctgtaatgacaagaggcgatacttaattgactaatgtgtagttatacataatttagctgataatgttttggtaggcattataataaccagtttcctttccaattctattaggtacaacttgaagttactccaaaagttgaaggtattctgaagttacatgggataaggtggacgctctcagatttattagttggctatcaatactttgaatttgacacaaaaaggaaaactaagaaagggaaaaagggacctcgtcgtactttgagcaacaccctgattgtaatcaaggttcggacttgtccagtgctctctttcacataatttgttctgagataagtgagtaactttaatttatttccagggtttacctaaacttacggggtgtattgatcacttgccaacaaatgcgtttgctggagatttacggctactcaagctgaatctgaggaaccagtcagaatatgctgtgaaggtccaaactatatatttttgcaactctcttcccttctttttcagtaatttgaaatgatttaacgaggtttgctcaaatgagcataacttttggagcaaatttaatggtactacacaatttgaaccaactaccacaaaccacactttcaaagaaggctttcagaaaactacacgttcttcagaaccacaaaactactttttttatgaatttacactagtcagacttctgactgagaccattagtaaggtatacgtggtaatctgtgtgccatatggaccacacacacgttcatggtccatggatgaccttctggttaatgtggcaaaggtacagtggatgagtggagtagcccaaagcctatagtccccttggtgctatgccatcaggatgacaattcacaaggcagtacttggcctgcatagaaactgtcttagtcaccgtatagttggaataatatcagatgttaccatatgttactttcatatgggcctagttggtcataatttgttgagagttctatgatggtcttaaaggacgtcaagtttttgtgagaactttttattgaaagtgtggattttatgatggtctaagtttagttgaagttctatgacatttacactaattttgtcctttatgtaatttttcagcagcttgttttgtagtaataattcccaatcttgttgtgcagaatattaagatgaagcttagccatccaagatttgtaattcctggtgatttatcagaagttgatttcgagtttccccaatgcttaagaaagcatgtacaatcagaaattagtactgtatcgacaaaacgtactcagggagatgccaagggtttgctctttacattttctcaagtgagttggttcaagcatgcccccttgtatgctgcaaaaatcatgcatggtctctgtttctttgcaaatattcaccgtactctcttgccaggatattaaaattcaagaaggagccacgttctcctggcctatttggttccatgctgcaactcctgggaacttttctctttatatatctctgtattatgaaatggagagcccaagtgagataacttatagaacattgcgcatgcactacaatattgaggtaatgacttgtgcttgtatttaaataatacatgatttgttgcaaatttggtggattaaacacctaaatttgttgttaagggttgtaagtgggttcttagcaaagttcaaggtggtagagggggtggtaaatgaacatattccttaaaactggaaatatttttaattgcatgaaactaactgtaaaacagggttgtcatgctccacaacggagtggaccaattaaaatactcgaaaggaggtgatgggtttattcctttttagcttttgagtgtctttttttgtttaatcagcatctgtgtttttatagtcagcatttcctactctggtgtgagtttttatctctaaacaattctctgcaggtttttccatcacttaatgtgtcctttgctataagaatgtgctcatcaagattgaaagagtatattgtgcgcatggacatcctgaacaggactccctcagagtcatttattcttcatcagttgtcatgcaatgacagtaaatgggcaatttcatcgttgcctttgtgcgattctatccgctctattgaaacagtatcagcaaatcagtctgtgtcgtgcttcttcaagataaaggtaatacttgtagcataccatgtcttccaaatctatatattctttttttgcccattacattgtagagtttaaaactgtattatattttttaaaatgcatctctttttttcaggatttaggtacaaattcttgtaaagaagctgaaaacagttcttgtagaagtgatatgctttttttatctcgtgagggcaacagcaatactgaggagtttgatgtttcccaatctcctattaccaatttccactatcaagagagataccaacagggaaggttggctaaggtgagttctgttaaagactataaaggcatttgcacccacttggtggtactttttccagctgtcaaggatttgttaccctaatcttcaagttggaatcaacaaaatttggctcgaaaaatgatgagaaattggatgcatatgtttttgttttcatacagtttaccatcacttagtcaaatgatgacatatatattggtgccatcactgtccagggaccacgggaccttcttgattttattctgatctcgaaagcagtaggtggtaactattccaagtcagatccagacgttcaactactctctcatcatgtgtgccattgcaggtaagtgctagattgtagaacctttgttacgacaaattctgttgggctctggactttaatgtgctgataccatctgctgtttctcagtgctatcgaccagagtcctatatggtggtttatggaagggcctagaacagttactcatgatttctcaaagtcttactgtgaagcaaacatccagttggtaattcataatactgtgcaacataatatttcagcgagagtagttacctatgacagcgtgccagataaaagccaaactgtcaatttgcaagattctaatagtaatcagggtggatggtatgatgtatcgctggaaaatgacattaaagctatctctactgccaaggggacacattatcagaaacagccatcagagagcatttcaccttttgtttggtgttcattgagttctgctcaagttgacctgaaacctgacacttccactaaagttcctctaaaagtgtgcatatttatgcctggaacatacaatctttcgaattatcagctacaatggaaagtgcattcatccgaggtaggacaggtggatgaaaatcaaagatccggtggtggccaagggcatcctttttatgtcactgttcttcaggatgcttgatgaactgcaaggaaggatggtgtgagacagtgagacaaccttctcatgaagaaactcgttccttggatgctgggtaaagatatacaatctgaccaacccaaaccagtggagtggtgactggtgaagatgtgtacctgtaagttcacggttgagtatagaatgaatatacatggattccagtttcaatactagcacagttatacaagttcttttcaagggtaattctggcgattagatgtataccattgtcggtgaaattttggtgctaggaaggatgcagacaacaaaagctttggtttgccgattgttgctgtagcctataggttcttacattgttcttgtaaatccttgtcaactttgagacaactcgcagatgcagtatctgtccatagttttcagtcatattgtacttttgaggaaattagatacttgagacgctccaagggcggcagttttgcctggctaattgtgatgttcatcatatagtgttgctttgaatcccagatcatacgaagttattttatttccattggcttagtttgtttgccggattatcttgtgatgtttttataagattctatataatagaaaatgatttgcggttgtcttgtttgatactttcatctactaacagtctccaagctgaaaccggaaaatgcaagttcgtgactcttgcacgttccagaagtagttcagctaatcgtgactgtacctttgacaaaatagcatcttgttttatttgtgtatttatgaatcgacagcctcttgtagccttgcctctagaagtccagcttttttgcagccaagtacttgtaccaacaaaatgtatcctcgtgttcagctgatgcagtggaagtcctaccaaatgcagagattttttgtcttgtgctgtgttttcgtgtgccaaaattttttgtaagtatatagacacatatttaaagtattaaactgtatactaataataaaataaattatagattccgtatgttaactgtgagatgaatctgttaagcctaattaatctgtcattagcaaatgtttactgtagcaccacattgttaaatcatggcataattaggctcaaaaaattcgtctcgtgatttacatgcaaactgtgcaattgattttttttcgtccatatttaatatttcatgcatgtatctaaacatttgatgtgacggaaaagttgaaagtttgaagaaaaaagtttaaatctaaacatagccatgaatgcaaaatccacccgtacctccattatgcttcacctctgcttgaacaggtaagactccgtgcatttacatcggccatgttgtttttattattactccctccgtttcaaaatatttaacaccgttgattttttaacacatatttgaccgttcgtcttattcaaaaaatttaagtaattatttattttttttcatatcatttgattcattgttaaatatactttcatgtacacatatagttttacatatttcagaaattttttttgaataagacgaatggtcaaacatgtgttaaaaagtcaacggtgttaaacattttgaaacggagggagtattatttagattttagatttttgtttgcatgtttccctactaaacggagtatttgatgccaaaagaaattctatataaaattttcttgaaatacttttctaaaacaaaatttcaactctgtagtagtagttaattttcattcgtttatatcgcaaaaatcatattatccgtcaattttctatatattgttgtgtctgtgcaattcagtgctgccccctgaagtgttccttgcaactctgtacaatctatgagggttggataagagcacccgcaatggtaaagtaaggtgctctctataaaacatgtacatctcagcaatagactagattaatagtaaaccacctcaatagtatgtctacatgggtatctatagctctctcatgtattgtctcgtttttctctatagactatctctagtttagtagatagttttgctctatctcttcatttaatatcttgcaaatagaaaaatatactgacgtggatctcttatagagagtctatagataaccattgcgggtgctttaagtgaaatttgcgcatgcacatgtgcgtcagttgctagaatcctcaacagcatgcaaagctcgtaaagcaaaacaaggagaggtcaacggagagagcacatcaacgcatcactatggtaatcccagagtgagtagtactagcaataataatagtgtcattagtactccctctgctgaagaaagcaacgccttataaaaaattaaaagaagttagtagtacgaaacaaataagacgtcaacgccgtcgacatccaaatgtgttactttctctgttataatatgtaacagcttttaaatttattatatcttagtattataaatctgaacatgtcgtttatattcataattcttatattgaaatggaaaaataaaaggagtattatagtacatgtgaggtggggcaatcaatcaaaaggcgtcacgttcacgtccttgtgatcgattgagacggtcagcgttgccgccttgggttggcctgacccggtttggtttgtagcgtggtaacatagcatagcaagcagaattgcgagggttcatccatgattggcagtttggcatgtgataactgagacatccaacggtggatgacgaccagtaccaactaccaacccagcaagttgtataaacgaagggcccctttaaatcacgggaataaaaaaatgaaggaataaaaaaatataggattctaatagaaatgtaatgtaagtgtaaataaaaaaaatataggattctaacagaaatgtaatgtaagtgtaaaacagaggattgcaaaacacaagaaaaacatagaaatgaccgtttaattggaccacaggaaaaacacaggaatttgaggagagataaagactcgaaggattttttccataaggttctacctcttgttaaaattcctccaaaacttatatgggaagaggcattccataggaattttataggatttcatagggttcattcctttgattcaaagggctttgtaggaaaaattcctataggaatgaaatcctctaaaagaaaattcctatgaatttcctttgaatcaaagggaccgaactctgcaactgatggaattattatgtatataggccgagtttacttccaaactttttcttcaaacttttaactttttcatcacatcaaaacttttctgcacacataaactttcaacttttccatcacatcgtttcaatttcaaccaaacttctaattttagcgtgaactaaacacacccatacttggttttattttcggtcttttgttctctgtcctttttatattgtcgtggtcaagtcaagctgcacacttgcatgcacaggtgcccttgctcgctctggttgatccggtcaaaaacgaccagctgaatgatcgcctacggcttatggctgatcctgatgccatgcatctccattctccagtcttacaaactccagtagcagttttataatactaccagtagcttttttttttttactcttgacaaatttattggcatgatttgaagtttacagttacctgataagctttcataaggccctttttatacggttcgggttccaagatttttcggaaccggtaatttctagttttacaaatttatgatctaataaatcaaccattacattgctaatatttagatatatcattttatttctattttaaattaattttaaaatttaaaccattatgatttaatgtaacgtacaaagttcaaatatgtcgtggatctggagttgtgcaaaacatgacctattttttttcacaaaataaaatgaaatccgtgctccgtttcatagaaagatatttaactatttgtcagtcttataaatggttaattaagggtttgtcaccggatccatataaaaaatcgtgagacgtaaattcttaattatcgcatctttaaagtggtaaaaaaaagttaaatgcaccggcccctctgaggttgcgtggttaggtttgaaacaaagcacaatctggacgcccccggcgcgccaccacacgccaccgcgtgatcaagcgccgcgcgggcagtgcacacgagggaggcctggactgggcggcgctcgcgagtcgcgacgccacccgcccgcgccgcggccatctcatctccctccttcctcccaccttcccaatccctcccccccgcgccacctcacgtcgccatttcaactccatcctcgcgtgaacgagacgagacccctccgaccccttcaactccgcgtctcctcctcctcccccctcttaactcctccctcctcccgatccaagaaaccggagcaaatcgtggccgatcttgtgttctagtgagttgctgcagccatgaacaatctcttctctagctcgtggaagcgcaccggcggcggcggcggcggcgacggggatattgaatcgggcggcggcgtggagatggcgccgccgccgggggcggcggcgggggcgagccttgataggttcttcgaggacgtggagtcgatcaaggacgagctccgcgacctggagcggatccagcggtcgctccacgacgccaacgaggggggcaagtcgctgcacgacgcggcggcggtgcgcgcgctgcgggcgcgcatggacgccgacgtcgccgccgccatcaagaaggccaaggtggtgaagctccgcctcgagtcgctcgaccgcgccaacgccgccaaccgctccgtccccgggtgcggcccgggctcctccaccgaccgcacccgcacctccgtcgtcgccggcctccgcaagaagctccgcgactccatggaatccttctcctccctccgcgcccgcatctcctccgagtaccgggagaccgtggcgcggcggtactacaccgtcaccggcgagcagcccgacgaggcgacgctcgacaacctcgccgagaccggggaaggggagcggttcctgcagcgcgcgatcgccgagcagggccgcggcgaggtgctcggcgtggtcgccgagatccaggagcggcacggcgccgtggcggagctggaacgctcgctgctcgagctccaccaggtgttcaacgacatggccgtgctggtggcggcgcagggggagcagctcgacgacatcgagacccatgtcggccgcgcgcgctccttcgtcgaccgcggccgcgagcagctggtggtggcgcggaagcatcagaagagcacccgcaagtggacctgcatcgccatcatcatcctgctcgtcctcatcctcgtcgtcgtcctccccatcgtgctcaagttcgtcaacaacaacaagagcagcagcagctcgccggcgccggcgacgccgtcgccgccgccgccaacggcatgatggtcgtatgatagtccatgttgagttcatacttcatagtgagagatttctatttttttgtcgggttttttctttcgtgattgtaattacttctgtatgattagttgatcgtcttgattattatacatatctgattcttctaaatatcattgcatttgaaactgcattttatccttttattcgagcattcgactatgtgcgatgcaattcattctccagaaaagcagtaaagtcataggcgaaaatttaaggcgtgttctaaaagaacttatgaaagatatggattatttgtgttatgctcaaacgattttctcagagaaaattctgcatcagcattgcttatacaacttgttctagctatttttttagcattatactaactccgttttatataagagataattttttcgcgaacgcacaaatttataagagataatgttgatgccttttagaataacgtttaacaattcgtcttattcaaaataaatagtataaacatgttaaagtataaaacatacttaaagttctttcataataaaacaaatcacaacaaaataaatgacatttatataattctttttaataaaacaaacggttaaataacatgccaaaagttaacggtgtcatctattaaaaaacgaagggagtactataaaatatttagttcatccttacaagtaattgtagctaagaagtccaatcattccgttagaacacgccctaactgatatatcgtctcatataaaaccaggtacatacacagagagctgatttacaaaatttgtcgtcttttttttctttacaaacagcaaccactggactatatataaatagataacattattaccttaacacgaaactgacatatacaccaagatggccgaagagaaatgcgagctcgaaaaagctagaagaacatgctggagctagaagaagatgctgaactggctggtgagtgagtccttgaggttggagaagagcccaaccagggagtactgccggagcttggacacctcataccacgagttgaggacggcttcgtgcttgtcagtgccggagaaggcgagctgaatcccggggctgcaatccacgctgccgcccttgcccgtgcagttcgccgtgctgatcgcgcagttctgatcgacgcaggtgaaggagggttgcccggagcaagcagagcagccgttggctttccagtacaggttctgaagtgtgcctttgttgaactcaaacacctaagaaacagaattcagttggtcgaatgatcagttggagaaataggtgaagatagaatgttcagaatgcagggtgcgggttatggatcgcaccagggtaaagctggtcacggtgtatgagctgttactgacgaaaaccggaggtgatcttgctgcatatttcctcccagcaaaagctaccatgtagccaccagaagttgcctggcacatagcaaaatagtggccaattagaaacacaagtggcttcattatattgagctaaaaacagttaaaaaaaaggacaatcatatgaagaccaatcacttatgggtaagaaagtaccactacaacaatgctaaatgcttcaaaagatggtgtgtggtttgctggccgaaacagtgaaaaatgtgcgcaacagtttgccattaaccgcaggttaccacagtaatcttctaacagtacaacaaaaaccattcttacgcaatagcactgcttattcttgcaattgagaatttgacatgctatggccaatcaataggagtaactttcgtagtgtaatatgaacaaaactgcgatcaacaaatcaggtagaaaacagaaaatgatggcctccatcgtgatgattagcccttatctaaaatgtcaagcacagctaaaccattttaacacatgttggtaattaaacaatcggtagtactgtagcttctctatgttcaatcaattagaataaaaatttccaaaccatagagcacaacccattgaataatttcatcatcaaagcagataaaccgacacttggcccacagaaaaacagagaagcatgttcatgggaccatttccatctgtgttactagagctcctacaaagagtccaaaaaatggtgctgtatcaatccatatgggacacataatccagctccccccaacttttgtcttcatcctccccaagcaggtcgtgattgccaatgttcatgacaaattgacaattcaccggcaagttcttcgtttctctgtttctcactaggcaattagggtgtttgattctaactaaaacctattgcatgacgaaactgacagcataaattctttattgaaaaggaattgtgtctatataaaattagataaaaaagaagaaactagaggactagttctttatgcgtttatgccaaacttcgggttcctgatatacgcaaccgtgcagtcagttagggttcctcgtgtgtatacaccatctgacataaaaatcgacattaagcatgaaaacacgaagcttctagaggtgaaaagtcgaccagggccttagttaccgggtcgaagccaccggcggcggaggtgttgacggtgaggagcgaaatctcgtcgacctcggggcggaacaccgcgagcttggcgcccttggacgccagcgacagccttccgtcgcagggggagagctgcacgccgccggagaagaagtcgccgcgcgccgcgaaggccacgccgaaggtgaacccgtccccgcgctgcaccgccgcgtccgcgcacggctcgtacacgccgttggtgtcgcccccggctgccaccgacggcgcgatgacgaggaggacgaggagcacggacgccgcctccgcgcacgcgcgcctcgacctcgacgacagcgtcgccaccgccatggccggcgcgaattgggtgcctcgggcgcgacgaggtcgttgacgagaggggctttggctttgctgttgctagttactacagctcacgaagaaacgcgtcgtggggaggcaaggaataaaggctaaaaaggcggttgcttgcttgttgggctcgctgcttcttaggccccgtagtcctcatgggccttgtgtacttctatctgatcggagataaaactaattattagtattagtactactttggggaaaaaaagaattatttttaagggcttggtaaagcttgtatgacccgtttggtaaagctctaactcttaaatttaattttagaagatagatctgtaaagttatggagcagtctaaacctagcttcacatctctagttcattttgtgatagcgctccaaccaactccactcctattttaggtagagttgaaactatttgactggattctagctccagaagaggtacagctggagccatgccaaacagactcttacttcaagattcttgttccatagagttagagctgaatcaaacactttcaagattctggataatataaattgaagttgttcttcctaaaaaaaattatactagatgaagcggtggtagtatatttttgctactagaatatttcaattattagatagagaaaacccttttgtaattgatgttgtaatttgttagagcatctccaacactctctctaaattcgactctccaaatatctatttggccaactctccatctcatttatcaagtcaaatttgttatttactccaacagcttcttcatccatcctctctattttgagtctatgacagcagtacccatgcatcagcctctatacccattcttcctcatctttctccccctcttcctcttcctctctctctccctctatacactcccgagacggctggggacagtggcggcggtcggcgcagacagcggcggcagtcgcggctagggatggcggcggcgggcgcggctggggacagcgcgggcgcgcggcggtaggcgcagacggcggcggcggcggacagcggcggcggggacggcggcagtgggcgcggctggggacagcgcgggcggcggtaggcgcagacggcggcggcgggcgcggctggggacgacgcaggcgacggcggcggccggcgcggttggctccggcgcctcgctcctccatgccgtcgccgtcgtgcggttcctagccgtcgcggacgacggcggcgggcgcggccggcggcggccggtgcggttggctccggcgcctcgctcctccgtgccgtcgtcgtcgtgcggttcccgtcgctgccttcttgcgggtgcgacggggagagagagatggggtgggagggagagtggtggggcccacgaatagccaggcagagtgactcttgactctccaaagttagtgagaggtgcaatttggaggttgttggagggtattttttctccatacttgctaaattttaacttggccagccatttggccattctatgagttgctcttagaacggataacttttcaatggcaaaacaatagaatttctcaaagggagtacctatacatctttcgaaagatttttataatcgtatcacacagatttttaatttttgtattaaaatccgatagatataataaaaagcaaaaagcaattaagaaacaccataatgaacattaaattaccatatcctcaagaaaaagaccaaatccaatacaaaatttaaaatttacatgtgaagattcaaaaattacagtgtaacttacaaaagttaccgtgtaagtttcataaattacactgtaacttacaagaaaatgcactgtaaatttgagtgagaaaatcgagtgagagataagaaaaaatctttcgagtgagatatagcaaaatcgtttctcaaataaaaactgtaccagtagcatggcatggaccaacacgattcataggtacaccaatcaaaaacacaaagttgttactattacatagtcttagttacaccttacaagtactacaacactaaacaaatagtaaaactctatatgtacggttccctcctctcagacacatatttgtacttctaccaactggtctcatctctcatgagatggtcagttgagcctgcatatctatatggccaagaaaagctgcgatgaatgcaaagcaaatttcttgaaatattggatagatcatcacagtccaaggctgccaatatatccatgaacgatatctcaggtgaaaatgttgccaatgactatggatgctctttggataattggattggctgtcaagtctgcagctcaactcttctaggcaactcaattgaactggcaagatgatgtttagtgacctttagggaccggttaaccgcagatttattcgtcatgcgcttgcctgcttcgacacctgagagttagggaaatttggttagaaaattgcaagtgtatgagtttgagccttaagaaacattgtatactagataaggtcagttatgtcacaaggaggagaaaaggcttaacatgaacacatgcagatgatgcgagatttttactcacagctggcaggtaaggagaatctcttatttccttgaggatctaaatgcccagtcctctccttaggattactactcgacctagttccaagtcccgaaggacgagacgaaatttcatcacatccttctctggatgacagtttcagttttgacttagccgatgccgaaccaccagaccggttcgatgaggaaccaccgccctctgagtttggtaggcaggtcttctggttcagtatgtttgaatgaagtgttgaagtttgtcttctaacatgtttcttatgtggagtatagacagcattttcctcgtcttgcattgctccactactaacaggaattccatctgctgcataagagcccaggaatcggctctcccatggacgaacagccatccatctctctagccaattccagccccagctgttcttgtcaggttgaaatgctgtaatggctgcatgttgccttgcttgccactgcgaaaggaggaaaataggttcaggtgtcaagttttttaatgacctccctttaagtcttattttattatcagaaatggaattaagccctcaaaaagtatggaagcacaccaaagaccaacacaaagtgacttgagatgtggccacaactgatgagagatcagttcttacagagtcattgggacagtgtatctgacatcaatgatgggaaggactagaaaaattcttaatctactacctgaaccaatgaaaacttttagagatatgaattcatcttatttctggaaggggttactgcatgaaaaaattatttgacctcaaccacatactggaaaaaggctcccttttcttacttctccaacatacggtgaactgtctaaataatttcatttatcatgattggattctttttctccagaaggagcatgcaaataggtctcatcttagctacatactgaaattacaattaaacgctaaccaacagaagcagaacagtacagaaagtcggaaacaacaagcagcctaattattaggctaacttggagggagagacaacatcatctgttatccatgaaagcaacgtttggaatccagcaatagcaacttagcaagcatgcttgttgttacatgctggagatgacagtgagtcgattactttcatgatatcaagaagctatacttggatgcagaccaatttgattggtgcactacagtatacgctataatccatggttcatatgattaattggataatcatagctgagtattgtcctggtgtaaaatgtttgataaagttacctggtgagttagagcataggccatggctcgttcgcgtttggctgctgcctcctgcctctttaatagttttgcttggatatcttccacagatcctatgctatcacaccaaccatcctgcatttttaaggtaaatagcataagtaaacaactcaagccaaatcactgcactttcatgccagttatttccttgtgaaaattgagaagagcatgcatgcaagcctacctggaaaactactgaaagtgcgactcacctcgatttcccgcacatgtgtctcatttattttctcttgtagaatagcttgctgatccgtctggctttccaaagcaatgcgcactcgccttgctctaacacgggcttgaaccctcaccaaagcttgcatacacctgagtgttatagcagcttgctttctcactatatgaccccttacaagggcttgaagcctaactagtccttttaaagcccgacgggctctcctagcctgaagagaattcaagttaaacttgtagtaaagcctgaagaaccaaacatttgggaatcatgggaaaatccataattccatttcagcaattctatgtttgcatatactttgcattggacttggactagttactaaattggcagagagagaaagagagagagcatcaataccaggaaggctctaaacacagtctgaataactgtagcagcccagatctccttgagttcttcttcagtctgaggcacaggcacgttaggtgaactaaaagcgggttccgagcacgaaagtgcattgctatcaccttctgatggaccattttcatcaggaaactcttctggtgctccaaggttatcatggtcttgaccgtgctgattttggcagtgaaaatggttagcaccgtcccttttctgcaatttcacagttcacaagttattacaaacccagccaaataaaaaaaagttattatatacgaacaatgcaatgctaaattgttaacacgatggtttccatttctttaaaaaaaaaaaagacatagtggtttccatctttcaacatttttgtcagtggcatagaagccaaaaaaaaatgatgcagatattatcatccagatctgcagtaacttcataaatttacacaaggcaaacaagcaatgcaagaagtaccaactgtagtcttaatttagcggagaacgaataccccaggttgatcactacaacaaagaattccccatgacatgatcaagattcacttccccatttcttttcagcaaattgttgtcgaattttaacacgaactaactagtcgaattcccggctacccccatcaaaatcaaccaaaaatgccaagaaaaatagaaggacaaggagcagaacaatggatgagagaacctgtgctactcgcccaccatctccatcctccttgctctgctgctgctgcttctccaccttcctcatcccaaccaacgacttgagccacctcgccgagatgcccatggcgccgcgcccctcaaccgagacaaaaacctaaagccgcaatctttctcatcagcaaccaaccaatccaaacctcaaaaatctctccacaaaaaagaagcaaaacaaaatcacccaaagaacacgcaccaagaacttctaggtgcgtgttcttcttggcaagaagagccgtgcccgcacaccaccagatcgcggcgagacggggccaagaaaacggtggtcgacgctggccacccaatgagcggcgcgccttgcagatcaagggtggtctactctactcctcccggtcccggatcatcacgccacctcgctactactctactctactagtagtggccaccaccaccaacacccgggaacccggccattactgccgcagctgcagctgccaccactgcgtgcgcattattgctgccatcggtgggcttgtgcttgtgtgcgtggcagtgtggcacgctctgctgctgctgctgcagagaggaggatgagattgattagctgattagtagtagtactagtataaaaataagcaagaaagcaccgcgcttttcttgcgtttcactttccgcgccccccgttgtcgggaaagccaagccattgctgttgttctcttttgtttaccctctagtttttcactgcatctttgcctggctttcggacaaagtgatctttatgatctgaaagagaaagaaattctttggtagtatagtactcgcaacaatggaatttcagcaattagcgatgtgctcgcactgttcgagctgaaagctgcaaattcggagatttccccgtggaatttcagtcattcggactaattgagtcattcagactagtgcaaactacgaatttttactattttactaccgaagtgtgcactgtgcaagatggatttgctttgtcaggttaaagatctgaaacatgtagttctacgttcgtgctgctgctacaattattcacatttattgttttctacatttactactagtaggtttttacgagtgccaccggtttataactgttcaactctgagtgaagaactattaccattaccgctccatcaattaaacatgtcatggcatttagtatcacttcttttcaataatgtcttttgctacctcataggaagccgagagctgaatcatcaactgctaccactgcttccctacacaggcagaggccgcaggaccacttcagagttcagaaagttcagagattgtgatcttaagctcaatatctctaattaaatccgtttatctgcctcgaattaaagtcacttaaaatgagaagatttcaggttgtttggcaaaatgcgaatttattagaagtagatgggttcagttggcaataaaatgggatatctacatgcgagtcaccaccgaaaactgacatgacaccagtgacagggcgcatgatggttatggatgggatgttcataatgccgtgctgaactctgttttcgggtggtttgcataagtaatcacgtgattaaattggaaatgttggcattagaactcagattaatagccggtgttcagaaatgaacagagattctctagtttctacagaacaaggatcttgattgagtgtcatgttacctgtcctataccatgacaagctattagtttatccaccgaatcttttcctttgtttcttcctcactgaaaaacatactcctaagtttttcctttcagttttttctgagatattctaagataaaatgtacgggagtactttagaatttggattttggagggtgtcaaattcaaatccatgacatgacaaacgggccaactagacacttttaaggcaaaacgagctgattgcgctcggatatcgtacgggactaacaagctttaagaaaaggctatcaacagagggatgtcttttaaccgtgagatgttggggctgtttggttctcagccacactttaccattacttgccaacaaaagttgccacaccttgcctaaggtgaggtgatcaaattgttagccacaacttactaagcctaagggaatcttgccacacttttttgagccattgacatgtgggacccaatttgttggaggggaatcttgccacaactgtaactacaaccaaacacctgtcaaatttgcctaaccttaggcgtggcaaactgtggcaaagtgtggcttgcaaccaaacacacccgttttaagtgacatgaaaagtgtataaaccacagcgccttttgcagaaaaaaaaaactagagctcaatgtcatgtgtcacttttcttgtccaatgcttaggcttttctacgacaattgatctagaggcctggtttagttcctaactttttcttcaaacttctaacttttccatcacatcaaaactttcctacacatataaacttttaacttttccatcacatctttccaatttcaatcaaacttttaattttagcgtgaactaaacacacccagagtaacaaataacactgtaaagtgtggtaacttaaacagtataaactccatattttttccattttgttaatccaatgtgcattgtcccttgaggtataaccgtagaacttcctcttttacacgtggtggaccatagtatatttattttgctagaatgaccatcctgatcgtactccgtctggtttaactatgtactgtactaagttaagagcctcattggttgccttaataagtcaaagccaaaactaaaatttaaatttccaaacttaattttaaaattgattttaagatattttcaacttagtttcttttatagtgttatttaacttttaagtcaataagagcatatatataaaagttttacctaaaaactaatttttattttctaatgagccattttggcttattagtaaatatgggcaaccaataagaacctaaagtatgtggaaagtagctcgaataacaatctgctctttcacttatatgaaataagattgggtaatttttacagtgtgagtcaccttttacccgcaaaaaattcgctttggatcaccctatatttgatctttacacttgagatatgtaatttttcctttcttacactccgaactatcttgaactttcttctcgagcgcatcaatgcctttaagcgtattggcggctacatgtcggtaatttccatgcaagcaaccctttatcatatgagagactatatgcgactcgagaacagagttatggtggtacaaagcgaaacaaatgcgaatttaccaagccaaaagtgaaaatattggatttaaaatgaaaagttgcatttaattgtgtgattagaaaaggttccatttattcagtgaggtcgaatagaaggccagtgactcaaacaggaaaaaaaaattggtggtatgcaagtggggtcgagggaggatgattataatctaaccatcatggtttaaattctcgtgtccatgagtattacacacttatgaacatgtgtttagtggggtgaggcatttgtcgctatctccgtcttctatgtgcaaatgaaaaaaagcgtcacaaatctctcttcaatggagaaaattatctcgtcgcttatgaagcataaagtttcttgtaaagaatttaaaaacagaaaaaacacagccaccatttttgcatgatgcacatataataaccatgaaaaagatacgaagtgagtgtagctctattagtttggttcaagtcctagatttgatatgggtgatcgtatttacggctatctattatttattatttcagtgctaagcaatgttaccgttgacggtgaggcgcatatagtgacttcgtcaatctcaatattttataggtgttcttagagatagagtgtgcgtgtataggggaaattgtgcgcgcgttgtgagtgtccgtgtttattccatgtttctaaaaaaaacatgaaaaaatgaatataaacgtttttcacataatgcacaaataataatcacaaaaaagtgaggaaaaaaaatcctataggagtattcgaaaacaatttaaatccagggaaacttgataaaaataaaaaaacaaaccaaccatattagtagtatactttccttgccttttctcgacagcgcaaggtaagcaagcatcgccaaggcaagaaaaaaggaatctctctgaagagagggaatctccttaccgggttgctcccgtcgcaccggacccgacaaacgcaacccgaaaccggagtcaagtcaacacgcgcggacacacgcgcttcccttccccggaacccgcattgcctctcccccaccctctcgcaggaagaccccggaaggatctggaagctgcaacccccaccgtccgatccagatccgacggccccacgcccgccgcatccgcttcacgcagcttccagagcattcactcctccgccacccgtttcttcctccgctataactacacccctcctctctcctcctcacaaaccgcttccaacccgagaccacgctccccgccggatcgagcagctagggtttcgacctttttttttcccaccaggagggcgacgagatgttcgggcgcgcgccgaagaagagcgacaacacgcggtactacgaggtgcttggggtgcccaaggatgcgtcccaggatgacctcaagaaggcgtaccgcaaggccgccatcaagaaccaccccgacaagggcggagaccccgagaaggtgagctcgcgagcgattcgtctcttgttttttcgtttcgatctgtctgcggcggcggtgaggggcgtagccggtttggatggaggtgggggatttgaggggggcgttggggagttttggatctgtgatagggttgaagaattcgatgggtttaggagggtttggagtagcgcttgcgtgtgctccgggaatgatggatttaggtggggggaagtagatttggttgtggaaatgtgttggattcagagcacgataagtcgcccttccccaattgcttgccaatcaacgaaaaccatgtgaacgtttagatgcaattccattactggttcatatatcgaaatcatctatggtttgaactgtactattcattagctgttgatgataagttgcccttcctcaattgcttgccaatcaaccaaaaccatgtgaaccttagatgcaattccattacttgttcatatattgagatcatctattttttgtatgtttttaactgtactattcattaactattgatatgcacatttaggggctttgctgatgattatgacagattagggtcttggaacattcttgttaattcagctaattgatagccaattctagtgataagtagtattgagaatgatgtgagatattgttcatttggctgatgcaaacattacatcgtcacctgccaagtgccaacctgattttgtattgcgagtttgtgaccatgtgtactatctatcctgcattgtcatagttaggagcctagttactgtggcatacaggctggtgtgttctattatatatattgttttacctcataattatcgctgatatcttatgagtaaactggttaagctttatgagtactgaattgccaatgctttatctggttaagctgtatgatggggacaatagctttcttgatgagatggcaaactaaaattcttgccttcatttcagttcaaggaattggctcaggcttatgaagtcctgagtgaccctgagaagcgtgaaatctatgatcagtacggtgaagatgctctcaaggaggggatgggtcctggtggtgggatgcatgacccatttgacattttttcctcattctttggaggtggctttggaggtacgagacatgagaagcagctcaattcaacctcctggtgattgtggtttgcttagattttgactggctctcattgtggtctgcaggtggtagcagtaggggcaggagacagcgtaggggagaggatgtggttcaccctctgaaggtttctctggaggaattgtacaatggcacatcaaagaagctctccctttctcgcaatgtgctctgctccaagtgcaatgggtatgtcatcagcttccttttgtgggtcctaaatattgcataaactgtttgactattctgatatctcacactgttctgtgctcatcttgcagcaagggctcgaaatctggtgcttccatgaagtgctctggttgtcaaggttctggtatgaaggtccaaattcgccagttggggccaggaatgattcagcaaatgcaacatccctgcaatgagtgcaagggaactggtgagaccatcagcgacaaggatagatgcccaggctgcaagggtgagaaggtggcgcaggagaagaaggttcttgaggtggtggtcgagaagggcatgcagaatggacagaagatcaccttccctggtgaggctgatgaagcggtatgtctgtgttctgactcctcgcattgtacagtacatggttctaaggtgtagtactccatgtgcttgtcaacactgttactgaccaacctgtgctttgtgcagcccgatactgtcactggagacattatcttcgtcctccagcagaaggagcatcccaagttcaagagaaagggagatgacctcttctacgagcacaccctgaacctcactgaggccctttgtggcttccagtttgttctcactcacttggacaacaggcagctgcttatcaagtccaagcccggtgaagttgtcaagcctggtgagtctcccttcaaagaaagatcaccatagagtagcagcattttggaaaccatctgattgtttttttaagcattcattttagaaactattttattgtttactcatatcggccgtcatcttgtcgcagattcattcaaggctgtcaacgacgagggcatgccgatgtaccagcggccattcatgaaggggaagctctacatccacttctccgtggaattccccgactctttgaaccctgaccagtgcaaggccctggagaccgtcctcccgccaaggccggtgtcgcagtacaccgacatggagctcgacgagtgcgaggagaccatgccgtacgacgtgaacatcgaggaggagatgaggaggcggcagcaacagcagcagcaggaggcatacgacgaggacgaggacatgcacggcggcggcgcccagcgcgtgcagtgcgcgcagcagtaagcagcaagcagcgccgtgcatacatatctgcacggctttgacggcggcgacaaattgtttctttccgctctaggggcgataatactatcaagttttccatgttaggcatatgatgatgtgatactacttttggtcttttatactgcgtattaatgacgtacatcaaccggacctactggtccatgaaacaaaatctctactgcttctccttcctgtgtgtgttagtgcgctgcgttcttcccatgtgtaggatttgctgcttcctcgagatgagcagtagcagatggcaccgcgaatggaactgtcaatgcgcaatttgactcggtgcaactcgttgaggctcggtcatgcactgtgtcagggcccccggtgtcgggatctaacaacatggaacatgaaagaagaggctcctgcttagcaatggtaaactaaattgaactacaactgcaaagatagtgagagactacaaatcagacgcccaatttgttcctaaaaggaacaaaatcgtgcgttgtttcatttctagcagaaaaaagtttcaccactaaataaaaaagttccaatctattaaatgttgtgaatcatgatagcagaaaaaagtttcatcactaaataaaacatttgtgaatgatgatagaaacaatccgttgtaacaaacggaacatcgagcttcagctgctaaaacagcaacgaatatgcaagaattgatgaaacaagattcaaactactcagcgaaacattttgattccccaagaaacatcatacttacattggttgaaacattgaaaatcagaaaaatgcactagtctagattgggttccttcctcttctccagtgatcacattttcctttggtctccgctgcagatctagaccgggacatgcgaggctcttctattccgccgaggtgccgtagccgccgctccacggagaccccgaggcttactcaccccgccgttgccggtcccgagccatcttagtcaccctgccgttgctggtcccgagtcatcgtcatcattcggatgaacaaaaactccgcccgccagatagtcgcatggggaggacgcctcgttgctgtcgaatggtgagctatttcgcttgatcccctgcaaggatcatcgagagagaaagaaagatgcatagaacgagcggataaaggagtgagagagtggataaggggggactagaaggctcggtatagttataaagtggaggtgggcctactgctagcatcgcaacatctgatcttttttagttgtatcggacgatagatatggagctttatcacagagataatagctatttttttaagaatgggataacaatcgtttattcttgtaaaatggataaagaaaattatttcaaattaatttcgctgaacatctactgaataaagcactcatgtaccatccagcaaattaaggatccaccataaagcaaaagaaggatcatggaaaagtaatggtaatgtgaacaactattatttggctctcccaaattctcgggagggacaacaccgcagcctcccgtggaacggctcttaggcttgacggtggactttcaacattgaggtggacggcggtgacaacctccctagtccctacaacttaggcttgacggtggactttcaacattgaggtggacggcggtgacaacctcctagtccctacaacttccagcattgaggtggatgacgcggcaacctggttcaaaaggatgcaacaccctccctccgtcttagagatggaaggcggcactagcacctacactaccataacattaaatttcactttgggattacctttattaccggtgttccattttaaatcaccctttaatcaatttcactttaaacatggtatcttcattttaaaaaagatatcttacctttatgagaccatactctaactcttttacccatctacattaaactaatcatctagggctcacgcatgaagtcagtatatattgaggcgaaacagagtgctcggtcatgtctcatcagttcctcgcattggcttgcatgggcatgtcgcatcgggtgatcatgggaaagcttgtcatgctgcggttgtcaggtgcttgcgtatctatcatttggctaggttaggggatagacgacgatgggtcgcgcgatcacttgtattcttgttggatgttgtgtggtccgtgtggagacggaaggggaaggtggaaggccaaacggcatgggcctagccgcctaggtcttgcttgggagcaaatagcatttgatgctggaacattggatttgatcggacggcttcaaaaaaactgatgacgtggaccaacctggagcaagttttataggaattaatgatgtagtgggtaccaactatgtaggaagacggatatagttagaccctaccacgagaagacaaaagtaattgtaacggcgaaagctagcgtggctgtggggattttaaagagacagaggtgaatctttttgctattggttggcctggcttatgtagtgtggggaggtgaggaaagcggaaatagaagcagagtaagacttggtacaaaattagcatataattgtggattgtaaggattttagcatatagccaatggatttagattaacatggaattatctacaactttttatagccaatggacattttttttaatttaaatttgatcctaattaacgataaatgtaagatgtgatcgtagcctagatcaaatttttccaggagaaaatatcgaaatgcaaacagaccctggatgttagctgctccagttttgatgctgcatgcaaagcatttttctaagtgaattctgttgcctcttcatgtccatcggtattgccctgcacgcgaactatgagcatgccaaccgtttgcacacagacagagagagagagagagagagagcgcttaggctcctagacggacactgcacacaccaggtaatcctagaaagttagaatcgatcggcaccatcctctcgccaccgcggctgaaacttctgcagaacaaaggctgctagctcgtgcttgcagctcgggcgacacctcctcgtggataaacttcgtcctctccgatgttcacagggacatatccatgcatcgaactgttaatcattacacttagaagtgtttggcaaatgagaaagagaaatgatttcccacctatctttaaatcctaaccatttattctccatgtttcatttaatcctaactcttcattaatttttcaatcccaatcccaccccccatttctcattatccaaacacatccttaggcacatcagcatctgcgggggaaacggtacggacgggtcaaaggagaacacgagcatgtcgtgaacaacaacgcggtacatcctgtcgagaccggtgtggcggggtgggttgttcgcaactacgtacagaaaacggagtgatctattagcacgttattaataaagtattagtttttttaaaaaaatgaatgaatttaattttgtttaagtaactttcgtatagaaactttttttaaaaaaacatgtcgtttagtagtttgaaaaacgtgcacgcgaaaaacgataggttaggagaaggggtatccgaacacagcctagtcagctgccgatctcgccaatcgccattgacgtcgagccagacggccccgacgcgatcagcacccgtacgtgggccgtgtccagagccgatggacgacaaagaccggcattacacttctcctaatatatgggattaggtgatcgagaaaaatccatcgtgattccaaccaaaactacgatcgcgcgcgtgctggcctgctgacgtggtaacggcacaaacgtgcgtgggagaattctgatctgaatcaaatttgcgatcgtgtgctacaggcagccgattgggaagtggaaacctatctggtttcgctcggacgacgacgcgcgtggaatgcggatgatagacgacgtacgcacgcgtgtgctagactaatggaccaccaaaacatattattcattttattcattggctagcggtggcgaaccaaaataccgacaaaaacctcttcatttctttttatcttaactaattaaaagatttggatttttcctttcgtcacattaatttctcgttcgtatgtccgatcgagcgaggcctgtgttcccacgcgccatgaacacaagcgatattgcacaagtttaaagatcggtacaaaatccaatcggacacagaacacagaggaagagaaaactacaaacaggaagaataataaaaataaaaatcacacagaaaaaaccttgactggctcgaattgagccattttattgagcccgattctcttcattgactcctcaatgccccaatcccccaatacaatgccccagatcctcaaattgaaggtgaaaatattaacaacaaacaataatccccatatccttattttaacatatgaacaacccagatcctcaagattagaaaaaaaagcatgaataaacatcaacaaagcacaagagtaattcattatcatcactgctccttcttctggtgtgggaggaagaacgggacggggtggcgtcaccatcgcatctcccagatccgcctgtctccgacctccacaccgatggatccaccggccaagccaccgagggaaagtagaggagaggaggggcatttgtcgcacctgcaacccgctgtcgccgtcagcccgtcaccatggaggtcggatgcggctaaatctgacggccccagacctccacgccgatggatccgtcggctaggtcgcccgtcatcgcccgttgaggccgtagccggtggcgggacgagtctggaagaccgagtcgccgcagccgtcgcctcgagtcgccgtgccctcatcaggaacggtgagcgcagggagatggaggagaggagcagtagaggagccggcgatgtggccatgcctgcggctggatccagacgaggaggggcgaggctgctccaacccgctcgtcaccgaactgcctctgagcaggaggaggagagccctggcagcggtgcgacgaagcacgggccgagcggcataggcaggaggatgccggagcccggagggacgggcgccggggtagagggagggggctccgccacggttggggagggttggagccggtggtggatatgtgccggcgacatgaagagagacgaagaaagccagggacagagagagtaaagcgatagagataaggctgttctcaccaaaaaaaaaagagaagaagatagagataaggctagctctgtgactgtgaccagggccaccaggcaacaagtcacgaactcacgatattttcccttcttattaaagtaggagcttcaattttttcttaaaaaaaaatacacacacatgctgtcccaaaataagttgattcatgggtttccgtgtacaatctttgacaatccgttttatttaaaatatatatgaaaaaattttaaaaaataagttacgcataaagtattattcatattttatcatttaatctatatctataactaataactaatataaatattcgtatttttcctttcgtcacatctaattttcgtccgtgttttcatctgtatgcaatccgatttggttagcaataacgatggaaaaaaattgcaaaagaaaaaaatggtggccgcagatgccgccgccggaggaagccgccgctgccggatccgcccgcggtcgccgccactgctaacggatccacccgcggacgctgcagacgccatcgtcgccgtcgacgcttgccttagggacggccgtcgccgagggagcgcggatgccgccgttgggagggcaccgtcaccgagaggtagggagggagggatggccgtcgaggccgacagggagaggaagaggaagagggggagggacggccatctccgccgtctccgccgtcgccgcgccacgccgtgagacgggagggagagggggagagggagcggtctgccgtctccgccgcatcctgccatcgccgcgccgtgccggtgagacggggggagaggagagggagcggcgccgctggaggggaggggagggaagcggcgccggtggggaaagggggagggggagaggcggcatcgggggcgggcgaggcggctggctcggctgggagggaggggtccgctggagggtaggggaggggaagcacgccaatggggagagggggaggggagaggcggcatccggggcgggggaggtggcccgcttggcggggggagggggagggttagggttctcatcaatttggaacttatccgagccgtccattaaaacgaacggctcagatcgatcgagcgttgggccaaaccacttgggccgtacgcgggccggtggtccagcaagcgagaggaggagtatggggatattaattagactttggtcgcttgagggctgaagaagaaagtgggctgaaaaaggcccatagagataaagggatttttatttagatttttatttcaataaatgctgaaatgatgtttgtattataaaaatagcaattaagctatgtaaatttcaagaaaatttcaatgagtgtaattaatatagaaaatttaataaaaaataaatccaaccataacattttatttctcacacttactttacttataaattaatttaattatatacctacctacttaaaaaatacccaaatatttcagaaattttgtgtttcatttaattataatttaatatttttctaattcaattttatttttttcttttcgtttcaacgcacgaccaattttgctataatttcaaatagtgtaattaatattgcagaaaatttatatttcattaaattagaatttaatatgttttaattcaattttcttcttttttttcattccgttgcaacgcacgggcatttttctagtaataatagagatatagataaagatagctagagaagtagaacttggtccgtccgtctacccttattaggatattcatggggattgatttggggagtcaatctcccgcgactttgggaagtcgatcttaaacgactctacatattcgcaaaccctgggaaaatggcgaaacttaagcagagcttcagccttctcttgctcatcgaacccatcgcagtatgggccacaatatattttctcatattttgaagcaccctcgttggatctgtgaagagcctctgcatttttcttgaatatcttgaaccggtgagtcatctcagcaaggtcacgcttcttatcgtaagccttgcaccagcgctcatacatggcccctatggcttcatcagactcaaaatccttgtccgtaaaatcgtcagcagactcatcaaaattcgtcaaaaaggcacctggctcatgaccatcatctatcacaatggaacaacattaatactgtcaagaacagcgagttggcttgcaagtttcaatttggttcctaatttgcgagcataaatgtctactattgtaaacattaaagatgtttttgtcggtactttggtacgttatccgtgtatgagttggattttaagttcgttcacttttggaaatacatatccatatttaagttcggttttaatctcgttcacttttggaaatacaaaatgagtcgtataagaaattctttaaaaaaaagattcgcatgctaacttgatatgattttctagaaaaatatatatctaaacaattctcacggtgaatttcaatgaacaataataagattaaaatagcttcacctgttacaacgcacactttttctagtctaaagaaaactatcctgcctaatatgcccatgccctgatgatggcaatcagaaggcccgtaagagcaggtacaatagcaggctataagccagctataaacatattttaaagagataaacgaagagagagaagagcagcgggctatagatctgtagccagctgcagcacggactccaagacgtaatgtgcgtatgacaggtagaaccgagtattaatagtatagtaagcaactattatatgaattggctattacattagctatagatgatttgtagttagtagttggctatactattaaacttgctctaataagattggggggattagcttacctgatggatcgtaatcgtcgaggtaacataccgcgcgtgcagcgtgacatgcggcgacggcggcttggcgtgctgcgcgacgtgctgcgatggccgccgagtgtggagattatggttaccccatatctacatagcggttatattccagctggatatatggtaccaaatatagatagaatatctttatgaggactcgggttagattctaaacttgtatgtcaagaaaatacccaggattctagtcggttacgattgtattttatctgtaatcccatattccgttaggatatggactgtattttgtattacggatcccttcccctatataaggaggggtccgggttcctctcgggacgatttcttttttctctcaatcatacaatcaataacatactcggcggaatcatccccggataggagtagggtattacttcttgaataagaaggcctgaacctgtataaaattctttttctccaaacccatccactttcctagcttgatagccacccccttttattattgccgaaatcttgttttgacagttggcgcgccaggtaggggttgcgtcaagttctcgccgactaagtgcgatgggtttcgtttctggcatcgacgactgcgccttccttcctgggcaggcgttccggttcggcagcctcaacttcatcaccaacgacttcggcaagatctctctccttgactcggattcaaaccagttggggagagaccaggtcctcgtgccattcggtattccgaactcggccgaggcctactccaagatcatctctcccaagtcggcttcaaaccactcggacgagatccaatctactcttccgcgaccagatcaagacgacgggtcctatccctcaatcctgatgaaacttcctgatgatttggccgctgttttcactgtcaagacatctcccactcgaagatctaggagagctccggcttcggccccgatccaatctagatccagagaggttggcgttatactccaacctcttgggacagtctcgacggaagagttggatggttaccttagctcccccggcgtcagttctcgaccaaccgagatcctcgactacaacgatttcggctaccactatgaccatggcgacctcgacaacttcgatgacagctctgaggataactacacgcccctcttcttcggcgtattcatggctgacaacgaaatggaggaacagcgccaagcccgagaagcggaccaagatcgcgcaaggcaagaagctgaacgtcgccgactggaggaagagcgacagtgacaggagcgagaacgactacagcgttagcaacaagatcgcgaacgggttgcaaaggaggctaaagatcgacggcaacgcgccttggaatctgggcgccgagcgagagagctcattgggcaacaagacgtcgatggaacagcggtctttcgcaccccccagcagaacgcggttgcagcaatcactctcctcgacaccctcctcaaggaagacacactcaaccaagctgatcatgttgtcaacatcttgaatcagacgaagaccatgatcgctgcctcggttccagccaactccgcaagcacccgtaccccgactagtagccgagtccctcacttccgatctcatgattatcatcagccaagcctcagcatcatcggcacaggatctagtcgcaggagcaggggtcacgacgaacgatcttttcactcgcctcccgaacgtcacagggagcgccgagctaaacggcctcactctccacctcaccagcgtcccgtcgaccttcgcgacatgatcaaccagcgccgtgcagcgcgaggtcaccgccattcaccaaatcgctacgacgacgacgtggatggagtagctgccttcactaatgacctgcgtcgagtggattggccagccagctttaagccgactggaattgagaagtatgacggcaccactaatccggagtcttggctcaccgtctacggactcgcaatccgcgcagcaggaggagacagcaaggccatggcaaactatctacctgtggccctagcggactccgcccaatcctggctcaacggactaccccgtggcacgatcggatcatgggcggaacttcgtgatcacttcattgccaacttccagggcacctttgaacgccccggcacacaatttgatctctacaacgttgttcagaagtctggagaatcccttcgagattacatccggcgcttctccgaacaacgcaacaagatctccgacatcaccgacgacgtcatcatcgccgccttcactaaaggcattcgccacgaggacctagtcggcaagttcggatgtaaaccccccaggacggttaagcagatgtttgaaaaagccaacgagtatgccaaagccgaagatgctattaccgcgtccaaacagtcgggcaccacttggaagccaaagaaggacacgccgaccgcaggagggagtggaagtaacaaccacaaggatcgcaagcgtaagcctgaagaacttgtggcgaccacctctccatcatcctgacaacgttcccgcgtcaacaccttcgacaagataaagaactcccaatgtccgcatcatcccaactccaaccacgtggccaaagattgcttcgtctacaaacagttcgcggagcaatacgtcaagaacgcacgtaaaccttcagacggagatcaaggcacatcaaagaacaaagatgatgaagacgatgccccgactggtttccaagatcatcgcaaagaacttaaccacatcttcggcggacccctggcttatgagtctaagagaaaacagaagctaacagaacgggagatcaatgcggttcagcctaacacgccccaatatcttcggtggtcggagatagcaattaagttcgaccgctcggatcatcccgactgagtggtccaccaggggcggtaccccctggtactagacccagtggttcgcaatgtcaagctccgacgaactctcatcgacggtggcaacgcactcaacatccttttcgtaagaccctggacgatatgcagattcctcgcacggagttaaagccgagtaatgcacccttccacggtgttatcccaggactgtcagctacaccactcggccagatcactcttctagttaccttcggcacgggggaaaattttcgcacaaaaaatgtctgtttcgaagttgctgatttcgagacagcatatcatgctatacttggacgaccagctttagctaaatttatggccgtcccacactacacctacatgatgatgaagatgcctggtcctcgaggagtcatatcactacgaagtgacatcaagcaggccgtcacatgcgacaaagaaagttgcgagatcgcccaaacccacgagactattctcgcccgcgaagagatccgactggctgcgaccacgacaagcgagggagaagtgcctgcaaccaagctgacgaagaccgaagaaagcgatgccaagacgaaaaagattcccttagatccctccgatcctgataagactgctgtaataggcgctgagttagattgtaaataggaaagcgcgctcatcacctttcttcaaaataataaagatatttttgcgtggaaaccatccgatatgcctggtatccccagagaggtgattgagcactctttacatgttaaggaagacgccaaacccatcaagcaacgactccgccgttttgcacaggacagaaaggatgcgatcaaggaggaattaaccaagctgttagcagcaggcttcattaaggaagtccttcatcccgactggctggctaacccagtcctggttcggaaaaagacggggcaatggcgtatgtgtgtcgattataccgacctcaacaaatcttgtcccaaagacccttttgggttacctcgcattgaccaggtggttgactcaacagccggctgcgagttactcagcttcttggactgttacttgggatatcattagatccgactaaaagaatccgactgcttgaagacctcgtttattacgccctttggagcctaatgctacatcaccatgccctttggattgaagaacgcaggagcaacctatcaacgcatgattcattgatgtttttcaactcagatcggtcgcaatgttgaagcttatgttgatgatgtagttgtcaagaccaagcagaaggatgacctgatcgcggatttagaagaaacttttacaagcattcgtgctttcaggatgaaactaaacccggaaaagtgcatcttcagagtaccgtcaggaaagttgctcggatttatggtatctcaaagaggcatataggccaacccggagaaaatcaacgccatcctcaacatgaaaccgccaagcttccaaaaagacgtccaaaagctgactggttgcatggcggcgctcagccggttcgtctcacgactcggcgaacgggggatgcccttcttcaagctgctgaaaaagactgacaattttcagtggggacccgaagcataaaaagcctttgaaaagttcaagagacttctcactactccaccagttttggcctcgccgcatccacaagagccgctactgttatatgtgtcggtgacctctcaggttgtgagcacggtcctggttgttgagcgtgaagaggaaggccatattcaaaaagtccaacgaccaatttattttgtcagtgaggttttagccgactccaagacaaggtatcctcaggttcaaaagttattatatggtgtcttaattaccgtcagaaaattatctcactattttcaaagtcactcggtcacggtagtcacatcgtttccactcggagatatacttcacaatcacgaagcaaatggacggattgcgaagtgggccttagagttgatgtctttgaacatatcattcaagccacgaacttcgatcaagtcacaagctttagctgatttccttgccgagtggaccgagtgccaagaaaacatgccagaggaaaagatggaatattggactatgcatttcgatgggtcgaagaggcttacaggcactggagctggggtcgtcttgatttccccgactggagaaagattgagctacgtattgtggatacatttttctgcgtcccataacgtggcggaatacgaggcgctactccatggattaaggattgcaatctctttaggcattcgccgattaatcgtccgtggagactctcagttagttgttaatcaagtcatgaaagagtggtcatgtctagatgataatatgactgcttatcgacaagaggtacgcaagttggaaaataaattcgatggactcgagctcacccatgtcctccgacataacaatgaggcagccgacagactggccaattttggttcaaaacgggaagcagctccttcagatgtgttcgtcgaacatctttataaaccgaccgtgcccagaaaagagacagtcgaagccatggatgctcaaggcgtaagcatgattgaagctgactggagagaaccgtttataaaatttttgagcaaacaagaactccctcaagacaaaaatgaagccgagaggatttccaggcgcagcaggctttacattattcatgagactgagctgtacaagaaaagtccatcaggaatactgcagcgctgtgtgtctttggaagaagggagacagttgttgaaggatattcattctggtatttgtggtaatcatgctgctgcacggaccattgtcggcaaagcttaccggcaaggttttttctggcctacagctgtgtccgatgcggacaagattgtgcggacatgcgaaggttgtcaattctttgccagacaaactcatttgccagcccaagagttacaaaccatcccgttgtcctagccgtttgcggtctgtgggcttgacatggtcggcccgtttaaaagggcagtcggcggttacacgcatctctttgtggctatcgacaaattctccaagtggattgaggctaaaccagtcatcacgatcacagcagataaagctagagattttttcatcaacattgtgcatcggtttggggtacctaatcggatcatcactgataatggcactcaattcactggcggagcatttcaagacttttgtgaagacttcagtattaaaatttgttacgcctccgtggcacaccctatgagtaacggacaagtcgagcgcgctaacggcatgatacttcaagggatcaaagcacgagtttttgaccggctacgtccctatgctggtaagtgggtagatcagctgtcgtccgtactctggtctttacgcactactcctagtcgggctaccggccagtcgccgttctttttggtttacggtgcagaagcaatgttgccgagtgaagtggaatttgaatcgctacgatttcggaacttcaacgaggagggctatgaagagggccgagtagacgacatcaatcgactagaagaagcccgagaagcagctttaattcagtcgactcgatatttgcaagggttgcgccgttatcataatcggaatgttcgatcgcgagcctttttagtcggtgacctggttatgaggaaaattcaaacaatacaggatcggcataaattatctcccttatgggaaggaccgttcataattgctgaagtcactcggccgggttcctatcgactcaagcgcgaagacggtactcttatcaacaattcttggaatattgaacaccttcgtcgattttacgcttaggcatttcgtttgtatctctcctctttgactgctaacttcaagtttttccttgaagttttcagtcagggggctactataataataatggagtgtgatttttatcaattcaatttgcttacttgatgtatcattgccctgtttgatttcttggcttagtcaatgaggactgaaagttttttaacaacttttgcgggttttaggctcaacaaggtttggcaaaaacttttaagaaatcaggaactaagttaagatatcaagcatagcataaattcatcagtattgtacaaattgtgcctccatcatcattaatcatcaaaatcattggtacagtaatcagtatcagtcttttcatcatcagaattatcaggaccagtcggtcgaagatcggtgtcctgaaatctctcaactacatcagcagcaatcttgtcagcggctttttgtgcattgctgatgaggtcaagagcagcttcttcgctcgtcccgtctgcaaagccatcaatggcatcaacgtcaaccctcgaataaagagatttggtcatcgccaacgccagacttgctcccatacttccagcttctttgatgttcttgaaatatgtatccggagcaactctcagcttgtcgaaaatttcagaagcatcaagtacactcgggccgttgttattgaagaacatcgcttgaacaattggggcagcagcgttagcaacctcatcccgggttccttcgagttttttgatcttgccaaccaggacgtcgaattgagcttgagattgatcttgcggtctgcatcaacagattcacattaataagttagcatatggaggataatggcttttgaggtattcattgttgataccttcaacttcctttaaagccaggtctctttgtcttgccagttctgccttgtcactttccagaatttgaatctggttctccaactgagatatcttggcagcttgcactacattgatcacggttaatcaagattgcaaagataacagtatgagtcagttgagcagagtttgtgcgtaccttttgatgagccactcagttcaaaatttgattcctggagctcagcgatccgatccctcagatcatgttcattcttcctagcaagttctttcacttcgtgcagttgattcctggtggcttcgagggttccgagatgagggactaacctctctaaggttactgttttggcttcgttcctaagatgaatcctctgcaagatagtttaattagcgcgtgaattaaatggcaaacaagatggttgaaatcaggtaccagagggcttacatttacaatgcgggttgcctgaccaagtgccttcttcagtaggcataactcttcgtcctctttttgcttatttatcacgatcccttgaggctgcatgttgtcatcccaccacttgaccagaatcggagggcatgaatcctcagctgcttgtatacgggggatttcttcttcatcaccaatcattggtcctaatgtattcactgacaaaggttagacaatcgatcagagttatttgggtcaacatggtttcagacaaagtgtttacccgtgatgatttctggacgaggacgagcggattcggatgcctttaaaggagatccagatctctggttattgtccgcgttttgtctgcgagggctgtctgcttgggtttcgacttctagaatctcttggcttggccctgcgtccgactggtttccagtcgggggctcctgattaactccggcttcggcttcggccgactggtttccagttgggggttgatcaccgaattctacattatcagttgccggatgattgtcactcgggtgatccccaacagttggcccggtttctttggaagaattcgtgcccatgttagtcgggtcagagtcttttccagacgggtctatatcagatggtttcctgcaaatttgattatcagtattattgccgcaatgggtgcgtatcaatacaagagagatcgttatatgagttgcacctagaagacttcctgatctttggcacatggcgactggatgttttcttccttggagtagcttgttttggtagtttcttggtcgtctctcggtcttcaggcctcctggtggtatcatcggcttcgtcgtcacttagaaccaacttcctctttcgataatctgactggccgactggatcagaagcactaggttgagtttcagaccgaattcttggtcctccgctcccttgcccagtttggtggtggggagatcggcgttgagcgattgggggatccgactgcatcaaagcaaattcctggatgtaatatccttcattgttagctgattcaacaagaaaacaagatcatattttgagaaagattgaagtgtatgaatacgtactggtggaggaggattgaatgcattgaacggtacgactggcagcaagtgtgagtagctgacaacgatggcgtttgagaagagcttatacatcctttccttcatgaccttgaagtcaagagaatctggatcttcacggtttgggtcatgcttgccgtcaaattcgaaggctgtgcgagatctttctttgattggagctaaccgacatttgataaagtgccgggtgatctgttctccttgaaggccctgttcttttagctttatcatcctctccatcagttctactgcttgtgcagcttcgtctcccattagcagtgagttccaagtatcccgataaactggaggaagacaggagtactcgggaagaacaggctcggggttttgaacataaaaccagtttgcgtgccagcctttatttgaggtcttgaagggcatggagaagtatttttggcttagtgttcccctgagttggaaaccagcacccccaacgacgcatggtttgctcttatttggctggggcttgaggaagaaaatgcggcggaataaggcgaaatgaggcctaatgcccagaaaagcttcgcaggcatggataaaattggcaatatgcactatggaatttggattcagatgatgcaagctaatcccgtagaagttcagaataccccggaaaaatcttgaggttggaagagaaaatccgccatagaagaaatgagcaaataccacgatttcgtgtgtatcgggggtcgggaatgcctcaccaaatgccggtcgccacccgatgatctcttttgctggaagaacgtcgtgcgccaccatctccttcagattgtcttccgtcacatcggagggcgcccactgactctcgaagctttctctttcttccgccatgaatgagaactgatgatttgatttagttcgagatacggctggaaagggatggggaatcggagcggtggatgcgggaagagatttcgtgaagttttttaagggtggattggagcggattgatgaaccctagtttgcccggcgcaattttgtactgtagcaggaaatggggaaaatggcgagagtctcagcggggaagacgaaacgacgtttggacttcggtgtttttagggtatcgggagtactaatgggccctggcctgtacagtacttcagcccaattatgttttcagcgtggcccgttgtgatccctagggacttaggcgctttttgctttggcaatatgtgctcacaatgatgcggcccgatgctgttgaaatcctttttaacgcgattcaataattctttggaattattatgatgcacatgaaaaggtgcccaacataaaggtattataccatttttgtaagcttttttaggctacgaaagctgttgggttaatttgagatgactggtttgttagtagtcattctcccagcatgttatatgcttattttggttatggtaagggtcacagcctaggctattagactcattaattaccatgattttctatcatgtttgatgggtcattttatgagattcttactcggattcctatcaaacatgtctatttttggacctttgagtgtttatcactcggcccttttcatattttttgtccttgatatattcaagtgagaagcagtcggctgggtattttattgagtaccatgcatgcttcgatataagatcactcggttcttgactatatgtttaatttttcaactaatcacatagtcgggggttacacctaattaggtgcatctactcgatgcaccatgttttattttcgcccttcacagtcttctagcactcggtaagccggagcaagttgaattgaagcactcagattattgttttttgtttcgagaagactattttggtcaactgcgaaggtctcgggggctactgtggagattatggttaccccatatctacatggcggttatattccagctggatatatggtaccaaatatagatagaatatctttatgaggactcgggttagattctaaacttgtatgtcaagaaaatacccaggattctagtcggttacgattgtattttatctgtaatcccatattccgttaggatatggactgtattttgtattacggatcccttcccctatataaggaggggtccgggttcctctcgggacgatttcttttttctcccaatcatacaatcaataacatactcggcggaatcatccccggacaggagtaaggtattacttcttgaataagaaggcctaaacctgtataaaattctttttctccaaacccattcactttcctagcttgatagccacccccttttattattgccgaaatcttgtttcgacaccgagcgtgcacaaggactagacgacgcgaccgccgaggagcgcgcggcacgggatgcggcggccgcagctaagcgggcggcggctcgcgcggccgatacgtcgcgggcgagcgacgccaccagcgccgccgttgacatgggcgagggataatcgattgaagaggaacggtaaaccctagttctccccacccgtcccggccgactgatccgattggagtatatatatatatatatcattaatatgcagtagtatcggccgagacggaacagtggatatataacaatctttctgctgctccgattttgtttcatggatactactgcttcatcgaagaggaccagtagatgaacaaaattggagcagtggatatatagcaatctttctgcgccgactggtccatgaaacaaaatctctttctgctcttcctcttatgtggtgatgctgcgttcttgactgccagtgtagtagccatgaatttttttccttgggtaagttcagttcgtaggttcacaacacatgctaaaattttctaacaccaaaaaaccgatacacaagtacaaatttaatataaatgcgataaaaatcaacattcaacaaccacaatttacaaagtgcatactcaatcattctcagattcatgaatcacaaatcgatttatgaagcagccgggagcggagagctggagacgggcaccggtagacgccacgccagacgggagacagcgggcggcggctctgcgacaagacggcaaccggccgacgtcccgcagcaaggcggcgactggcgatacaaggagaagttgtaacgtcgtcggcccccagctcggcgccgcgatggcgcggacggcggacccacgggcgtcggcgctgtggtgtggctcggcactgggctgcgccggcgctaacagcggacgcggcgtggcgccggcgcggacagcggtcagtggcggcgtggaagcgggcatcgggcacgaagggaatagatgctggaggtggaagcgctccaggctccctcaactcaaccctagctgtttgtgggctgttagagatgcctctaacggagtggttatttttgactctctaaatatctatattgccaggctgataaaaatttagagagtcaaatttatcttctattccaacatactattcacattccactctattaaccaatggattccgcctgtcattctcctcctctttcttcttcctcccctctctccaatccttagcccgtgctcctgctcgtgccagcgggtttggcggtggcgaaggcgtcgagcatctcaagttagcatttttctaggagtttgactttcatttcaagttagcatttttttaaaagaaatttcttatacgacttcttttgtatttttagaagtataaacgaacttaaaaactgactcaaacacagaactgtatttccaaaagcaaacgaacttaaaaaccgactcaaatacggatcacgtgccaaaataccgacaaaaacatctttattttttataatagttgagataaagataaagatagagaagtagaacttggtccgtctacccgtattaggatagatttggtgattcatggggattgatttggggagtcaatcttccgcggctttgggaagtcgatcttccactgctctacaaattcgtgaatcccgtgaaaatggccaaacttaagcagaaattcagccctctgttgctcatcgaacccatcgcagtatgggccaaaacatagtttctcttcttctggagcatccttgttggatctatgaacaagctctgcagtttccttgaatatcttgaaccggtgagccatctcagcatggtcacgctccttatcgtaagccttgcaccagcgctcatagaaggcccaaatggcttcatcagattcaaaatccttgtccgtcacactgtcaactagatcagtctcaaaatccttgtccgtctcatcgtcagctggctcaggaccatctatcacaacagcacaacattaatactgtcaagaacagcgaattggcttgcaagtttcaatttggttccttaaagttatcctgcctaatatgcccctaacctgattatggcaatcggatcagaaggcccgtaataagatgggggaggattggcttacatgatggcaatgggctgggaggagcaggagttggctcgtagtcgctgtagtcgtcgaggttataagacgggatgcgtgacaccgcgcgcgcggcgcgagatgcggcggcggcggctgagcgtgccgcgcgacgtgctgcgacgacggccgccgagcgtgcgcaaggactggacgacgcgaccgccgaggagcgcgcggcgcgggatgcggcggccgcggccaagcgggcggcgtctcgcgcggccgatacgtcgcgggcgagccgcgccaccagcgccgccgttgacatgggcgaggcgagtgatgatcgatcgaagaggaacagtaaaaccctagttctccccacccgtcccggccgactagctgctccgattggagtatatatagaacaggaataagttcacttgccaagtctaatttaacgcttttgctattctgatcgcgacaccggggggccaagacgcgatgcttacacggccgagtcaattgcgcattgacagctccattcgtggtgccatctgctacggcatacggctcgtcatctcaaggaagcaacaatgtctcacacagcagtcaagaacgcagcaccaccacacaggaggaagagcagaaagagattttgtttcaacgagtcagggatttccaaggagaagtggatgtagagctagctagcttccccttcatgaatggccgctggtacatcggcacgccctcgatcgtcgttgacagccttgaatgaatctgcaacaagatgacaggcgatatgagtaaacaataaaatggtttctaaaatatgcttaaacaatcatatggtttttgatatatgcggctatgaatctgcaacaagatgacgggcgatatgagtaaacaataaaatggtttctatatataatgctgcttaaacaatcaaatggtttctgatatgctgctgccctatcgtgagttttctttgtagtgtacaagttgggacttgggagacagctaaacatcgtttcaatgcttgaaacaattttgccatagcaaattactcccccatcccaaaatacctattttattgtaaaagcctatccaaccaacattgccacgtcaaaattatctctgcctctctacatacatgaatatctattcggctttttcttcatacgtggatttatagtggtacttatcagccatatcgtctcataaaatgtggttgtgaggtgaaatcgggttagagtcaactaacctaaggacgagcttgagtcaaactaacctcatagctagccatataactatccacactgatatggtccgctgcgaatccatgtcagaagaaatgggttgaatcaaatgtttgtgaaggggatggacttggcagtgctgagtgagtgggcttttgcaacaaaataggttatgtggtggaatatcaaaacaagagcgataattaatttggatggtttacataattttttagtgctattgttcttgtaaaatcgataaataattttaaattaaatttgctgaaaatctactgaggccctgtttagatccctccctaaaatttttcaccctgtcacattgaacatttgaacacatgcatgaagtattaaatactttgcgactaatttacgagacgaatcttttaagcctaattactccatgatttgacaatgtggtactaaagtaaacatttgctaataacagattaattaggcttaataaattcgtctcgcggtttaatgacggattctgtaattagttttttttattagtgcccgaacactctatgcgacaccctatataatacctgatgtgacacgccaaaactttacaaccctagatctaaacaccccccgagtaaagcactcttgtaccatcaagcaaactatccatggaaatgcagtgcctctgtgtcatgactcatgagagagagtgactactattttttttctttttaccttttcatgagtgttctttgcttgatccaaaacacgggggcgcatttagggaaggcatcactggaggcaggctgctcaagtaatgcattatccatattcgattcaacccaaccaaacctaaacccaaaataaaatgatgcctatatacttctggcagttgaccttccatcctgactagccggcggttcaacttatttttcagaatctgcatcgagacagaacagaggagaaagattcagaaaaaagaaaaagaagaaggatgtaacacatctgtctctgagcaaccattgttcggctctcaagtaccagtcggttggtcagatggaataaggttgctgcagtagcagtccatttctcttgatcttgatttgagtaggtgtgaagcaaaacctcgtgtcaatttggatgactttgtatatatgtagctgtcattgaacttcacttctgaaacctgctaaatttgaagtcggtatctttgcccatgtttacgctgtatctgatcaaaaccatttataagcatctgtggtttcactcaacccggcgaaaaagatgttatttagcgatgaatcagatattcagttgtaaagaagtgctcgctatagtattcataagtaaacaaactattttttggacaatacaagaggtgacttctattcttctagaatgcaaaggaagcaacgatttgcaaacaggtcaagcaagaaaatctcttcttttttttttttgctgggccggccaaaggatggccgaccaatttcattaagagaggggaaaaaaataaatagccaattacgaagtttgttacatcgacatgaaggatgtcgagggcgatcaaggccaggccttagatcaaagttgtctctttttttttttctgggccggccaaaggatgattgaccaatttcattaagagaggggaaaaaataaatagccaattacggagtttgttacatcgacgtgaaggatgtcgagggcgatcaaggccaagccttagatcaaagtcgttgtaatgtgaagcaggagtagtaccgttcaccaaaaaaaaaagtgaaaatagtacttcacatgccaccttgagaaattccttgttctcaaggcactgaaaggactactataattgcaactgaaataaaaccttggcttgcaatgcagaaactggactcgaaactcctcaaaatggccggtatgcttcacacgactttggaatataataaaaaccgtaagagaaatacaacctgtcgaagcaaagtcaaatcccaaacacacacatgattgcattgaccattacaaaccaaacaattcgacagatagtaagctacgcaaggacaaacaaagccacagcaaatcacacacaaactcatcttattttaaacatatttgaatctttttttcaaaaataaaaaaaaccatggccatatgcccatatgccattgacctcgaaaccattgcacaacctcatcgtctccttctctctctgtccaagttgtgtgtttgcaacatgcaaaagcgttgacgtcgcactcgcaacctccccctccctcgctttggatccaaacaaaaaccgcaccaaaccatcgagctcagccgcggcgcgcgcgcggcgacaccaccaactcgctggctcggcgtcgatcgccattgcttgatcaagctcgatcgcgatgagcggcggcggcgcgccgcctggggcgccggggatgatgacgccgggcgacggcaactccgtcggcatgttcagctccgaccgcatcggcgggttcggctacggcgtcggcgtgtccgtcgggatcctcctcctcatcaccaccatcacgctcgcgtcctacttctgcacgcgcgcgcccgtcaccgcggccgatgcagcggcggcggcgggatcgtcgcggcggcaccgcggtgggggtgggggcggcggcggcggcggcggcggggccgggcacgaacacgacgacgtcgagctcggcatcgacgaggcgacgctcaaggggtacccggaggtggtgtacggccagccgaggaaggaggcggcgaaggcggcgtcggcggcggcgacgaagaagggcggcgcaaccacgtgcagctgctgctcgatctgcctcgacaactacggcgacggcgacgtgctccggatgctgccggagtgcggccacctgttccaccgggagtgcgtcgacccgtggctccggcagcatccgacctgccccgtctgccggacgtcgccgctgccgagccccttgccgacgccgctcgccgaggtcacgccgctggcaatggcgaggccgtcatgacacgtggaggttctttgcttggttttcattttttaaaatttttttcttattcatataaaactaaacttgaggatgaaatttgtgtattctgcaaaatggaatgcataaaagaattcctcaagatagggactagaaatttcctcttggtaattgggtgtaaatttgggttcagagtagattttcttttctgatataaacaaagtttggcataggattctctttggaattaggattcactttggatttttggagggagattatgtatggattacaaatttggatgaaccttctagagatctaatttttatatcatcaagcttagtgcagaagaacgaagatgagtgtaaacaaagtaagaagtaggaacatatttgcagaatgctttatatatgtaaaattctatcatgaatatctgtaaaattgaagatgcacatttcaaaaggaatagatccttttaattaatgctcttgcatattatctagaaattgaggttgatgaggatatggaatgcagtaaacagattaacctcagttcaaacactcatgcattgtactcttgatgaattaattcaaagatctactaggtgcatatcaaatgatgacatcagcaacctatatacggccgtcccctagatacattgctccttcccccaggtttttgctgggtcaatcagtttacgccaaaatcattactttgtgctttgaagtaacggatataccaatcatgatgcatgctcttcaagaaaagagagcaaaagtgaaaaatgctaatttggcctaaacaaggcaagagtgcaagacgtatctacatcaagcctttttctgctaacaagtgacaacaacagatgtttcttttacaatttctaggaaaagaaaaggagaacttaattaggcaaattaccttcacatctgcagtgtcctgccacagaagctatggaatcattttcagctatgttgcacactgcagagtctttctatgatataaaagactcactgtgccgctctttggtatgatagacaattaggcatgggcaaaaatctggacaccaaactccatgacatcatttgaacagacagatctatttgcaaagatttggtccggaagaccggaatagtcgaatatatattgtgaatatctgaataaattagaatgtgattgtgatcattttcaggttcatctctgatcacatggagaacaagagcttaaaggaatgtctgcacgttgtgatgcagattacaaactaaatctttgcaaacgaaataaattctaaaaaaaaatcgaagcatcaggtggaaatcctgccattccctgtaggaaaaatattgcagcctggttatgtcagacagagtggttcagaatgcataattcatacagctctctgcagaagccatcttatttttgttcatgattcatgaagcacctagtcgctcccctgctgctttgtttttgactgtaaataacttttatttctcttaatacaaaatgcgctccttgcgtattccaaaaaagcacctagtcgcccttacaatcttcgtcggtgtcaattcctgcatcaatggcaccgggctttggttgataatgatcatttagtccctttcaagctttcatgacatgtgagttaagagtaaaacataattaacaaataatctagcacagtagcactagtgcactcgcattgtattattctagtacaggtccatgtgacttcgggatccaattcagcttcaagctggccaatcaagcaagagaagagaaatacaaaactaactccatttactccaaagttccctcacaatgaccaactgatcccaagatctaacatattaaaaaaatagcaatcagtctgaaggaaggaaaatctagttagcccagtgtatacaaaaatacaagtaacatcacattaaacaattgaacgttggtgtacagtcttctcttccattctttatgatcgaactaactcaaacaagaaactaataggaaatattagtaaattaaaatctagctcaggggatttagttttcatccaaggaaaaatgaaagagatcacgaagaattacggacatgtagatacagtttagtaaattccagtgagatcacagattcatcagtggtctccatttcttacatgtgtattgaagacactcacgagtcaccaatataagcatatgtatcttccatgtaatcataaaataaaagagatcaacaagaaactagcagccaagaactaaaacaaaacttttttttttgtaagtcgggaacactattttgctatatatattgacaaattttcttccaaatatttatcaaatgtaaatactgttttaatccaattcaggtggggtcttcccccccgatgttccatgaagaaaatgtaaatactgtataattacagtacaattacattcgaacttgtataactataacttatatgttacctttacataatcttgaaccattagtttgattacttcaatttctatgcaagttgggaagaaaaaaaataatagttgcaagttgggaagaaaaaaaatcatagtgcacacacgagtgaggatatttagtcccacggcgtccgctttgcaaattacgaattgtactgcatttacatgcaagttacgatacagttataatatgattgtactgtatttacatctgataaaatttcataagtatatactaggaattaataggcaaggagtagacctgagcaactaggcccattaaaaggcccataggcaggcatgagaaggccgcatccatcagcatttcagcacgcacctgagacctgatgatttgagtcctcgtcgcgtcgcgtcgcgtcgtgtccacctgcgaatcctctagtcctcgcgagtcgcgacacgcggagctttggcacctgcagcgatggcgaccgaccaccgccgcttccccgtcttcctcgccgcggcgctgctcaccctcctcctcctcccggcctccgccgcggccaccgacgtcgagtactgcagtgagtgcttcgaggcccttcccgtccgcagcttcgctcgcctcccgtctcgtgtcaagcttacgtttccgcttttggtggggtggggtttgttgctgcagggcaggggcgggattatcctgtgaaggtgagcggagtggagatcgtccctgaccccgtcgtcagcgggcagccggccaccttcaagatctccgcatccacgggtaagcaccaagcaccgatctgttactgcggcgggttgcagtttagtgcggtcatgcggttgggggatttactgggcatatgcagtagtcggatcgggagtcaaattagtgtgggttttgtagcgctgtccattcactggcattattgaattggtccaatttgcagaacagtacaaccatgcgatggaatttttgttgtaaggaagtaaagaacaaactgctggctgttagaaacttagaacatggaaatattgcgctgcagcctgcaggtgtttctgttaagactgcccttcacaaggcatttttcattgcgatgctacttgcagatggagcacctaatgtttgttggttgcaacttgcaaattgtgacaatgcgtgcatctgtatatgcatgctggatttagtgtagtttgccatagtttcatgcccattccttgtttgttgatgcccgtgtttgagcttactatgactgggtgccctggagttcatcatctgtgcactgttatgacacgtgttcattgtgatcccgcttaaattgctctgatagcaaaggggagagaatttctacaaataaggataagctaactgtttcgattttattcaagaagcatccctttctgtagagtacatttgagctacaagtctaaattcagcaacagaacaagggaatttccgtccacctagtttaattagcttagtttaattagctttatattgtttgtccaacatcctgctcaatacaaatatgatgcggcctctcacttcatactaagtaaaacaaaagtattaacacgtgttttctgtaaacatcataatacttattcatctcattagacatagtgtagcattaaccgttaatattctgggactatttgacacattagaagtttctagttgttattctgtctacttaatttagataacttgtgaggaaagctagaatacctccgtttatagttgaaaaagatcaaccaacaataagtcgataaagttgtgtgcattctttccacttgacatgtcggttacttttgtgtattttactaactttgtttgttgcatgacaagtatcatggcactgctcacttaacactcagtgaagtactgattcatcaaaagttcttggtatggttgtcaagtgtgtgtatggcttaagcatgactacagtacataggcttggatatttgaatgtatgaagctctggcagcacagctgctgtcactgtcttttcccatgtgttgtttctatatttcggtagatgcgtggattctttctttatagggaatatttgagttttgctcatatttcatgacattatgtgccaaacaaaattgaggagttgttgaggctgtattcattcagtaatttgtttgaggaaagcaaacatagcatataatttgaagttaatgatgagtattcaattaatacaaagatacattacaaatatatgcttcctagctcacttttcttatgatgatatttgatttttaaaagctactactataaagttttacgccagtagattcttgcctttgagtactgactggggactttttcatgactgctgccagataaaagcatcactaaggggaagctcgtgatagatgtcaagtacttctttttccatgtccattcagaaagtcacaacctttgtgaggagacctcttgcccagtaactggtgaattcgtgcttgcgcacgaacagactttaccatcaatcaccccaccagtaagcatagctgcagcatgcttttagttctgttggtgaagaagatattcttttgttaatgaatttcctaactacccaagaagaggggatagagaacatgtccttatatgacttctaactttctgtatgacattctaacataatattgtgttgcagggttcttacactctcaccatgaggctactagatgacggcaacaaggaactgacctgcatctcgtttgggttcagcatcgggttcatttcacctcttgctctcatctaaattcagctggagtcacagcaatgtacttgcagaactcccatagtcctaccacaacatgttccactaaagccggtttaatctccctgagttgaacatcttactacttctggtgttatgcaataactatagtcaattgccgcttatgttcagtatacttgattggacattgccctgtcgttgatctgtctctctgctctggctgtggagtccggtcgctttcatggaagaattgaaatgggaccattgcttcatttccttgatggcttgtcagcgtcgatcacctgtcatggttgggactaaacccaatcagctagacaaggttattgcttgctgactagccattatcaccctaatgcacaagcacaaaaccggcagccgtttgatcatggtggatgcggacatgcggttgttgtggagcatgcacttgcccatgcttattagctctaccaagcaaattttaggtagaccgctccgcgtgcgtcgaatggtttttgtttcatgcaactcggcatttacaggtcacctctggatatttgacctgttttttatacatgtaaggacgtcggatataacacagacactatttgtgaatgcgagtgcatacatgcttggaatcttatgagacttatgtgttcttatcagggtttttgcgttatcgcgatacccggtgttatcaatgggcacctataacaaatttcttcaaaaattgtcgataacggttctcaacgcgtaacaataactcctactagctaatagctaataattgtaatcgataaggtaaaaccggttctatttttaaaaatttatcctaaagtacaacaactagccatcttaatctctaaaatttatcttaaaatataacttctccaccagtcttattatcttaaccaattataaccatcttacacgcactttttttaacttgaccaatcaagaccatcttaatcaccataaaaaatacaaaattgtttatattttaggacggatggagtgttacacatgctacaaatatagtgtttttctcgaacatatgaattttacaggattttcgtacataaaatttcttcaaatttctccgtcttaaatgagacgacttaatagtaacacataatttcccgctaaaatcctggtggggcgtaacggctctagcctagccggccccgactcgaactcgaacgttaaccgggggcggcggttagttaagcttgaggaaaccgaaggcgggcgtacgaaatacgtattcgttgtcagcacgcgccccgcgcctacggctagcaccaaaagggaagggctgcgaggtacacgggcctcctcgcgagtcgcgagagccctagccttccacccctcctctctctttcccctctccaacccgcctccctctccgcgccgcgcgcctcctctctctctctcgcttcctcgcctccgcgccgcgccgcgccgcgacaccgcctctgcctccgcggggggatggagccgagcccgtacggaggcgtcggggggaagatccggcgccgcccggcgtcccgcgccgccgcgaccccctacgaacgcc

SEQ ID NO: 62495 - DNA, 746 bp, Oryza sativa
  unsure (1)..(746): unsure at all n locations
aaaccggtcgggctcctttcgcccaaacctggaaaagtaccgataaatcccaagtgatgttggtgtccccttgattgaacaagcagaagtgatggccgtggaaattgtgaacaaaaccaggcatcgatcctgaggaggagatgtgatccagtctttaacctatatatcccttcaaaagaacgaccacatatctcataggccatgcataggtataactccaaatagatagggcgagataatggttactagcaggctatccacttaatatgcctaatggtatgttggacattcgatcggtaagggtaaacatctcattgggatatatggctgggcacactggcgaccttgaagctcctatcgtggggtgcacggcaggtgatcaaactgtttaggcgatcatgaatgcactgctctctgtcttcctagccgtgcaagggttgataggggaatgcttcaccttctactttggtgtgcatgattatcactgcttgaaaatgctcatggcggaccggaattctgttatgtctatcgttctcgatgcgagggaccaggtcagtggcattaacatggtcaccgtccactctggcactgcgggtgacatggngaaaagatatcagatctgcttaacgtttcctgacaggatggactggtcagcgttcacctaaccactgtgaatgcaagaggtgattccagaatgcattgtttgcaatacacccggtaacaatttaggatctactggtgtttgg

SEQ ID NO: 62496 - DNA, 760 bp, Oryza sativa
aggaactggtgccatcattgacttttgccatacctgacaaacaacaaaatgaggatactggtcctcactgtcggtgatccgctggttgttattgaacacatgcatcgtgcatgattaattatcatagtaactcttgctacacatacaagtgtgaatgactcatatcattctcgtctccacacttaatatctagtgcactttcaccacctttcatcttgtagcccatgacgtgaagtctactcatatgacaacatgatgaacatgaactaatgcagcattccattatttgtgtgtacatacataccataaacccaatgaacagcctaaggcacaacgtggcgaacgcatgtgtctaacctatatctggtgaatgcaaaagcggatgaccgccctccccttcttttagtgtctctctttagaacacagaacgcgggacaatacaattcagccttgacaaccctaaccacttgcttgttagctactcgctgcagagtcgaacacttgaatgtggacatactcagtagacagacacaaaatcacctctcgcaagcgaacttggactagaaatataattaggcacatctgtaatcacctgcactatatccagcacgaagcccacgtggccctttgaatacgcggggagagccattacctactgcctggcagtgcacagtattgtcattgaccaccttacatgccgctgacaatgactcatccgtatcagccgcaatatctgaactaacctggcccttatccagag

SEQ ID NO: 62497 - DNA, 1098 bp, Oryza sativa
taccccatacccacacggcatggttatccgactagttataggggataacttatatatatgaaatatgtaacagattatgacttgggtattacgtttccctgtatattatggaacggcctaaagtcctggtttgataagattgtaaagtagatttagtaaaccgataccgtgttggttaaggtttctatcttgtaatcctgccccccatcctatataaggtgggcaggaggccctctagggggcatgacacaactagatcgtcagatcaatacacacccggcggattcaaatccccaaacaggagtagggtattacctctcattgagagggcctgaacctgtctaaatcctttgtctccgcatccatccacttttagggctcgtgcgctaccccttttattattgccgaaatctagtttcgacagttggcgcgccaggtaggggttgcgtcgaattacctgtcgaaaagtgcgatggaatcaacttcagaagaagcccggagatcaatctcatcaatttcgacggctcaaatctttaatcgggtttatcgttccaatctaatttttattagattgatttttaatcgttgtttgatttcctgatattttgatgcatttcatatactcgatgagatcgagacacggccatcatcgtcgcctgctcgggtgcccttgccgtgtccgagtgctcctctcttcctttccttgcagttggacgtgttgctggagtagcacaggccgccaggagcaaattaaacacacgcatctgttgatttattaatcaacacgtatatgcagactggaattaatctactaattgctttctattgcatgtacacatgtgccgttcgattcctgtttccatgtatgacagttgatgtgctccgccggccatctccgataatggcgtcataccgaaagaacatcgagttagcagttagttgccggggcttatacatgttgcatggcgcgtcgccggctatcacccacgatccagcctcactgctcgacttgagtttttcgtttcaatttgttatcaataatcaatatatattagattgatttgtaatctcagataaatttcttgatattttgtggtg

SEQ ID NO: 62498 - DNA, 686 bp, Oryza sativa
aaccaagcacatggcaagaagctggaggaagagatggagcggtctctggaggtgctggatctttgcagcgccatgcaagagatgttcgctgacctgaagatgaccatccaagagctgcagatggttctcaacaggggagaccatgcagttgttcaagtgaaggctcagtcatacatccgcctggtgaagaaggctaagcatcacctgaagaaggccagcaacaagtctacctctgatgaggatggaaggcttgtcagtctgttgacaacagcgagagggatcactgcctcggtcctgaaatctgccctagagctcctgtcgaagcaaatctccacctgcaatccaagcaagtggtctcttatctccaaatcgttccagaaggccaaagtttcatgcgaggaggtgcaattgcaggcattagagttgggcatcgttgccatgggggcggacatcgcccccgccgcccccggtggcgccggagcggactctatctcccctcgccctttctcgccggagccttctccggtggtgggagtctgggagaccagaccagacgagtaggcagtagtaattttttctggggccgcgggcttacttgtatttgggcctggtgggtttttccggtatctcatattaagcccactacaaaatgggcccccccacaatcaaaatcaaaatgaacatcg

SEQ ID NO: 62499 - DNA, 639 bp, Oryza sativa
agaaatcctgccaaatttttggcaagtttgtcaaaattttggcaactataccaaaattttggtaaaatttggggctgctcactttgctgccaaaaaaaccttactaaattttggcaatggcaactataccaaaactttggcatgatttcttatatagttatcaaaatttggcggcaaactaaatgtagccacttttttttttgacaactttaccaaaatttggtaaggttgaaaatggcaccaaagtgaacatgcctttggtaaggtttttttttcatcaaagtgaacaagccctcagcgttacatcagcggattagacattgcccgctgaattaattaagttatagtaacattttgaaaataacataataatagcaaaatatggagtgtataccatatgcatgcatccaaaaacatttatgtacgcaagactacaaagcacatgccgatcccacaatgcgtcgcatgctaactccaataccagaggcccctgctgcccaccctgacgctagctcgaccctattttggcttcgtgctgacccgatatggagtagtacaatacactatcattttcttgcatgataactgtccaaatatgtgcatgccaaacacgccgaagatctgatcagggaagcaaag

SEQ ID NO: 62500 - DNA, 1722 bp, Oryza sativa
ggcgctgctgcttcttgacgtcggcgcgcgccttcctggcgaggcgcgcgtaggcgctcgccgcgctctgggcgccggcggcgtcgcctcggcggacggccacctcgaggtcaagcgcgcaggcgcgcatcgcccgcaggctgtccctcgctgcggcgcacgcgtcgagcagcgccaccgacgcctcagctccctcctccacctgctcggcgcaggcgaaccgcacgagcggcccgacgtgctcgtacacccgcgccacgccctccagcgcgccggccatcgccgccgccgccgaggaagacgacgacgacgacgccacgttctgcctcagcctgcacagctgctgctcctccatagctgcagatcaccacactagcttccctcaattcttgggaattaatggcgatcgatcgaggaagacgaatgcatgcaccatggacagatgcgatatatatcctgagccgccggaagaatctcatcgctggcatgtcggtacggcctgcctcgccggcaaggcctggctggcatgcctcccgtgggcgcggcacccacaccgcacgagcgcgcgacggcgacgacggcgacgcaccacgtacgtactaggaagcgtcgagcagttgcaaccacgagtggttggagcttgacgacgagctcggctagggacgcgtggcgcgtctccacggaagcgcgcgaagccgacgagtgggttcgcgcgcgaatttgaatgaatgattgcacggccgtaccagcgaaggaggggaggaggagatctttggggatcctgcaatcggattaaacaaacgaattaaagttgattaatttgtgctctgacgtgcatgacatcgtcagatacgttcatacgctggcctgatacagcattatctgtatctgtataagtataatcatgattaaggtttttctctgctgtgtttcgtctgattgatgctgtctctctcacctaatacatgtacgtgtcactttctcaccaggtttgtgaaactggtttgtcttgtctccactgatgcaacagatgacaacatgctgacatcctggcttttgttttctcaattcatcatggaattgttattactttttttattcttttttaatttttaattttaaaaatattttttccgaatctgaacattttagccacgccaccctacctgtagtggatgtgtctgtatcgttttgccacaccaataggtttagatttagaaataggttttgcgagattttatttttaaattaagaaggttcaaaaaaaatttagaaaaaaacttcaacatcatgtttcatatgtactgatctggttgtcactttcaagaacagcttggcaaccagattcaagaacagtgcatactgagacaggttaagagatgaaagaaaaaggctcaactcaagttacactcgctgtacaaagttacagtgtcacaggtacaaatgaatcatatcatgtgtatacagataaacgcagagagagactttttttcgacagccaatcaaattaggagattgaagagttgcagtatcagggccatgtctgcataaaatgctgtcatgctgaggctcccaattcccaaatgcttcggtgggaattatcgagtagagactccaaacagagcatcaaacatgtctcattatcgatgtagaggcaggagtgatatccattatctaaaaaaattatctcattatcgagtatcagataagattcatccacag

SEQ ID NO: 62501 - DNA, 11378 bp, Oryza sativa
atgttccaacaattagcagcaagaatcagcaggctagttcacttgactggtggatcttgacatatttgtgtgctcaatgtattattttaatggggtgctaattgagttttattgctggcatgcgtgttctctagttttgttgcagttgttaatttccataggtgtttttctatgcacaattcagtctgcttacacgctcaacctcgtgtgttgaagctggcttgtttttttctgtggtagcaagatccactacacaaggatcctttgcttgttgctggtgcaacatatggcatctgaataacgtggccatacaatagtaaataatttcaaagatcagagtgaacagtctttgctaactacttctataacaggcaataatggcaagcatcttataagaaaattaggtgcttctgtcaaagcatggatgaaatgcaacaagaagtagataaaatactgtgctttgtttctcaacttaatatctgtacaattcctctaatgtatatacacattgctaaaatgttgcagtgaccagcagatcctttaaaatttggacaccagtcacaggggatcaaagtggtatatgatctatctacaagctgagagtgttgagaagagaaactctgctctggatcgatttcctgaacagattcttgactccagtgtctaaatcagcaatgttcgactccaacacttgcaattgctcctcttggcagaaaagtgctctcttcttgaatgtcttggagacaagagaccacttgctagaacttggcatcgcaagttgccttgagagaagatggaatgaggtttcaagcattaagatagctatctctcttgcttcagccaacagcttgaccaccctgcagctttccagatcaactgaagaagacttcttgctgatcttcctgaactgtttttgtgccttcttgataaggcagatataagactggatcttcacttgcacagctgcattatctcctctcttcataatcagctgcatgtcttgaatgctttgcttaaggttggaaaagctctcctgcatggcattgcagaaatcgagcaagatgagagagcgctcaagctcttgctccactgctttcctctgcagtggctggcaaattgcaacatggctgcttggcaggcacatgatctcattgatgcagctgtagatattcccgatcctcttcaagccattactcattgtctcaatggtcgaagacgatgaagaaacaattgccttcaggttctggagctgcccttcgatatcgatttcgttggagcgagggctcgatggcacacttgcagatctcaggtggaatgccatgtcttcagaggaagctgtaatactttttttttcctcctctctctgaagttggaagaggagaaggtatgctacaatggtgtcgacacggttagctttatctctatatataacggaagaagaagaagaagaagcagaggcaatggcatctctactctgtagacagcattggaatctcaattacatttaagtaatgtgctgctgcaacggatgccacccatctcctcgacaagctgatgaattttatgtttggtaatcaagtgtgtgtaacagtgcaagtggcatgtctagctcatcttgtgtctatcatgtgctggctattggcagcaaactcattgcacgagcatgttgtttaaatttagatccagatccagatcatgggattgatgagcttgccactaaagagaacaagagctgttcctttgctcggccacgcaacaggtgactatacctccatgatgtgttcttatctggtacgttcttcgtgcagcatcacatcggtggcctgccttctgcactcacagcattcagcatctgctgcaatctcaagatgattccacgtgctgtccaaatttctgatgcattaggcctaactgagtcacattgtcatgttccagttattggcagcaggaatcagcatggcagcttattctattactgagccttgtcatacgtgtatgctccagcacccatttaatggagattgctaatcaactagtattggtgccatgtgtgctattgcatctgattgctgagcaatttatcaacaactatttagttatatggggagcaaaggatcttgtgcctgttcctgtctcatgtgaatactggtgacatgaccatcccatggctttacgaaggcaaggtgggaactgtgtacttattactaattgcatatattatgacagccaaaaatggtatgtgtcttctgactaatttattatttttttgcttgaacatgcttcaggtgaagcgctccaaatgtccggtgattgtttgagagcagtatgcgtcaagtgaagggggaaattagaggcaaaagagtgaaatattcattgaatgaactcctgtacatttcctcatgtatgatgtaggtgaacatacaaaattgttttggtgatcaacaaatcctctaataggcggacgccaatcacaggtgtcagagttgggaatgttccatcattctatctacatgctgagagcgtttagaagagaaactctgctctggatcgattttctgaacagattctcgattccgctctcaagatcaacaatgtccaactccaacgcctgcaattgctcctcctcgcagataattcttctcttttggaatgtcttggagacgagagaccacttgctataactcggcatcacagtttgcttcgagaggagatgtgatgagatttcaagcattgagaaggctgtctctcttgcttcagccaacagcttgaccaccctgcagctctcctgatcaggtgacagagtcttcttgctaatcttcttgtactgtttctgcgccttcttggcaaggcggatgcatgatggaatattggcttgaacagctgcgtcttctcctctcttgataaccaacatcatgtcttggatgcttgccttgagctcagaaaagttctgttgcatagccttgcagaggtcaagcaagacgagagagcactcgagctcttgctccactgctttcctgttctgtgactggcaaaggagaacttggctgctaggcatgcacatgatctcgtcgatgctatcatagatgctcttaagcctcttcaagccatcgttcatcgtcctgatggttgaagaaggtgaggagattgttgcctttaggctctgcagctgttcttcgacattggtttcgctggaccgtgggctggatggcgcactcgcagatctgagatggaatgccattatatttttctcttgttttcttttctctggagatggataggaagagaaaggaaactgtgctgcaatggtgtcgacctgggcatggtttgcctgtatatataacgaaaggagctcaagcaatggcatttctgattgtgtagacagccatggaattgttgtgctgctgcaacagaagccacccaactcctcgacaagctgatgttttttttcatgtaagaggcatctctagctcagctaatgattgtaccatcatgtcccgattattggcggcaaactcagctgcacgagcgggttgcttagtgttgaattcaagttcaagatggtgagaccaatgaagcatgcaatgaaatgggagaatcaatcatgcggtttctgcactagcatgttactcctgcctgccgtgctaaactgcaaaatgttcttatcagttgtgagttgtcatgctgcaaaataaggacacattgtgacattgtcaaccatctctaacaagttgatgcttcatgtcttaggttgtgttggcaaagtggcaaactcatctgcacgagggcgtggttggttcttgcttgtgtgagaggattcgttgttcttataaatgacagccttggtccattgacatttcagccattatatatcactctgttgtcttcacagcattgctgtcatgtttcagttgtatggtacagcacatttctctgttcaagtgttcattatggatatgatccacatttagtgcattttttcagtgtattaggtgccgttcgtgtagatgagtttatgttttttcaacatcagtttccggcatcagtctttgttatagtatgtttcagctgtctgcggttagtatttgatgttcatatgccttttattttgatattatgcatgtttgatcctttttcaagtacaatgttggtgcctcttaagagcttaattaccacatatacattttccagttattggcgagaatgaaaccagtagcgcactggtactaagccaaacaggtgcatgcatctttaggtgattctaaatccaaaatctttttaaggttttaaaccaaacatatcaaaatatattaatgccaaaattggtcaaatttcgtcattaccaagttttgataaaattgaaagtgtcaacaaagtgaaaggacccgagatgcgcattctctgattctcctccatcttcctcatcagcttgggccgaaattgacatgtgacgcccatagtaaagcccacacggcccataacccaccacgcgtctcttcaaatttccgcccctaaataaaaataaaacgaaataaaagaccaaaaaaaaaaaaaactcacgagaggcgcatcggcggcggcgccgccacagggccaccggccgccgtcgccggcgatctgcagggtcaagcactcaagcccccgcagcctgcttcccgccggaggtcagttcggaaccctacttttttattagcgttgcagtgggttaccgccgtccttccactgttgcgttatcgcattagcgattgggttagggaatgattacagactaattggtgctaatcacaaggtcagacctcgtggggttggatctggcatgctgcgtgtatgcagggcaggccagcatgatccaccattgaaggatcgtgcgctgattatgggattaaacaagtgcgaggtcacatggccactttgaaatcaaacatttaggttcagaaatggacagcattaagcagttgaaagttgattccatctacttataacttattctagtcgaatctctctcttttttctctatcttcctgagaagagaaatcgtgtttcacttgcaacaataattcacatcttctgtttttttcatgttttttttttgttacccatagttttatggacatcagcacatcacaaaatcacatcatcagataccactgaaatcagaaatcagaagcatgtataaatgattggagatgagacactggctagatcaaaactgctgttttcaattgctctttttgttctatacatttacagatgtacaaagattggcagatcctttaaaaggcggaggccaatcacagggtgttagagtgtcttcactttaggagaatctatgagctaagagtgtttaggagcgctactctgctctggatcattctcctgaacagaagttcggctccattctcaagatctccaatgatgcactctaatgcctgcaattgctcctcctcacaaacaactgatctcttcttttggaatgccttagagacaagaaacatcttgggaaccactagttgctgtgataggtggcacgatgtcgactcgagtagagagacggtgagcactctagccttgatcaatagcttgatcagcttgcagtcctccttgtcagaagtagtcttcttgctcatcttcttgcattgcttctgcgccttcttggccaagcgggtgaaagattggatcttgacctgaatgcttgcactgtctcctcttctgagagccgcgtgcagatcttggatgatggtcttcaactcggtgaagttctcttgcatggcactgcagagatcgatcagctcgagggagcactccatttccccatccaacattttcctttgctgtgcagagaaaacttggttgctgggcaagtggatcatcctcctcgatctgattgtagacatctccaagcctcctcagaccatcaatggtcgtggagggtgaagagatgcttgcctctaggctttgcagctcatcctcgatttcagcttcattggattgcctcttggatggcaaactgactgatcttaggtggcaagccatctttgtattggagtattcgagagttgggagatgtggaagaaagatgaaacttgggtttgatgtctctactcctcaggcgatgcctatttatacactggaagcaactgagacagcatcaattttttaagaaatgggagagagcgagcatcttttgaaaggtagacagaaagaatcatgccatttgatttcccagatgctgtctgttgaagttgcatgctaatgctgcagaagtgctgcattatcaaggcttttcacgtgaagtacacatatttagttcactagacttcacaaactggtcttaacactctgtcatgttgcaattataggtagcaagaatctgcatttgttccaaccgtcacgatgggtcttgagggaaatgcaaggaaaaccattaacaggttcttaattgagtattattagtgcatgtgtattagttcaattcttgttgctctttgacattagtaggtgtttccatcagtaaatataaatgataatgctaattaccgggttgtagctcgtgtgttggagctggcatgtttcagctgagtagagcaagatccatttcagaaggatcttccgctagaggaacatgtgagttaacataacctttgttcccataaaaaaaaaccattaacgtgaagcccgcaaggctgtaataacaagttgataaccttatggagacatgtcacttttgttttaacatcaaaaaattataagaggcacaaaattttacttggctggaacggcccggatcttaggttgttcttttgccctgtaaatggatggtatgtttgaggcacaatacctatattttagttatgagaaacgtcaatcagtcatgatgtgaataataccaaagactcatagcatgaaattgacaaaattgcttctctttctttttaatttagtgaactttgtatacatatccacaagactatacatgttgcaaaattgttgtgatcgactgatcctttaaaaagtggaggcctatcacagggtattggagctcaggttgcctatgagctaagagtattcagaagagaaactctgccctggatcaatctcctgaacagaagttctgctccactctcaaggtctttgatagtgagctccaattcctgcaattgctcctcttcgcacatgactttgctcttctggaatgtggcggagacaagagaccacttaggcgtctcaattttcttcgacaggaaacaggatgtagactcaagcaatgagacggtgatttctcttgcttctgctagtagctttaccaccctacagtccatcttatcagaagcagtctttttgctgaccttcttgaattgcttccgcgccttcttggctagccggatgtatgccttgacttgagcagacgcatcttctccccttttgatggccaacatcatctcttgtacactcatcctcaactccatgaagctttcttgcatggcattgcagaggtcaagcaagacgagtgaccgtccaagctcttcctccaccaacttcctttgcagcttctggcaaaggctaacttggttactaggtgtgcaaatcagctcctcaatggagttgtagatatctccaagcttcctcaaaccatcgcacatcgtgtcgatggttgctgatggtgaagagacgactgtgtttagggtctggagctgctgctcaattgtggtatcatttgagcaagggctggaaggcacgcttgcagacctttgatggcaagccatgtcgggattgaagctttggtgttattttcttctgtgggaatgggaagagaagagcaaggaagagagaagatgcactttgctggtactcaaacactttggctcctctcttatttataactgaagaagcagaaccaaaaacgtgattgggtttgaacagagcaatcgacagaaagaatctcatctactaacctccctgcattgtgcgttgtcataataagtgatctgttctgaaacatagccattcaagcctagacatgttgttattcatctgatttttaattagtgcaacaaatgctaatgagtgagcttatgagcctgtcatgtctcaactattgatgacagtatacttgcacgagggtttagtttgatttcagatccagatacatcatcaggaaggaaggaggaaaagcagccttttggtgctggtgaggaaataattattttggttttcttctgatactcctacattaggacgagttgaacattcatctctcatgcagcagcagcagcagcagcatcgctggcatgttccagctatccacagaaaggatgaccatgcaagtgcacgcattcttgactcaacaaccagtataatttatcttgtaatatcaaagtttcggttggatagatatgacacgatcatgtcaaatcatatttattagggaaggtagcagtgagcagctaagcatacagcagaaatgtgacttgattagttagcttaaattttgacaagaactttctaggatgcaacacttgcacacgaatgcaatcatcatctggcaaaattttttgagatattttaagagtttgcaggcgtgcaaggaagtgttgagaaatcaaacaatcgttgtcacagtagtcaagtcagtttgcgtagcttccgattgtacacctggatagagataatgtgccacttgttcataagttgatagggtaaacacaggctccaagatggtagagaaggaacaaatcacatgttaacaaaactgtgtaatttctttttgcaaggaagcaatgcatgccttctcaattatgtatcttgctatacatttagacttacgtacatattattcaaaatttgtggtgattgacaggtcctataaaagttggatgccaatgccaatggagcatctatgagctaagagtgttcagaagggaagccctggtttggatcaatctcctgaacagattctcagctccgctctctaggccaacgatgcccaactctaatgcctgcaattgcacctcctcgcatgaaactttggccttctggaacgatttggagataagagaccacttgcttggattgcaggtggagatttgcttcgacaggagctctagggcagatttcaggaccgaggcagtgatccctctcgctgttgtcaacagactgacaagccttccatcctcatcagaggtagacttgttgctggccttcttcaggtgatgcttagccttcttcaccaggcggatgtatgactgagccttcacttgaacaactgcatggtctcccctgttgagaaccatctgcagctcttggatggtcatcttcaggtcagcgaacatctcttgcatggcgctgcaaagatccagcacctccagagaccgctccatctcttcctccagcttcttgccatgtgcttggttgctatgcaagcttatgatctcgttgatgcagttgtagacgccaccaagcctcctcagagcgtcagacaccatttcgatggtggcggatggcgatgagatgcctgagcatatgttgcgcagctcttcttcgatcttgatgtagttggggtgaggcatagacggcaggcttgtcgatctttgatggccagccatgtttggaatgaaatttggtgctatgcctcagactctgagtgttgggagcagatgatgaactggtggtgctaatgctccaactctccctacttataatcaggaggttgagaagatggtatgaggcaaattatgcagagacagcaggaatctccactgctctgctctcccatctgctctttgattgcatggccaatgcagctgcagacaaggtgatgcccttcagatgttgtctaattccaggtacactgctaactaacctttgctgtgttgtcatgtctcatgcattgcaagcagagtaagctgcacgctcaagagattgtactgttgggttcttatggatgacaaaagcacaaaaagaacgaaacaacagaggtacgtggaagtttcatcggtgttgattgttgaaacttgtttcagatatcgtaagcaggatccaccatttgtattcacctgccaagttgtaaggatctgagcatatctgatcaaatgaacatctgaagcaacacatcatcacttgtttggcaacattggaggttcactactcgttgatcctgttgctctgtctgtaggatttttttttcttttatgtccaatgctttgtctacaactctaagtaggacttctccatcatgccagcgggctcatcggagattcctcatactgcaaatgatctcaaatagtctgaaaatttgtgacatcaaaaagacagccggaagatgcaatcctctaatttgctccagcttcagggaacagtgtgaataactctactttggctaagtgaaaagaactatgtgaagctgagctgatagcgtggctttgccccttcccgctgtttaggagttgcttttagctgccgcagtagttcctaagcttcagtttttggctttgctttttctcccttcccttgtaacaaaaattctttttcttctaatatattgacgtgtaatccttttgcgcgttcgcgaaaaaactgagctggtaatatattactctgacactagtctacttaaggaggtaacctatcctatgcaaataagtttcgggtgcatcctcaaaaattcttgaaaaaattatacatgtatttccaatagtattgtaattgtgtgtgaagtctctttaaaaaattcattatatatagagagagaccaaattctaacttacttatattcttaaaactattagttttataaaaaaaaacggatgaaataaaaataactttgaagcggagactttacatgtatgtgtagtactattggaagcacatgtacagttttttctagaattttaagtggaatttgttagatggtgtgcacgttgtgcatccaaaacttaggctgtgtttgagggagagaggattgggaagatacgcaaaacgagatgagtcattagcgcatgattaattgagtattaattattttaaacttcaaaaatggattaatatgatttttttaaataacttttttatagaaattttttgcaaaaaccgcaccggttagtagtttgaaaagcgtacgcgcggaaaacgagtgacaatctcccctatctccaatgaacgaacgcagccttagttaatgactgattgttagtccagtttatgtgaaagttgtttcacaacaaataatttcgtacatgtacgaatgtaaaagactaaaggagtagtagttatgaaacaaagctaaattgtgttcatcagcatatgtgacatgagaattctgatcttttcttcttcctttcgatgggtatgatggcatcggagagcacagtagtccaagagaatgg

SEQ ID NO: 62502 - DNA, 12115 bp, Oryza sativa
gaaaagggtttaggaagatctcgccgatggattattgctgggagtggtacaccggttattcaggtatattatttctcggtataatcgacgagaaccaatgaaacacggacaacctttgcaaaagaaaaaaaaaactgctcggagtactttattcgttttttggttttaactggtttactgagcggtttcttggctcaaagatggttgattagcaccatataaccaaagcgcagtggcttatctacaattttatataggtgatccaacttatatattttttaaatatataaaattatcgtggattattttctcgattacatggacaaattaattgttttttttaaagactgtctatgtaaaattgcagtggtaagcattgcagcgaaagaaagtacggagaaaatgatttttagcaataatccggggtactatataaaattaatttattttctaagtatgtaataattgaaatttaattaatcatgcactgacaattttattatttttcgtgtcctaacttaatcttgattttcgatagaaacgatcagtaaatttatcacacctatacggagtgcaagggcagaactagatatgagagggggtgcctaggaaccgttcaagaaatttgtttagctatagtttatctatttttaacatatttgcaccttcactcaattcaaattcagacatatgtatcagtctaaacttgatttaaagtaaatgatacccctctctatttgacagcgtgtatatgtcagctttatggataccacatatctaatagtagttgactaaatcttggcaggacctaccacatactatgtcctatatggaaacaacctacggatataggaggagttccggataaggaaagacaaccagagttctacatggaaacaacaaagactactcggattgtatccatattgttttccctagttctacttggacgaggggacacctataggtataaatacaagccccccaggaggagaggggacacgagacgatcaacacccaacacaatcgacatagaagccacaacatagaagcctaaatacgccaaaacacgccgccggatatcgacttcagggataagcacggctagtaccctgcggtgtctccggatactgtcaggagagacgaaagcgctatctctgatctcgccgggcacggattcgaggaggaaggctaccctgttgtcgactacgagtcagatcttcagaccgccaggttgacaacagttagagaggctaccccaaatattgtactggtgtgattatcatgaataagagcaatatcggcttcgactaacaggatgtagggttattacctgacaattcaggggcccaaacctgtataaaaatcctcgtctttgtctcttttacttcagtctcgcgtataccctagtaccaacgatccccataccatacaaataccagaattgcgacatcaaacgtcgacagtatatactcctcatcgtagagcaggtacaatagcatgctataaccagccgcaaacatatttcaaggagacaaatgagaaggaaaaagagcagcgggctatagatttatagccagctgtagcacggactccaagacacagtgtgtgtatgacaggtaggaccagatattaatagtgtagtatgtaactatcgtataaatgagctattagattgactataaattaattgaagctagtagttgactatactatttaaacttgctcttacaagcttacttgaagtacgagttacagtacgttaaacgttttacagcccgggatatgagaaatctgatggcagagtgcatgggaagagaggctgtaccagcagagagcagtttgtgtgatggcggccaacgaggaggcgaaacgtgtcgcatgattttgtgtcatcgtcggcgtcgtagggaccacatggctggagatggacgtactacggggcagtggccactgggtggctcctatgctagctgctgctgctgctgctttggcgtttgaggatggatggatggatgggtggctgcgtcgtcgtgacttgactttggtccacacggccccgaccaccccaaatctagcatcatcatttccccctcctgcaacaagcaattaccactagccggaggagtagtagccatctatgctacacattgcaccacagccatagccctcatctctcatcgatggggagaaagaaattttagagatcgtttttctccttttgacgtcatctatggtacgagcaaagccctaatataacagcaggtataagccaattataaatatattttaaggagataaaaataagagagaagagcagcggactataaatttatagctaactgcagtatagactccaagaagcaacatgtgtgatatgtgggaccagatattaatagtgtagtatatgtttgtaggtaactattgtataaattggctattaaattgattatagatgatttagagctagtaattggctatactattaaacttcctttaaccaactcttctctttgaggccattcacagcgctcctatgtagcgtgtggactcgctcagccacgtaggacactcgctgtggtggacaaaaaagtagatggggcccatgaccttagtttgcttcccctatctcgttttggcttcgagagcctcgcctgcaactgcatgcatctaacgcagggcccacaaagcggcgggaaggggagaaggggaagcggcggcgctgcacgtcatggttgtcgtcgccgagagccatcgtggtcgtcgtcaggccaccaacagatcagccgccaactctaccgcccaagaagattcagcggtgatgccgctgttgcgagtagatcggctagcgagaggaagacgaggcggccatcttcatggagcgtgggacaccgcgagtagccatcgttgccggctccaagaagatgagcgcgagctcaatccactgcgcggcagcaccatcggagctcgattcgcagagagaaagagggccttgtcaccgtcgcctccggccgccctttccgcttcatttattgggccaccggcgaggaggaggagtggcggtggtggataggagagacggcaacagaggggagaagcggctggcgccggcggagcgagaacgagatgcggcgattccggcagagaagaggatcatgtgagagagagagggggagggaggagaaaaggtataggaaggggctgacatgcgggtctgaaataaaaaaaacaactaggctgacctttactgcggggtgtgtggcctaaatgtgttgtgcttatgtgacatctagggctcctcaaatgagcaaaccgcattatgaatggcctgagtataacctttcaaatcttgcacaaatagtatttcctcagtctaaacttcaaaagaaaaactaatatgagtacgatacattctaactacgaatctgaccaatgctaaaattatgaggttgttcggctggctgggctacgactgcgttacagtagtagctagcacggacagttcctcaattgtcaaggcagttgtcgcgggtgttgtggcccggctttgccgaatagactgactaccccatactccatatgtggatgagttttcagtcaagtttatgttatacccgattcacctctacatcctttaatatccatcttttaattaaaaagggtgttgtttttacaggaatggaacaattccattcaacggcatgcttcccgagctttcaaatggtgcactttataaagaattctcaatacattagtttcttataatactatcttgaatttattttcagcatcataacaattaattcatttgtttataccatatgataatatcacaaatcattaaactaatattcaatattccattccatttagtaaaagtacatatgcttcaattcccttttttaaagttgtctaaacacaagtactcccttcgtcccatcttaattgatgaaaagtgaaactcaaaatgaaacgaggatgagtcacatcattctataaatattaaccgttggattcattacaagacgaaagaggataaatgaatcttggctgttgaatttgatggatgtgaaaataataattcaagaggtttccggagatgaaactactagaagacaaaagaaagcaaggaagggggaaagctaaagaataaatataaggttatgcatataatttacgatttgcatctattgagtaaactactttacaaataaaccctcatcataaccaaagattcaccggtcaagattgagcaatttagggcaaatacaaaatgcaggttcatttgattaattttatttctaacagttaattttaatatatttgagaaaaaaatgcaataaggacatgcagagtcatggtcgcccgaatataggtttaataattttcacatgaatttgaaatgaaatcaaactcattccttaaaaacctaaaaacaatatttgtgcataggctataaagagcacgcaccaataaaaaatatgaggtcatgcaaccatgaagacctataagacaaaacttataaaatttgtgataaatattaagctatttattgttattatcataatattaattagcatgaccaatgttttttttacaagcaacgagaaacccataaaaaaggattgtcactctcacatatcacataccatataatagaaggtatagagtcacgcgaatacgcgacatcagatgcgggttttaagtgtagttgtgggtttttgcgtccaacgtttcaccgtccgtcttatttgaaacttttttataattagtatttttattgttattagatgataaaacatgaatattaatttatgcatgatttttattttttcataaatttttcaaataagacgaactgtcaaacgttagatacagaaactcacaactgcatttaaaataggacagagaaagtattattactaatacatactccatccgtaaaaaaaaaacagctttctgactacatgtatctggacatatggagtacgttatatccaaatatatatagccagaagtgtttttagagacggagggagtataaagtgtatagctgtcttccttggaaaaggaagagaatcaacaaacaagtataccctgactctgatggtgccatggatggaggctgctgtgcagaaatagtgcaatactacatggaatctttggagcaaggcggcttcctcatccagggtctacaaacaacacttgggctatttcatgggcccatcactatcaaacgggatttatttgtttctttggtcctgaacgccgggcccactttctttcggctctggcctttgttcacattcacataccactgctccactacagcaaaccacagttgcgaaccaggctatgctacagtgaatccaactgaaaggagaaaaaaaaagggaaaagtacaccgaaggtccctcaacttgtcatcgagttacaaaatcgtcccctaaccgcaaaaccagatatcggagatccctcaactaacaaaacagttcgcttgaggtcctctggtggttttggacccggttttgtctgacgtggcgggtgagtcagcgtgggccccacgtgtcaggctgccacatcatctccctcccctctctctcactcttctctctctgccacatctctctctctcactcttttctcctctcactcgctctagggcgggcgcggccgctggggggcgctggcgaggtgggcggtggcggcgacgggggtggggatgagaacggcgggggaaggggaggggagcgagtcaagggtggtgggggagacctcgtcggcggcgaggcggcggaggagcaacggcgaggagaggagggcgtcggcggcccccacacccgcaaccacccagcacgtgctgccgatgcccggcggtccctcgcgcgcctcgacccgccgcggcggaggggcgacggcgaggagaggagggccggcgccgtgggcgcgtccggcagccagcaggggaggagggccggcgtggcgggcgcggtcggcggtcgacaggagggagtgcggcggagaggagggccagcgtgacgggcggcggtcggcagccgacgaggaggagcacagctgagaggacgcctctctgctccgcccgcgcccggagccgtcgccgacgattagggcgagtggcgcggccgtcggcgccactgctccctatccgccaccgccgctccctatccgccgccgcctctcagccaccgcgctcgcccgccgacgccgcttctccgcagccacactcgcccaccgaagccgccgctccgccattgtgctcgcccgccgacaccgccgttccgcttgctctggccgcctttctggtgcggcggcggctccttcggggacgaggccggcaggttcagatcgaacggcagcagcgagcaacgcgggacgggggcctcgtcgccggcgcccgaggtgctgtcctcgtagagcacggaggaacatgagctacgacggggagagcgaggaggccgccgttgtcatccacgacagcaggtggagaggtgacggaggccggcggagtgggagggcgggcgcaggaggacgaggcggaggcggacggcgccgatagggagcgcgacgggagagcgaggaggccgccgccatggttgcacatctgtcgcccgcgccgtcggcggctgcggtggcagcgtggggggcggccctcctactcccatgtcgttgctgccgctgcgtcgcccgtcgcccatcgccggccgcccaacctcctctcccgcctcgccccgccggccagtttgccgagacagctcgagaacggcgagggcggcgcggagatggggcgggggtcgttggctgcgaccccggcgaggcggcctgctcacgcgttgcagctgccgtcgctgcctcgtcggccgccaccctcagccctgtcacgccgctcgtggccgaccccttcaaccggtcaccggcgtcggcatcaacggaggaggaggccgtggccatcgcactcgcgcaaagaagagaagagtgagagagagagaggaggaagggagagatgatgtggcagcctgacacgtgggacccacgtggggcccacgctgactcacccgccacgtcagacaaaaccgggtccaaaaccaccggaggacctcaagcgaacggttttgttagttgagggacctccgatatctggttttgcggttgggggacgattttgtaactcgatgacaagttgagggaccttcggtgtacttttcccaaaaaaaaaaaagccatatctagatgaagtcgcgcagattaacacttgtttttcttcctcatgacaatggagaaagttctcggcctttggataatgaaaatgcacacagcagctaaccttgatctttgggtgtttcctttttaagggggatttcctgtctgtctgttgatagaaatttgatgtgtgcatattttttttttttgcggggagatgtgtgcatattgcacgttttgactgatagatgtttgagattagtgctggccgttcaatactccatatgtcccaaaaaaaaaagtcaaattctagggatgaatctgacatgtgtgtctagaattggactttttctttatggagggagtacgtgcgatattagttgcacttcttttaccgtgagatatctgtcgagattcgtgctggttgttcgataagtactcgatcccgtgatcttagaattgcaagcactaagctacgatggtttatttagttacacccaaattaaattgcaactattctgtacatgctaactagcatcatacttaaactataattataatatagctacattttacgtgtttttagagaattttccgtcgaattttaaatagcttttttatatcatgttcttttttccgatgagggtggaacagacatctcatccgctacatcacaaaatgcacacagataacgaaacctccctcttttatgctccttttctacaaacacatgtactaagaaagtataaataaaagctaaggaatgatcaaagaaacagctgctaaatgatgatcaactcattcatccgttcatccatcgtactctctccgtccccaaaaaaaaaaaaagacaaaccctgggtttccatgtccaacgtttaattatccgtcttatatgaaatttttttataattagtatttttattattgttagatgataaaacatgattaatactttatgcgtgacttatctttttagtttttttcataattttttcaaataagacgagcggtcaaacgttgaatacggaaacctatgatttgtcttttttttttggatggagggccccggaggaaaaactgacacatctggcccgatcgaatccccatatccatctaacaattcatcatagcctcttttacgaacccatggagatcagccggccagagccatgtgcccaaaacaccatatattcgtatcctcccgtggaataacctaaagcggaagctgccgcgcgcgcgacgcatgcatgcgcgcggctggcgcggtggtgaccactggagaacgcgtgcgtgcggttgtcgtggttgcgtggccggtggattggggctcgctgtctcgacgacgtcgcgcgcgccccgtggttttctctccgatcccccgcgcgcgcgacgcgactggggagatgacctgatatgtcgcacgtttttggaccacgcgcgagagccaccaccaccacaaccacacgcgccgcgccgcaatccagggctgcgcgctcgaacttttttttttttttccaatcgatcaaaagctagtggtggtggtggcggcacagccatatgtccacatcttatcacgacatcgatcgatcatgttcttttttaccggcacggccggacacctccggcgcctcgccgccgccgccggcggctgtcaggttcataccacttactagaacatctgtccgtgccgggaaaacacgggcaggttcgtacacacgtactgtgtaaaacacactgtttaccactacgaggttaatttcattggttgccgccgctacactaccggagaaaccatctttgatcggtcgaccaaattccacaatagtctcggttccaataaaaactgtgactaaaaattctggtcagtcgaccaaattccacaataatcccggttccaataaaatcaggactaaaaagtatctcgttttataagcgcaacgggactataggggttgcaaaccggaccagtccgtgctagaacgcatcatttgtgtgatggcgttgcgtgcgcgtgctatcaccacagtgagcgggcatcgtgattgatcaatcgcaagactttcacttttacgaatcagtacgtgacagcgtgtgatgtggtaccccatgatatttttctccatcaaatataaaaagtgaagctaccaagataggagtatatacgagctgatgatggattaactaccaataaagcgtgtttagttggggaaaaaaaaatttttaggtgtcacatcggatgtttgaccggatgtcggaagggattttcagacacgaatgaaaaaactaatttcagaactcgccgggaaaccgcgagacgaatcttttgagcctaattaagccgtcattagcacatgtggttactgtagcacttatggctaatcacggactaattaggctcaaaagattcgtctcgttatttcctccataactgtgtaattagtttttctttttatttttatttaatacttcatccatgtgtctaaagattcgatatgatatttttgcgaaaaactttttgggaaataaacgggccagcttcgacgatcgacccactgaaagcctgtcacgcatctgcaccaactaggcatggcattggatactggaatagcttagctagtaactctctctgttagcattttctacattcatatcgatgttaatggtctagattagttaacatcaatataaatgtagaaaatgctaaaatgatttacattgtgaaacggaggaagtagtaccggtttgaagaacaaaacctggaaaattaccacgtcaaaattggtctatacggagtactccgtacgcataagtgcataacgtcaattgctttctaggtagaagtgacagtggtactattcacattcacattctttgcacatttaggagtatgtccatttgatttaaacctgaacatatatactcctaggaagtgataacatgatgatgtgatactagtctctgatgccatctttagcatccagctttattatagataagcacaatctcttgttacctttcctgttttggactatgcagaactcttcagaaaaatgcgtcataggctgtgtttagttgagggggaagtttagattttggttgaaattgaagatgatgtgactgaaaagttgtgtgtgtatgacaggttgatgtgatggaaaagtactaaagtttggatccaaattttggatctaaacacagccataacactactactctctagagtctagattattttattcttggtctgaatctttgtctatagacgggattacgtcaactttcctagacggctagacttggatgacaggaaccaattaacgtttactaccacttaatctctacaagctcaacgattaaacaaaggctaatgacggtgtgtttgcactactagctggtagtactatactactacttacatgattagcaataatgagtacaagtgaaaacttaacatagtgcatgcatcagacgagtccaaatctgaagtctcgtcagtctcaacaaccctgaaactaatcggctcttgaagcaaaggacaaagaataccttactagtagtaattactccctccatcctattataagtgcaaccataagttttcgcgtctaactttgatcgttcgtcttatttgaaatttttttataattagtattttcgttgttatgagatgataaaacatgaataatactttactcgtgacttatgtttttaatttttttcaaaaatttttcaaataagacggacggtcaaagttggacgcggaaaacaatagctgcacttataatgggacggaggtggtactattccctccgtcctatgcagtactgcaagattactatattttaggacggtggaagtactagtactattaccattgttgctgttgctttctgtctcttagcgtccttgcatcgatcgatcgatcgaaactgttattggggttgcttttgcacggacagatcagtttctttcggtttggcgcatctatatatatccatccatccatccatccatccgcgatatgaaatgcaaaagttgtaggagatcagatgccctcgcgcacttggtgttgttcagttagtgcgactgaatcatcaatcagtcgcgtgccgacaacgagctatagctaaaaaccttaccattatggagtgctactgtcctaccactgcatctcgaagagactgctcgaagaaaagattaccgtggaggaggccatgttgttgcattgttgttgttgttgttacctgatgacactgacgtcttctctagctaagcctgaaccaaccggctcggcatggaacacgagatcttctcgatcatcaagtggaattactattcagagtgcaaacgcgaacaggggagaaattatagccggagaccttggccttccttttgctgtttccgatcgagccgcccagttttcaagcaatcagccggagatgtgggagcagagttcaatctttcgttttttggcttttgtagtggagggtgccgatatactgaaatttcgaaaattttgatccaaaattttgaacagaatttggtcaaatctgaacaaaatattgtcaaattcataaaaaaatggaaattttgacaaaaaaatatcatatctggagggggggggggcgataggaccgaaatttcgttcctaaattttgaaccttgtatgggagatcacgtatggcgagtaagcgccgaggtgtgctcgccaactgtgacctcatcgacactgaggactgtggtcggagttcgccgcttacgtacactcgggaccgaaccctgatagaaatgcatggccctatcgtttcgcttatccttatatttatttgtattgcttattaggaaaaaatgagtaaagattatatatatatatatatatatgggctgcaggaat

SEQ ID NO: 62503 - DNA, 10833 bp, Oryza sativa
tgccatgccattctgcaacaatgagttaaaacagattaaatatgaatacccacaaataatacgggatagaaagaaaagtaatactagatagacagatcctacatttgctttggcttctatatgtgcaccacgttcaagtagcaattttgctgattcacaagaactgtttttcacagccatgtgcaggggtgtctctccatactgcagaacaacagaagcagtaatttatatcttaagctcagagcatacaattagtgtcgcagaggtgccaataaggctgcaacaaatgccagatacttcaattaccatgttctttgcttccagctcaactttatccgtgccttggaaatcaagcaagaatttgactatgccagtgttattgtagccagctgcgacatgaagcggtgtttgggacatctgcatggtacattgtcaaagagaaggtaaggaacacaatattatgcagtacttcacaatattatgcatagcaattatgcactacaaaattctagtcagaaaacaaaaaaaaattaaggcctcagttgtttagaaactaatcaaattcatcatcgtgcaattcaggtctagccttcatgttatctctggcaggaatttggtgtgttgtgaactgagatatacgcaatatccttttactgatctatttgcaaattgtgcgcaaatcaagattgcagtggcagcaacattacaagatatccaaatcttatcagttcaccaaacataaacgtctaaatcatctcgaaatgcagagttacaaagtgtataagaaagcgaccaatctgagagaagtcgcaaaccatttcaaagaggaattagagaaacctacaattgcataaaactaaattccaccgaaagaaaaattgacagtttgaaaaccattgctgcaatagtctgaaattccacctaaagaagaaccgacgtcggaattaaacgaatctagaggaaattttgaaaactcttggcgagaaaagaaacttgcatccatatcacaaaccgagaaagaaacatcagagcaagcaggaggatggggagaaaaaatattcccccaaagaaagcaccacctcagcatcctaaataaggaacgaaatgggggaaaccgccaacatggggataaaaatccaagaaccaataaaaatccaagaaccaaagctcatggaaaccaagaagcaagcacaaaatccgatcaaaccaacattttttcttcacaacgaaagagaccccatctcttgcgaatctcgaatgctcactccagtccactccacactgcaaggagtgtcaaacgaaaccgcgcaagaagcaagcaaaagatcggaatttctttaaaaaaaactaaattaaatgaacaagaagcaaaagggggggggggagcaaggcgcgggcacgcacgacggggttccggtcgttgatgagggcgggattctcctgcagcttcctctgaacgccggcaaggtcgccggcgcgggcgaggccgtggatggtttccgccttcgccggcctcggccgcccgttctggctccccggcaccggcatctcctcccttttctgctcccctccctgtgatagtgtgtgcgcgctcgctcgagcagcttgcgcgtgtgaaaaggaggaggagacgaggaagaaagggaggcgacggggggcgagccgacgggtaccaaatccctcctgctgtgctgtgcgctttaaaaattggatttttttttttgtttctggatttgttcttgttttggtttaattttagtttgtttctttggagctttatttttggcatctatcccggggttttctggctttgttcgttgtgaaaaaaaaatgaacattttttctcgttttctttccctgcttatcgcatgcaaaaaccaatgattgacactaattacaccatgatttggtaatgtggtgctatagtaaacatttgttaatgatggattaattaggtttaatagattcgtctcgcagtttacagatggaatctgtaatttgttttgttattagtctacgtttaatacttcaaatgtgtgtctatatacgtcaaaaaaatttactttcaggattatggataccacataactaatattagttgactaaatcttggcaggacccaccacataccatgtcttatacggaaacaaccttcagatataggagaagttccgtatgaggaagaatgaatagagttctacatggaaacgacgaggactacggtcgtagtgcagagagtattgttgatcctttgtacttcctccgccccctaatatcaaggattttgacattttgctttcactgtttgaccacttgtcttattcaaaaaatttatgcgaatataaaaaacgaaaagttatgcttaaagtactttggatagtaaagtaagtcaaaaaaatagataataattccaaaaaattttaaataagacgaatggtcaaatagtgtaagcaaaatatcaaaatctcttatattaggggatggagggagtaacattttaggtggcgtttctcccgatgaagatgaagattaagtttttttacgtaaaacgatgttgtattaacgtatgattgattatttttaactattgcaaacttgaaaaatagattaatatgatattttagagcaactttcatatagaaagtttttgcacaaaagtcaccatttagcagtttgaaaagcgtgccacgaaaatcttaatcttcatccaactcttgttggagaaaagaacgggaccttgaaagcacaagaatataacgaaaatacagaaaatcatggaacatgaagaaaatgatgttttaaatggcacgttgaaaaaaaaagtgaatatgaagaaataggaaaaatgaaaaaacacgttttgatttccacaaaattcctatggaatagattgttccgtatgctttcaggtatctttcatgagctaatcatttgtttcaaaaggacttgatattcattttatccatatgatttaaatcataatttacttttctttgttcataaggggaaaaataatcaagtgattcttaaacactccaatttttttatttgatgtactaaaatagtatcatccttccagttttatcgaattcaatcatttatcaagagtgcacaaaaagactatgtagcattacatgaacgagtaaatgtgccacaaaagggcaacaaaccaaacaaaaaggaaaggggaaaggagaaaaacatagaaaattaattataaaaattgttttttagcgcatctgcttacccaacatattttttggatgaatgtttttgtaacaaagattttcgaatgaaaattttcatatgaaagttttcctgatgaaagtcttcagaagttatcgaaaagacttttgatagaagttaatagtgcagtccttccaattttatcaaattcaaccatttatcaagagcacacaaaaggactaagtaagagacgagtaaatgtgccacaaaagggcaacaaaccaaacaaaaaggaaagggaaaaggagaaaaaaaagaaaattaattataaaaattccttgtgttttttggatgaatgttttcgtaacaaagattttcgaatgaaaattttcatatgaaagttttccggatggaagtcttcggaagctatcgaaaagacttttgatagaagttaatagtgtagctacatttaaaagttttccacctaaatacttacaatagttttttagtagtcctaatttagaattacttgtacaaaaatatagttttaacttttatccgatataattaagaatttgtttattgtaaatgggttatatccaatgtgttttatttgataacaatatatttgaggccatcaacctagcttgctgacagactcttattccagagatggacgacatgatttgtgtgacatacttgcatcaagaagaggactaatcgatcttactttgcatctatgatttgaagaagccaagcatttgatttcttagcaaaagaaccattgttacagagcacctcacacgtttacgtcgatatgctaaaagaaaattatattatgttggtaacataggatcattttgtagttatgccatataaaaatattgttagtgtaaaaacttattcaaataacttatctaactaccaaatttggtatagttgaactaaaagctaaatattgaaggcgtgaggaaaaacttacatgaaactaaacacctgtatgttactaatagtatttctattttgagtctgattaagatacaaatttcgtttttttaagttgtcaattggtgtgtttcgtgcgaaaacattcttccgtacaagttaatattaaatctattttcgaagtttgaaataattaaaacttaattaattatgtgctaatgaatatttcgttttgcgtgtctgtactcgagacatctatagcttctcccaattatttgtattttgtaaacgcaataatacaatgcaatttgttattcttccgagtctgatttagggcttgttcattttatagccattttcaatctttccaaaatttggtattgccaaaatcttagcaagttagcaacattactaagttttggtaggataggttaaatatattattgtcaattctctaagtatgacaaatatttgataataaactaaatattatcatgcatttgttaattttatcaaataatggtatggtttaaaatatcataaatctgaacgtgcccttaaaagtaatcagtttttcaaggacaaaatcacatatcaaaacctctagtactagtaccaaacaagaccagcacaataatgtaattgtacagccagcataatttagcttgaggatagcgtagatctacgcataagattggattaattttgggctagcatagctacattgaggcaatgtttctttcagtttaggattattataatctaaattattgagtcagattactataagctataagctagattgttataatctatagtagaataagcggttagttgtttcttttctagattattagatcctagattattggatttgcaagtctacaatgggagtggggtggcatggtgggtaatttttacccaataatctgaaaaaagccaataagctacttcaataagttgtctgttattttttagcttactactaataatctaaattataataatcccaagcttaaataaataggacattttcagcttactactaataatctaaattataataatcctaagcttaaataaatagggaaataaatagagcctgactcatctggacccgcccccgtacggaccccagtccccaagtgatgcaggcagcaggctgtctgtcggccagcacgtgggaagccggctcccccgcgcccgcgtcggctcgcacgcgtgagtgcgtgacgcatcagctgttccgcatctcgctcgctcactgccagtgccagctccccgccgccgcatcgcatcgaatgccagcggtgttacgtcttacgtgttcagagagagtgattttacactgttcaattattagtatagatttacatgtcatttaaataataaaaaaaataaaaaaagagacgatggatattttcatatcactcgaatattatattttctaaaggaaatgagacgatggatttacataagttaaaattcaatttctacgggattaaaaccaaattaaattatactaactagttaacatatatttatagttaaaaatgtttattccgttgtaatatgtataagttaaatttgaccttgcatatttacgaagtgatcaatcacatattaatcttatctcgttgatttttttgattttttcataacttatttaaatgatatgcaagtgcaaatcataaggcgcagtaacaatgcaagctacgctatgcgtgtctcttgcccatgcaaagcatgttacctcttttgtgtggccttaattggggtgaggtactatcgaagccacaaagcccacaatactggtgaccaaagcaaggaaagtagcccacggaattaattcccccaactaatctcgacgagtctctcttggacgcatcgcatccctcaacctgtcgcctccaggtccactacacgcctcccaatccaccacggcgcatcgctgaccaccatattccgccgcgaagagttcacggcgatggagctctggagcgaactggtgctgcttctaattggatataccccatctaggccgacaagagtgagggcatgaaaaagaggggcaagaaggtgatggtagtcgtcaaatccttgcactgagagatcagacttgtcaattgagatgtggaccgaacctagggtctaggatgtggctgacattgatgttctagctcgtccacttccaaccccgttaactgtggaacaggatgtgatggcggatgcggtgctggcttcagctccacctgtagcagaggcttcttgaactcctccaacaaccaagtcaactcaggtaatggatctcaatcctaggtttttgtaaatttgggtgtcctttggatatgaatcatacgaagttgtgctcttgatttaatggcatgaatcggtgggcacgtgagagcgattttagggattccatcttcggtgtggcgtgaggggaaaacgactcggagccatgccctccacagcgcaggcgcgatgtgttttctcagccgtgagtggactcacaaagggcaaagaacgtgtctctctgtgtgggggaaagaggctcaacagaggcgcgcatttagtcgacacataagtgaatatccgagctggcaatacgaagtaacttaccgcatcctcgcatggtaaaggcctaaagggcctaggggcacatcctctccgagagttttcaatagttttccccattttctccatgcttgggcggttgggcctccatttttcctctctccgttggcttacgcctcctattaatgggcctaatatcggcccatttcatgggtcggcccgtgcatcggtgcatgccacctcaggcccattcgctctaagaaaaaggccctaaagtctaaaaccctacgcgtccgttatcccaatcccctcgattctccggcgactccggcgatgatgccgctcctcctcctcctcctccccgtccgctccgcccctctccggcgcctcctcctatgccggtgctcctcctcctcctcccccgccgccgccgcctgggcctcgtcatccgcgtgccccgtccccgcctcctcagtcctcgccccgtaccaccgcgccttcgcccgccgcatggccctcgccggcgtccacccgcaccaccgcgtcggtacgaatgcggcgtcgctttattggttttcttgctgaacgagtggctctgaggtatggttggttggctggtttgcagcggtgggggtctccggcgggccggactccatggcgctctgcgtgctcgcggcggcgtggaagaaggccggggaggggagggagcaggaggatgagggagagggcggcgtctcgggattcgtggacgggctcctgggggtcgtcgtcgaccatggcctgcgccctgagagcgccgacgaggcgcagctagtccgtgatcgggtgcgcggcatgggtaaatcttacttatggattaacactgtataatttctttattttaacacaaatttactctgcacctgcgcacatagaaaattgcaatgatgattggcttccgttaggtctgctccttgagttgcatttgaatgggaccttttcttttgaactgttttttttaatgcgacttgatccacaaaatagacattttgaggtgccacaattttgttgtaggtgttgtttgtgagattgctacatgtgaatggccgaatgggcgaccaaagctggggcatattcaagaagctgcccgtgaaatgaggtgtgcgtctccctctgccatggttcactacttgtcaaggataatgctatctgaacaatttgattttctgcaaacttagtatttgtggttgatatggccaattttttttatgtctcatcgatttccaaaacttacatgcatgctgtatggatatctgaaaaaaaatgtacctcacctactaacaactttgtatgaaatttgtgtagaccatttacttgcacaaagtgttaggagttaaggggctttcccttctctttaccggcacttaaggcattagatttagttgtttgttatacttaagagggcacatatgttagtattttgaactgtgggttgtgtaggcgtgtgttgtatggctttatttgccacttctcttatatgaaatgatacatagctctccggcatgttcaagaagaaaaataatgaatattttgttttgtttagttaaaactctgaaccttacatgttggtattagtgcattattctcacaatatattggcgctgagggtatcaggaatgttctttaggattcttcatggacattacctcctgcacaatgtgcattttttttttcaatttccagtgttgagaagctgtaaacttgccacttcaaaagtaaagagtgacatggttcacactgactactaaaatatatggaaatttagtatgctatggcattgtgaaaatgaatgctatgttcttcatgactgtatatatctacctgatatatgctctgccagttccataccaatttattcacaaacacagaaataccttagtgcattttaacaagacttcacattttaataaattcaggtaccaaaaactgttggacatttgtataaagcaacgaatagcagtcttgcttatcgcacaccactctgatgaccaggtctgttaaattgagagatgtatttttcctttttcccttggttttgaatgagtgttgccccacttatggaattgtgagttaacacataaaatccttgttatgtaaaagcattgagccaaatgacacctgttatcatcgtcaaataagcggtgctaatttttttctcttatattttaagtttttgtggacttgacaacttgcatatagggaactattattagatatgatactattgtgccttcatgtattactgtatctttgtttgtgcatttactctctaggctaacatacattgtcacatgaatatctgatatcggatttagtggaccttgcactgatccttgaatttagacatggttaccttctaattgtcgtagtatccaatgtggtattgaattaaagattactgaatctaatgtatactgacatctttctaccattctatgttatgattttatgccattatagttactgcagatgcagattatatgttttctctgagtgaatttaggcttataaatgcaggccgaactctttgttctgagactatctcgcaacagtggtgttttggggcttgctggtacagcctttgtatctcagttgtttgcgcctaatctaaaatatgatggagataacttcagtcgttatggtgttattcttgtccgtcccatgcttgaattttcaaaagatgacatgtataaggtaaatcatgatctcatgatatttagaatcagccttgcattttacttgaggagccttatcttacttttatctttcaaatatagtcaatatttcatcattagacacttaatttgaattttgatttcccaaaattcatttaacatgctgtatttaatgagttcagcttatgtatgtttctagaaattcctcaccaatattcctaatttctcctgctgactagcctttctctgaaaaagcaacatagccttttcttgtaggagactttgatgactttgctttgagctgtcatttttttttaaaaaaaatgatcatatttgtgtagctgttactgattgatctgtcatacttggttctccacagatatgtcaaggaagtaatcatttgtgggttgaagatccaactaataatagtttgctgtacgttaggaatcgaatccgggcatctttgagaagtttatccatagaaggttcacaattgcacttaagctgttgcttttgagtgattttagaatcatcatgttgaatcctttgtcttcaactttacctcatttatatcataatatagatcattcacagatgatgattgatgaaaggtgatgtccataaacatttgacaaatgtataaagcttgattgagcatgcgtacgttttactcattataaatttcaatgaattttccatcactattaattatcaaatgccatgtttggtcacaggaacaacttgttctattgaccatccgcaattgggtaattctgttgaataataactgactattgactgtagatacaccatcttctggaatcagcataaatgtttgcttgtgtgcaccaaattgtgatttttcatgtttcttgtctaggttggtctgtacacaaggtctatttattttatagtaaataaaaagtgtgtcagactatcagtggcccagaattcatgggtatctagctcaagagattgtatttagttaaattcacttgtggaagtaggtcacagaatttgtagcaaatgacaacattttcactgtttcacatgttgccaattcgtggccgaagttatttgtggcaagtcctagctccaattggtatgtgtgaagctacatcagctctggccagcttgtctgcagttgtaaatttgcaaacgctatcaccttatgatgagcgatgaacgaatgcacattcagctgacaaattttgcttatctacaggtacctttcagtcagagcttcacaaactgatctatgcgtgccggttgacacgagcatttatagataatgcctgcagtatggttttaaagaagtctttaacaataatggaggtataccctttttctgtaattcgatgtctcctatatcatgccattactaaaatttatatactaactcttttccccc

SEQ ID NO: 62504 - DNA, 606 bp, Oryza sativa
tggtgattcgcaatgaggagcacctgtgggcgttaaagtgctgcatcggacatcttgaggctggagccagactcttgatactgagacggatgcagaccctggttactctactgaacattcttagctcatatatacttcttaagatctgacactcttaagaccctgcgaggggcatacgtctttcaaaggagaggctgatccttcccactcgcatatggtataggctcactgtacagcctggaaaatacatgaagagagacaaagttttgatccaattcttgatgcgcacttgatcctctggtgttgcagagatacatgacgggctatgcaatctaatgtacatataatcgccctggcatatgactgatgcaatatctgggccagctcacgatattactttcatgtgtttgataccctacaggcgaactgatatatgatgcgccatatagctatcaaaaatggccatgtgggtcattccattctgcgccgtttgctgccttactagcaagcatctgaaccatgtgaagcggatcttgctgctgcaggaaaaacaagccaacttcaatacacaaagattagcgtgtgagcggggtggactgtacacaa

SEQ ID NO: 62505 - DNA, 2997 bp, Oryza sativa
  unsure (1)..(2997): unsure at all n locations
catagacatactgcgtcttggagtccgtgctacagctggctacaaatctgtagcccgctgctcttctctctcctgatttatcttcttaaaatatgtttgcagctggcttatagcctgctattgtacctgctctgacagacagcatctgggaggtgaactggcaggattctgtttgtctaccctccaaatgatgccatatcttacaaatcctctgtataaatagacctcagcacatagctagacacatcaaaccaaaactttcccttcctcatctctcagattcaacagagagacaaagttttagccacagacatggctttccaccaaagatcaattagcttgccttctaggcctctctccaaagttgaagaggagcttcacagcatagaggcatgcatctcttcaccctccctgaccattgagatgatctctgatggtttgaggaggcttgaggacatctacagctccattgaggagatcatgtgcctgcctagcaaccaagtttgctcatctgggcagaggaggttgttggatggagagatggaatgctcccttgagctactggatctctgcaacgctatgaatgaggtcttcaccgagttgaaggccatcatccaagatctgcaagtgtttctcagaaaaggagatgacgcagttcttcaagccaagatccagtcgtacatccacttggtgaagaaggcaaagaagcattccaagaagactttgaagaaaggttgtgttagacaaggagtgcaggatagtcaagctcttgagcgaggctagagagaacaccacatctctattcgagtcaacaatgcacctcttgttgaagcaaatcgagatgccaaaattgtccctcatctccagggcattccagaagaaaaacccagtgatttgcaatgaggagcagttgcaggtgttagagtgctgcatcacagatcttgaggctggagcaggacttctgttcaggagattggtccagagcagggttactctcctgaacattcttagctcatagatgctcgtcaagatctgtcactcttaagaccctgtgattggcatccgccttttaaaggatttgctgatccttagtatatggttagacttatagtgtacagaaaaaagttatacatgaaagaaacagaaattttgatctaattcttgtcgtgcgctcaatcctcacatattattgagatatataatgtgattatgcaacacgatgccagtattattgcctttgtgatgaatataatttgcacaacccaacacatgaactatgaaatatatgtgccaagtaatatagttttcctttattttattatttttatactccaaatgattgctgatatactgatatgccatatggcctcacacatttttcttctagacatgaatatttggaagcaaacaatttgcgctggtccacaactgcctagttgtttatatattcatgtggccatgttacttcacacccgcctaagccaataattagtacatgatcttagttttggtgcatctcacgctacattcatgaaacatgccaggcccaagctacaaagctaaaagcttgcaatcagcacaatattttgtgggtgtgtgttcttagaggtggatcagtgttgatccctccttttatatttgttttctttcttcttaatgcaatgaagcacaacacacctgtgttttcaaggaaaaaaaagttacatcctaaatttgctgcatgatcacatagcttacctagtattgtgttcttgtgtatatattatttttactgttttggagcactgatacacatcttgataataaagcacgttttaattaagttcagaagtaaagagaatttcttttaagcacagaaaaacagtataattatagtgtgcacagcaagacacagattatcttgagacacatctcaagtttatctcagcaaccacaatttaaccatgcaatgtccatgaaactcataactcattggctcaccaggtatgtgcctcgacttggagaaagacatatacttattgagaaagaacaagattttgtcaacttcttgattgattacactgtctatgcaagctttggtacaaaaacataattttcacagaagactgatgttcatcattattgactgttacatgaacagttagcacagatagttccaattcacttttgaaatgctttactacgaaatagtcacatagccaatgctagtttctatgccagtggatcttgcccccatagctaaaataggccagctaccataaacaaagttgagcgggcaagcagcatggattgcacataatagaacacatgttgaaattaacacgagtattaagaaatagattatgcatgtataaaagatactactctggtagcactctactaaaattatcccatgagagcatgcaattatgtctaacatccacaagtagagtgaactaacctgctggttcttgttgccaatagttgggacatgacaatgtgatagctcacttggaagatagatagcagtgcataacaaattattataacatacgagagattccatatgctgctgccagatctcaaaccttgagagacagcatcggggaggtgaactggcaggattctgtttgtctaccatccaaatgatgctctgcattgcacatcaactgaataaataggcctcagcaaaaagctagacatatcaaaccataagtttcctttccttcttatctcttggattcatcacaaagcgccagagtttttgaaacagacatggctttccaccaaagatcaattagtttgccttctaggcctctcttcaaagttgaagaggagcttcacagcatagaggcatgcatctcttcacccttcctgaccattgagatgatctctgatggtttgaggaggcttgaggacatctacagctncattgaggagatcatgtgcctgcctagcaaccaagttgctcattttggcagaagagggtgttggatgagagatgaatgctccttgagc

SEQ ID NO: 62506 - DNA, 4091 bp, Oryza sativa
ccgattgggttgttccttgctaaagtttgtaaatccaattcttgggaagagaataagaattattcaaatgctctctgtaacaagttgaagaatgctaaactcgtgcagcactctagatatttgcaattgtcagcaatgaaatctcttcaaatcttgagatctattccagcacctgcaagacgaatgctaccagtgttgaccaactcgcaaggtgctgtattgagtataccggtaaggattccactcaaaagacattattttgttttcattttgtaattttaatatgttctatttttttaagtacttcattaatccgatgcattgtttttttaaatcaaacgtgagctaccgaaagctaggtagtggtgaactactccaaaccttctaattgcatgaggttagcacagcatgaagcacacatgacctagctgcccttgcatgcatgccttttatttgttagctaactatggaaaacagctgaatatcaaagttggcactttgatatcgatttactataatatggtgagtatgcgaaactccaagagcagtactggccatgcgtggcatagttctcaattctcaaatattgaaaatagtaaaacctgtttttggacctggcaactgattaggaggtctgacttcctagtgattagccaattgcttcagtctgtcacaatttttaacgggttcagtaccaactgaaacagcaggtgactaggaaataggaatatcgtgcagccagtgacttggcttggaacagtgacaaactgaagttgttcataacatggagtagaagtcctaggtagaagtctataaaccatctggttatcttgaaaattgaccagagaattttcatgttgatttcttttctgtccaaaaccatactgtcattctattactacatgtagttactgaatgcacagttttctataagatcaaaggcttcatgattcaggtggcaaagaaaatttacagatatgaagttctgggagatattatatgtagtctttctggaacttgcatattttggtttgacatactcctagcatcgtttatcagatatttgaaggcatgtagacagtgaatgcatttattccttcagagaaaggctttactcctattgtgctaatattctctcttttttcccttcttgttaagagtattggcttccgatgttgcccaagcctattaattgaagcagtattcagtccaagagtaccacttggtggaggatacacttcatatttgtaagtggttgatatctattgatgacaaaacatgaaacatcaagtgtataactgctgttgagatgtaagcagccgctggtaatacaaaacatctgatcaatcttctccctcagtcaatcattatatgcgagctgctaatgatatatactagtatcatgtttgtcccgtataactatttcaggtgctgaatcgcttgcaacaaaccgtccaatcattgccaaatgcgaaacagccttagcttgccaacgtcgttgtgcagttaactgatgtttcgtgatccctggttcatacatatgatgatttgacaagcttgacaagaacgggatttttacacgacatttgcggatttgccagtttgcagggataaatcactacaacagttatatgccagaacaggcccgattctgcactggtttccatctcaacacctgtcgttggacatcagggtgatcatggctgaaatctcgtagcttcgctttgcagtgccaaccaggtgtcgctgaggcaatagcaacttttggcactaggcaagtggaaatgaaggtaccactagatcactgtgagagcaattttgtcagcgctggaggtggctcaagtgcctaatcgttaagaattttaaataggaggatagataaatatatcaagtacctgagcgctggaggtggctcaagtgagatttacctccccaagaatgcatcgcctagcagactcccggttggacatcagcctgtaatttgaagccaagaatcgtttcatgtgaattattcgtcagacattcttactagaaaagcaatgcttaactctacttacgaatacgataacagtgttcaagcagtgacagacaaaacactgtaaatgattgttcatgtcttggtatgtatgccttctcattctcttcacatccaatgggttcgtgctttgttcgcacggacaggacataccaccctccatatccaacagcgattcgctgtcagaatccgaaccacttgtgccttccagagtttggttcatattcagattggtagctgatgtgggacttgctgctgcagctgatcacagcatatgaacagagtagtgagcaagaacagctaaacatctgaacattgtgccccatcattagatgcagttttgatgcagcacataacacattaataactactgtccatgtatgtccattgctggaatctccatgtgctgaaacatcccaagttgacaacgtagaaactcctgttaggctgttaaccagaaaaatgatttctcatcttcccatgcttagaattcagggttccctcttaccaggcaattcgaataaaattcctctaaaacatgaaataacgttcgtttgtagactaaaattgtgcgagaaaaaaatatactactagtcactatgaaaaagttactgtagtagcaaaaaattggtagaggttgaaacagtcttctacttgaaaggtagcaggaggcaggagctgatcagtagcagtaaatgaaatttgaagacatgaaattgcagtcaattatatatggaccgtgctactacaagctacttccggtaaaactatgaagattaagttgacacatgtaaaacgagaaagatattaatatatgattaattaagttttaattattacaaatttaagaaataaatatatatttaatattttaaagcaaacttgatatagaaaatttttacacgaaacacatcattagtagtttgaaaatcatactagcagaaaccgaggtgaaatgtaaatcttaattagaaaagaacagttaataacgttaaaagtaatgatatttcacttgtgagcgagggcttccacttattctacacctctcaaatcatcttatgaagtcggtttaaagtcaagctcaaagttttcttttcctgctgattctgtcaagcccattccttagctgtggtttcctttctttttttttttctaatttaattgagaaaaaaagtctcatctttaattttggctactcaccaaaggaaaggagaaaaagaagagggggaagctgttttggtccatccaaacgccccaaaagcctcccccaccgccccacgtctctccttgcccctccttcccctccgtatttgcaacactgccattccgtttcgttcaaaatctgactcaagccctcgtccacgtctagtactgcagcggggagtatttcggggaaacttgggcgctgctagtttagggcatatttgggttgaggagcttcagctgctgtaacttcttctaaaatcagaagctctccaaaatagtccagcttttgatctagattctaaacctatagtggtataatctaaaaaataaactaaaaattaaaagctgaaaaaccttttttagattcttataagctagctaccaaaccaactgtcttgagcaacagacccttgggagttgattcggatccgcaccacgcaccgacctcccgcgacatgacggcgcaacacgttggctgccgcgcgatgtcctgcatgcgctctgacacgtggggtccaccgagcgggggcccatctaggggtgggacctagcaaggcgcatccttggtggagactggagagccgtggagtctctgcctgtgtgcacgggaggcgggctacgtgtcagcttggcgggatcttctggggcatgccggcatgtggccggccacaggttttgcacgatgagtggtggtgaatggacacgaggggagagatgatgtacatgtataagagcaaggtaaatattatagcagctgatggttttaattagtgttcatgttatttatagtagacactatagttaatatgtacgataaagaaattttatgttaactgcgatattttattat

SEQ ID NO: 62507 - DNA, 20688 bp, Oryza sativa
ctcctgataaaaaaaatccattgtcctattaaaatttcaaataaaaattttaattttttacatttattttattttcaaaatttatgtcaaaattttctgcactaattatttagtctcattagttttataaaatgcacacgatgtgcactcaaacaaaattttcaattgtttttgaagcttatatttaaacctaaagcatcaagggcaaaaaggacatttgcaaccaaacgtaacactgaaatgatggaaaatgtaacggtaggggcatggaagggatcaatttgaaatttcacggtaggggcatggaagggatcaaattgaaatttcaggggtatagaagggatcgggtaaattttaagggtaggggcatgggagggatcaaattgaaatttcaggggtatagaagggatcgggtaaattttaggggtatgaaagggattgagtgagttttcaggggtacacagggaatttactcttttagatgagaatgatactcccttcgttttttaatagatgacgccgttaattttttttctcacatgtttgaccattcgtcttattcaaaaattttatgcaaatgtataagatataaatcacactttgtcggtgatatgggaccgggagtatcatgaccagaggcttgaggcagacgcaatcgcccacgtggcctggcaccttcggggacgtcgggcccgagggtgaggtgtccgccctcctcctgatttcccccgaggggggggggtcgggttacgcttgccccggccccgagggccgaggcaccccgaccccttaaagaagtctgcgccacatatatgggataagtgagcacagctgtgctcacctaacagcatttattacagtctggtcaagcgtgtcacgctgcatgtaacgcagtacagcacgctcttttatccggtctgtgaccagtcacagaccggtcagatcaagggttaggtggcgactggcggtctgacgcacgccttgccccatcccgtcaagacgaaagcctctaggcaactcgtctcaagccggagctagcgtgttatctcttagagatggcacgttagccctggtcagatttataccaggcttcatcctaaccattacaggcaagatgttgtgtgaagaagggcaaacatgcacgttgctaagctgacacgcggtggacaagaatgaccgatttgtgaccggtctgacactgctcaggtcgtcagctcacagccacgttcccgcgacgcgcctgcccccggcagaagtggaggtaggtatgtgccgtcccatcagaaggacgtttggagggcaaccgtgcaaatctccgtccatttacgtaaagaagaaaaagtccagtttggaaagggaagggtgcatgtggtatccccttgaagtataaaaggaggaccttgcccatagagaggtgggtggattcttgccagatttagagcctagagcggaggagaagtggacacactttgtagctcattcatacacaaatccacaaaaacacaggagtagggtattacgcttcggagcggcccgaacctgtatacatcgctgtgtctcgtgtgtcttgcgggcgagtaatctttccacacacagcgagagcttgagatctcaccctaagcccccggccgaaccggcaaaggggggcctgcgcggtctcccggtgaggagccacgagctccgtcatctggcgcgccaggtagggggctcagcgtgtgttttctgagctctcagactcttccgtgggcgccaagtttcccttgttcagcctaatggccgagcaagcaaaggcgcacgacctctctccgagtgtgagcggcgacgacggggagccgaatccacgccgtcgagctcgtactcccccacctcctccgcgccaaagccctaagcagggggaggcgcttgagaaggtcgacaagtccatggcatcaccagtcgcgggtggtgcaggaggacggcaagatggggagcgccgcctcctcgtatacggcgacggcagcacgcctcagggtgcgcttcaggctgctggcgcgctcttacgacacccgcctgtcgtccatgacccggagtctccagcccaacgatggctggaagatgtggccaacttggtcatgacggctcagcagcgcctgggtgctggtggacggtccaccaccaccaagacctccggcgccgccaccaccggttccgtgtcatcaaggcggagggcgcggcgagcggcggcggctgcacgtcattcggctgccactccctcgtcgacaccgtcgactcgggaggatcagcatgagaagccggatgcccgcctcaacagcgagcgccggcgtaacagccggcgtactccccgtgcaacggagggcgcctcctcgtccagagtgtcacctcgacatggacgtgaggatcagccctccgtgcccccggctggtggtgtcggctgtagagcctttgtggcgagtcttcggaatgtccgttggcccccaaggttccggcccaccatcaccgagaagtacgatgggagcgtcaaccccaccgagtttctccaggtctatacgaccgggatcgaggccgctgggggtgacgacagggtcatggcgaacttctttcccatggccctaaaaggacaggcgcggggttggctaatgaacctgccacccgcgtcggtccactcctgggaagatctgtgccaacagttcaccatgaacttccaaggcacatatccgcgcccaggcgaagaagcggacttgcatgcagtacagcgaggcgatgatgagtcgcttcgctcgtacattcagcggttttgccaagtccgcaatactataccatgcatccctgcacacgcggtgatctacgcgttcagggggggcgtgcggcacaaccgcatgctcgaaaagatcgcttccaaagagccccagactaccgcggagctttttcagctcgcggaccgagtggctcgtaaagaggaagcgtggacatggaactcctccggttccggagtggcagcttcggccgcccccggatctgccgctcagacagggcggcgtgacaggaggaggaagaagaggtcggaccgttccggcgacgagggtcatgtcctcgccgtcgagggcgctccgcgggccacccgaaaggggaggcctgcgagcgacaaaaagaaagaggctggtactcccagcagggagcgccccgccggcaggtggtgctccgtgcacaacacctccctccacgatctcgcggactgtcgtgcagtcaaaaacctggctgagcgaacgaggaagtgggaggaggacaggagacaggaacgccgtgagggcaagtccccggcggttccttccggcaaacggcgaagtgaggccaagcagatggcccccgctgttgacatcgatgatggtgacgatgacctaggtttccaagaacctggggccaccattgccaccgtcgatggaggagcgtgtgctcacgtctctcgccggagcttcaaggctatgaagcgagagcttctggccatggcccctactcatgaggcgatgcgtcgggcgcggtggtcagaggttgctctcactttcgaccagaccgaccacccaccgtgcattgcccggggagggcaggttgcgatggtagtttcccccaccatctgcaacgtgaagttgggacgtgtcctcatagatggaggagcggctctcaacatcctttcccccgcggcctttgatgctatcaaggccccggggatggtgctccgaccgtcccagccgatcatcggtgtgacgccggggcacacgtggccattgggtcacatcgacctaccggtcaccttcggtggacccgccaacttccgcacggagcgggtgagcttcgatgtggcggacctcagtctgccctacaacgcggtcctaggaaggcccgcgttggtgaagttcatggcggctgtccactacgcctacctccagatgaagatgccgggccccggtggccccatctctgtccatggcgaccttaaagtcgcgctcgcttgcatggagcagcgcgccgaccgcctcgctgctgcgtccaagcccgagggtggtgacgagaggcttggcccctctgcccccaccgccccgaggcagcggatggccacatgcgacgaggtcccggtcaaggaggttgccttgggcgacggcccatccatgaccacacggatcggtggtcttctggatggcaaataggaagacgcgctcgtctccttcctgcgggcaaacgctgatgtcttcgcatggagaccagcggacatgcccggggtccccagggaggtgattgagcaccgtctcgctgtgcggccgggcgcaaggccggtccggcagaaagtgcggcggcaggccccggaacgtaaagccttcatccgcgaggaggtggcgagacttctggaggccggattcgtccgtgaagtcatccatccggagtggctggcgaacccggtggtcgttcccaaggcgaacggcaagcttcggatgtgcatcgactacaccgaccttaacaaggcatgtcctaaggatccttaccccctgcctcgcatagatcagattgtcgactccactgcggggtgcgaccttttgtgttttctagatgcatattctggttaccatcagattcgcatggctagggaggatgaggaaaaaaactgcgttcattacccccgtaggaacctattgttatacatcaatgcccttcgggttaaagaatgcaggtcccacttttcagcgtactactcgaatttctttgggtagccaaataggacgtaatgttgaggcgtatgtcgatgacttggttgtaaaaacgcgcaaccaagaaactttactttcagatctagcggaaacttttgaaaacctccgctccgcccgcataaaactgaaccccgataagtgcgtgtttggtgtacccgcgggcaagcttctcgggtttttggtctctgcccgaggcattgaggccaaccccgagaagatacgagctatagaacggatgcgcccccccagcaaacttagggatgtgcagtgcgtcactggttgcatggctgccctaagtcgttttatatcgaggctgggagagaaggcgctacccttatttaagctcctcaagcgctcggggccgtttacttggacggaggaagctgaacatgcccttactcagttaaaggtgtatctcagctctcccccggttctagtcgccccagagccaaatgagcccctgctactttacttagcggcgaccccccaagtagttagtgcagcgttggttgtggagcgcgatgaggacaatcctcattctgcgcacccccactctgtgccgacttggcccgggagcaggcagggaggagaggcccccgagtcgaacggtggcctaaggcccccgacgaccggagtcggccctctgcccgctcgtcagacggtgccgggtgcccccgaccctcaggaaggccccgaggccactgcgggaaggccgcatctaccaccctttgaccccgaggctaaccctgtgcagattcgacccgggagagagcagggagaagaggcccccgagccgaacggaggcctgaggcccctgacgaccggagctggccctttgcccgcttgtctgacaacgccaggagcccccgacccccgggacggccccgaggccactgtgggaaggccgcacctgtcatcttcggaccccgaggtcatcagcgcaggagacgagtgtgccccaagaggccacttggacgaagagcaccccggggatacggcccctagcgaagaggatcggccccgccgaaaggtgcagaggcctgtctactttgttagtgaggccctccgggacgccaagacccgatacccacaggcccagaagatgctttacgctattctgatggcctcgaggaaactgcgccattatttccaggcgcatcgggtcaccgtggttacgtcttaccccctcggtcaaatcttgcataatcgagagggtacaggacgagtggtaaaatgggcaatcgagctttctgagttcgatctgcactttgaaccacgccacgctatcaagagccaggccctcgccgattttgtggcagagtggaccccggctccagagactgtctcaatgcccgaggccagcacgaacccctcacagctgcctcaaaccgcccactgggtgatgcagttcgacggttctctgtctctccagggcgccggtgcaggggtcacgttgacctctccgaacggagacatcctcagatacttggtccgtctcgactttcgagcgactaataatatggcagagtacgagggactccttgccggactcagagtggcagctggactggggatccgccgcctcttggtattaggcgactcccagctagtcgttaaccaggtctgtaaggagtaccggtgctctgacccacagatggacgcctacatacgccaagtgcggcgtatggagcgccatttcgatggaatagagcttcggcatgtgcccagacgggataacatgatagccgacgaactctcacggctcgcgtcctcgcgagcccagaccccaccgggcgcctttgaagaaaggcttacccagccatcggcgcgacccgatcccttaggggagacggatgcgcctaaccggcccccgaggcccgtcggagtccaggcctcgggacccgaagggagcgctccaagctcccttagattgattgcttggatctctgagatccaaacatacctcacagataagactctacctgaggaccgcgaagggagtgaacgcgtacaacgcatttccaaacgctatgtgctggtagaagggaccctctatcggcgcgcggctaacggaatcctcctgaagtgcattcctcaggaacaaggcgttgagcttcttgttgacatccatgagggcgagtgcggagcccattccgcctcgcgtaccttggttggcaaggcctttcgtcaaggattttattggccgacagctcttaatgacgcagtcgatctggtccggcgatgcagagcgtgtcagttccacgccaagcaaatccatcagccggcccaggccctgcagatcataccattgtcatggccatttgctgtctgggggcttgatatcctgggaccgttcaaacgggccccgggcgggtttgagtatctgtatgttgcgatcgacaagttcactaagtggcccgaggcttatccggttgtcaagatcgataagcactctgctcttaaattcattaagggcatcacggcccgttttggagtgcctaatcgtattattacggataatggcacccaattcactagtgaactcttcggcgactactgtgaagacatgggcatcaagctctgcttcgcctcacctgcccaccccagaagcaatggccaagtggagcgcgccaatgcagaaatccttaaaggcctcaaaaccaagaccttcaacattctcaagaagcacggcgattcatggatcgaggagttgccagcggtgctctgggcgaaccgaaccacaccaagccgagcgaccggggaaacgcctttcttcctcgtctacggcgcagaagcggttctcccatctgagctcaccctgaggtctcctcgggccaccatgtactgcgaggctgatcaagatcagcttcgtagagatgacctcgactacttggaagagcgaaggcggcgcgcggccctccgagctgcgcgctaccagcagagcctgcggcgctaccatcagcgccacgtccgggcccgatcactctgcgtcgacgacctcgtcctacgccgcgtccaaacgcgtgctggattgagcaagctctcaccaatgtgggagggaccgtatcgagtgatcggtgtcccccggccgggctcggtacggctggccacgggcgacggcacggagctgccaaacccgtggaacatcgaacaccttcgccgcttctacccctgaaagggggggtcgggtgtcaggtttctatctcgggccaaccccgcacccccctcgggtgtgcagggttggccgggggctaccacacatgcacatatattccttttcttatttcagcttttcaataaaagcagtttcaatttcctaaaggttgtgtctgtgccgtttttccttctaaagaatcttaacttgaaataaggtcactcgtgctcaaccttgccctcgggggttcggttcggtcagcaaaaatcgccaaacggggcccagaaccgagccgtgccccggggtgtggtgaactccgggggggaatcggcaaaagcccacgatcgggttacccatacccctcggtcaccacgttcccggcctggccagtctcgacatgtggatctccccaggcactagccccgacccgagccattcgaggaccgggacttgggcgcgagcccttatttcaagctaaggcgcaaaaggaccatggcacagatcatcctcaacttatatatatagcaaaataaagttaacatagaaattgtttcatcatttttgattgcagagtaatttgatctatacaaaagaggcatgaaggccttagaagaaagaaaaagaaaaaagtaaagattgacgggggctcgggggctcattctgacgcgcccgggtcgccggcctcgtcgccatcgtcgtcctcaccgctggcatcgccctcctcgtcggagctgggggcgaacgcgagccgaggggctgagccctcgaagccgttgacgatgtggtcggcggcatcccggacgcgcgcgcgcgcgtcgtcctcggtcccgggagggaactcctccagcgccatccatggagagaagttggggtcccgggcctggtaactcgccagcacgagttcgaccgctccccgcgcgaggtcccttgaggatgacttgatggtcttctcaagctcctcggggagttgctcgagaacccaagccatcctgttgaggtgcggagcgaggccttccagattggtggggggcaccgacgactggcctccccagaggcccgcttgccgaccggcgcgcttcatgcgggagaccgcatcccaaagcatgtcgggcccaatctcgcccgccaagcgaagggcctcggcctccccggtggaggagtccagcgctcgctgcatttccgcgacggtgtgttcggcagccgcgaggcgggcggccaggtcgctttcgcctgcggccgccccgccgataggcgccctcgcggccagctctttctcccgtgcctcgaggttggcagcccgctgctccagcgcggctctctcggcacggacacattcaaggttgcggcgcgcctgctcctcttgcgccgcctcgcggagggagaggctgttcgccagccgttgcgtcgtggcctcggcctcctcgagagctcgctcccgctcagcgagtgcatcctcgcgaaggcggagcgcggactcctcctcggcgcaggcggcctcatgcgccaccagcgtcgcctctcggagaccagcggcggcctcgcggcctgtcaagcccctctccacggcgccggcgtgttcttccagcgccatggcacgggcctcaagggcctcttcgcgccgccgcaacgccgcttcagcctctgttgctcgctgctctcgggcggcggcggcgtcgaggaccccctgggcggcgtcgagcttgttattcagatccgcctcccagctcccgtgttgaaggcggagggagtcctgcgcctcgatcatcgcggtggtggcgacgagggcggcctctcgctcctcctccacctctcgggcgatctccgccagcgccgccttgcgggcttcgagctccgagatgtggcgccggtgggccttacggccctacctccaaccatggtgtccaccgagcgccgcccctcctcgacgcgcgcccatgcggcctcgagctccgctcgttccgctcgcaaggcctccacctgggcgctaaatccatctagcaccgcggtgtttgcggcggccaaggcctgcataatgggctcggcgctcaccggggcaacggaagacgaggagaaaagtcgccttggagaaaaggcgacgcggcttggccccccggaggatgcgctgggctcggggatgtcccccgggcccgtttgatcctgggcgtcgcccggtgaggtaggcccaggcgatgcgcccgcggcctcgtcgcgagccgcctcggaggatgtcacctgaggaccgcccgagggagtgggcccaagtgacgcgccagcagcagctgtcgcctcagcctggcgagcccgggcggcctcctcccgggcagcttcttcggcttggcgagcccgggcggcctcctcccgagcagcttcctccgcttggcgaacccgggcggcctcccgggcggcatcttcagcttcccgaaggcgggctgcggcttcacgccggtcagactctcgcctccgctcctctgcggccgccggatcttcggcctcggactggccggatttggggtggcgggaggaatgcgacgggacatcgctgaagcagaagaaaaaaccgaaagacgaacaaaatgagtaagaaaaaacttcttttttgggaggaaaatggttgcaatgagagtgagacgaacctgcgagggggtcggttgaatgaccactttggaggggaaatcaggtttccccggcatggttccgtctcccccgtcttacggagccgcttcttcttgcgcaccccctcgggctgcgacgtcggcgcggccccctccgggcgccgactgctggcacgcgccgccccgccccctcggggaggagatgggggaggtgtacctcccagcttcctcttcccctgggcgtcggcagggcggctgctccccgagcccccgacgcggggcccagaagcacgaccccctcctggggcaggttgttccccccggcggcgcacgcccgcgccgtcgtggcccttaggggctctctcctctgaggccccgacccccatcataatggttagaatggagacgcggtcgggatcgctgcagagggggaggatctcctgaggaaggcgagacgcctccgcggagctaagattcagcaccctttggactacgatcttgaagtcctcaggagcccaatcccatctggctccctggtgggtccgcatatagtcttcaggcccagtatactcccaggcgctccgggcgcgccgttggagcggcgcaatccggcgatggaggtaatcgccgtacaccatggccccggtgagcccttgggatcgcaggcccgccaggcggtcgaggacggcgtcgtactcctcccccagatctaccggcgcccgccagctggagacctgcgccgggggctggcttggaagacggaggcgcgcttcgttggcgaggggggtgtagaaccagtcgctcttccagtcgtcccacttcttgcggaggacgcaggggatgtagcggttcagcaccggcccccgcggctggaagtagcagccgccaactaccgacggcggcgacaccgactgcacggtgaagaaccaccggaacaactgaagagaggggcgcaccccaatgaacatctcgcacaggtgtgcgaagatggccaatgtcatcaccgcattgggggtgagatgcgccatctggagatcgtagaactccaggacatccatgaagaaatgagaaaatggcgggaccagcccagccattgcgaaggggaggaagaagatggaccgccccgggtagtctggtgccgggcgcccctcgcccagcatcactatctcccgaccggtggcggactccggcatgaagcggcgcggcagtccggcgtgcctctcgttcacgatgcgggaaggcggcagtacactgccgtcgagcagagcagagccccgtgccatggcggtggaggaagagatgattgggaacgagcgcgtgtggcgaaagtagggcgtagcagagaaagagttagagctcaggcggcgaaggcaagaggaacaatggcgaaaggaagggagcaaatcctttcctcgatgcttttatacccttgccatcgctggtcctggctcctcgtttctcgcgcccactacctcgctccctcgtatctcgctatctcgctccctcgtttcccgtgcccacgcttccactaatcccattcgcccgcttacggcgcatgaagtggatatgcggttgtggcaatcgaaacggattgtatcgtgcgcgcattaagtacgctcgccgaccgaagcggcgttaccgtatctccgagcgagacaaatctgctcacccagattcgcgcgctgctcaagtgatgtggcagtcttgagtagaccgcccattatggacaaccaaagtcaccaataccaatgtgcatggattgagaccgttgggtgttttgcccaactacggagaccggtcccacctgtcaccaggctttaggggtggcgtcacacctgaccgcttcccttcggaagggaaattgctctggcataacgccgggggctactgtcggtgatatgggaccgggagtatcatgaccagaggcttgaggcagacgcaatcgcccacgtggcctggcaccttcggggacgtcgggcccgagggtgaggtgtccgccctcctcctgatttcccccgagggggggggtcgggttacgcttgccccggccccgagggccgaggcaccccgaccccttaaagaagtctgcgccacatatatgggataagtgagcacagctgtgctcacctaacagcatttattacagtctggtcaagcgtgtcacgctgcatgtaacgcagtacagcacgctcttttatccggtctgtgaccagtcacagaccggtcagatcaagggttaggtggcgactggcggtctgacgcacgccttgccccatcccgtcaagacgaaagcctctaggcaactcgtctcaagccggagctagcgtgttatctcttagagatggcacgttagccctggtcagatttataccaggcttcatcctaaccattacaggcaagatgttgtgtgaagaagggcaaacatgcacgttgctaagctgacacgcggtggacaagaatgaccgatttgtgaccggtctgacactgctcaggtcgtcagctcacagccacgttcccgcgacgcgcctgcccccggcagaagtggaggtaggtatgtgccgtcccatcagaaggacgtttggagggcaaccgtgcaaatctccgtccatttacgtaaagaagaaaaagtccagtttggaaagggaagggtgcatgtggtatccccttgaagtataaaaggaggaccttgcccatagagaggtgggtggattcttgccagatttagagcctagagcggaggagaagtggacacactttgtagctcattcatacacaaatccacaaaaacacaggagtagggtattacgcttcggagcggcccgaacctgtatacatcgctgtgtctcgtgtgtcttgcgggcgagtaatctttccacacacagcgagagcttgagatctcaccctaagcccccggccgaaccggcaaaggggggcctgcgcggtctcccggtgaggagccacgagctccgtcacacttaaagtactatgagtgataaaacaactcgtaacaaaataaattattattacgtaaatattttgaataagacaaatggtcaaacatgtgagaaaaagtcaacgacgtcatctattaaaaaacggaggcagtagcagataacaaacaatacggtgcagcgcaaagtagcaatggagagaatttccttgcttttaagcagaaattggataatcacattgaagagaaactggataatcttcaaaaacatcacagccaccatggttaaacaattacatgcatgatttatgacacatgtcatgtactcaacaattccaacataatgacgaactgacttttaaacagatacccaaattttgtgctgattatttatgggattaatgacagattcttgtatacatatacccagttgccctcttactgcagattctgagttcagaaaccctgttcaacaaggtaatcgccaagcctctccacaaccatgttgcactggccaggagtcatcggttcctcatagattccaatgatgatggatagataaggtcttcttgacagtaacccctccagttccctgagaaaatgtaacaaaaatgcgatacatgaaattagcatgtctctacagagaccagcaatagcttgtagcaaatcaattttcgggtaaaatttgtaagtttgttaaacataaaatacttctgcggttgagatagtgtctgaacaattaaaggtctggtcaatctgctttccgagataaaacggtttgatgagagaacggagatagtagcagggatgaaaacggtcggaaaaaccttagtgtgattcaattctaggaaactttatcaatgtgctagtgatatttatggtccatattgtggcgttcctagtgatttctgaaagaaaggggaatcttgcagcactattctagacccttagcttcgaaaaatgatgtaattgctttcagctgatttgctggaagggaagtatattttgtaggtcaaaagttgaaatttgaatcggcgaactcggtaaagttgctctcatagctttcacatatttgtgcgccctatgggtagatataagaaggaagccaacatagtctacctttctgtgagatagaagctaaagaagtttattcccatgtaactggaaaattcgaataaaatgctcataagatactgggctacatggtcattcgaatttcagaagatgaagtctatacagaggtgtgtttggagggccattcacatgaaacagtccttgcaaggttgcaagaatcaggaaccaaaatttctctcatttttctagaaatttttgcgataataacaacttgccaaatataccaagtataaaacgcaatcgctggacacacaggaagccttttgtgttcagcaatataatttcccttcatcacattgttctaaacttctaatcagttgtgtttagtttaccactgattcaccattcaccaacaacgatgtcagtcctccttttggcacagaatgactgactgataacatcgaatgctgactaaaaattagcaacggaaaacacatgacagggaaaaaaaatagagcctggttttgctgctagatcaaaattctcttctcttccaggactggaacaagcaaagcaatcgcaaacgtctctactggtaatggcagggttagagttacgcatctgaatatctctcatctcatgagagtgaagcagagagcgagagagaaaattgctctgctccgctcgtcctgtgctcccagagatttgattcgattcgattcgattcttgcccctgacttgccttgcccaaatcttggcaagcgtcgtctctgctcaccgtatgtttgattgatcgcacgtaaatcagtagtattatgggccttgaaggcccgtaatggaaaatcagcctgttgcccgggtgttgatccttgcatcatcatgctgtcttttaatagatttttttttggtggggtggggggttatagtaggcccaataccttttttttttacattggctgaataaatgattactcctacattcttggtttaacgagtctaggatttgggcggggagcatacagtctccagtcagcactagacctagcactcattgccattcgagcaagatcatgagccaccctatttctcctccttttattttgtgcacttgcacctgttggagacattgcatcacacttatttccaagctttaatggatgaatggctgaactgcaacggattatctgatgatttgggatgtgataatatttgaggtacaaccaaatggattagctgttataaatttaaaagaagtattgtagggaacttacatacgtagaaagctattattataaagcttgaaggctgaagcttccaaccataacttaggctgtgttcggaaacccctcccccccggcaagcaaaacgaaatacatattattgcatgattaattaagtattaactattttttaaaagaaaatgattaatatgattttttttaaaacaactttcatataaaattttttttaaaaaaaaacacaccgtttagcagtttgaaaaccatacacgcgaaaaacgagagaagtgagaacacaatcttagggtgtgttcgtttttcttttttgcttttgcaactcccttgtttaccgtaagcacacttttcaaactgttaaacgatatattttaaaaataattgtatataaaagtttattttaaaaaaatcaaataaacatgtttttcaagtttgtcgtacttaataactaattaattatacactaatatcatttattgtttcgcacatggtaagaaaaagaaaaaggtaaacgagcttttcaaacagagagtatattgcaaaagttcaatattcaagccatagcatcacaaatagtaatagtgaaaaatagttaacacaataaaagtcaactattttagactaataaaattaattaatttgagatgtaaaaacctgctatagaaacaaaatggttcgacgtatggcaacaaatcaaccaaccgtaagtagattagatttgatttatcattaaatgttctttaaacgtgatataaatatttttatatttacataaatattattgaataagataaatcattaaatattgataaaaagttatcggcttttattattaagaaacggaggtagtagatgttgatatgccggccaaacaagagcccatccaagatcggatgcccccacgtagcgtattcatcaggataaggttgtgcatctgcaatcgcctacgccaacagccgatgcacacgcgtgcgacaccggaggcaggatatagaccagcagagagaaatatctcctcagaaatttgtcattagcagcaagcctaattaattcacggtaaaaccaattataaaagataaacccaaagatatttcaatcgtctcaccaaaaagatacaacagtgcacagcacggcaggtacgtacacgaccgattattaactgaacttatgtgtctgaaaaaaaaatgcaattcaaagttgagtactatagctagctaggcatcgtttgcttcacgacgacgacgacgaggaggaggctgtaatggctacggcggcgcggacggcggcgccggcgcgcttgtagttgtcgatgtagtaggcagggttgggcagcttgaaggtccggcggccctccggcgagcccagcaggtcgctccactggtcgccgatgttgccgatgatcaccatccccttctcctcctccagcttcttcctctcccccgacttgtactccaccaccgatcccgtcgccgtcgagttctccgacctgttcgttcatttcatcaattttatactcgcaccgtctcaaaatgtaagcatttttagactcttatacacggtctgcgagatgctactttaaccaacaatatctatataagtaagatgttttaaataaaaagagttacatatcatgatagtttgtttaatgataaatctagtaacatcaattttacatgattgatctttttttactattaatggttaaagtttaaaatatttgatttgtcactatgctaaaaatatttatattttaggacggagggagtacacgcaggaattcagagattaattagtttgtaacgtgaccttaatatgagctcgtcccagcagtcgaagccttccttgatgagattggtggcggtggcgttcctcagctccggcgtgtccggcctgtccgacaggaagacgatcttgacgccgaggaggagcagcttcttgtacagcgtcaccgtgttcggcaacgccgacgctctgccggcgatcagccactccatgaacgccggctcgtcggttctgtggtacccgaagccgtgcttcttgtagaacttgacgtgggagagggcggtctcgtcgacgtcgaacacccaggtggcgttggcgtcggcggcggggtcgccggagaggacggcggcctcggcgtaggcggcggcctcgtcgacgacgaccttgctgtcgcggcggtagtggtggccgcgcatgtagttctcgacgtagttgtcgcacttgcgcggcgccgccgtccacccccgcacgttgttcgcctccacgccgacgcgccagctgtcgcagtagtcgccgtcgcccacggccgccgggatcatcatctgcctcagcctgtccacgaacgagagcgccgccgccgacgacgacacgacatcgccggcgccggcgccccacccgtggcaggtggtggctagcgcggcggccacggccaagaagcagacaagtcgcttgggcgccatcgccgtcgtctactgatgtttatgcttcactctgcagctggcagctggatatatatacacacactgacacacagcaatggcacagtgcagagttagttactcctaacattctatccaagatttatggaggtaattgtatggcggccccggtggcgaggtgaagagacaagaagagtttttgtctattgcaatcaatcaatcgagcaagcatgaaccatgtcgcatttgtcacgttatccgggaccaagcagcaacagcagctagctatagcctatagctggggctcaggaatcatgtggattctggtgtcaagataaggcgccgcgggcgcgtagcgcgacgtacatgtgtgtggacgcggcgcagatgacgccgcctcgcctcgcctcgcctcgcctcgccggccgcttcacctgtcgccacgccacgccacggcgcgccgcgcgacgcttcacccgcgcgcgcgagagagaagcgggccggtgtgatgtgatggggacggcgtggcgtgggccggcccatgcggttccgggccgagatggcggatggcaatgggctaagagctattgggccgcggtgcgttgtgaggcccattggaagaaaagggaaattgattgaagcgtagtagttcaccgtacttggatttgctgatgtgatgacgccacgagttccatgacgcatcggatgatcggatttgtcatattcttgggaggaattctgctgctattttctaagcggagcgcgcatctgcaaacaacaggcgacaattgcaaagccaacagaatctaagatatacccgcaccagcatatattttatttcccacaaaatattattacaaaattagtccactcttctgttcccatccactactatagcccaaagttgttttacttacttgggaaggcgggaaacacatggctattttaggagaggcttccgacaatcaaaagctactcaaatagtttagtttttttatttaggtttggagaagttatatagttttaaaattcaggaaaataataagaagcagacgcctgcaaaaatgttttttttttcagttgtgtgtttttttttcacatggtttttctattctctcaagctgcttatctgaatctaaaactctcctaaatagaccgacagatcgaggtacagttgagaagttgggtgcatatgattattcatcatggttctaaaatccgaattccccacaaatatcgcacacatgggtacctttcaagaaaataaagttgttttacttacttccattactagctaggtttaattacttacacagcactaaaaccacaaatgtgggtaaggaaacagcgtcgcattggaggcaggaatagataggcatactcctttgagataattaaatatgattagggaacaattgcttaaaaaaaagaagaaactaaagctagatcaatatcacatttgggagagaataatccggaaaggaaagataggctagcttagctaggccatgttgtgttattctcaatcccactatctaacagtacaattcgccttgcaacttctttttgggaccgaatcaacgacacatgggagagcttaacaagaggttaactcacctacacacatgtgcacttttagtttctttttcttttctatagtatcgtctccaagtaatataattaaggtgtattaattcttattgtatatatgcttgtgcgcgtgagagagaatatatccccagatcgatctcttttcaatttctttgttaacaaaatagttgttttgttttgttgcatggccataaaagaaatagatgagagtgaagaagacagacatgagacatggccgaactctctctttttcactctttcttttatcctttctatctcctgtggaaagggacatgtgagcatctggtttgttctatgatgttccatgaacctgaaactgtctgaacctaaccattattttttattaatctctgaggctctgagcatatcataggcaacaaaacacatgatcagtagcttggatcatatcatactatcatatcggctgagagatctagcagtaaatattaactagtgttaaattgcccaaaacagattgtacaagaactatatatttcagtcttaatttagagatgaaacgaataatgttcataatttagctaggttacaaacacagacgcacaaatgggcaagttacttctttggttagctgctctgaaaggtagaattataaagatagagatagtttattatgattcgctaaaagacaaatgcgagaacaaataataggggacattaactgcaaaacaaacaaggaggaacctttcctttacctaactcgttcatcatcaagttttttatgaggaaaggcgatgcatatgttctctccttagcactgagattctcagcagcaattatagaagtagcattatgcccta

SEQ ID NO: 62508 - DNA, 17514 bp, Oryza sativa
tactttcaacttgtaagtcaaatgttatagtatacctccatgtcctcacaaatatatgcaaagaggtccacactatgataaaaagtcaaacaatctcacaaacttaagccctgtacacctgattcacactagggaacataaccattccacagttggtctatgcagaggcacgcaatccaatgaatccagtctactacaaacattagcagtagaaccgacacaaatggcgtctaaatccccaaaggggaagacatgttagacctaagtacataaacccgagtccaataacaaaaatggggtttgcactagagtgtaatccagtctaatacaaacattatgaacaaccacaaaaagacatccaaatcccacaaggctaacaaatttgcatagatcataaagttctcaataaactagcgtaacaaaatcaattaacctgcctgcctgccctaacttaacagaaattaaattaaggggctgtctatataggaatcgaatgatctatataagttaaaacctatattgatctacacttcagatcaatatctcaggcttcatatttctagcttacatttgagtacacacaaagaactagaaaacaaaatacaacgtggatatagtacttatgtagcaatagtaatacaacacacaactaaatcacacacatcatcatgatgcaaagtttctgaatctatacaacagttcttttgatgacccatctaataattaaaacaaagggagagagaaaaaaaaagcacaaggagttattataaggatgcacatatcagaagcaatggaaaaaatgaaatcaaaaatagaacattgcatagcacacagggaaaatagaaacataatcaatacataaatcatagcaataattcactatcagatcaacagctaacaataattcatcagctagcaagctaaacaaatagttgaagactacaaataaagtacaaatagttagagatacaaaataatgcaacacaaacttttataaatccaaacatgagcaaacttcttcataaacatcattcaaaacaaatcacacgcatctactaaaatagcaactcgcagattcaacaaatcacaacctaacatccggagaacaagggagcaactatagaatcaactcaaattcccatgggaaaaactagatctaactttacacatcacagatcacagagcacaattcgtaaatcacatatcacatatcacagatcacacatcacacatcacataaacgaaactttctagaacatcgcatagcacaaatttatgaacaaatatatcatagaaacctaaaaaaaaatcacaaaagcaaaatcgaacacgaatcatggggattcaatgaaacaaacaccgaaacaaaaggtgctcagatctacgaaaactagaacgactagtactacagaatcaacgaaacacaacatgtagcatgctaaataggagatggaaatgaacaaaaaaggaaaaaaaaacaaaaaggaaagccactggaataatcttgcgcaatcgacggcgcgacacctccgcaacaacagcagacgccgagtcggctcgccgaagagcagcctcgtcgcctcgctaaatcgctgccacgtcgccggagacgatgagaacgagacgacgaaatcgtcaacctctccttctataactctctctctctctccgtcggcaaaaggagcacaactagcggagcaaaacaacaacgaatcgagcagcaagctaacaaatgaagctggagaagaatcaaaacatactcaccggagaaaaagaggagaaggagctcgaggacaagatagagaagcccacaccgcaaactccagtggaatcaccgccgcgacgtagcctgcacgaatccacgccgcggcgtagcttacgccgcgtcgtcgcctcccggagtcgccgacgaaatctccgccgaaatcaccggaagagacgacgaggaaaaaggcaaaaagcaaaatgaatctctcacactctctctctagtctgattcagacaatctctccggtgcggatttcaaaatttaaatagtgtatgtgggtcccaccattaacactcacaaaaaaatctctctgtcggcaacacaaaatgggtcccacaaaaatgtaaaaaaaaaagaagcccatttagcccacatatggaagcccgaacttacaataatcaaaagcccacatagtctagatagcacgaatcttaaacaaaatccaagggacaaaaaaacgaatgatacagcccaacaaaaacatgcgacagccatatagcctttcccaaaaaaaatcctcctaatcacaatgccgtcgcggagatgacaatgacagggacgatgagctcgaggtcgatttaccaccgggagctccttggccccatcctgccttgatccgtgccatcggcacttgcttccagcgaagacgaggtggtggtggtggctccgctgctcatgtgcctgtacaaggcgagacgaagttgtagacgacactggagggggcaaagctggcagagatggagagggccagagggaatacctccgcgacggtcctggagctcgacagcccgcgcgggtcctcgatacgcgcctgctcaccagccatcgccacctaccggtggtggtccacgccgtcgccagatccacggggagcggctcggctcaacgccaccctacttgtcatcggccttcttcaccacctctgcgccaaatcaaccgctcggatcgtctcctcgatagcctccttgccgcttccgccaccaccgcctcaccgcttccgccgctcgcaccgcctcctcgtccactttcgcaaccaccgctacctcaccttggctcacctcatcgtcagcccgctcgtcgccggagatcagaggcggaggcgatgacagatggtggtggcatgccaagcgacggcggggactctggctcctccttttaaccagctgtcgttcgatccccgccacctccgctgcctctatcgtgcatgcagagctggcctcatccatcggttctttctcagtgcaaatcaatggtggaaactcgaaagcacaagccacaaccatggtgtatgagagaagacgagtgaacttggattgaaagcagaggtggacgacgaggcactcacagctcacagctcccgattcccaaaggctacctgctaacttatgcgtgccactaacacctagcaaatattcattttcacccctaatagtattttttatcctatacttcactacatataaaatattttcgaaaatacccctaggttagtactcacgtatttatgtgcaggaccttctaagttttaacttttcaatactggtttggtctgatgtacaaagagtaaccttttatatgactccatattaagaccgtgtttagttcatacctttggttgaatttagaacgatgttacggaaaaattagaaatttatatatagaaaagtttagatataatggaaaagttagaagtttgaagaaaaactttggaactaaacacggcctaagttgatgataggagtcatttactttaaaaatatgcattctataaatttcgtaattttcatgtaatttgataaattttgtagatcctattaatctaaaagacatatcttccaaagtatttgttaaacgcatacagatacgcttaaagaagttatttgtctgttaacaaatctgtttttaaagttgaaaaataatttacacgggacaagtacagctatctaaatacggcacagaagaattagccatgcataaactgatcgtattgctctcttttttaataatagaataaaatatcgtggcctttgctcaaacaagctacaaccaattattacgtagctcacacaatagcaaactcacacagtgagtccggaaatcacagtatgaaatttttaaacaagcataaactaatacaccaccaacacaagataaagatcccacaactattgaatcctatttgagaacctccatccgaagttggcaaagagctgcataatcgttgactcaagtttacgacatgtatcattaattagtttgatatcttcttcacacctctataattgcccaatactgaagccaatacgttgccctgaaaagtacctgcaaataagatttttatggtaatttatcaaagcccatcttattcctactaagtcagagagcccaacataaaacggatgctccaacaaaaataagattcttaattttttttatcaacaccaaaaaggtgttcgggagtgagctttggaaaccacactccctagcacacaaaacaaatcagcatttatctcataattaatcaagtattagctaaaataaatttgaaaaatggattaatatgattttttaaagtaactttcgtatataatttttttttgcaaataaaacactgtttagcagttcgaaaagcgtgcacgcggaaaatgagagagatgagttgggaagatggagataagaactcagcccaagccaattcctgaacatatgagacatcctttgtggaggatataaaccaaaggaaatgtgtacagatctccaaataaatcttaaaaaatgacaatcttttttgtaaaaaacatcttaagccatttatatttgattctaattcggatttttagggcgttcagtgaaaaatgttggactacttataatcgaagccatccctagagccactgtgcattatgcagataaacaaatttcagacatgttatcttatcctatgtggcactttaaggccgctcatatgaggctcttatactgtgaatggtctaagaaagatgatagaactacagttttttggtttataaaaaaagagaaagtgatggatacactcaggctgaattttttttaaaaaaaaataaatacagggaacgggtaaggaacaaagtaatttcatttttttatgaagtaactaaaatacatgttaattgttagggctattatataaaacatataatttaaagtcataaaacgatggaataacaataaccaaatcgatcatcatcaaccacatatatttgacattgtcctctgttttgttttatctgatatgtaatttaaatatatacaaacataatgcagacaaataaacaataaataatacgtgccttactgtgtaatatggtttatacaggttacatggatagggcgccaacagcgcacaggctttctagtctcttaaggcctttcacagtgctcctaggtggagtgttgccttattgtgccagctaggaatttcgccgacatgtcgcgtagcaccgcgtccttgttgagccgctcgctcccaagcaaggaaacgcgattcctcgctcgcgcgaggtagagggaacgcctggagctcgcgctgtggagggcatgcctccaactcaccgtcccctcgcgccctctccagcgtcgacctcgttgccgtctcccgctccgtgccgccgacctcgatgtcgccggggagctcgtcgccgcgccgcttcgatccgtgccgccgccaccatcctcgtcggagaagctcgccggctcgatggggaaagcgcggagaaggagaggagctcgaggtcaatgccgcgtccaacctcgccgccgtcgccttgatccagtgggcctaggccagatctggccgctcagcccggcgtcgtagccgtcgccgctcggaccgccgcttcgcccggctttgagaggaagacgaggtcgcgtggctccggtcgacgacgaccgccgtgaggacggccgtgccgccgctcgtcgtccgcgaggaagacgaggtcacgcggcgacctccgcgaggaagaccccaccgagagcccgtcgctgcggagcggggtagggggagggaggcgccagcgtctgtggcctctggacccgacgatgagaggcgccgccgcgccgaagtccatgccttcttgcccgccgtcctcgccccggggcttcccgtccgccgcgtccctagcgtcgttcggtgccaccgccaccctcgccggctgttgacgtaaaacacgaggcctgggagatctgcttaactccagtgcaggtccaaagctcgccttcaggtgtgttagcgtgccagttgatttgatcctgcaatcaacaagaaatagaaacagagagatcgcggttaaatctataaatgatagccaatcggctaagtgccgataacatatcatttatctttgagccgatgtcatatgtgaatcgatcggagactataaatagataataaagaactaaatctactcgatcggttgtagatattaccaatatatagttcttatatcgatatatatttaaatcaagtgattgggatagatcggtcgccatgccgagacagtataaatcacttggatcgaaatatatattaataacaggactatatatgtttataacatagccgatcatatagatctagcatgtataggctaatactccgatactactctatatcaggatattaaaataagtataatatatcaaacaaaagcttaatatacttaaatgcaataagatcttgacataaagggcggatttaacatgtcactgaagcatatagagcaaatatggttaaatcagataatatcggctgaaactccgatactaccctaatcggcaaccagaaggcatgctagagattgatattctaagcacgacttaatagatcaaactcaactgatgcagcattaagtatgaaaagaagaacaatatctagacaatcaagccgctggaagtttcatagagtggtagatatcttatataatctaaatcaacatcaaaatctaacctaatcggctatcctctactaacagatgttagccgattgtaggttaggtagcgatatttgcagagattatgtacgatatatgataactcaacgaattacgtaaacaagattagagtatcatgaagatggaagcactaatcccgagaacacaagtcgtcgtaacaagttttacctcttgttgaagatcgaaaccgatgcagctcaacccgaaagcaagaactcgtcgaaataaaattaaagcaaaaaggtggcgatgcgccgaaattgtattgaacgtgtgttttccttttttttacatagggctcgggatctatttttacccgagaattacaagatatgtccatactggacacgactattatctctaacaaactctaagataccataagtctttgcggcagacttttgccctaagcatatcactaaggaaattatataaaacatcctaattaatagatacaattgccttttcaggactctatccacgtgggacaatcatcttgaagcatatcaactcaaacccaatgttggatacgagtcatattgccggaatcggctgtatcacctaatccagtctgattcagatttagccgattctagtcgtagccgatctggactccagccgattcttacactgttcccgcaacaatccttatctctgattccgcttcgatcccatcttcacctccgatgctaatattaccaaatttggtcgttaacatcggcttcttccgcgagggaggaggggagagccggcaccgctcggccccgaggacgccgccgccgcaggacccgctacctcgccatgcgtgcagccatcccgccgtcgaggtcaccgccgtccggccccgacaaggagaggagggggcgggcggtttgccgtcgtacgccgccgtggagccgagtgagggagagcctcgtcgttgtccacacgctccgctccgcgtcaccgacctcggtgtcgccggggagctcattgccacgccacttcggtctgcgccgccgccactgtccttgtcggagaagctcaccggctcgatgggaaagcgcggagaaggagaggagcttgcatgaggttgaggccgcgtccgagctcgccggcgtctgtgccttcttgcccgccgtcctcgcccttgccacttgccgtcctggtcagtggcatgcgagaagaatggatagatatagagagggagagatgaatgtgaaaagagagatggtgggacctactaatatgggtgggacccacaaacatgtattgtttaagacacatgcactgtgaagtgtggttctttatccggttctttgtctagctggaggctttgagctcctcatgtgtgttacccgcactgctactggccttataccgaattcagggcgtgttctcgagcgttagcgacgccacgtggctcagcccgattgcaaggttcgctccctcgctcgcagccgtcggatcgcgtatccatggtcagaaatcgatgcggtggagctaattgtaatataggaagtttaagggggctttttccaaaacggtgaatacctcttcgcctgttcggtcttgcgcttgtttccgtctaaggacagaggaactccctcttccttctcctcggtcgcgttgtcgccacttacctccaccaattccgccctgatcccctccgaacgtgctcatccgcgggctctcgacgaacacctccggccgcgacccagtcggactcggaggaggccgccagatttttctactccctccccctccgtgccgtctctctacccctctgcctccatttgccgcggccttgggacggaccaccatcgccgtgcggacggacgaccggagcacggcgtatacgacatcgtgtgcggcagcgggcccctcgacgagcctgcgcgcgtcggatttaagtatgtctttttgttgttctgaagaaattgtgtgtatcatttcttcaggtgccctgttgcaattgaagtatggaggatagtttgctacgctttcaacattagctcgctaagtgtgcataaacctgtcagtaatctggctacattattttcaaatagcactaattgttgttgtcagcgtatcgatttgctgccttgtgtttacacctaaatttgacacctatggacgaaatagggaaaaattgccaaagtttggaaagtgccgggtttccttcacaagggccggttagaccacatctatgtggacggtctgaccggctagtagggtcggtctgaccgcaggtatgtgggcggttagaccgtcagggtccgagtccgagtctgttttcgtcgggtctcgggtttccttgctcgggaaggcatgtttcgtgtttccattggtttctatcccgagttggacgtggagaagggcctgtagagagcaagaccaacccctatttaagggacaaggccggttcattgtaaaaccccctaatacaatctacttgaatcgttcttttactgtgttttctattttaccctagtttagtccatctttgtcggtttgcgccgtaaaccgtccgccaccgctgcgagagtgcgacacctctttgtaggtttgtcctgaaaaccttccgttttgcccacgagacgggtagttatcctcatatcgatctaaatcggcctagaggctgattttgatctctaaatcggctccattagccggtttagctgtttttctacaaaacccatcttgatttggccgcttggctagattaaggtggttggcgaggcgtttaggtgttgcgatcgtgcttatcgacttgtcacaaaaagttgccaacacgatttttgacgactccgttggggaacgatctaatcggccatatcatggccgaatttcatttaatctagtaattactgttcatcaaatcaggagtttcggcttaatagccgaaatcaatctacactgtactgctatcgctacgcactggtttcatcgccggattaatctattcggcggcgaagttaattatctagtcgtcactgaatccatctgaatacttgccgttcagcccgccgcgtataccgaggatcatcgtcgggaggcagaggccggctcgacggcctcgtttctttttgtttcacacggcaacagaaagatttgattgatcaaagctagtactgtacacgagttagaaaagatcaggctattcaatccgatctattactgttcacattaaaaaaaaggaagataaaaaccgattcaatttgtatcggttacactgtgaagctttagattagtttctaaattttgctaagtctactcggttgattatcaaataaatcaaatacttttgccgagtacagtacatacgaggaagtcaagaccgtatattaatttattcggtcaaaatatttcggctatgagctatatggccggaattaatcaaggaatttcttcatcaactataacgagcaggaacgggttcaacaatattactacacaatacattaggactgatcaaggcattatcccgctatctcaagtcgtagtttcaccaaaggtaacttccgattcggccaactcatactttgctattcaaaaggttaatgatcgttgtgtagatgcatatgctacctctagttttgctcctatacaatatgcttataatgctatgggggtcaatgggtgattatacagccgattacacaggaatcggctatatgcaaaacctagctaacggtatgactggtcatgacaccggtctaaccgcatcctatgccggtccagaccgtgccctattttggccagatcggacctcctatggccggtctgaccgcaccactaaccagggagtttctccaagttttcataccataactagcagtactgattttaattattattcatcacctgttaatactgttagtcatgctattccacatatccctaatgcctacaatgatattaataggggatatcctcccgatactaggtatggccaatataacaatattgtgccacaacaaccaccttttaggccaccaagtccaccaccagatccaccaaagcctgaaactgtggaggattggtttagaaatactatcagggagaatttcacaaaactaaggaatcgtgctagggagtaccaaaagccgtatcctgatttttatgacgctgtcccatatcctcctgattataaaattcctaaatttaccaagtttagtggtgagaatagtaggactacatacgagcatatagatcaattcttagcgcaatgtggtagggctagtagtatgaatacatgtaaattgcgcttattttctttatctttgtccggtactgcttttgcatggtctacttctttaccggaaaattctattttttcatgggctcaattagaacaaaaatttcatgattatttccacactagtgagactgagcttaggttgtctgatttaacatcggttaggcaaaaatacaatgaatctgtcgttgattatattgaaaggtttcgagatattaaaagccgatgttttagtttgaaaataactgacaaagatttggccaacattgcatatgatggattgcttgattctattaaagagaaattgaatggccagatatttcttgatattgatcatgtgttgcatgaagctctggctcaggaaagccgagtggatgacaatagcttacaagctagtttagatgaaaatgcaatatcatgtatagccgaaccaagcgatggttcggattgtggtaataatttgtgcaatgatgccgtaacgagtatagccgaaccaaatgttgattcggattgtcttattagtttggatgataacgcaataaccaatatagccgaaccaagtattggttcggattgtgttactagtttagacaatgatggaatagtcgaaccaagtaatggttcggattgtgttgctagcttagagaatagcatcattgaaaatatagccgaactaaatgacggttcggattgtatcacaaacaaaagtgaaatagcattgtcacctaagaccgaatcacaaatcggtcatgtggatgttggaaaagataatgaaaatgtcttgcgggatagtagtgagatagaatctaaaatatttatgcatacatatcaaaggctgtatcctgaatacgtagattcggtcccgtacccgcaaggatttgaggagcccaatttcacaaaattcacaggtgaggatgctagaacaacaatggagcatatcggccaatttattgatcaatgtggtaaggccggtaatgatgatttgcttaagttaaaattgtttcctctttctttgtcaaactttgcatctacatggtatagtttacttgctcctaattcaatttctacatggtcacaaatggagcatgagtttcatggttatttcaaagatgcaaacttgatgacaaagaccgattgatacttcatcggtcacttgtgaaactatttcggttacctctatgcctaagaccggaattgttagtgatcctctccttgttagttctattgatgttggcaaaaagaaagggaaaagtgttattattggggatcctcggcccaagaataggatcaaaaatgcgaaggccgaagatcataaagttacaaaagatgagtcatctagttcccaaaagactaaaaagccgaagctcacttttgagatgcttatggctaagtacaagaaaggattagctggtcaacgatttgataaccaaactagtgattcgaaaagaccaagatcatctcgtaggaagagatttggtcaaacatcaaagcaatcgaagccatcaactataccaactccatataaacctccggttgtgatgccatggtatccacatccaatgtcactatttggttatacttttatgtattacatgccatggatacctcaaccacatatgccgtatcatcgaggatggaagcaaccacctaggacaataccaagtcaatataattcaagacaagactgtttcccacaaaagaatcggtccggtagatcaaaggtgaaaagtgtgaagaaggtgtgggtgaggaaagaagccaaagctccggaggtcgttgctatcaaggagaaatctcaagatgttcaagtacctactgaagatgcggcgaaaactatacaagcggagaagactgaaaccaacgccgttgctgtcgacatcggcggtctgaccgagccagctagccagtctaaccgccagactacggccggtctgaccaaccctcctagccggtctgaccaaccctcctagccggtctgaccgacggcttgtggccggtctgaccgggcctaaaggccggtctgaccagggggcattggagaagagtgggaaaattgagagcaacacaggagcttctatttcgaccaaaaatattaagaatcattatttagctcctagaaaacagccacagccgaagtggataccttctgctttatctcgctctcaaaagaggagggtacaacgtcttcgggccataggtaaaaaagaaaaagaggccgaagatgtggagaacaaaacatgtaataattcagagccgcaaacgacacctaagcgagtgtggagacctaaagaagtaaaagttaaaagatcggtgctttcacggagtagtgatgtattcaatttggtgagagaagaatcatcggtcattaaagataagtctccttcacatgatgctatgggtgttagtgcggtattcatcttgccttcgaaatcgtgcaatcaagaaagccgattttgcttggggggcaagacattaatatgctcatgagggaaccaagaaaagaagaacggcaatggatacaacatcacatcttcgagccgccgttcgttggatgctaaggcaaggtatgggtttatggtgttcatcgttatattatatgcctatgtcatgttagaacattgcttgctatctagcacatgtgtgtttttgcttatcaaattgatattatacatacatgcaaatgccagttctaagtagtagaattggtaggttggcatataatttgtttcaagtatgatttggctcatgactctttgatatttatttaaagccaaatcgtatgtgtttttatggatcaccatataagatatagatttcatatttattgcaccatgaaagttttccttattagtaattcggctaatgtcaatggtcaatgtgatgatttattctagagttgttttctttagaaacattggcattgttaatattttgcatacatgctcaagtcgattacttacatttgtagtttattggaattcatgtgtgtgaggcatatgactttggtgattcattattgataatacttcaattggctaagtgttttgatgccatgatggttattgtttcaaaagccacttgaattagtattcatctagacatgttagttgggtattatatttttttcatatgtctagagagaaagagttttggttcaatagtttgatacaccaagcatctggttataatatgaagaaaggagtatttttgatattagtgaagtcggtgcttgatttttaagtctttggatgaaattggcaaaatcacagaccaggggttgtctgaccggcattgcatggccgatctgaccggtggtgacatgcggtctaaccggctctgcatggtcggtttgaccggacagacagggtggtctgaccggcattgcgtggccggtctgaccgatcccagacagaaggctggggggcacgttacaattgattaaaaggctgaattaattgtgaattcggacatttgtgcccatgagttagaaatagcttggagaattcctttgattagagttttgaaagatcctacacttaaggttgatcggaagattcggcggtaagtgctcaaatattatatcgccaaaaaatagatggagtattacttagataatgatcaactaaagttgctaggagagtagtacatgaagggatttgtgaaattcattaatcggcccgtaagataaattggttgctaggagagtggggtttcattggccgaaaataattgatgattgtttcaaatgttatagagggagtgaagcttgtcaatggatcggcaatgttcaattagcgtctaccgctgtgttgaatcctatcattaaactatggccgttccgaggttgggtttgggatttcattggtcaaatttattcttcgtcatcaaaagggtattggttcgtgctaattgcaatggattacttcactaagtgggccgaagccgtgccgctcgagaatattacttgtacggaggtaattgactttattttgaagcatattgttcatagattcggtattcctcaaacgttaaaggagtttcttttatgtccaaagaagtgagaagttttgccaaatcttatgatattaagttgttgagttcttctctttactacgcttaggctaatggataagccgagtcgagtaataaaacattattgaaattgccgttttgccagttgaggtaaatcttggctctcttcggtatttcaagcaagacgacttgtcggttgaagattacaagaccttgatgaggagcaattttgaagacgtcatcgacaagcgtttgaagattttgaaggacatgaagacacttcaagacggtgtttccagagagcaactaatgggagatagcttgaagaaatacttcttgagcatttggtaagatgcttaggaagtcctatggccggtaattggattatcgccctgagataacatgttctatgcttttaggttcacgtatgttcaccaaaaaggcagggggagcatgtgtttacacctaaatttggcacctatggacgaaatagggaaaaattgccaaagtttggaaagtgtcgggtttccttcacaagggccggtcagaccacaggtatatgggcagtctgaccggctagtagggtcggtctgaccgcaggtatgtgggtggtcagaccgtcagggtctgagtccgagtctgttttcgtcgggtctcgggtttccttgctcgggaaggcatgtttcgtgtttccttttgtttctatcccgagttggacgtggagaagggcctgtagagggcaagaccaacccctatttaagggacaaggccggttcattgtaaaacctccaaatacaatctacttgaatcgttcttttactatgttttctattttaccctagtttaatccatctttgtcggtttgcgccgtaaaccgtccgccgccgctgcgagagtgcgacacctctttataggtttgtcctgaaaaacttccgttttgcccacgagacgggtagttatcctcatatcgatctaaatcggcctagaggctgattttgatctctaaatcggctccgttagccggtttagctggttttctacaaaacccatcttgatttggccgcttggctagattgagatggttggcgactccatatcaccgcaaagcgtttaggtgttgcgatcgtgcttgtcgacttatcacgaaaagttaccaacaacttattgttgctggatcaaacgaaaacttcaactgagccggaggccgaggccccagcattgtctttcacgcctgcactgacttcagctgatggagctcatcaggagccgctcgtcgttgctacgaagaactcaattccgcggattgcacatatgccaatggtgccaacgaggaggctgtcctgtccagagcattttgtcaccacttccgaaggagttcatcagctcagtcgctatagcttggcagactggttcagaaatgagcttgggaatgggatttgggggagctggatatttctggcccttagtttcgtcattcttgggctgaaccgcgagatttggaggcagccgcagatactcaattgatctggaggtttatttgaagaggatcgagcttgtgcgtgagcaagtcaccgccacgctagaagagctcaggctcttcagaatgttgatttgttctctcgtttcataatctaagtactagacagtctatatgtatgtcttcgataatctacaacaatatgtctaagtacgtactactagacttaagtattacaaagttacggttacctattgtctatctacatatatattccaatgattttgtgataatacagtttgtttctggatcttgaatttctaactcgattgggaactatgtcatgcattgctagggctgtcttctaaatagttttccccattcgcaaattattacttcattctgtaataccactgaactgacacttccatccgattaaaatggccattaaacgtaaatgaataatttctatagattagctcatcagcatgatggtaaaacatgcaattgaggggttttggacctctgcctgcagtatgaacaattgccttctctgtactctgttccactccattccaatatcatggtttttaggagaaaggaggaagtcctccatggcttgctgctgcagttccagcgcatgtatgcgtgtcggtgttgtcataacaagttatttattgattactgccaaggcaagccatcagaatatcagcaagaaaattggtccttaccagcctgcagccccattcgcaggtgttcttaagtgtcatcatttttccatttcaccccatctaaaacgaccaaatcaaagcagtcactgatcgatgacccaagtccagaatttatttttcaagtgtaacccatccaacgatcttccctccctgcttcaattaaaaatttggctgctagttgctatttgtaaaatccatagctggcatatactccctccgttttttaatagatgacgccgttgactttttctcacatgtttgaccattcgtcttat

SEQ ID NO: 62509 - DNA, 18797 bp, Oryza sativa
atctctctcccttcccctataaaagcctcactattcccccccttctccccgtctccaccacccactccttcacgccgtcgcgccgccatcgtagtgccgccgcgccgccatcgtagtgccgccgcaccgccgccgtcgtgctgccgcgccgaccgtttccgtgcccgcaccgccgttctcgcgccaccgtgcgccgccgtcgctgccgccgtcatcgccgctgccgccgccggtgagtcgccctccgtttccctcgagtccgccgccgccaccgctcgggtgggaaagagagagagccgagagaaagagagggagagccgagaaagagaaggagaggaagggaggaggaagccaggagagaaaagaaaagaaagggagagaaagaaaaagaaaagaaaagagaggagaggaaaaagggaaagaaagagagaaagaaaaattaagagggaaatttaaaatatttacaaatattagaatttaattatagggttaataaaagtatagttagatgaaattttactaattaaatacctaaaatactaactcttaagtataggattaatgaaaatataaatggatgaatttctatagattatagattatttttagtactctccataagaaatcaattcacagtattaatttagatgtaattaataattgaacaaatgtatgaattcccgtaaattattgtggattatttttgggtaatctctataaataatcgattcacggtagaaattcggacttaatcgctaggaatttttagacgtacattatatttaattgtttagtcataaactaaattaaaacgtgtaatattataagataattttaggattccgtccgacatttagctcgcgatagaaatttctaacctattaaatgatatgttgctcgggtaggttaaattaaaaactcatgacaacaaaataattcttctcgcaacatagtttaaattgaagtggagtttgccctagttcgcgaatagtaaagttaatataaaagaatcgactttcgcgttcgactttcatttggatttatttggattcttatttgaattctaaccgaaattcaaatcaattttcgcacgtaactatagagaccgagggagccgtggatccaagcgaaggccaagacccgcaagactttgagcaaggcaagtcatcactattccttgaacatgttgatcctaattgtgaaattgttttgtttataaataaaattgcatgcaatgatgaatatcctacttgtgattatgccatgccttgattattgtttacccttaaatctttgtaaccatgtttacgtatgagtccttagtcaactatgacaattgcttagaaatgctattctagaatcaggcatactactcatatttatcaaatgctatatgcttgggcaattacctgtgggaaggtaattgaaatgcggcttgtggtgacatgagcgccacattgccatgatattgatgacatgatttgtgaaaggagaaataaaattaaacaactgttttcgactgaggcggacggaggatctgggtggtatctggaaaaggctagtaccgtccccagtcagttaaggaccgagccatgaagttaagcatgaaacgacccccgtacaaccgtacttctcgaatgggtatagacctagcggattagatagctgagcggaggcagtatccatgcatagtggtttcttgatgtgtgaggcaggggctctacggtggggcagccattggtaggaccgcgaggcgggtgtctacagtggtgtcgccatcggtaggactgccatgtgagaatctaaaacataattataacttaatgcatgtgtgagtattcccttcccgggtgcgccaaaactcctctcactgctagaaaccgtgtacgcctagagtgcatgaggatgaaaagttcatggagcgggtactgccaatgcgaggttatcgaaaagctttgccgtgacgcgtctcatgtgttgggacgaggctcatgtgttgggcagtcgcggagtgcgggtaaagtgtacatccactgcagtgtgagtaaaccaaatctattcgaatagccgtgctcgcggttattgagcaccgggacatgtattacacttggctagactctaaattctttaacttgtgtgggatgggatattgcatgatgatttttatgctgatggagccacttcctgagaggcgggaatgtggacgtcctcagaaaaccataacgaatcaatggcgggaagctatccttgggatcacaatggatggtggacagaaccgtcattgtttaatatgaacactggtattaaaacttggtcagtttatgctaggtcttaggcttgtgaaaagaattacaaaacttgctttgggcaaaagaaccatagccatcctttgaattcccctgtcatgtgcatcattgatgtggtggcttgctgagtacggttggtactcacccttgcaattataaaattaatcagaagcgggagatgaagccttggaagatccttatgcctactatcaggagggggacgaagacgatggcgtccagtaggtcttagtacggtcgttgcctgtggcaatggcatgccgctgcctaaaattccgctgccttatctaaactctgcttttggttgtattccagaccgctcggtctgatgatttaaacaatgcccgcgggcttatgttgtaataattcgtactagactctcgtgtatgagcatttggtattccagctatgaattcgtgtgtaccagactacttgatccagggaaatggtacggtttacacgattgattcctgttataaaaacgggggtccacaccgcccctccacccgcgtccgcctcgccgtcggccgccgaccaccgaccgccctccgcgcgcagcagctggcggcggcggaggtggtggagcagtcggtgaacaccatccggttcctcgccgtggatgccgtggaaatggccaagtccggccacccgggacttcccatagggtgcgcgccgctcacgccagccgcagccgatgccctgcttcgctccgtcggccgccgtcctcgtcatctccgccgcgaccgacaccgccccgtgcgcctctgagagagaatatatatagagagagagagagatgagaagagagataagagatagagctgatatgtgggcacaattgcatttttgacattttacgcgatttttctctcctcttcaaagggcccaagggtatttttgacatttcacgcgatttctctctccacttcaaccagaaagcattattttaatcgcgcggtgtccactggcaaattaccacgttttatgaagtgttttcccccaaaagtgagtttgggtagtatcttaggattaaaacaacacataagcatggtcctgtagcaattttttttggttttttttcgactatacgaaaaacaaaaacaacgaaaaataggaagcctcttactaatataatcttgagtgaatttgaggagaggtgagagagagcaagagcaagcaagagtggcattcagacttgggcaagaagggagcccccgagggacggggcgagggggggtgcactagagaggttggcgtgctccccctgccatgtcaatatcggccgccacggtggtaggggggcggcgacagcgactcagtagccaaaaagaccatatatagaataagtttgttcaaaattctatttatgagataagtttttcaaaaaaatcgtgaaaaatccatgtccgtgggccactacatgtcattgactatctaattgcgagagtgagcgtgagcgtagccggccttgtctctccaactggcaaacggctccctccatgcaccgggtcttggtacacccaggtccccacgacacgagcacgagctctgcgcaccgggtccagtagaccgcaaaacccacaccccatcgtattcgtcgtggacgggggggggggggggcaaaagcaagagggaggccaaaacccccctccacccatttcgctctccttctcctgcaagcttcctcctccccacccacccctcgctcctcgccgcgaggggcgagccatggcgccgccgctcgtctacctcagccccaccgaagacggcaccggtacgtccagatcccgcacctccgctaacctcttggttggctctcttcaattcttctaacggcgatctctctcgctctcgctctcgctttgtacgcgcgcaggtgcgagcactctcatgaaggcggccttctgcgggaacctgggaagcctcaaaggttgcttcctcttctcctctcttctccgccgcgtcgatcccactcgatcgatgtctgtatacatgccccccttttgcatgctcctgtgtgtttcttttcctccgataggtttaatttgtgtgtcgacgcttgtgtactcgttgttgcgcttgcgatggtcgtatgatggattttgcatgagctgcgttgttgttcttgggaatttgccgcattttattttccgtgatgctatggctgcttggattttatcgtgcgtgaaggccgtaaccctctgggcatgtggattagcggatattgcacacttatattatctagaaattgcaagatatgaggcttttattgtagcaagcacttgtgtcggataaatgtggcagcgcgttcgcgttgttatcatcttctattatattacctctccaagtgtggatatatgatgtatagtcaggtactctaaacaaatgttaatttgcaagtcgcaaagtacaggttataggtgcacattgtaggaataagtcttggctggttggtcttggtcttgtggtgcctttttcctgcttttcagctttctaggacagcatctctactttcagtttggatgctctaggacagttaggacagcagtttgttgagatgctctaggacagtttgttgggatgctctgctctaggacagtttgttgggatgctgacagcaccctcttagactagcatggctgcatggctgctacaagcagctataaatatgtatccaatcctctttgggaggacatggcttttgtatttagtgaatgaagaaaaccagaaaattgccccatctcgagtgccatcctcttctcaatgagagtaaccattgaaattctaacatctggtatcagagccacaccttcctgtaggctaaacatctcttgttccaccccttcccaagctcggttgagctctcagccagcagcagcagcagcagcaccggttgcccctccttcccctttcccttccccctctccacacagcagccccccggaggtgcgccatgtccgacgctcggtctcggcgttcggtcgcctcgagcactcggcgtcagcaggacgccgagctcgccgcagcagaagagcgcaggcgagcaacggctcagaccgctgcagcagcagcgagggcggccagactggcggcagcggagttggcagcagccagggcggaggcggaggcggaggcggcggaagatgcggcacgtgcggcggaggtagaggttgagaccttgcgcagcagcatcaacgggtccatcgccggcgacatcaccgctgacagggagcttgaggagctggcaagaggaaagggcacgggagcgagcagagcggtgggcagcagcccacctccacggcggcggcggcggcccaagggaccgtgcgcccgccgacgggaacccagacgggcgcgggcgtgccggcggcagcccggagcccgcacgcggccctcgcaggcggcacggctccctctcccctgaccggcgccatggtcaccacggcgtccagacggtggtcagggattttggtcccggcggtgggtggcctaccctcaccaaaaccaactacatcgagtgggccgcggtgatgagggtgaggctccaggtgcggcacatgtgggaggcagtccggtacggtgacgtcgactacgacgaggatcggcgggcactggatgccctcatcgctgcagttccgcccgagatgcagttctcgctttcccagaagcggactgccaaggaggcctgggacgccatcgctgcggcacgcatcggcagcgaccgcgcccgcaagtccacactgcaggcactccgcaaggagtgggagaacctggccttcaagccaggtgaggatgttgatgactttgctctccgtctcaacactctcttgcagaaaatggtgcagtacggcgacgacacctacgacgaggagagagctgtcgagaagctcttccgctgcgtccctgagaagtacaggcagatcgctcgctcgattgaatctctgctggacctctccacgatgtcgatcgaggaggcgttaggtcgcctcaaggtcgtcgatggtgatgagccacggcctctctcggggcccatcaccatcggcgggaagctccatctcactcgggagcagtgggaggcctctcagggtgacgggaggaagggggagtcatcttccccgacaggcggccataagccgcgcaaggcgcggggaggtgtccagctacggtgggcgcgaagacgtgccgagggtggcgcccgcagaggcgcccagggcgttgccaccggcaaccacaagccggcacgagacgacacctgccgcaactgtggcaagcttggccattgggccaaagactgtcgacagccacgacgcggccaggcccacgtcgcacgggtggaggaggaagagccggctctgctcctagctcacgcaagcatcgagctacctccagcggcaccggccgcagcggctttcctccaccttgatgagccgaaggtactcgtctccctctgtgacggctccagcaacgacaaggctgatgggtggtacctcgacaccggcgccacccatcacatgaccggccgacgggagttcttcaccgagttcgactccagcgtccgaggcaccgtcaagttcggggacgcctccggcgtggagatcaagggtgttggctccgtcaccttcaccgccaagtccggtgagcacaggctgctcaccggagtctactacatccccgcgttgaggaattctatcatcagcgtgggacagctggatgagaacggctcacgcgtgttggtcgaggacggactcatgaggatttgggatcgccgtcgtcgccttcttgccaaggtaaccagaggcactaatcgactctacatcctcagcgcgcaggtcgcacatccagtttgcctcgccgctcgtcgggacgacgaggcgtggcagtggcacgagcgcttcgggcacctccacttcgaggccctgaagcagctcagtgccaaggagatggtgcgaggcatgccgtgccttgaccacgtggagcagctctgcgacgtctgcgtggtgacaaagcagcggcggctcccctttccccagcagacgagcttccgagccaaggagcggctcgggctcgtgcacggggacttgtgtggcccagtgacaccggccacaccaggaggacgacgttatttcctgctgctcgtcgacgacctctcccgctacatgtgggtgatggtcctcggcagcaagggagaggctgcggacgccatcaggcatgcgcaggctgctgcagaggcggagtgcggccgcaagctgcgcgtgctgcgcaccgacaacggcggcgaattcacggcagctgaattcgcgtcgtactgcgctgatgagggcattcagcgccactacaccgcgccgtacagcccacagcagaacggcgtcgtcgagcggcgcaaccagacggttgtggggatggctcgggccctcctcaagcagagggggatgccggccatcttctggggggaggcggtggtgacggccgcctacatcctcaaccgctcgcctaccaaggccctcgatggcaggacaccgtacgaggcttggcatgggcgcaagccggcggtctcccacctgcgggtcttcggctgcctcgcgttcgccaaggagcttggccacatcggcaagctcgacgacaggagcaccccaggggtgttcatcggctacgcggagggctcgaaggcctaccgcatcctcgacccggagacacagcgtgtgcgcattacgcgcgatgttgtgttcgacgaagggcgagggtgggtatgggacaaggcggtggatgatggttcgactccgacgtacgacgacttcaccatcgagtacgtccacttcgagggagctgggggagtaggcagctcttcttcaccgagcgtgtctaccccagtccccgagcctccaccgactccaacaccaacacaccctcgggccacgacttcgactacgacgagctcttcgtcgacaccaccccagccggtgtccccacacgctccagcaccaacagccactcctccgggcacgtctactccgacgccagctcgtgttgagcgcagcccggtggagttcgttactccgctctcccacgacggggagcgcatcgacgcgtaccatgacggcgagcagctacggtaccgtacgatggaggatcttctcggcgaccagccggtgccgggactggtgcctcgcaacctggaggcgcagttgcaccttgcgtgcgacgacggtgagcctcggtcttttgcagaggccgagaaacacgcggcatggcgtgccgcgatgcagtcggagatggacgcggttcaggagaaccgcacctgggagcttgctgacctccctcgtggtcaccgcgcgatcacccttaagtgggtgttcaagctgaagagggatgaagccggagccatcgtcaagcacaaggctcgcttggtggcacgcggtttcgtgcagcaggaggggatcgactacgacgatgccttcgctcccgtggcacggatggagtccgtgcgactccttcttgcgctggctgctcaggaaggctggggcgtccatcacatggacgtcaagtcggcgtttctaaacggcgacttgaaggaggaggtctacgtgcaccagccgccgggatttgtgatccccggcaaggagggcaaggtgctacgcctgcacaaggccctctacggcttgcggcaggcaccgagggcgtggaatgccaagttggattccacgctcaaggggatgggcttcgagcaaagcccgcacgaggcggccatctaccggcggggcaatggaggaaatgccttgctggtgggtgtctacgtcgacgacttagtgatcaccggcaccaaggatgcagaggtcgcggcgttcaaggaggagatgaaggccaccttccagatgagtgatctggggcctctctccttctacctggggatcgaagtgcaccaggacaactccgggatcacgcttcgacagaccgcctacgccaagcgcgtcgttgagctggctgggctcaccgattgcaacccagctctcactccgatggaggagagactgaagctgagccgcgacagcacagcggaggaggtggatgctacacagtaccgacgtcttgtggggagccttcgctacctcacccacacacggccggacttggccttctccgtcggctacgtcagtcggttcatgcagcgaccgacgacggagcaccagcaggctgtgaagaggatcatccgctacgttgcggggactctcgaccacggtctctactacccgaggtgtcctggcaaggcacacttcgttgggtacagcgacagcgaccacgccggcgacatcgacaccagcaagagcacgagcgggattctctttttcctcggcgagtgcctcgttagctggcagtcaatcaagcagcaggtggtggccctgtccagctgcgaggccgagtacatggcagcatccgccgcttcgacccaggcgctctggcttgctcgactgcttagtgatctcctcggcagagatactggagcggtggagctcagggtggatagcaagtccgctctggccctggcaaaaaaccccgtttttcacgaacggagcaagcacatccgagtgaggtaccatttcatccgaagctacttggaggaagggagcatcaaggcgagctacatcaacaccaaggaccagcttgcggatttgctcaccaaaccccttgggaggatcaagttccttgagctttgctcccggatcgggatggctcaactctcccacaagacggcgcacaagacttagggggagaatgtaggaataagtcttggctggttggtcttggtcttgtggtgcctttttcctgcttttcagctttctaggacagcatctctactttcagtttggatgctctaggacagttaggacagcagtttgttgagatgctctaggacagtttgttgggatgctctgctctaggacagtttgttgggatgctgacagcaccctcttagactagcatggctgcatggctgctacaagcagctataaatatgtatccaatcctctttgggaggacatggcttttgtatttagtgaatgaagaaaaccagaaaattgccccatctcgagtgccatcctcttctcaatgagagtaaccattgaaattctaacacacatgactcaacgaggttgtttccaattgcacacattagccattccccttttcatgttctaagcttctataggctataactacttaatctgtccattctcttccttagtgtaatgacgttttcggtggtttttctttgggagaaggtgctatgcctataaagagacttgagattgagaaagtaaaggcccaggatgcagtcttagcttttaaaaatgatggaatcgggttgctgcacgctgcggcttgccagggccaactgaatgtttgcaagttcttggtggaggaattggggggtgacgtgaatattgctggagcacaaggtcattatctaacttttatcatcctttcgtgagtttgctggcttccatgtctacgtttggtagtatgatgtgtgagtatactaatgtgctattcatcacaggtttaacaccgtttatggcagctgctgagtctgatgatgttcctactgtaaaatattttcttgatcatggtggtgatgtaacaaaagcagatgttagaggatgcacagttctccaccatgctgctggcacaggtctcccttgatatgaacactatccatttccttgttatattatcaattatattgttgtacaagattctacgatactgcattactgttaatagattacatttaattcaaccatgtcgtcacagttatcttttattgtgtcgctaatctagatactattatagccccatcatttggcctaaacagccaaagaataagccaaaatttgaatttttgaacttgattttgaagttgattttgaaatgcttttaacgtaatttttgttaatgttggcttttaagtcgctacgaacaaatatacaaaagttttacttataaattaattttaattttctaataagccaaataagccattttggccaaatgggcaaccgatgggagccttagtttatatatcaccactcaaagttgtattggtttgctctgtatatacttggtcacatctcacatgtaatctattgtgatttgtccattgcactggtaaatgtttattcaaataactcaatttatatagtatttgtttccccatgatttatggcccatctcattcattgcaggatgctgtaaggtaacagagttcttgctttcaaaaggaatacctgttgacatagactgtggccttggaacaccactcttgcatgctgctaacgatgacaaggataagacactgaagattttgttggatcacaaggcagatgtatgtagttgctactatttcttatttcctcttcctttttttcactgctagtttggatagctagatatttgttttgctttccacttagattattagctgatgtacacttatgcgtgtttgcatgggactgttttgtttgcctggactgaaccattccaagatattgcagtgcataatccatacttttggttttttccacttttaacattttatggaggatcttagatcatatgatggtgtgatttaaaagttatatttccagatcttaaaatgatttttctttattatgttatgaaatgcattattgtgattattatatatcttaccctcgaggattatcctaactcctaaaattgtcatttggcctgctctaagtaaggttgactcatgatttttggagaaagagtatggaattttaagtgttcaattcatcacaccaataataaaaactattgtcctgctctatgagcttctcaactcttaataaatgaaatgcttttggatcattatgtcaaatttgtaacttcatctgcatcatttccgcccttctagtttgatattgacatcaccaaatgtccaccataatctcttccaatgcagcaacatcagtttggcttcatgaaatttgagtagctgtggttgtacctgtatctgaactctgaatataattattggtttcatgtgtaatatgaattttcctattgtaataagaaatccgtaaaatatgcacataatgcaatttgaattctttcaacagcgcaaattgctaacttgaatttgtaaaaagtggcaaatgctaatcaggaaaaaaagtgcagttcaagcattatatttatttcctttttcatccacatattctgctttcagcttttactaaggctaaactctcattttctgctttcagcctaacgtaattgtcaacaatggagcatgtagtctcctgatgagttcccttgtgtgccgttcattgaagtgcatgaagctactcataaaggtcaatgcttaattgagtctatatttgttcaactaccgctactgttttattttgttaactcaaaatatttgttgtggagctaaatattatattgcacaatgcttttcttaggctggtgctgatgttaatggcaagggagcacttgtgtctcccttgatgtttgctgcatcacaaggatgctatactaacttcattaagtttctcctgaaggctggagcaaaccctaatatacctgatgatgtatgttttctgttcttctgagtcacttattagttttccactctggtctgattacagctctgattattttagggagttattttagcaataagttgaggctgctttgactatgctagttgtattgcacttatcatttgaatattttattctaaaggtgcattttgtagtttcctatcattatcagagcctatgtcctttatttattgtatgtgtaagtatatcttgcgagtacagaaaagtttgtgcaaagcatggataacattttagtgaccaatgacgctacaaatcaagattatatccaaaaggccttttcaatgtccaaaattgccatggccagcttttaacctacacaccatggttttttttgggacatatggagatgtttggttgaaagccacattttgtgataatttgtcgtactctgaatttaatctgcattcaccaattttggtgtcttttaggttccttgctgaattacgctgtatgaaatgacttcttcattcttttgtgcagttgggttggttgcctgtggagcatgctgcattacgtgattgcagggaagatgttgaaaggctatttccattgacttccccaattccaaatgtcccggagtggagtgtcaatggaataatctctcatgcgaaagtcaaagatataaggccaatggtacgttatgtatttatgtacagtaatgctctttcagtctttccatactaaatattgtttaatgccacaggtttccttatgttattgtgaaaattagagttttatttgagtgactgacatcaagtacacttgagttgcggcataagaatgccataggcctaaccacaaaactatgaagaatgttggagataaagatgctaagtttctttattaatggaaatcatcctagataaatgttctgctattcaaactttcaaatatccactttggattgcattaaattaatggaaatcattgaccgttgaaataaagttttcatgcattcttcttaagcttgggaatgataacgttgtttatgtgatgtttgagcatagacaatagatcatgggccaaccacagttctgtacacaaacaggagcatttgtagattgctcatgggtgatggtgaagatgctcaatctgatggtaacagatcccgaatgatgcggcctaactgggaaaaagcttgttatcgttggagtgcaggtcacatgctactcaaggtaagattcgctgcagcttacctttttgtgatccatcatgtattatggtctgtgtcctgatttactctaaatctaggagtacaaacaactgtgggatgctctcatggatgcacaaaaattggatcctgggagcgttgaaattgagaaggaacaaaggtatcatcttctgtttctcttgagcatgttttccaaacacaatcacggttgtgcatggaacatgtgttaatactaagatgtagttgtgcccacatttactgcagctgaacactcaaacttttctttttggttttatatgccactcttctatctttgagtccatgtaacactttgggttattatgactgacatttaattgaatcgcaatctgattagctggcatattcaaatcctgcttatttgtctcaaaggagaataggctgctcattattcaaaaccattataggtatagcacccgatgagctctgatattgttgttacatttaacccataaattttctggttgaggcatatttctgcataatgctgatatccactgtatttcgatggctcctacagccttccacttttagatatgtgatctgtaatagccgtctgttgctggatctatattatgttgaggctttgcagtatccacattagtcaagtcttcttgctgttcatatgctattttcctcacatggaggaaaatgagggaaccatgggcttcattgtctgttaccatttttcactttgctttaatcattaagtttccatgacttgaacgattgtaatgaatgttgctacgtaaaacattgaaaataaaaaaaaaatgacagaattgctagtgttcattttaatgtatatatcaaggttgatgatgcagctgttgtacttgtacagggaatatgatatccaagaaagtaaagatgtaagtttacctgcacagctacttcaaacatttcaattacctttaatagctgttgtccaatttacttataagcttttcactggaactcattttgaatttgattgatcttttttatgtagtagtttagttcatttttattgagttcgaattccttttattacaaatggtgttggctttatggttttgaagcatcaaatttacaaaattggccataaattaatctatttaactatatttccttgtactatcaattaattcttattttaacattttttttcacctcccatctgtaggttgtggagtcgaaggttggcctttatgataaacccactgcatcttatggggtcaaacctccaaatgtttcatctgttatgggaaaaacacaagtaagtgttgccaaaatccccctactttgctctgtatgaataaatgctgttgtattgtatccttattattagaaatgcaatatgaatgttgattcctgatacctccttttaattacttaaatgcgcaatgtatttaagatatcatcatatgtttttaacttcaagatatttatcatatttatccaggtttttgtcaaacatccccatggaacgttatccctgcagattgatacatgcaaaaatgtggtcctttttaaacaagaagtatagaaaaggatgacgctggatgtttctggatccttcttcgtgtaccagatgagcacgttagaagcaggaataccattatcatcgtatggtatagaaaaggattcaaatatatatatgtgtggtaggcttctcggtggacagaggtttcatggaagcagaagagttcatggtagaagaaagttccacggtcgaagaaaatttaaaacactatcacaatttttctaaaagcatgggcatgagttcctaagggaagttcaacttccggacaactcaagaactaaggaactcactgagttgggctgtttggttctctccagtttgatacacttatttacatcggtgtttgtagctggaaagacatggaatgggaacattgacatggatggtttgattgttgttcatgggagagtcagaatcaagaaaaagccatggaaaggcctcaactcaagcaagatgaacagtgactgcaccaagttgacttcgatgataagagaaatgtttgtcaaaaaaaatgttcatcctccgtacttgaagcaccttcttggaaagttagaagctttagctgtcgatgttttcacagtgcgtcagcagcttgcttttgactatcatatctctttgataccttctctgaaccgagtaaatttggtgtatcaaattaagagatgctatgatggctgggatgacagagagaaaatgtacttcagatttgttgcagacaattgcacagtcccagaagattggtgcaatactttgatgtctaagcatttgtttcgcctagtgattttggaaggacagaagaggaacatcatatacggctccaatggcatgagtgcatttcatttggtgagaaattacaatactcatgcaccagaacattcctgggtaagctcgcccttctcttgtttctgattgtgattccagaacgttcctagatttcctatttgcgattctgattcaaaaaagaaagaggaaaggaaataatgacatgaagctttcttttgcagattcatgtgttcgtggattccaaaatagaacattaccaatggtttcaatgtgatagtggtattgagctaatggtcccaaaatatctaggagactttcttgcagaagctgtatttaagtttattgaagatgagtttgatttaactcatgtgtacgtatatttcatttcagttcaattagtttaacttttttttgtgtaggttagtttgaactaatttaatataaaaatttcttctgtaggttaaggacttgttttgctttggggtcctatgttactgactcattgtcagacagtagctccgatgaatcgtcgtcagagagcagctcgtatagtccctctcccaggaaaagaaagagaaggaattcagttagtcacagaaagagaaaatctcggaggtgttcaagttcttccagcagcagcatgtctgattatccacccaggaaaagaaagaaaagccattctaccaaaaaggaaagctccaaaaaatgtaaaattgagcactaaggtaagaacacatttttctgaattgtccgctgctctcttgtgctttaatgtctgatgtagcttttgcttttctggctctttctttagccaaatcaaaattagtgtccgggcctttttggattgctactaagggctagtttggattgttaccttgccaaaattatggtagggtagcaaaccaaacatctctattaaatcactacctttgccaaaaaattggctttgaccataaacttgtctcttatagtcatattttggcttcaatccaaataaatatttttaacttcaccctaccaaagttgctcaagatttggcactaccaaaattttgatagggcatcaatccaaacagacacttcttcgctataatttcacattttgtctccatgttggtaggaaaccaaatataaccaaatgcaattcaggtatattaaaagattgtgttgtttctctgctttcaggtattccaacactgctacgacacaacttccatgaaggatctgaatgtaacagccatgacaagctgtcaagtccatttgatgggatgggtgcattctggaaaggatagttgtagaatcttttaggacttatagaagatatttctctccatgagcccttgtcatttttcagtgcacgcatttcagactttagtttaacaactgtctgtctctgaatttgaagaagacacatttcgacttcttcatgaaccaaagtattaacgtattattcagctttctgtctctgaacaaatttgctccacactcacgctgcatttcttgggtttatccttatgagctgaaaatctgcatacttgataattacgctaactatttctgatggtataatgtgcagctaagaagctaaggcgggtgccaagaccgacgcctaaagcctgggcgtcatcatcctcatgctcctcaaccaggattttaggttgagggtatcagtgtcaactcaacactcatagcaacaattaattacatcctgtagtaaacttataacgagtatgaaaagtaatagaagaatgctatgtaactagatgaaattgaattgttatctaagtaatcgttgttctcaaataaaaaatccttaattaattgttactatttaaagaaattaatcaggtggatagcttggtgagtgagttagaacaaaattaagatgaaaatcaaatcggaagttggctatttttttggctggtaagggcaagaaaaaaaaactcactaacgctagtttcagaagcagacgttgcattggcgttgtcttgaagaaggcaaagagttaggaagacgtgtaggctgcatctatctattttacttatttagccaaagctcaaaaaacaatatattgaccggtgtcataaggcctcttggtgttacacgggaagtcatcgattgtccatattctctaatgaaaattattttagcttattaggaaaaaatattttataggtagatatatgtcctaacgatttaagagcaaataaaaaaaactacgttgaaaacatcgtaagatcaactttaaatttaagtttaaaaaattcaaaaaataaccttggcttcaaattaactagggcattcgaggag

SEQ ID NO: 62510 - DNA, 616 bp, Oryza sativa
gctctctatgcaataatgaactaaattgtgatgtttattattgcagggaacacaagtatgctcacaagtagcctactggaaattcatacagactttggacaaagaacagctgcaagccagagatgatctaggttttgggggcttaacaaaaatgaatggagtccagattcgccggcttttctgcaagcaaattgctaggcaatatgacgagtagactagagctttcaatataaatggaaccatgctggagataaccattgaagatgtggatcacatactcggcgtgccatcggaaggtgctgaactggttgaagtcccacaagcaatccaagctgacgttgatgccccaaaggacaaagatgaaaacaaagctctacagacaacaaaggccgctttgtttgcattatataaagacaaaaggggaataagataactctgtcagccttgcaggattcattgaatttgaacaaatcttgtgacgatcactttaaaaggcagtttgtgctatatacaattggtctgatcctatgtcctacaactgagagatttgtccattcagattacctaaatctgctcataaatataccagatataaagagaacgggctgcaggaatt

SEQ ID NO: 62511 - DNA, 621 bp, Oryza sativa
tcgctgtacggacaagggtacctggcgtctgagtggccagaaggaaggcgtggaagctgccggaaggcggagcccccgagacggtggctgtagtcgtgggccaggcgacgaagcgcagtccaggagaggtcctggtacgcgatctggagagtgggcctggccaaagtgaagtggtgtgggcaaggccagctccgtgtatacctccacgggggtagaggtacacagagagctcacagtgagggggaacacggcccacggagtaccccgtgtactcgggacacgagaagccaaggaaacgggcgaggtcacgaagctgagcgacgtggtgaccctcaccaaaaccatgggaactgaagctggcgttcactgccatctacaattttgaaagagggagaaagatcagtaaccattttagaaacaaactattgaaaataaggaaaccaaaagaagccttagcttttcgcaagtagttttgaacttagtatccttagggtcgtcctaaacatcgggtttcgccctagggccaagcctgtgctctgataccatctcttgtcaccccccgaactagtcccgactggaactagcccgtgacgctccaaattaacctgttaatcgatacca

SEQ ID NO: 62512 - DNA, 519 bp, Oryza sativa
ctcaaaatataagcagcctacactctgataggatatatccgtactacgaatatgtactggctttatcgagattcgcactagaggtgtctaatctgattttaggttactataatttagtctgttttttaatagctgacgttcaaagattaaaatgtgcctattcattgtgttgagctcagtaagatgtaatttaatctcaagggagaattaaatttgaaaatatactattcattcgattttttctcacgaatattcgggatgcaaaattttttacagaaataaaccgtcggactctttctaccgtcagcgtcagacactacgaccggatattgaatggggttttctgacacgaataaaaaactaatcccataactcgtctgaaaaccacgagacgaaacttttgagcctaactaatccactcgttaacacatgtggggttactatagcacttatgactaatcattggactaattgtgctcaaaagatttcgtctcgcgattttcatgcaaactgtgcgat

SEQ ID NO: 62513 - DNA, 7243 bp, Oryza sativa
ctgtatgtaagaagaacaatgtgacctatatcagaacaatggtctttttgttaattaaaattgtaataagcgtgtgcttggttactggtggaatgttttttttccctttgtatctataacatgttttgaacaggtatcattggttttttttgtgtgtttggggggtggggggggggggggttatggagtacggtcatgagttatggacaaagtgtgagataacagcatcctattactgcttctaaatgaacacatgtcaatatggccttgtttagataaaaaaaaattggcaaaaaacatcacatcaaacgtttggacacatacatgggacattaaatgtggaaaaaaaattaattgtacagtttgcatgtaaattacgagacgttgtcacgatatgatttgacaatgtgatgctataataaacattagctaataacggattaattaggcttaataaattcgttttgcagtttacatgcggaatctgtaatttgttttgttattagtctacgtttaatacctcaaatatgcgtcggtatacttcaaaaactttacacccaaagaatcaaacacaccctaagctttaatagtatatagttagtggtactgatgtcttgggataatgaaaattatgattatgttggattacgaaatgttatgattatatatgactaatagagagagaccttcaaggccctcgagtcttttctgtaatcattgacaacaccaagttgtttgcttggtggctgtttctgcagaatggaaatcatgtgcacactattgatgcacatggtggtggttcagaaattatataggacctggaagactgcatttttcccgtgataaaatttacaacatagacagcaatgtgcatcatgaagaaaattataccccaaccacagccgtccacaatcttccaaaacaaaaccactgcttatctggtattaccagaaagtacagcaactctgcaactattgtagctaactgtactcacagcaccccaagtattacataggcattgttaaaaatttagattacatttgggcacttgcatggaagaaatcttacattgctcatatggattgccgatcatctctatgctgttccattgctagactttggaggtagaaagggctcccaccatccatactcatacttggggtatggagctgtccatttctcaggcttgtcaaatttcaagtcgaccgggttagaagccaatgcctcctcaagcgtttctgcttcaaattgttctgctaagaccctgtctagcctcaacttcataaaactgataacaaaagaataaaatgagtaaccttgaggattgccatgctacttaaattgaaagtagttaatcatggtatcggcaattacaagatcattaaaagtgtagatgctggctatttcagtgattgtttggtcctcttcctatctggaattttggatggttagaagcacaactggtctggtcatggcgattcacaccatgtcgtacatcatgacatccagaaaataatgtgatgcatagtcactgagtcacatgctcagagccaaaattctgtgtattatcatgttgtccagtttcgtagtccaataagattgtccctttccctctattactttttcactagctttctcatcaaatcagtgtgttcaggatgcgaacgactcattaccaatgtccacaactcgaaatcctacccagttagtatggtgcgtggaaaaaaatcagagaaaattcctctgtgccctgactagttttcgctcaatcatttctatgcctctgaatttttcctattttcctacatgctcccgagtttcattttaatcccatatatacctattccattagttgaccgctagatttctttttccaaaacgacaatattacccctcgtacttgtgtgctagcttattgagaaaaaaaatacaattctcaatgggaaaaaggttcattattttttttaaaaaaaacaaatggggtataattctttgaccacaaattttaaaactgaaatttatcatttttaaatcattttcaattcaaatgtaagccaaacaaaaatagttttggtttcaagttcttgatgaaattttgtatgaattttatcagtattttgaagtttgctaaaaatttgaatctttcatatttagggtcaaataattccatcacttttgattttatcatatataagaattttccacatcgagaattgtgttttttctcaataagctagcacataattatgagagaagggcagtatagtcatttcagggaaaaaaatataacggtcagttcatggccaaataacggaatgggtatgtagggtatcaaaatgaaaactcaagaccatgtaagggatgtggcaaaatttatagaagggattgagcgaaaaaacagaggcacgtaaggaattttctcaaaaaattaagatgacacttgtagatcattatcatgagccatgacaaagaaagacagatccaagcatcatagcaaataagatggaggatcacgtaaaattccaaaggactgttgacttgagcaaaactcaaaaggtacactcagtgtcttcgtttacataaggtgtattcatccattctgaaatgtttgacattaataaactaaccagcatcatacacaaataaacagagggagtagttctgagtttttccagtcatatcaacactacaatatacctatgcctcacaatacttcacaaggactacaaaaaacttttgtacttttgcatttgaaacaggatcttgaccaaatgttagaaatgtgcccggtgaaacacatcaaacttggaaaatggacgttacaattgtacagaacattacgggctcaaatctgactagttgctcttataagaaaaatattctactatatgtctatatccctccgcttgcatttgcaagagacacaatttactgttttgtgggatatatttatagctgcagaatgtgtttacagtcgcaggatgcatatttcgtgggaagcattttacaatcgcgagtgcaagtccgatggacaaggcactactagcatctttggctgtaattagtgctatataagaaaactactgcttatttgcaatagtttggcatttcttatccctgaatttgaagttttttcaacaaaaaaaaaagaagaatgcttgcatattaaccaaactaggcattttggcatcgtccttattttgtcaccagctcagaacatgtactgaagcaaatgtatgtcggcgtaggatcagcaataccgtaaagctctatttaaatccacatttgatgagtggtaagagaaatgaaaaactgttgatgttgtcatcatgttggttcggtgcttttgcagtttgtactttgttctctgctgatcataagtccataacacactacacacaggtaataccgtactgacactgcgactctttatgataggcgttttaatttctgtactagacatgttttgtgttgtactagtaattagcttattattagcatcggttgcggctgcaattgaaacgatcgatggagggagggggcactgcacttacgtgatccagttgccgtcggtggagacgagcgcgacggcggggcgcttgaggcgcttggtgatgttggggaacctgtcgaggaacttgggctccaccaccagccagaagtcctgctccttctcccgctccccgtagagccgcagcttctccttcagctgctcctggaagtgctcctcctcgtccagcatgaacttggcgttcgccaccaggaagtggtacttcttcggcttcgcctcctgcgcgcgcccaatccaccacaattctccgtctcaaccgggacgggaaaattatcaaaattagggcgggaggcgaggggcggtttggtttacctgatcgggaggctcgggggagccctgctggtcggagtcgacggccacggcgcggagcgacaggcgccgccgcctcggctggcacgagacggcgggcgggagcgcgaacccggcgccgacgcggggcagcgcggcgcgggacggcgcgagggtcgcgaaggggcggagggacagcgtcgcgggagccaccattgccccactcgcctcggctgccgaactcggggacggagccgaactgaagtgctgaagctggtcgtgtcagctcggagagggggcttgaggtcggaggacgacgatggacggtgagctttagccttatctctggacacgaggggtgggcgcctttaatactactgtgccgtgccattactggttaaatggctccatgacagcacacgggttttcgcactgtgccgttttgaggcccatagattttttttttgggcacacgtggaccctactttgggttttatataggaataagttcatctgaggtccctcaatctctatatacgatttcaggtctaatcccaggcctctcactgagccacgtggcatcacgcttgcgctccatccaaattctcagcaggagaacatgccacgcattcaaaatgtcccatagccgtccgatgacatacgaacggtgagaaaaaggtccagcggacctaaatataaaatgcaagttttaagaagggtttttaaacaaaatggacaatgccatctagaagagcctggagtagaggaaaaaaatcccagaaccaaaaaaaaagaaggggctgtctatataggaatcgaatgatttctgaagctccaatcatacagattttatctaccataggatgcacatccaacaactcagaaaaagtgatacaaatagatattacacttaaaaacagatatattatttgattatttgaacgccatttttttaaagcctaaatccagatccagatccataaaagcccaaatccatatccagatccataaaagcccattagtaaaaagaaggcccaaaatacaaaatttgaatcaaacacaaataaacaaagcccatgattttttcgcccatgcgaattatttgaaggcccaagtctatatccagatccataaaagcccattagtaaaaagcaggcccaagatacaaaattagaagcaaaacacaaggaaataaagcccaaatcataatccaacagcctatccaaaaaagtagtagggaccaaacttggaagccaagtagatgaaaaacatgtcacgtgaatcaaccatgtatgggaccacacttttcaatcccctacttttcaacagcactactagttcacaaacagatctagcacgaatcaaacatggagctaggagaagagaaagaagagagaaaaagaggatccaaatcgcagatggaaggagagagtacaatgtcagaatcaaagagtagttctataggaaagaagaaatcaaagacaacttctgaacagaaagttgagatccatacaaaggaaacacagaatctggagaacacaaagaaaaaacaagaggaaggcaaaatcaagagaaacaagaaggctccagttcaaggttagttcaaggctccaattcttatcccctatatacaattcctgaaaaagatcaaagagagagtttaggtcaaatatataattcaaaagaatacatgaaattgctgaatatgtcaaatgaaacaaggttaacaatccactttgctggataaatacaacaactcagaactgaaaatttcatatgtttgctctgtagatctgaactatgtaatgttaaaagtaaaactacactgcattcagtactacaaaactgcattctggatgatagtattactgtgtactattgatgaataccaaactaactttataaaaaaacatgacagattgattagtcttccaaccttactgaatttcactctgaagatatcacagtcatacagttatacagaaatataacaactaggccatatagcatatcctgaattgtcatacattcaattttatcagcataatcaccatattaaactaatgacaaattcaaatctcaatgtcaaccacttgtctcatccaactcaatattacataaaagttcaatatctcatacagcacaaacaaaagagccaattcatatgaactcacatcttaacatgttactgtaaaaaagtaataaaattacatacaagaatcacagtaattctagtattaactcattgtaaaaagattagttcagtaaacaaaatagtttagctcacacaatcatgcacaaattcaggaacacattcaagatatgttttaaactcaagactatctcagttcaatgtttctctcatcatcagataacaaaatgaagatttcagataatagatcattattgatttgttcaatgtctcaaaatagaatataatgaaactagttacagtgaacttgtattacaaatatatagagtgaacactacaatttcaattgaaaatacatgtaactacaaagaaacaatgtaaaattcatatgaaatcatgatctaatgcagtttaatctcaatttcaagatgatttcagatttttcgagcaaaaaacagggtatcaaatacttcaaaagtagtacatatgtaaaaaccaaaacaaatcatatctaattgaaatagaaagaaatagaaaagaaaaagtgccatcagatattataagaaaaagtgccatcagatagtttgttccataagtaaattttaactggaattacagtagcattacactctaattgaaatacttatttactgtaaccgaaggtcgacgccgcttcttcctcgacgccgtcgccgttcgttgatcttccgccgccgttttggtcgccggtgagttcgccgcgtcgccctctacgtcctggtgccctccgttcgcgccgccgcgccatcgttcgccggcgagcttgtgctcccgagccgccgccggtggtgacgtcaccgctgacgtcatcgtcgtcgtctctcgtggtccggccgtggatcggtcgatctcggccgtccgttttggataagatcgatctcggccgtccgttcccgtgaaccgtcgccgtgcgcccggtccaccgcgaaaccctagccgctgacgcaataaatccctttttccttttcaaaaataattcattattgcgtcataattcaattaaaatccatataagtgttttaatccgatttaatcttcaaaaattcataactaattcatcttagctcggatttagttggttcaagtctctaaatttttctaaatttgagatctacatgttaaaaatatccacatgtactgttcatgcttgtttttgtgctgttttggtgattttgctcttttctgcttagatt

SEQ ID NO: 62514 - DNA, 15455 bp, Oryza sativa
attcctgcagcccgtacgcgcatccgtgtttgagtcggtttttaaattcactcgcttttggaaatacagatccgtgtttgagtcggtttttaagatcgttcgcttttgaaaatatatagaaggagagtcgtataagaaatctcttttaaaaaactcgcatgctaacttgagacgataagattcctaattaccgctcatgattttataaaaataaacaaatccaagggaattcccatggtgaatttcaacttagctaaaccgtataatataataactaaaagaaccttcacccgttgaaaggcattttttctagtataagtataaagggaacaatggggccggatatgtgggccatcaaatctagcccaagcagtcatgctgcctacttctgcaaccgaaaattctgataggcccagcccaacctgatatagaagctgccctctctacggactaatcgcgggcctctctgaagaactaagattgcagagcttgcaggttcgtcagaccgttcgacaacacagattcagattggtactacacaactacacatccaaattggcacagatcaaattattcagggttcttgcctgcaaatcatgctacacatacatacatactgcagactaattcctcacactattgcccacacctcctgatgatcatgcatccacaattcccaatttctacccaaactgttttgcttacttacagagcgaagcaagaatgcggcgaggaggctcgaacgatcgccgggagtgaagcaccgcccagttgtcgatgagcaggatgtcgccctgccgccacgggacggcgacgcactcctcctccaggatctcgccgcagccggcgatgacgtcggccggcagcggcgagccgtcgccgaaggtgacggccctgacggggtcgttccgggcgtccttccacccggtgtacgcggccaccatgctgttgaaccatatcttcctccccctgctctcgtcccatttgaccgctggtatcgggcccatgatcgtcttcaccccgtcttcagtccattccagcttcatcccgagcttcgcagccctaagtgcaattaattgacagagtgacagttcagtaacttcagttagtagctgcagcatgtatgatacattgctacctgtgctgaaggtaacgtcagaattctagttcaagtgagaaaccctgtagtgtgatttgtgtgatggtcgatgggctgatggaatcggtgatgagcagctaaaatggcttgaattattgaaggtttttcatgtggctaattactgaatgtggtcatgcagaactgaactctgtagttccattggttctaaattgaatcatgcatgcaggtcaatgaaacgtactccctccagtttcaaaatttcgtccatcagttttatcactttatatcttttgtaaaatataagattatgactgtacttttcgaggcaaatctatgtatacaatttctattgctcgcaatctaagcattcgagaaattgttgatggtttgaattttaaaagtttgacagaatcctaaacgttaaatatttatgaccggagggagtattatggtggaatgcgacgatgttgcagtgggtttctgaatgcaagtgcaaacattcagaactcatgacaagattacgatatagcggtatatatcagtgtaactgaagatttcagaaaaagaaagccagacctttcctctgcaatgctcttatctttggtgagaaatgtagagtgccatccacggccaataggagaagacggatcatcaccctctcctaacaccctcgtgtatatcagcccatccttctccaatttctcaacaaattctggatacttttccttcatcctcttgtaaacgtagtggctcaacactatcggtgtctcaccaccaatcttcggttccacctcgcagaagaagaacagcttcgccggaaatgtcggaacctgaaccaaaaacatatatgaaatctcagcttaattttaaacattagtataagcttgtagcgaaagcattttcttgaactcgaattggattcgatttgctgtgattgtatggtggacctgcgccatctcgtggtggaaggggatcttctggtcgggcggcgactcgttggcggtgaagacacgccccaccacgttgctccgcggggcggcgccgccgacgtaggggagctccgcgtacccgaaggcgtccacggcgcggtcgaagtccgccgcggcgcgcgccgggaacccgcggagcagcaccgcgccggcgccccgcagcagcggctccaccgtggacgccctctccgaccgcacggcgtccaggaacgcgtcgaggccgccaccggccgcggcggcggcggcgctcgggacgagcaccgccgggaaggcgacgccctcgacgagccgctgctccgggagggcggcctcctggaagaagctccccgccggcgccaccatgttaatccgttgggtggtgtgtgcgcgagcgagcgagcgagcgacacgaggtggatgacaaagggcgttggattcgttgggattttttggtggggacgatgcatatgcttgggatgaacgtggacgggttctcgaacagtgtcgggatggtggcttgtactagctcagtcaagctggacgtcacacttgtcacgactcacgactcatgatgatggcaacgtgcattaccctggtgttgatggctactacctccgttcaatctcaaaagttagttattatattctggacggagaaagtattaaggatgtaagcggattaacctgtaaacattgacggacccagcctaaaattttagctatagcgtaacaacgtagagagtacactttgaactaaagctatagaatctactttctccgtttcacaatgtaagtcattctagcatttcccatattcatactgatgttaatgaatttaaatagatatatatgactagattcattaacatcagtatgaatgtgggaaatgctagaatggcttatattgtgaaacggagtagtacaaaacattgtacagaaagttatgttgcagattagaattaattcaaagcatttttgaaatttagattagattttctagacccgattgtgaaacgagtgctaagcatagtgaaacgagtgctaagcatagtgaaaaaaaatgctaaaattgttataaaaatcaaaatcaaattctaaggtttaaaaaccaacttccaattataaatacgtagtctcatgttacttatagtcataataaattacatagaacaaaagcttgatgaagtgccctcttctctctatcctctgtctccctcttctttctctccagccgacggcgcggggtcagagagggcgactgtggggcggagtggccgacggccagagcggcgtagcttgactcggcggggcagcagcaaggtggcgcagaggccatgcaggggaggtttgaaccgaggcattccagaggatgctcttcggtccggcggtcgtcgaggtgctgctgcttgcggccgaaagtcatggcgtcagggaggcgttgcgggtaggcgggagcaggtggatgcggttggtgtcaccggcattgcatgggcgtagagcaatgcgtgcgtggccgacgtactcaattcgtgggtacagtgaggccggcgtcagcagagtgggcgtgaggcatgggtgaggtccgtgtgccgggacgccgcggctgcaggctctggccaccctgcgcagcgctgccgacatccagcgcgccgtggcgcggggtctggaggactttgagcagcgggagtcgtcgtcgcctgctccgaccactgcccaccccgctccaccggctagagagagaacaggggatagagagaaggggtagtgaggataacgtgtgggtccgcgcgggcccaccattttttattatttgtgtgtgcaactgacacatgggtcctattgattttattattttttaatctaattgccacataagcactacgtcaataacacgttaggtaaagacctagttaaaaggagccatgtaagcgttaaaaccgaacacaatatggccgagggatcttatttaaacggttttgtatgctgggagacctgttatgccggttttgcgatgaagtgatgaaaatcggattaagcgacaaatagaaggaaccaaaagtgaactacacgactcggactctcccagcctcccagccaggcccagcaattgcgttggcacttgggtcacccgtatccgtatcgggttgcactcaagagtcaagagtagtttatcttcgtctcgcctttgttttccccttcgcgcaccaaacaccaaacaccaaaccctcgccgccgccgccgccgccgccgccgccatgcggatccccacgacggagacggagacggggacggggacacgcagccacaggcggcgcaagggatcgtccgacggttcgcgggccgtacaccggaccgacgcatcccgtcgcggaccaacgccgaccaaggaaacggagattcccgggcggccgccgaagcgatcctccttaaccctatcgttggacgacgcgggcgcctccaatccagcctcaacctgggcgatcctgaatcggtacggcgcccggagggattccttccgcggcgacgaccgcgaccgcaccacgtcggcggtctcctacacctccggcggcgaccagatctccgtctccttcgagctcgtgaagccgccggagacctccctcctcaccctcgactggccgcaggggccccgcccgtcggcgggaaccacatcctacccatacgtcatcgccgcgcacgacaacgtcgtcctgttccagatcatctcccccgacaagtacgctcgcccttccgccatcgactacttcgtctacaatgccaacagcagcagcagcagcaaccaccacccctccttgacgcggctgcccgtctcctactggaggaggagagacacccttcgcccgcgcatcatgagcagggaaggcacatgtattctgtcctgcagcaacaattctccttcgttcgttgtggctgagctcgagagaagatcatgccaatcttccgaaaccaacatctacctctttgcttctggctccgatgactggagagtcttcaggaatgtgccgatccgccatggcgacggcctcgctcacctgtgctggtggacaactgatgcagtgttgtcgtaccacaatcgctacatgatctgggtggactacttggtagcagggatgatcgtcgccaaagtggcacatccaggaagggttgacccaccggagcctgttctatggtacgtgccgcttcctgtcgatccagttgatgggaacccttatgacattgaccgtgggcgaggatgccctcaagcctcccgtagtgtgtgtgccacccaccatggcatcaagttcgtcaatgttaaccaacatggcggcggcagcagcagcagcagcagcagcagcagaagcttcagcatcaccctgtggtcgtggcgcgaggaggatcaaacatggggagaagatgcaacattggatgctgaccaacttcgggacctcgattctgagaaccgccttccaaatatccaacctgaattccccgttgttgacatggaaaacccttacgccgtttgcttcttgttgaacgagcgctaccacactgctgaccccaatgccacaacgtggatgatcaaggtgcacatgaagaagaaggttctactagattgtaccggatattccaacaaaggaagcccttctactgccagaaggatgtctgaggggctctccttcatctccagcgaaatgccatcttacctgtctagaaaaaccatcaaaaggtaatttcatgtctggtttgcgaaatgcctgttcacctaccatctctttattatgcacaactgctactgttcttggggttgcatgtcctgcagaatcttactagtctgaactcgaagtgaatttttctgcccaaatatgtttagacaatatggacatcgtggttgcttgatcagggcttgcatgattgttagatgaatatagaattgttcctaggatttaggtatttagcaccaccaacgtttcttgaaccttttaattacttggtcctggatcccgctataaaccatgctagtacagtttatggaaagcatgataaaaatcgatgtttgtttatatgtttctatttcatcttctcaaagagactccgcaatcgtgaactcttattattatttttgttttgttaatctaaccatttctctgaatcttaacttcaggcaggaggttgataagctaggaatatgacaggagattcaggaatcgtcttaccagtttgaagattggatgcatcaaaacgaccaggatgtgagctcctgcatgttaggctaaattatagatgttcggaaagaaatttggcagactatgacacctcgtagttggcagactatgacacctcgtagttgtgttaaattatgtatttttgctcgtataatctaaaacaggattatggatggattgtatgctatattattttgtctcgcatgtccatattatttttatatttttgttgctggggcactgctcaacctgagtactatatgagcaaacagtcgtattgctctacttgattactcgagtaaacaagtggtattagctgaggcattgaggcacaatctcggcgaagggatccgaattaggagagagacgctctctccccatctcgtgcttctcattagactcgttctttcttttctttccgcttcctttttttctcgagccctattgcgtattgcgttgagcgtgtgatgacttgtgataaatttataacaaaatgttgggatcttggataaatgggtttcacagatgggaacagctttacatgaactgaaaagtcacattcgaaccagttcgcatgtttctcaaatttgtatgcccttgccttccagactcgagcgagtcgcttttagcgcagccgatgaaaaatcattacaatgcgattcatatcataggaaaatatgcatttttagcattgccgtgcttatcaggacacgagccgtatgcagcgatgtgaaaagtgactagcaatcaatccatgattccatagtgcgcactgttccttccagagcaaatgtgaactttggctagcaaactgatgaaactcacaccaagccttctaaaatagcaaacgaattcgcaaacctaaaaccctgaaatagctattgcttagaggtgtaccaaacgaatttgcaaaccttgaaacaaagtgaaccttaaaacgaaatgagagacacaaaaggtcttcagaacgtcagcaaccctggcggattggaatatatacattacaaccttgatatatacatgtaaaataactgtatcgtcaaccttgatatatatgttaaaatgaacactagcaattctgtcattcatttccaatgttttacatagcaacatgccaacattcattagaatcgttctagtcatgaaaacttaatgattaaagcaaagtcaaaatgataacagacaatgacgcccacggttccctcattttccttcatgcgagaaaaatgggtgaaaatgacaatgtcggaactcattgggcactgaaatgtctgaataatgagctgcctttctcctttaagacaaacgagcaggatttgcatatgccagccaaatcagattgccatgcagttaaatgtcagttaaatgcatgcagccaatgcacgttgccatcatcaactcaaagatggaagaaaggcatataaaaccaaaaagaaaagtttcagtgttcagctccagtaaatgtggccacaacgtcatcttaataataacagtcatgttccgtgcacaaccgcatttgtgattggaaaacatgctcaagagaaacagaagatgatacctaagttccctctcaatctcaacgctcccaggatccaatttttgcgtatccaagtgagcatcgcatgcatgcttctactcctagatttagagtaaatcaggacacagaccataatacatggatcacgaaaaggtaataagctgcagaaaatcctaccttgagtagcatgtgagcttttgcccagttaggctgcatcattcggcatctccatcagacagagcaccttcaccatcacccatgagcaatctacaaatgctcttgtttgcgtacagaactgcagttggtccacgagtctatgctcaaacatcacataaataacattatcattcccaagcttacgaataacgcacgaaaactgtatttcaacagttaacaagcaaccttctaagacatcacaggtttcaagataatggtgttaagggtatagatgtgaagggtattttgttagggataaggctgctagggttaggatctaggctgatacggtatagatgtgaagttacaatactacccgtcacatctatacccttaacaaatggcagagtaaaattacttctaaaccatcagaaataaggtgcaaggatttaccaaatcatatacttttgctgcacagtcgtaattcttctgcctaaatgccaaatctgcatgcgacttcaaaatagcttttctactctcctgatgttgatcctaaacaatgaaaaattcttatgcaatccaaagtggaaatttgaaaggttgaagtttgaataatagaacatttatctaggatgatttccattaacaaagaaatttagcatctttatctccaacattcttcatagttttatggttaggcatatgtggcactcttatgctgcaattcaagtgtacctgatgatatcaatcactcaaatagaactctaatttttatcatttacagaagtcacaatatctgatgcttaataacgaaaagcacccctttttcgttttcacactcaaattcacaacttgaggtccaaatttaactttccaagtagtcactgacaatcaagtcaacagacagatggcccaatatattatttatgaagagctcaagatgccacttatatttattaataaatacttttatttggaacagaccttaaagtcaggttatcaagtactctagcaaaattgaaggtttaacaagtactcgcaaagccgagggacaaaaagggtctgctctactttaaaggaacatgcatgataacagagcacataaaatccttctctttagtgctattaactgttgttgatatgtaagttaaaccagtgttacagcctaacaagcatcaggtaaccacataaatgagacgggaaatagagctccgtgatgcaaagtgcatggtaagcaacagaaaatatgtgcagagagcatagcattaaacaaaatttagtactccctccgttccaaaatataaggcataaccacccctaacccaaagaccaagaaaataattattatcatcttgtagtttggatcatcctaataaatacaatgcatgcatccaatagaattagagaacatgagagtggaggatttaaaaaagtaataatttaatggagaaggggtcatagttaattgcctacatgcatgcacgcattatattatggaacatctagaaaaagtggttgtgccttatattatggaatggagggagtatgaaaaaagcaactatatataacttaccgttggctttgtatggttgacctttgcatgagaaattattccatcaacactccagtttgggacatttggaatttggggatgtgaatggaaatagcatttcaactccttccctgcaatcacatgatgcaacatgctctactggcaaccaacccaactgcacaacagaagggagaaagtcatttcatttcatacaagataattcagcaaggaacctaaaaatgccaaaatcggtgaaacctggaattgtttgtttgcagctttcgaacaaacaactccttatgtcccaaaaaaccatggcatgtagttaaaagctggcgtgagatttttggacattgacaccatgacatggctttcttacaaaaagggaaaaacagtagaaacaggctgtagttgtggactcactgatcactataagggcattcatgctttgcacaaactttttccactcacaatattatatacttagttacttacacatacaataaaatacaagaaacaggagtcaataatccatagaaatctacaaaagtgcattgttggtataaaatgttcatatggaaggtcatgaaagctatctctatggctaaggattgtctatggataagtcaaggtagcctcaacttgttggtaaaacaatcagagctgtaacagaactccaagaataacatacttacaacattgggaatattagggattgctccagtctccaggagaatcttgatgaagtaagtataacacccttgcaacgcggcaaacattaagggagttatacctgtacccttgttattaacatcagcaccagcctgagatcatgaaaagcattgtggatcatgttttgattagcaaaataaaagcacagcagtagttgaacaaatacagactcgataacacactggcctttatgagtagcttcatgcacttcaacgaacagcagtcaagagcacttatcagggtactacaggctccattgttggcaattacgttaggctaaaagcagaatatgtgaaagaaaaaggaaagaaatacaatactttaacttttttttttctgatcatcgtttgccaattcttaaaaacgagttcagagttcatgaagccaagatggagttgccgcattggaagagattttaatgcacatttagtgatgtcaatataaaatgagaaggtcggcaatgaagttactgaaggtacaaacaatgacatgataatccaaaagcatttcaatcatttagagttgaatagctcatagagcaggataggttttattagtgtcatgaattgaacgcccaagttttcactctttccgccgaaatcatcacccaagccttacttagagcatgccaaatggtaatcttaagacttaggagtattactaaaggtcaagatgtataataatcgccgtctatgtcaataggtattccttttgaaagcaagaactctgttaccttacagcatcctgagcgtgaatgagatgagctataaatcctgggagagagatactatagaaattgggttatgtgaataaacaatgaccattacaataaacaacttggaacagattacatgtgatcaagtataaatagagcaaacttatataactttgagtggtgatatatagaaactaaaggtatctagattgccacataagaaatgattaccttttttttcgaagggcaggaggactcctcttttcattaataaaggaggagagaaatggtttatttgcaggcgtttgctataaatacaaggacataagaaatgattacggtgaagctgtgattgaaacatactccattaatagtattgcagtattatagagccttgtacaacaatacaattggtaatatatataagaatgaactggatattgagggggatctgtgccagcagcatggtggagaactgtgtgcatcctttatcatctgattttgttacatcaccaccatgatcaagaaaatacttcacagtaggaacatcaccagactcagcacaggccataaacggtgttaaacatatgtgataaacagcacattggtatacttcacatcatactaccaaacgtagacatggcaaccctgattttgcaaaagggtgatagagtaagataaataatgaccagaacgcttcagcaatattgacgtcacccactcaccccccaattcctccatcaagaacttgcaaacagtcagatggccctggcatgctgcggcatgcagcaacccaatcccatcctttttacgagctaagactgcatctcgggcctttcctttccccatatcaaggctctttataatatcttctcctaaagaaaaacacagaaacgtcatctcattgaggaatagaatggacggattaactacctataacacgaaaagaaaagtaacaaatatgtgtaatgtgcaatatcctcactgagtcatgtgcacctatacactcactgggtcgtctatgtaaacctgtactttgcaacttgaaaacatttgttcagattactacctgactacacatcacaaacagtcacacttggaggcgtaaatgtaatagaggataatcacaacatttgtcgcatttatcgaaggcaaggaagcctcaaatcttgcaatctctagataagataagttggtaattcatggacctgggaattaaacagttaaaagctttcacaaacgatcaaatccatctagagaacctagaaatacggaaaatagaatgtggcaaagttctgaaggcaacgagagtgctagatgctgaagcgcagctaggctaaaacttttccttccatgttcaaatcaacaatacaaccatcgatgcaaacgcaacacaagtacacaagcatcactcaaacctaagggcggaaaagcacacaggagcatgcaaaaggggcatcccctcatttgctatctaaatggttatgaaacaattaagaagatagattaaaatgtgatatatcactccataaacatgtattcaacttttacaagtccaacgagaaaaaaaacaaattaaattacagctagttaaagtaggtctatcacatttatcttattaaattcttttagaaaaattataatcattatagtggcacgtaaataaatatgtttagaatagtttcccatcatgcctacacagatcgatcgggtgggatggacacggcgaagatgaggagaggaagcacccttcgagtcgtccgaggtacccatctaaggccgccccaggagagcgctcgcacctgcgaacaaagcgagaaatcaccattagacacaggccgaggagcaagccccccgactaacgcgcgaccgcgacgatcgaactacgaggagaggtgcggcaggggaaggctgaacgaactggtgccgctggtgccgtcatcggtcgggcggcggacgaacggcgccgccatggctcgccgcgaggaggacgggtggggtggggtggggtggggagcaagaggagacgacgaggagcgttgcgttgggggtgggtgggcccgtggcccgtgggcggtgtttggccttcctttacttcgggactgtttatttcgcgagaagaaaattgctaggtgttacgtaagatgtttttactggatttcgaaagagtttccggatataaataaaataactaattttataacttatctgaaaaccgcgagaagaatctttcgaacctaatcaacccgtcattagcacatgtaagttactgtagcacttatggctaatcatggattaattaggctcaaaagattcgtctcacgatttttcacctggttgtgcaattaggggctgtttggttcacatactaacattgcctaggtttaccatgctttcttagccaaacttgtcaaaggtgaggccatcaaaatccaagccacactctagccaacaaaatgaaaccatgccacactttttagagacatttacatgtgggacctagattacaaaagagaaatcttgccacacttgtggaagccaaccaaacactcacctaacatggtcaaacttgtctaacctcaagtatggcaaagtgtggcaacttatagccatcaaccaaacagccccttagttttttaatctatatttaatgctttatatatgtgtctaaatatttgatgtgatatttttgagaaaaaaatttgggaactacaacaggccttcattagtcgcttcgtacggaaacgcaaccaagggtgtgggtttttccggtgcactagactgggtgcactcgtggggcgggtgtaggtagacccggttcatggagccatttgcccggtcttgagttgagacaaggctcgatatacatacacacacgcaaaatgcacgtatgtggtaacgatggtggctgaagtttggacgattaatctgctttatatttttgcgggcgagcgccgccttcaacctcgccagttgctgccgccgctccgcccgtcgtcacggcgctcgcccgctgccgcactcctcctgcacttgctcgccatcgccaccgccactcctcccaggctcgcccgctgccgcatctgtgatcgcgacgacgcgccaccgccagagcgagacgaggaggacatgctcacagtggggcccatattgggcacactggtctttaataattgtttctctctcctattcctttaaaaataataaaataatcatgctggtgtccagcagctaattgctagtttttttacgatgccttacagcaaatacaggtttatgatgtctcctagttaataacacgttttttggatgtcctgtagcattttttttgctaaaaaacaatgtactaatttgaatggcaaattttgctacacgacactgtttatgggttttagccctaggacactgcctaaactcacttttgggagaaaacactccataaacgtagtaatttgccagtggatccgcttcgattaaaataatacttttcggttgaagaggtgagagaaatcgtgtgaaatgtaaaaaatgcccttggcccacatgtcagatctatctcctatctctcttatcatctctctctctatatatattctctctcagaagcccacggggcggcgtcggtcgcggcggagatggcgaggacggcggccggcgaagtggagcggggcggtggcggcggcggtggacgagcgtgcggctggcagagcggcatcgttggtcgagcagagtggtagcggcggcgagcgagcgcggggcaggcgacagctagcggcgtgcgagagccgcggcggcggcggctggccagagcggcgcacaccccatggcgacggcgatggcgacgcaagctcctaccatgcccgccggatggtgttcaccgagaagcgtcgcggccatggtgacgacgatgcaagctcctacctcgcccgccgccgcgtccgggcgtggctccgtcctccccctcctccgtggccgcctgtaacattctgaaaattcgaccaacaaaatcaaagactccaaaaattcagatcttcaaaaaaaaactttttaaataaattgcatcatgccaattttattcgaagattttattggattttgatttcggatttcatcgatcacaaatgggaggaaattaactaggaataaaccctaaaaatcaagtgggctaaataaataattaaaatataaattaaaataaagattaggtgggtttggaaataaataaaatgttatcgcaaccatattaacaacaattaaattttaatacgatggaatgagaattaactttaattaaaaattcaaatgaattatataaacaaaatatgagtgatattaaattaggtgaatctttagttagaataatataaatatggggtaaaacttcatttatgcaaaaattaagaatttcggaatcaaattcatatgagaaacactctaaaatcggtttattggaaaa

SEQ ID NO: 62515 - DNA, 24863 bp, Oryza sativa
  unsure (1)..(24863): unsure at all n locations
aattcctgcagccctccgtcaattttcaaaatggaaaattatttttgtaaaacttttaataaaaaaaattataaataaaaagaattgcatataggactactactcagcacaatgaggcccaggcaggctgacgaattctcgcgggcctcacacgacgtactactactctgcagcattctcatgaaaaaccttgtaaaattatcgtcgaaaccggttcggattcggtctcatttggaatgaaatgctcttatgaaaacttcacaaaaatttcattggaattggttcgattcccgcatatttggtcccatcatctagctatattgctgatgaaaactccttgttttcgaatcaccatctctctaaactagtgtaataatctgtactcatatagtgtagtactagtagtatatagaaggctaagctagaagtggtgatgcttttctaatattttcaagccgaatcttcccaacggtagtgacgactagatcacttgacaaaatcccaagtaggaactaaccagtgccctaatttataaagtaatactatgatcaatgcccaactaacccattgttacacaattaactaagcagtgttaatggactataagaaatacaatcttcctaccatagtttaatctcaactacactatgtgccagaagtcatgtgttcatcttcatcaggtcaggagtagaatctgcttaatttagctacaaaagtagcatcaagatcaggggatcacatagccacttaaaaaattcaaatgatggggactctctccagttgataattaattgaagctacttcttcagacttaaactagtggggggcatgcacttgacccaaactaaagcatccaaactttttgaaaaaacactagaaatatactgcactgtagagtattttactttatatagttctgtagtgtttaggacacagataagatgcatgactgctaatgacaaacggctatgcaatacttactcataaagccgcctcgattcacgtgctaatcactaaattagtggagcaggaggagtagcagaaggattcattagagtgagagctgggttagtttaattaatcaacactacacttagtttgacatcattggctggaatcaaatcgatcgaatggccgcaacgacacatgaaaccaaactgtcagcagcagcagcagcagctagcattgctgggctcgagatgcagaagactgaagacccagtgataatccatagctgaagacacacattttgtccatgttttgccgtttgaacaagcaacttaaactgtaattagtgctggccgtattcatgaacagcaatcaggtgtcaggttaggcagtagggtttacgtctccgatcacccaaaaacatggccaagaaaacaagggacaacctacacgacaagatcaaccaacaaacgaacaggccaaaaatccataattattcagcgatggtaattaagaacagtagaacgtgaccaagtccggacatgattagtgacaagcaggggcgtaatcaggttgatcacgttaatttaattgtggaactacgcgagttttacgccaatttatcgcagttttttgaactatctgcgtgatgatggatcgatcaagtggtcgtaagggaaggttcctacgcgcgtgattctcgttgtggcacctgtgacatgttgacatcaccatactgatctcaagaaaagcatctctctggatcaacggtcctgatcttcttgtgcaattaggcaaaattcgttataccgtactatatccgttctaatttttagctataaacatggatatgtatttatttaaattcgtagataaacattgttatattttagaagggatggagtactatttaaaatcaaaacttaaaagttgttcatctttaagtagaaaaaacgtattcatatgcttcatccgtccttaaatataagtgattttggtggtatgtgacacatcctagtatgtccagattcgttataatagaatgtgtcacatcccacactaaaatcttttatatttagggacagatagagtatcaaacatgaatccacaattttcaaatgatgtttagccacaaacaatattcaactcaatatgttaattttccatcttttgaaatggatactgtagagtataccgaagctgcacatgtaaggattgctcatgtgactacggtgtgtttggggtgttgaccatgacgacttttatattacagtaactaccaatttattacaagtaaaacaaatatatagatgtacggcgctgcagcaattagtaaaaacaaatacacgtatattctcagtactcgagtggtagtatactatactgatttttgtttttcaaatttgaaggacttgctctctttgcaggacactgttggttgggatgagaatacttcaggggatacaggaccgttggatctgagtgcagagggagacaacggaaatgagccgttgtttaatgataccgatgggaatagaggacgtgatggaatatgcccgtctcatgacaaatggtaccttcaattcatcctcactcacactgtcccagtacacttcctgtccatcactctatgagcaacttgtgaatctcatcagtaccattgtttttttttcttttcaatttgagtagtacaatcaccacaacaatctcatttgatagtttaatacttctacctctgtctcaaaacaagtttattttttatcccccgtttttatcaaattcccaatataactattcctcattttatcttctcctaattctcatacttgtacaaactccaaatacaatgactactttataaaagaacttattttgggacaaagggaaggagctaaaaatgaattcaatacgaggcggaggaagtagtatgggtcactataaatgcttgatgaccgtggaagttttttttttattcggccagaattaggctcctttggaacaaaacggtttttaaaagaaattcaattccatggaaaaaatttcctaagtgatcctttggatcaaatgaatagacatcaaaaaatcatatgcgatttctttgggtctgctcaaaacataggaattttgattttttttttaacttaaggtccaacctattgggaaaaaaagaatcatatgtgcctatctctttcctgcttacattcagacggtcatttttagagttttttttaattcataggatttgaagtgctagggcattctaagtctctaattatgtaaccttttttaactaatttctatgagtgtcgttaatcatgtgttccaaaagagtccttactttagagtttagctctttctctcagactcggaggagaattattgtgtattgttggcctccatatatagtagaacagtcaggagtcttgagagttgagaagcagtggtttaccatatagcagatgtcagtgatttgagtccacttatcttcaatatatgaacttattagatcttgtgcacaatgcaatagtgttatacacaaacaaaattagggtcaaaagcaccctttctagctttactacaactcgtagatttcagtatagactcactgattatagacaactactgtagtttagaatatgatatgaaaattattccttcatatgtgatccattttcacccccctaattcacacccgaaagtgcaaaggtaaagagaaaaaaaaagagtcaagccagacttgcatcagggccagttgacttgggatgtgttcggcaggatacgttggaaactaatcctttcgaaaaaaaagaaacagatcattagcgaatgatttattaagtattaacttaaaaacttaaagaatagactatatgatttttgtaaacaactttttaatagatttttttttgcaaaaaaatacattatttagtagttcgggaaatatacgtgtgaaaaatgagaggtagaagttggaaaagagaagagaagaatatacttaacctagaaagtttccacacgagcatactctaaaattgccagtttcagactattttgagtcatcagtcgggttgggcatgcctgtgaaggtcttatggcagctgtagtatcgattcggcgagtttgttccaccgaagttaaggccccgtttagttccctaatttttttttcaaaaacatcacatcgaatatttgaacacatgcataaacattaaatatagataaatgaaaaaactaattgcacagttagggagaaattcatgagacgaatcttttgagtctaattagtccatgattagccataagtgctacagtaacccacaagtgctaataacggattaattaggctcaaaaaattcgtttcgcggttttcaggcgagttatgaaattagttttttattcgtgtccaaaagccccttttgatatccggtcaaacatccgatgtcacatccaaaaattttcttttcgtgaactaaacaggccctaaataaatttggaaattgttgtacgtacaactttttcttacgatcttagtacgataacggcgcgagcacatgacgagcacacggcacatgcgcacgcggcagtcaagagcactcatgggctaggacagaaacgtttcatcgtataaacatcgtacaaaaaaatcgtacgtatagcagcggtgaatcaattttttgttagatccccgaaacgtcagaatcgattttacgagacccacccaaaaaatatcccaatcacatctttcccctcatcctgcatatctaaaagaatttattcgatgtgttcaacttctctttgattgaaactattcggttctcacagtgtataaggtttgtttttttttcattgtacgtaatggattctaggttcacctataacaagggtttcacttatcgcacgataatcacggtgattgcgcttatcacggggaaatcggcgatatagtttaggtgaattttgaccaaattcaaaattccggaaaaaaatcaaaaaaattgaaaaaaaaatcattgatgtagttcttgatttgtaattgacaatagtgaagaatatttttgaaatagtgtaaggtaaattcaaatttgagggcaaaagcgaaaatagtttacaaattggaaaagggaagagaatattaggccttaagtatccaacatattcttccaattattctcaatttatagttttctacacatattcaaccgtattttttattttgttttccctatttattttacattaaatgatttcagctacacagcccatgataatcgtgcaaatattgcggttatcgtgataaaccatgcgattatcgcggtgaaaccgcaaaaccgccaagttttgaattcgaatttttggatgtgatttttgtgcgattttaggcggtaagctcggcccaaatgataaggtaaaccctgcctataactgatgttaagacggacggtcccaacttcggtgttgtaacatcccggcctagggcttaataggattaatagaatacttatataaacaagttgcaacttcttttctggaagccgatctctaaagaactccgaggttaaagcgtgcttgacctggagcaatttagggatgggtgaccgatctggaaattcttcccgagtgcgcacgagtgaggataaagtgtgcagaaaagacttgtgttggtctataagggcagtctatgacctatgaaagctgccagatataagcgggcccaacctgggagaggtaggacgttacaggtgtcctgtacaatttgcagcacatactacacgccgtgaccgtgctagtatgccatgcttgggcacaccatcgcattgcacatagtcgattgaattgtactactagtatagcactacgtttctttgtcacagccacaccaacaagccgctattactccattccaaaatataagaatatggaccaacagtcttttcaaattcgtaatactataaaatatcatgtctggttcaagattcttatactctatccctaaataagtactagtaggagtacatcttgtataggatgtgtaaatgtcgtagtaatacagatttgaatagtttttctccgttacgaatctggacagtaggagtagtatgtgtttggctgtgtttagatccaaacttctaacttttttcatcacatcaacatgtcatacacacataattttttagtcacatcatatcaatttcaacaaaactttcaactttggaagaaactaaacacagcctttgtttttttaccagggtgtaatagaagagtagagtacgtgcaccgtaggagtactctatttagagtacgtgggcacgtcgggcatccgtacgcagggagtagattgagcggaacagagacaaggagtgcaggagggaggagacgagacacgcgacacagggcggcaacaaagatccagggcgtggggagccgtgcatgcgtgcgaagtgcatgcgcaggtgtcagtcgggagtccagggcagggcaggccggccggtggtcaaatcgcacgtcatcatgtagcagtacactcctctgagctctgctaccactagccctgtccggactccggagtagggtagctcgtcgccttcgcgtctcgtctcgtggactctgctattcctggccgtcgcatgcatgaacccaccggctggcctcgcgtcgtcggagacgatatgaatcatatcgcaacctctgctactcctactcctactccacccgaagcgacgaccaccaatacggcgctctgaatccactcgtcggcgcgtcgcaccacgactcctgcatgctcgcctgcctgcctgcctgcctgcagcgctagcctgtgtgtgtttatatccttcgttttgtaccggtccggctacccatgcacgctaggccaagtgtgcgtgcatgtgatcctctttgccaaaatgcatccagtgagatgatggtcgcacatgtcgacccgggcgaggcggtgtcacctcgatggatgtccagccctcccagtgtcaccggaaccgagggttgagggatgccacttccatcactactgtaatcaattacgattaagagcagatacagtgacagactattagctaactataaacatattttaataagataaaagatgagagagaagagaaacggtatacagatttatagccagctgcagcagcacggattccaagacacattatgtgtatgatatgtgtgaccatatattaatagtatagtaagcaactatattgtatgaattaactattacaatggctatagataaattagaggtagtagtggactatactattaaacttgctctaataagcttgagctaattcctaccaatcctgacaccataagcttgcatttgctagtaatattcatatccatatttcatactccactgttactactatgcagtactttctccgtcctaaaatgtaagtacttttaaggttggcacggctattaaaaaagtaggtgataatgattgaaaaagatgtgtgattggttgaaaagagaaagtaggtgaaaaagaatggttgtgattggttgagaggagaaggtgggtagaaaaatagctttattttggaataaagtactgtgctagaaatagctacattttaggacggaggtagtattccaattcatcactgcgtgtgtgtttgtgtgttcatcatccacacggacactgcgacacgcagcaaagctgcaaagcagagccaatgagccatggcaatgccactgtgacgcagccattggagaaccggatcgaactagtattgacctaccagcagtatactccctccatactcataaaaaaatcgtttttgacagcgacacggtctccaaaacacaattttgacatcttgtttctataaaaaaatttattgaaaagtgatatgtatacttttattaaagtatttttcaagataaatctattcatataatttttacattttcaaacctaacaatttaaatcaataacttaaaagttattcatgatttatatttctaaggtttaaattaaacattattctagacgactcctctactaacactgagggagtactgtactactatgacgagtgtactgtgtaccccagtcaagtccttccaggagagatcgagtgcctttctcagctatcaaatcagaacctaatcattgccgaaaagaaagataggcgttgaaaagctagagccagagaaaaaaaagaaagacaaaagtatgacctttcatatcaccactcagctccgattcattcaccacctgctacatgctactcctactactcctaccagtatactccagtagtgtgtgctcacatgcaatgggcttgtgtgcagcacatctggctagttttacagtttttcaaatcctttaaaatccctaagaaataagcttaagagtactaagaaataagcttagtagtatatgtagattttaaaagaaagttaacagaagctttagaatctttaaattttgttttttttaatctctctctcattcgattcgtatgatctactcctatataaacaaccgtatttgtagtatttgatatttggattggtgccaattacaagccaaatcccatattgtagtgaggaaatttctagaaactgtgccaaatttaacatggatataaccaactaattggcttcaagccaaactatcgcatttactatttaaactaccaaaagattggtatgggcacgttttgacatcaatccaaacaatttttatatttctacctttttatcaatcctgagtttcagaaaaactcttactgataattagattgaaccctttctgataattagcgatctaattagttacttcatccatttccaaacgcaagcgattgatttgcaggttgttttgtactagtactatcgtaatgtatatttgtgtacagatttgaatcctaagaaagagtaattgaaaacagagggagcagtattattaaccattacctagttcttcatggctcatgctggattctgctgtgtccataaaccggatggtccatgactgaagtaacttaactacgagtatccaatctggtttacatggagatcttccatgcattggacctactgcagtaaaagggacaatccctgcgtatactgctggagacatcgttacaattcattcaattctatacccaggatatggggggtgtggtgattgccgactttttttcactgcgaggtggactagaaaataggaagaacagccaattgaatggttcgatccaatagccagttgaatgtttcgatcggccggcgagtgtgctgtaacagtgaaaaatcggaatctcgtcgagtgatccatccgttgggtttgtacggtgagcacagttccgttaagcagttaccgagtccccattcgccatgtgctgtaaagtggttgaagtttgaggctcccaacttcccatcagttgccttcactccttcagcatagtataagccataaccgtttattattgataaaaaataatttaggaataaaactttgcatatgtggtgttaacggcttaagaatcaaaagttcttaaaaaaaacaatggcacgtctaataaggattaacatgataaactgtgtaccaaccaaacaacccctcgtctctataaccgaaagaaaaaaaaagaaaaattaattagagtagcaggtttgacagagtcatgcccaaccaaacggtttcagccacatctacaaaaagagagtggagtgaattagactgttttgataaaatgaatcaaagaggtgtagttgctattaggttactcacaactgtactctagaaccaactcttcgaactaaaatttacttcatccgtttcataatgtaagtcattctagcatttcccacattcatattaatgctaatgaatctagacatatatgggtctgttcggttcagctggactgtggctgcacagctacagcgctgcagctctcctagcataatcttgcttgttgagtaatgtagctgcagcgccgctgctgtcacagccagctcttctgaacgcaccctatatctatctagattcattaacatcaatatgaatatggaaaatattagaatgacttacatcgtaaaaaggtggaagtaagagctacagctctagctacatgtacatcaccagtacccctgagctggaactgggaggaacaaactacggcaagtggcagcagcggcaagtacccaacccagttcaaaacacacgacatgccaaacagttgtaagcagctagcgatcgatcgatccaggatgagtgcaagcctccaaacgagcgcaggcaaagggcacagtgcagcatcggaattcttccgctccccggggaggcaaacgcatgcaggcacgcccccctcatgcctctacagcctccccggtcggtcgtcgtcgacctcgcccggtcacatgcatgcatggcaacctcgagtcggtccaaggccatggtggattggtggtggtcggctatggtggtctcgtcccatgagtgactagctcgcttgctgtgacgagacgtatagggcttgtttgaagaagtttctagctgctgtaacttttctaagaatcagaagcactcttaaatggtacggcttttggtttgaattctaaaaaattatagcattagaatccagaaaataaattagaagctagaaaatgaacttctcttacaattataagctcccctaaacagttttttggttcagattttaaaaaattgtagatgtaaaatttaaaaaataaactaaaagtcagaaactggaaacccaacttttctagattcttaaaagcttactagcaaccatctgcctctcagtaaactccccaaatagggtatagcatactgctggcctctaccattcaaatcctggctggtcaatgccgtttaatccgttacctttccggacttgttttttaaaaaaaaacaacgggatttgatttgctggccttgaattgataggggaatgtacatccaagtgcactgttaaatcagaggggaaagaagtgggattttttttttttgtaatctcccctccagctagctcaacgtacactttgcctgtcacttgtcagtaacaagctcggagacgacggcaatggcggagcacacgatcgccattgccatcgatcaaacatgatcgatcgctactatgtcgcatagaaacagagactaagaagaagaagaagaactagttcttgtagtcctcttccttcttgcaatggcgaacgctgttcagatcaccacctcctctgcaagaagaggtcgcggtccctctcggcggccggctccgacgagcggtcgaagcggctgagcacggcggtcttgaagttgaacgcctcctggacacggttgcacgagcgctgcatgcccacgccgctcaggctcgccctcgcctccagggtcacctcgctcagcggcaccctcttccgcgcgccgccgccggtgccgccggcgacgcccggctccggccgctgcttcggcgcgctctgggaccgcaccttcgcctccgacgattgcgtgctcgacatgtagccgcggcagttgggcgacgcgccgtagccgccgccgccgcagacgctcttcgtcggcgtcaccggcatgtgcgcaagccgcggcgtgctctgcgccgtcgccggcctgggcttctcgagcgggcaccagtcgtactccgggaagtggcgtgcgctcggcgccgatatccgcggcggcgcgccggggagctggtggaacgggaggagcggcgacgacaccgagttggcgtaccactcctcggcggcgccggcgtcgaccacgggagggctcgtcctgaccgacgacgacctcgacttgggccgcccggtgtccatctccacgatcttggggctccggtcgtacccgtacgacgacgactcgatgctcgccgacaggcggcggctgtacgccgccacgccatgctcgctcctcgtgtcgtccatataccgctcttgctgcaaacacaagaaacccccgaggtaagaattgtgtcacagcaaccaacatgcctcggacgaacacctttaaaaaaaaagctcgcccgcttcgcacgcaagcgatcgtggtcgtactcgtaccagggaatagcgcggccggacgggagggtggtggtggaggtgcagcggcggcagcgcggcgccgcgcgacgagcgcgcggcgcggacggcggcctgcgcgcggacgagcgcctgcatgctctgcagcgtcgccgccgcctgccgcctcaccaggtagccgcgcaccagcgcctgcagcttcaccagcgccttgagcgctcgcagcgccttcttcgcctgaaccaagaacaaaaataaaaatctaatcatgtcttaatctatgagctttttttggaaaaggaaatctactggaacagtggatgaaatcgaaatgagcacgtcgccaaagaagacgaacagatcaagaacagaagcagacactgttgttcttggaagaagtgaggaagttgttggggctcactcaccaagaatcctcggaaggctgtctggatcttgaccgcggcggcgcggccacggggatccaagacgccgccgcagacgaacaccgacgaggtgggtggcccctggctggtgaggcggacgacctcgacggccgcctgtgccgccgccacggccgcgtccgccgcagccgcggtcgccgcggcgaccgcgatggcgtgcttgctctgctccctctcggtgtcgctgtacatcgacttgagccacgccgcctcggccgccttcgcgatcgccgcattccctcccaccgccgccgccgcctccccctccgtcgagtccctcgacgacttggcgaagctccaccgcttcctgtccggcgggggcggcgccgcggccgtcctcccatgttctctcccctgctccttcttcccgccgccgccgccccacaggctgcggaaccacctcgccgccttgcccatggccggaattcgcgactccggccggcgagagagacacgccgcgctccaagaccaggtcgaacacttgagcaagaaggcgaaacgggtcaagtttgaataagagagggaaacgcccgggagggaggagcggggttcaaataaaaagaaggggagggggggtccaatacaagacaaaaaattttaaaaaataaaggggaaaaaaaactatccctaggaaagaatcaaatcaaaccaaatgcgaccaaaccaaatcgaaatacgaaatcataaatgatggcaataaacaaatggcggtgcagctagcatccaagtgtgtgagagcatgagagaacaaccaaagttgtagtagctcaccattcaaaaaaagaggctgtttcaaaaagataggagtacggtagggggggagtatatccactcccacgtcccgtggctgcactgtgaaagctgcaaacccataatctcaacgtctcttcgtgatttgtgttggcttgcgagatgtgaggtcacttgccatcattaacgatgtaaaaaaaacagttatctatacactcatttgtataaatctacgtgtccagattcattatactataatgtatcccgttctagtatgaggatagttttttttttaaggacggatgaagtactcctcctgttgaaaaaaataatttctatagataaaatctaaatataggataaattgttttttttacatagagagtattccctcggttctatatggtgggttttctacacagcggtatatactacaatgaattcgaatagagagtgtgtttcaaattcgtcgctctacacaatacgttttatcatagaagactctttgttgcaccgaaaataccatcagaggggttatcgcagctgtgggtaagcactaagcagcatggagagcactagtctactactacctggcacgtgatgggagcgctgcaaaaaagacggtgaaaaatacaaacacctttggcctctttccacgacggcgcgcacccaaacttgccatccctacacctccaaaacctccaacgatcatgtcgattaacgtatatgcatgcacgcgtacgtacgtacgtacgcacagtgcagccttcgtacacatacacacatcgtgtacgtacgtaagtacgtacgtacgcagtagtttctttttactagcactagcagctgtacttttctttttttctttttgggccattggagcgtgtgggcttttgtaccctggcgccactctcgtgagctgcactttgacttgtagcagcagttgtagtatgccggtgcaaagcagagaaaaggatcttttgggcgatgacgtcatcgggatcgagccacagaagggctcacaggacgagtgggtccttgggaatatcgaattattgatccatcgagccatcgatcgatcgatctggcgcatcaccgctactatgataaaagattccaaatcgtcgtccactgtagggtagtactcctatatcagatttgagtttggttttgggctaaatttaatttcatcctcacgaagtagtgagcttaattcaatcgattagatttcttacgataaaaccagcttatccgggtttaaattctggatttgacacatatgcttgtatttaggactaattatttttatcaggatacgtgatgtattcgtcgataacgaggtgtccgtgatgcgttcgtcaatcttaatatatatcgtcctaatttttcggatacgtttataagggtagtgtgtccatatgttagtacgtagcgtctgcattcgtaccgtatttctaaaagaaaaattttggttttgttgtagttttatttttgtttaaaaggatacgcgaatgcaaattactgtacctgtagtagtagtacgtgcgtgtcctcgcgggtcgcacgtgcaggatcaggtagggcgtgatgtgtgcgcaatgtgtcaaaaacatgttactactactgctgctggtgcctggtggcgaaactgttgctgtgcgtgggtgatttgaacgaacatgacgatgcagtgcagctgggtgagaggcgcgtaccacgtacaggagtttttttttttttatgtaccaccacgatctttgtgacctcgcgtcgtggtactatctcacgcagtaaatgaccctgttcgtttcaatttttttgcagggtcaactcgccccagtgtgatctttgctgacctggcccctgctgactctgaggtgtactagtaaaaggaaagaggccgtgtttagttgttttggcaaaaaaatttaatgcatacgggcacacatttgaagtattaaacataataacaaaataaattatagattccacctgtaaactgcgagacgaatctattaaatctaattaatctgtcattagtaaatgtttactgtagcatcacattattaaatcatggcgtaattaggctaaaaagatttgtgtcgcaatttacatataaactgtgtaattggttttttcgttcacatttaatgtttcatacatgtgtccaaacatttaatgtgatgaaaaagttaaaaatttgaagggaactcaacacagcctcctacagaagtgaaagcctcatccgttttcacagggtttgactcgggccgcgatcgcatcgaaaccataaatatgaattttaacagcagaccgtgatgaaacgaaacggattggcacgaaatttaacagctgccattgaccggccaggtttttttggaaatatccaagtgaaaacttgtgatatttctgagacgcagaagctgtaaataaatgtgtacggcggcaaccggcaggtgcacatttgctggctggatctttggggggcacggcacgcatggtgtggactgtcacacgaatatttttttaaaaaaattctttgggattagttggcgtttttcgggtgtcacgttgcgatgcaagtatgatgtgggggaatcaatgggtttttttgaaacgagaaacaaagaagggcggatggaatcagaggcatcatggaaatttgaacctacgacacaacgcccctcgatttttaaccaaaacagcaaaatttcaattcaattcctatacgagatggagaggtgaattgatcgcggtaataaaaagtttgcacggttttctcgctcgccgccacacggtctacgagaaagggaaactgcaggtaaaatccgcggtggccggcggcgcggcgacctaggtgccagcgccgccgctggatcggcccagccatcaacgtgggccgtgagcccccctcgtcgacggcccatctaaggcccgcaccgcgaaaagcccaacgcacggcgaaggcgacggcggtggcgaccggcgaccccgactccggccaacttctccattcacctccatgccaatgtgacgcgagtaaatccatccaatccaatccaatccacgatccaatttggttgctggattctcttctgttcttggatagatatccatccgatccgaccatggacaatgtttcctccccctgttgctacgcagtgtgcagttaccgaaaagctaaggaacagaacaagaagagcacgacgcttatccctttccgctgccgccgtatcgatcggtagatggatcaaaaccgccactgaaagggatcaactaaactactgatgaaaaaaagttgagtgctttagacaaaaacacaaaactttcacgtgcctccctccaatcccagattatttttctatagatcgatcgatcgagccccgtgaatgcgattctgcgcgcatttccggagcgtcttttgatcgtggttgggtttgtctgaaccgaactccaaaggtctcgcctttcttgctctgaagcttttctttagcttttcgattcgcctgtcggggaccgggatcatggcggcggtggaggcggagaaggtggtggcggagctgcgggagaggtgcgcgacgccggcgtcgctgctgcgggatgtggcggcggcgatggccggcgagatgggcgccggcctggagaaggagggtgggagcagggtcaagatgctgctctcctacgtcgacaagctccccactgggtcagtcagtatacctgcatatgcatcgcctcctctgaattctgaatttctgatttgtgttcatagcgtcagaaacaagagtgacagtagatacatctctgaaaatgatgggtttacactgatcagttttgtgccacgaattcaggagagaggatggattgttctatggattggacctaggaggaacaaacttccgggtgctcaaggttcatcttggtggcagcaagaagcatgtcgtcaactctgaatccagggaagtcagcatcccaccacacctgatgtcagggacctcctcggtgggtttttgtacgctgaatcatcatcatttgaccgagttttgctccattttgatgttgttccactgttgtgcatttttttatttgacgatattcgttgttttactatatgtctgcaggaattgtttggtttcattgctggggaattaggcaagtttgttgctgaagaggaggagggtactgacatgccaaacggcaagaagaaagagctaggattcaccttctcttttcctgtgaggcaacgatctgtggcatcgggtacccttgtcaagtggacaaaggcgttttccattgatgatgcagtaaggcgtccttcataaactcaacatgcatcgcatacattttttgtggtgatgtaaaaaatagtcctaattagtaactacagctctgcaaaacccattatttatatgaacatcttgcgatatgaacgttgttctagtcacaagccttgtcattaatacttgctagctcttactagtagatcagtttcacgcaaacaaaatatccatttttaagctgatatgagtgaatcttctatcagataaaacatttctctgaaatcaggtaggtgaagatgtggtggctgaactacaaacggctatggtgaaacaaggtctggacatgcatgtagctgcattggtgagtattgactggcttttacctttcataaacataatatatctacaatgtcaggtaaacatttttagtctgagagaacttttttgatgaaatagattaatgatgctgttggaacattggctggagcaagatactacgatgaagatgttgtcgcaggtgtgatatttggtactggcacaaatgctgcatatgttgagaaggcaaatgctataccaaaatgggaaggggagttgcccaattcaggggatatggtaagggacaaaggccatactcccaccttccattgaaatttaagcaataaattaactcacataagtttattttactcaacttttttgttgtatctttattcaatttctaagttttttttaagtgcgtttatcgtatttcaggtcatcaatatggaatggggtaatttctattcatcgcatcttccagttactgaatacgatgaagcattagacaaggaaagcttaaaccctggagagcaggcaagtttcttcagcaaaagaccacctaccctgcatgcctgtactgttggatcttgggtcttggctcaaccatatagttttgttttctttttcagatatatgagaagttaacatcaggaatgtatttaggtgaaatcgtaagaagagtgctgcttaaactgtccttgcagtctggaattttcggttctatagataactccaagctcaaaacttgtttccatctgcggtatgtcatttccttttgttttcacaattagcgctcttatgcaattcaggattgagtaggttgctttcaaatgcagcccatatgatatgaatgctcataagactgttttataaagtgtagaaaattctataacagattcaaggctgaccctaaaatatccgttaatgtggcgaacaggactccgcacatttctgcaatgcaccatgatgaaacacctgacctaaagatagtggctgaaaaattgcatcaaatcctagaggtatccatgcttctgaaaaagctcatattctgcatgtgtattctctgtagtgacatggtatgtatgcctgcagattacacatacatccttagagataaggaaaatggttgtcgaaatatgcgatatcgtggcaaggagggcagctcggctggctgctgctggtgttgcagggatcctcatgaagcttggaagaaatggcggcatcaacaatcagcgctcggtcatcgccattgatggaggtttgttcgaacactacaccaaattcagggaatgtttggagagcacgttgggtgagttgctgggagaggaggcttccaagtcggtagccgtcaagcacgcgaacgacgggtcagggataggggctgcccttattgcagcctctcaatctcgatgaaaatttgctagataaatagtagtatatgccgtccatttttgctctggagtgaaaaaaattattgaaaaaacctagctttgttgtatgtgctgcttgggcatggtggaactggaagcagtctgtaaccaaaatgaggcttgatatactgtcgccctgcatagttgtaacctgaaataaaattggaactgcaaaaccttcattgttacctataattatcccttttggggatttttttttaatattccgaattggctgtaaagatgtgtgtgtgcaatgaattatattatgcgctacttccatgaattaaattctgcagtagtaaggataaccaatcaaatctagccatttataactgtttgagaatgtataaaatttacaatctgtgtaatacggagtataatattctgctctaaaactcagcaagtaacaacaaaggaaggaaaatgtgatcccatcattatttgttcaggtgaatgttcccctaaaaacattttgctagcatccctgtctctgaaaccatcgtgtaaaaccagcagcggtgactcttccgttaaatccccaacgttaatctcggtccttaggtttcaattagatgtgcactttcaataacaacatgctacaacaaggaaagtttttaccctgaaagttgaaacgtcaagaatgattctcgatcatactccagtactccccctgtcccaaaaaaatctatctagtattggataaaacttttatctagcatgtccagattccttgtactaggttatatcctatctattctatattggttttttttttggacggaggagtatgtacaagtactgtttatagtatttttgttagtaagccctataagctaggtatacatgttaagactggattaacaatgatgataacgcaacaagaattatgccatgatatgaaaatatatctcgaatgaacaagaagaaattcccatgttaacacctccactaaactgtctttacatcttaagttgtacttactgttagtagatgtggagatgatttcattcaatcaggcgaaattgtgcctacgtgtgccgtgttacgaccgttggatggcgcgcggagagtgcggcaggatgcggcgtgtctcggagccccaagtttgagaatcattcgaacttttggtttgaaagctccaatgtttacctttaagttgtgttttttttttggcaaaattttcacgcgagggattgtgtgtggaagctacgccgaaatccacttcgattttgagttgaaactagccgaatctaaaagtgagcccacttttgagttgccgaggtggatagcaatactagagcccatgatgacaacttgatcgagatgaaacgccgacacgatcgatggagctcacatttttgcagacatgcatggcaccataattaacttaaacgcattaactagatcgcttaattaacaaaacacataactaatttgacacatgcctgcctacatccaaaattacaccaccaaaggcgccatagattagcttaatcacccagctactagtaattaacaacactgttccatgctactcgatcgtactactaatcatgaccactaataccgtcatgatctctcgtaagtatacatataattatgcagcccaaagacatcaaaatggccataaagccaagcaccacagatcaaaatcctctgcagttaaagtcatgtgacgttatcattaacatataggcccgataatccctaggtccacctgtcaatgacaaaggaccgtgtatttgactgcagagggatctcaatccaagcaccacaccatgatcaattcatcatcatcggcagcagcagctgaaattgacagtgattagttcagctgtcagctgctgccctcttcctgctccctgccgccctcatcagctgcaaattcagaacgaatcaggagtaaattcattttgattgatcatggtggttggtgggtggtaggctcaccgacggcggcggcaggtcggagctcttgagcacgcgcagcctcttcgcggtggcgatgaacatcctgcagcggatcgatcgatgagacgagaaattcatttgggatggaagctagctacggatgtgtaattttgtccaacttactgccagggaacgtcgccgacgagcatccggtcgccctcgtcgtcctcgtagacgagcgtgtactcgccgccgccgaccatctctccggcggcggccgcgtcggcctcgccgtcagcggcagcgctctgagctgcacgagcaatagcatagcatcgtgttcgcatgaggtcacagcaaagagcaaaccgcaccacgcggcgggcggcgcaaggtaaagctgagctcaccggctaggaggccgcggaagagcttgtcgacggcggcggagagctgggcgtagccgccgtacgccgcgaggtcgaccttcctcccgatcgggacgccgtccatgttgatcttcacgaacatgcccttctccgcgccgccgtctttgctcgccttgtcgccgttctgcggcgacgacgacggcggcggcggcgcctgcttggacgacgatgacgacgacgaggcgaggttccgccggaacgaccgcaccggcggccaccccacaaccggcgccgccgccgctgccccgctacatgcattttcacacataaattaagcatcaaaattgaattaattagcttctttccacctccatttctgtcgaacaaatgaacaaaccttggcttggaggcattggttccattggatcggagagcaaaagcaggagcagcggttgatccctccgatggcttggaggaggaggaggagganaagtaggcggggaggccaaggcagagctcgaggccgctctcccccgccgccgccgcgtcctcctcctcccggccgaaccctctcctccacgccatcgatggcgacgacgacgacctcgatcagctactgacaactgtactcctgatgaaaacaagtcacgagctcttcctcctcactgcgtccgtgcagcagcagcagcaggagggagtaatatatagccaaagatcaacgacgacgacgacgagctgcaagaaggagaggagacagagcaggtggtgacggcgcgagggacgaggaggagcagagagcgaccaaaaggcggcaaggatttgcggggaaaagggacaaggtttgcgcgccacgaggccgtcaggtactattcaaagcagccaaggccaaggccaagccaagctgcaaggattcagagaaacaaagcgagcaagaatcactactccctactagtcctaggccaagctgtgacaggtcacaggagaggaggatgcagcagcagcagcagcagcgagagaaagggaaggaaagctaggagatggatgcgagggagcatctagctcatgcgcaggaagcaaagctgaagcaggtaggagtagtaggagctagcttgagcttagctaagccaatgcaagcaagcaacggctgctactaccattatctcgctgttctatctctcgatcgctgcgtgcgaagctcgcaagggcaggagtgagtgtgttgcgagtgctctggttgggctttataaatcggaggggggatgtggcgccaccacaagccttttcttttcgtgtatgatcatctcctgcattaaagattccttgtggggagcactgcgtaattttgtgcaaacatatcttcctatccaattctgatgcggctaaactgtacttctaactactccagtccagctttaggctatgtttgagcaagtttaatagtatagcccactattggctccaatttatctatagtcaattcatacaatagttgcttattatactattaaatatatggtcccacctgtcatacacacattgtgtcttagagtccgtgctgcagctagctacagatctataacccgccgctcttctctctcatcttttatcttattaaaatatgtttacagttggctaatagtctactattgtacctgctcttattaggtgagctaaacaactgcacatcaaaaggtgttcaaaattttaatcactagtataaatttaaaaaataagtttatttatttataacaaatttagcagttcaagaaacacgatcattaaaaaagaaaaatgttagataaaaatgctcaaacaaacgaacccttaatctgaacttagaaaaactaataagcattctagtgtaggagttgttactagacaaaaacgagggagttggtagacaaaaatgtttgctcaattttatcgctgcctaggctgtgtttagatccaaagtttggatccaaacttcagtccttttccatcatatcaacctgtcatacacacacaatttttcagtcacatcatctcaaatttcaactaaaatccaaactttgcgctgaactaaacacagccctaactagaaacctggtgaatctttggtggatttgcactgtacagcatcagaaacacagagcaaaggtgattggtggcttatcccaagagacacagggagagacagtggcaatgtctacaatggctgtgtctagttgagcgcgaagtttggattttagttgaaattggagatgatgtgactgaaaagttgtgtgtatgacaggttaatgtaatagaaaaggactgaagtttggatccaaactttagatataaacacagccaataatgcaaagctgtagtggccggtgggtcatgtttgattagtagaagaggcatgtgttaaagtgacaggaatgccggtgttggacatagagggtgagaggatcagataagataagctcaggctgctcagcttgtggttattactatacaccatctccttttctttgataattgattctcctaccacattatacttatctcaagatgatgataatatttcctttttttccccctgcaatctcaaggagtcgaggttcattgtatcactgcatgcataaatctgaaaacaattttaggagtattgtgtttcctagaaagttaatgagctgtaattgatcaagctattttagttacagctgggctctttaactggttaagctcttttaatcacagtcagtgtcgtcagtttgttgattgcacagaatattggcaaaaacgattggtcccccctcttgtagaattaacgcacattccttccagataggcaggtactaccaacactgcaacagcacatgtcaaaactgttaaaaggccaaaaaaaaaaaaaagtaaagcaagtagccgatgagaaagtcatactccggtgagaaaactccgaaggcagcgtttggctaatgggttggggaaatcatttcccattcaccaaaagacatctttaaatcctaaccattcattctcctctttcatttaatcctaacccttcattcattttccaatcacaatccaaccctccatttcccattatccaaacacaccgaaaagggtttaggaagatctcgccgatggattattgctgggagtggtacaccggttattcaggtatattatttctcggtataatcgacgagaaccaatgaaacacggacaacctttgcaaaagaaaaaaaaaactgctcggagtactttattcgttttttggttttaactggtttactgagcggtttcttggctcaaagatggttgattagcaccatataaccaaagcgca

SEQ ID NO: 62516 - DNA, 2699 bp, Oryza sativa
  unsure (1)..(2699): unsure at all n locations
tcctgcgnccccaaaacgttcttcatgtaatgagtcaagaaagacaaacatttcatctttcagatgaacaatgaaaacaaaccagtggcgcttgtagaaaattggaaagaagagctgaaataattaaataaaacaaattataaatgtaaaaggaaatatgaaattaaatatgacaagtaatttacaaattcacaaaccatttcacatgattgaataggtctagcttttgatgcaccatcaaagcatttcctaactgatgagaaatcagttcttgatggatgctttagaagatcatcctatagcacaagtgtattcaataatttaaatattaaacatatagtaaaaattggttttcaattataaatataataaaacaaaaaataagaaacttactccaatagaagagaagaaataatgttttttggattttgaggggtgagataaatgaaacaaatatcggcagaacacagagacaacaaaattagaaacttcatgtccaaaattaaatgatcctccaaaagaactgaatttgcagtgaacaccatcaatttcaactgcatgtcgtctacattcagaatacaaataaattcaaattacaaatcatacattgaaaatgaagattatcagaaaaaaaaagtacaaaatagtacttactcttgatatctgcttgttgatagagtgcagacagcattataaatttgtctttcatattgtgagactgtgaagtttgatctttgaggagtataaggatctgtgcaatactttgtgggattgattacccttctaagatcatgatgaattggttttgttccagaagtacttggattgaaattcttcatgttgcataacaaaactctttctggactagcaaaggttttgaagttttgtttctgagaatccaacagaattctattcattttattgtacatcatgttggttttgtttccaatatcagcacatttcttagagaatttcttttcaccaataaaaacatcaggtgaatcctgaaatttaacaaataaattaaatagtacagttagaagcatattaaaaaaagaagatcaaaataactagaaataaaaaataataattattagcttataaccagaacagaaaaatgataaataaaagtaaggtacagggcatgaaatatttgaaatatcaatatgaaataacagttcagtaaataaactaatgatgttcaacagcaaacttacaaacttgagattataaactgaataaaaagaaatgaataagcagtgagaagaaaaaccttttggaataaaaattgaaagaatgtatgttattaactagaactgaaatacattgtaacctacaagaattacagcaaaactatggagaacaagaatgcaaaaatggaataagaaaaaattttaaacaccatttaatttcaaaaagggaacatcaatgaaaataaactacgagattattcatacctttatgatgtgacaaactttttcattttctttgttttcattgagagaagcattaggagaagttgaattttcaagtgtcaccatgtacatcttatcctaaaatttcaaaatttaacaaatgaaagtttagtttgtatatacagaagaaataaagaaagaaattaatgtcagaattaccggactgtctgaacagattattgggctttcaacagcagcagcaaaagtttgagacaactttcttggagtgatctgcaagatttgtataaatcaatataatgttctaaaaaagtattccttatgaaatttgaagttacttcacaagtaccttatttcttaaaacaggatttggggagtatgaatcaggaataacttgatatgaatctacaagatgagcaggtgtaatttcttttttgaaatcatcattttcatgatggaggtcatcatcagaatcctagattttaaaagacggttgatcatgaaaaacttgattgtttcgagctacagcaataacataagaattagaaacaaaaaatatggcaacaaaaagtaagaggaccatagtacagtgcactaaaatcacatgacaaaagaaatgaaatattacaataactcaatttttttgatgctagaacaattaaagatatacaagtaaaaacaaatgagattccgttaaaaaaaatttaccagtcaaggcagaatttttctctgtttcatctggtggattaataggaacatgaccttcaatgttaaataggcacaaacatcaataattcatatttaattttttaaaaaaacagattaacaaatttagaaaaaaaaataacctgttttgttcatctttgtcattatttcatcaatgttgatatgtttaatctgcacagataaaaaatgacagttaaaaactatcaacaattacagttctatatattcagattataatgattgaaataaaaatgaaaaaaaaacctcttctgaagaattcaaaatggtagacttattcacaggattaaattcttcatttggaattggcaacttatcatcatctagtactattttactgtttccctacaaaaaaataaaaggacaaaaaaatgcttaatgattcacatgactattagaataaaaaaaattgaaatgagaacagaaaccaatgtacctttggagatgagcgtgaaattgttatttttttgcacagcttgattaacatcatcattattttcttcaactggttcatgaactggt

SEQ ID NO: 62517 - DNA, 17111 bp, Oryza sativa
tgccatcctttgttatcctgtgcacttgcatatttgctgcgtggcttgctgagtatgtcatatactcaccttgcaatcattcatcagaggaagagttctacagtgaagctgatggtgtggaggattaggtgtagccctggtcaagctgcctgtggagtggagtcgtctgcgccgtttatcttattttttccgctgcttagatctttattgattgagaggaactatctacctctataatgacattttattcgcttattaattagagtaataattgtactctattatcaatttgttattgtgtgcctcggctgattcctggacgagggttcacacacatgtaagcgtttggaattttggatagaaattccgggcgtgacaagttggtatcagagctccttgaccctaggttatgccaaatggttacccatagaagccctctaaaaatattggaaaagtagaactgttctcctccccttctcttttaattaaaccaaactaatggcacatgcatttcctaatattttttttagtggttctcgttcaaaatttattctagcgttattagtactgtacatctattactgtactaatggctcattttaccaacaaaagttttacaatattgtttagtttaatcttgctgcaatgaaataaatttagcatgttgattttataactttcttttatttcttttgaaaccggttgttcaaaagtacaaaatttgtgaccttgtttccaactgtttcaacttatcctgcaagtttggcttaccttttactttgattttctaactttattcaaattaatccaaaaacttgtgctattaattggataaatgtcttaactccctcctttcacttgtctttagatgccgcgctacaagcctgagtacttgtttggtgttgagggatttgtccaggagttgcgtacgatgtcctttgccataggatttgggactgcccctttctatgcccaaattcctcatgatcgtcacgaagagaagtgccgagtcaaagtcaccttgaacagtaatagtgaagatattccctcagtgatgttcgaagccggaggaagaaactacatccatacatgtcaggaggtggcaaggatcgccataggagagctccttgatcgctacagtgatcagttggccgacactgagtatcgctaccatcctcgccaaccacagggaagtgaccgtggcagctaccttgagactgagggaattgagaatgatgctaccacaaggcatttggttgagatgctgtgggctatggatgaaacccgtgcggagactgtgttagcagcccaagatcgtgaagaccggaatcgtggtaagatttgcaagcttgaggacaaagtggatcgtttggagaaggaactagccgcattgaagggagaagcaccaccgcagaaggccaggattcgtcttaccgcaaggaagagagctctatttgtccctcgctaccaattggtgccaaaggtccgtgtggtggagaaagaagttaccccagccctagcggatcctccggtcgtcaatgtaagtgatgatgaaggagatgaatcaaagcgcacccattccaagattgagtggggagcaactcaagatgatgaagacgagccgaacgagccttcaatcaactccgatgcccggaagacctagaatgccttgtcaaaccgttgtcttagatcgttgtgttagtttgcttgtttaagtttggttgtgtgtgtctcgcatgtgatttacatcagtggtgggatgtaagtgcgtgcgtttgtttgctttcgagtgttaggtagttggtaagtttagtggtgtgagagtcttcagttttgtaataatgaaactcacttaagatcaataaaagttaaattaattctcggtcctaagtagttttccccggtttctcttcttatgctcctgcccatgccagatggtgctcactcgcagcaatgggaatggccccaacaacaacaataacaacaacaacaacaatggagagaatcccacacttgcctaagtcctggctcaacagacacaacttatgaacatgatgatgcagcaactccagaaccagcagaaccagggaaataaccatgcacctccccagaacaagttagcagaatttcttcgtgtgaggccgcctattttctctagtaccactaatcctgttgaagctggtgattggttgcacgccatagaaaagaagttggatttgcttcagtgcactgatcaggagaaggtctcatttgcatcacaccagctgcatggccctgcctctgaatggtgggatcactcccgccttaataggattactgctgaacctatcacttggcttgagttcaccgctgctttccggaagacgcatataccatcgggagtggtgtctctcaagaagaaggaattcaggtcgctcacccagggatctcgctctgttaccgagtatctgcacgagttcaatcgtctggctcgttatgctctggaagatgtacgcactgatgaagagcgccaggagaagttcttggaaggacttaatgatgagctttcttatccactcatgactggggattatcctgatttccagaagttagtagataaggctattcgccaggaggacaagtacaatcgcatggaacagaagaaacgccggattgctcaattcaagacacaacaggggaataatcagaggccgcgtcttactttaggaccccagtccatgccacagggaggttcttcgtctgttgttcgtccgcagcgtcagttcttcaacaacaatgctggcaacaacatccgcaatcaagctccacgccctgttgcagctccaacacagcaacagcctgccaagagggagcaaggcagcaagcccgtagtgtgtttcaactgtggagacccaggacattatgctgacaagtgtccgaagccccgacgcgtgaaggctgtccctgcccagagcaactctaccgcaccagcgccaaaggcccgtgtcaatcatgttgctgctacagaagctcaaggtgctccagatgtgattttgggtacgttccttgttaacttagtccctgcaacagtgctttttgattctggtgctacacattcattcttatctatgagttttgcgggaaatcatgtgatggaagtagaagatcttagacgtcctttgatggttaataccccaagtaatcaagcactctctttgcaacgtagcccctctgtcagaatagaaattctcagatcattatttctggccaatcttatcctgttagaatccaaagaccttgatgtcatcctagggatggactggttagccagatataagggtgtgatagactgtgctaacaggaaagtaactctcaccagtgatgatggtcgagttgtaacaattcatgcattgtcttctgagtctttaaggtcaagactgaaccaaataactttggaagagattcctatagtccgggagtatcctgatgtgttcccagacgatttacctggtatgcctcctaaaagagatatagagttcagaatagatttggtaccaggaacaactccgatccataagagaccttatagaatggcagccaatgagttggcagaagtcaaaaggcaagtagacgatttgcttcagaaaggatacatcagaccgagttcatctccatggggagctccagtaatttttgtggaaaagaaagaccatacccagaggatgtgtgtggactatcgtgcactaaatgatatgactatcaagaataagtatccgctgcccagaattgatgatttattcgatcagcttaaaggtgccaccgttttctccaagatagatcttcgatcagggtatcatcagttgagaatcaaagaggaagatatacctaagacagcttttaccactaggtatggattgtttgaatgtactgttatgtcttttggacttaccaatgcccccgctttcttcatgaacttgatgaataaggtgtttatggaatacctagacaagttcgtggtggtctttattgatgacattcttatctactcccgaaccaaagaagagcatatagaacatcttcgccttgcactagaaaagctacgagaacatcaactgtatgctaagtttagtaagtgtgaattttggttgtctgaagtgaagttccttggtcacgtcatctcagcaggaggagttgccgtcgatcctagtaatgtggaatccgtaaccaactggaaacaaccaaagacagtttcagagattcgcagtttcctaggcctcgcgggatattatcggaggtttatagaaaatttttccaagattgctaagcccatgacacgattgcttcagaaagatgtgaagtacaagtggtcagaagaatgtgagcagagttttcaagagttgaagaatcgcttaatatcagctcctattttgattttacctgatccaaagaagggtttccaagtgtattgcgatgcatccaaactggggttaggttgtgttctgatgcaagatgggaaggtggttgcctatgcatctcgtcagttacgtccgcatgagaagaactaccctactcatgatcttgaattagctgcagtagttcatgcgttgaaaatttggcatcattatcttttcggtactcgtacagaggtgtataccgatcacaagagtttaaagtatatctttactcagccggatttgaacatgagacaacggagatggttggaattaattaaggattatgacatgggaattcattatcacccgggaaaggctaatgttgtagcagacgctcttagcagaaaggatgacagttaccattggaattatgcgaggaatttgaaagattaaatttgggaattgtcagtagaggtttcgttgcagccttagaagcgaagcccactctaattgatcaagttagagaagcccaaattaatgatcctgatattcaagaaattaagaagaatatgagaagaggaaaagctatcggtttcttggaagatgagcaaggaactgtatggttgggtgagagaatctgcgtccccgacaacaaagatttaaaagatgcaattctgaaagaagcccatgatactttatactccattcaccctggtagtaccaaaatataccaggatctcaaggaaagattttggtgggcaagtatgaagcgtgaaattgcagaatacgtagcagtatgtgatgtttgtcagcgaatcaaggcagaacatcagaaacccgccggtttgttgcagcctttgaagattcctgaatggaaatgggaggaaatcggtatggatttcatcactggtttacccagaacgtcatcaggtcatgactctatttgggtgatagtcgacagacttaccaaagtggctcatttcatcccagtaaagacaacatattctggaagtcggttggcggaattgtatatggcaaggattgtgtgtttgcatggcgtccctaagaaaatagtgtctgatcaaggcagtcagtttacttcaaaattttggaagaagcttcaggaagagatgggttctaagctgaactttagtactgcttatcatccgcagacagacggacaaaccgaaagggtgaatcagattttggaagatatgttgagagcttgtgctttagacttcggtggaagttgggataagaatctaccttatgcggaattttcgtacaacaacagttatcaagctagtcttcagatggctccttacgaagcactgtatggtcggaagtgccgcactccgcttttgtgggatcaaacgggagaacgtcaggttttcgggacggatatcttgagggaagcagaagaaaaggtgaaaatcattcaagaaagattgcgtgtggcccagtctcgccataagagttatgccgacaatcgtcggagagatctaagttttgacgcaggagattatgtgtaccttcatgtcacgcctcttcgaggggttcatcgttttcataccaaaggaaaattggcaccgcgttttgtgggaccttataagattgtcagtagaagaggagaggttgcttatcagttggaattacctcaatttggcaggcgtccataatgtgttccatgtgtcgcaattgaaaaagtgtttaagggtacctaccgaagaagctaatcttgaacagatagaagtccaagaggatctgacctatgttgagaaaccaatccgtatcttggaaatagatgagagaagaaccaggaatcgagttatccgtttttgtaaagtccagtggagtaatcactcggaagaagaatcaacttgggaacgagaagatgaattgaagtcagctcatccgcatctgttcgccagttcttccgaatctcgaggacgagattctgtttaaggggggtaggtttgtcacatcctaaaaattcaaaatatataaattgttgtttaaatggaattttttagaaatgattttaaaaatctttgaagagaagatctaattttaattaataaattccaacataaaatggggccagataaaatttcattaaatactttgcttaattctataattcctagatttttctgggatttatttgagctaaggaagtatttttaataaatggaattgcatttcatgaataatttaaattgaaaaaggttttaaaaagtcttcttttggctttgggccgaaagtcggcccaaatcctctctctctctctcctcggcccaagccggcccagtccgcagccgcgcgcgcgccctcgctgtagctgacaggtgggtcccgcctgtcggagtcgtcgtcttcgtcgcgccgccgccgcccgaaaccctagcgccgcgccgccgccgtttccttccaaattcggccgatcctttcctttcccggtgaaatcaattgaggggaaatgtttcccgagatctcctctaccttttctcttttggaatcatcggctaaatcggcttggaaagtgttttattcgaggtcgaatcggatcggtctctttcctccgaaccccgaagtttccatagcgtcgccggtcatcgtgggccttcgccgccgcctcctagcccctttaaaaggacccccggagtcgccgctacccgtcgccaccctcgccttcgcctctcgttgccgatagagccctagccccgtgtagcctcgcgccgccgttgtcgccgccgctccagccgtgctccgccgtcgctccagtcgtcgccgtcgctcggggaggtcgccatcgtggtcgccgtcgcgtcgccgtcctcgtccgccccttcgccgtcgctgaagaccgccggagcatcgtcgccgtcgtcaagccgaaggtcgacgccgcttcttcctcgacgccgtcgccgtccgttgatcttccgccgccgttttggtcgctggtgagttcgccgcgtcgccctctacgtcctggtgccctccgttcgcgccgccgcgccatcgttcgccggcgagcttgtgctcccgagccgccgcaggtggtgacgtcaccgctgacgtcatcgtcgtcgtctctcgtggtccggccgtggatcggtcgatctcggccgtccgttttggataagatcgatctcggccgtccgttcccgtgaaccgtcgccgtgcgcccggtccaccgcgaaaccctagccgctgacgcaataaatccctttttccttttcaaaaataattcattattgcgtcataattcaattaaaatccatataagtgttttaatccgatttaatcttcaaaaattcataactaattcatcttagctcggatttagttggttcaagtctctaaatttttctaaatttgagatctacatgttaaaaatatccacatgtactgttcatgcttgtttttgtgctgttttggtgattttgctcttttctgcttagattccgtcgtttccggagagtccgttttcgcaggagaagagtttgaagagttccaaggtcagcaaggcaagtcacacagatcccaaacaaccctttgagcatgttgatcccgtttaaagctatcgtttctattcaactattgcatttattttcgaatgtcattgggtggaattaacctattgtttgttatagccctttttgttcttgattactttattccttgataccttgggttgttataacttgactagttgggctatatatatattggttcaactagatgtattagatataattgcttagccctgcttagaaacattagcacactattgggataacttaagatttactattatttaatgatggcttaatgatagttcacgatggtcaatcgtgattggttaattaattaatgtgccaactaaaacctgataatggtgggttgtgagcacatggttttgatggtcgtgctcatgacaattaaggaccggttcacgagtttcggttgtgaaacattaaccgtgccaaccacaagccagcatgggcaacggctttaccttttgtatagcatggttcattgcggagcaccagactgagaagtgacggagataagcccacgggggtcgctggggagtccatgccttgtttataagggggtgattatgatccaggaaaggtgcgctgtagtggattgtgttgtgcaaggggtattgtcacagctcctttccgaggtaccgtggtggtattgaggcacatggtgacatgatgtggggctgtgtcttgtgggtacattggtacacctctgatcagagtaaaactattcgaatagccgtgcccgcggttatgggcgggtctaacaatgtctttcgtgattagtctcacacctctcatcataataaaagatgctataactggtaataatttgattagctcctggtttggaatggtatattcctagtttggagatagaactgtgcagctgggatggttgttcagaatggttgggcctatacaacagggtatgttgtatagcgttggattaatattgtttaattattacttaactgttttattaaattctcaaatgtttgctaaatgctgcttttgcaaaatgaaaccctattatgccatcctttgttatcctgtgcacttgcatatttgctgcgtggcttgctgagtatgtcatatactcaccttgcaatcattcatcagaggaagagttctacagtgaagctgatggtgtggaggattaggtgtagccctggtcaagctgcctgtggagtggagtcgtctgcgccgtttatcttattttttccgctgcttagatctttattgattgagaggaactatctacctctgtaatgacattttattcgcttattaattagagtaataattgtactctattatcaatttgttattgtgtgcctcggctgattcctggacgagagttcacacacatgtaagcgtttggaattttggatagaaattccgggcgtgacagtaacgttcagatgtaatagacaaggcaaaccaacttctcaatccaaaccagtaagcgcagaggaaacagtggtttcggaaagaaatacaaatgaaaatgatgcaacagattgcaagtgtgctctggttatttcagagaggaatgagatttggaatatttcaagggtacaattagaccacaatcatcaactaagtccaagagatgaagtgagatttctcaaatcacacaaacacatgactacagaagaaaaaatgctcataaggaccttgaaggaatgtaatataccaacaaggcacatgattgtgattttatctgttctaagaggaggattgacttctttgccttatacgaagaaagatataagcaatgtgagaaccacaattaacaaggagacaagcagcaatgatatgatgaaaactttagaatttttcagaaggaaaaaagaaaaagatccacatttcttttatgagtttgatttggatgagagcaagaaagtgaaaaatctgttttggacagacgggagatcgagggagtggtatgagaaatatggtgatgttgtgagttttgacacaacatatttcaccaacagatacaacctcccgtttgctccctttgttggaatttctggacatggaaacacaattgtttttggttgtgcatttttgcatgatgagacttcagaaacatttaaatggctgttcagaacttttttgaaagctatgtcacaaaaagaaccaaaaacaatcattactgatcaggatggagcaatgagatcagcaattgctcaagtatttcaaaatgcaaagcacataaattgcttctttcatattgtaaagaaagctttcaatctatttggaaatttgttcaaagcaaaagaagggttgtatgatgagtatgaagacatcataaataactcagttacagaagaagaatttgagtatttatggcaagaaatgattgacagctttgaagttcagcatatcaattttctaaagcacatgtggtcaattagaaaaagatttattccagtgtatttcaagggtgatttctgtccatttataaaaagcacagctctcagtgaagggactaactcaaggtttaagaataatgttggtccacagtacagcattacaaacttcatgatagagtatgaaagagtaatggatacaattcaaaacttggaacagtttgatgatcacatttcaaggacaaagaaaccaagcaaactttggtcccattactacattgagtaccaagcaatgagaatgtataatcgcaaaatcttcatcaagtttcaagttgagttgaaaagaacaactagatttcaaataaatgaagtagagaagttcaaaacttatgaagttttttttggcattgaatcaaaatattcaagtaatcagaagaaggaagtaccttgttattgtggacttggaaaaggaggatttcaactgcatttgctcaaagtttgagaaagatggacttctatgctgccatgtattgaaagtaatgctccacctcaatgcaatgaagataccagaaaaatatattattgaaagatggacaaaaaaagagtacaaaggtcttgggggaaaaggcaatggaaatatacctttagcacagagctcaatcctgagattcaacattttgtcaaggaaaagtgcagaaatagcatcaaatggatcgaaaagcaatgaaactttccagtttgcagtggaagagatggacaaaattgctaaacaattggaattaatgtgttcaaataaagatgctgagcaggagatcaatgattcagatccaaatgcagaagacaatttgaactcacatgaaaaaggcaatcaacaatctgaggaaaatacagaagaaatattgttggatccagatattgcaaaatccaaaggcaggccagctcaaagatataagacaatcagggaagaaatacagcaaaaagaactatatcattgcagtcattgtcagaggacagatcacacatttccaacgtgccctctgaaacacgttgagtttgacttgccaaggaagaagagaagaaaggttaaaaatacaagagaacaggtaacaaaaattacaaatccatatgaattgaatttttttaaaaaagtaataaagaaagatattatttgttgcaggatggtgtagagcagaaaaagaaagatgtttcaaacaaaagaaaagatttgcaacaagatatatcacaggagaagcataattctggggctgaattagaaggcaaaaagaagagaaattcatcttcatcaaaaaggggtggcacaaaagaatagaaatggaaatgactgaaaatagagagaggtttacttgaatacaatggaaatagacatattccataagtttctgtaatattccagaacatgtactctggtgtcacaccccaatctgataccgccgtacaacggcacctgacaggagcgtgtcgtagggaaaacggcgtgaaccgtttcctacgaaaccgcgatctcggtaccagtcccaggacatagtgctggtacccacggtgacaaatatgaatcatagcaatccttaaaataaatagaggacttatttaccttaacttaggttgcagctcagaacaatccgagaatgcaaccgacgacacggacgaggaaacaccaacaacagcagcagcagcggaaccaacgaactaacacccaacaccacaggcgacggctgggaaccaggacgaaaccctaatcttctcttcactttatcttctcttcagggcggaggaactatatatatatatatttatatagagcaagggtgagtactttcgtactcagcaagtcacgggaacttaggtgtttgatgcaagcttggaggagaggcaaggttgttttacaaatcttttatttgaaggcattttgaaatcactaagtgatttatttctttctaagtttgggccgaagagagacttgcgtctcgattcgactttaagagatgcttttcaacaactcaattggtaatgtaccgacctcccgggtcagatcattacttctcggctcccagagccattccacttgattaatcggctcccagagcctttttcattttctcggactcccagagtccagctgcccagcagcacaacaatccgcttccactcgggaagcctagtctatgatgcccacagacatcccgaatcacacagattcgtttctgaccactcaggtcatccatctgccacataggctgattctggttacgattcccacaccacaacaacttttcacaaagcacaggcaaacaaatctacgcaacgggaaccacctcacatccgcccatgaccatgggcacggctgttcgaacagttagttaacctctgcagaggggtacactttacccacaagacacgaacttactccagacactggccggtgtcagaggttcgcgacaaagcctttcccaagccgacccagggatacctcatgccacatagaaggatcaaatcctcacataatcataggccattttaggcgttcacaaatcaaactccaaccacctcgatcggtaattcagcaagcttctcgttcttgcattaccaggaacccggtttggctccaaccgtcgaccccgccccggcgttcccaactattggcatgcgaggtttccctgaaccgactagttacttagccagggtgtcccattccaccttgtggttgcactttgattatgttcgatgagtttcccacaggaatcggtccttatatgcgaatacgggacagtgccacataggcacaacccccgcatcgcgagttttcacaattcatttttattttcaaacacaccgacaccacatgtcgggttttgaaggcttcacaaacccatttcccaagttttcgacaaacaacggtgtatgtgggatatttggtatacgcgctcagagagcacgaataccgaggtaccacaagggtggagcgacaaggaaacagggtagtacaacctacggaaattagtgcgattactgggtaggtccgtcggtttggcacgcaaaccgaggccaagcaagttaagtgtgtgattctaataatgcaagttgcaaacaaaataataatgacttttcaattataggggcaattgatcaaagggtgacttgccttgctcaaggtcttcacgaagcttcacgaatcttcgagaaaacccgcgatcgacgaaaatccgataaccgcaactatacgcaaacaactgaaaacctaaacaaaagaccaaaagaaagaccctatttagactaattagtagtgccattaaatagatctcaattttatgggaatattggaagttgaacggagtcaatcagagttgcgaattgggtgatatgaattttggaagtttaattggagtttctggaataggagaaatggtttatggaatttatagaaataatattctcaaaaatattattgatagtcactgtcacgcgggaccaaaggaaatggtttgtggaattttgggaataaggaattgatttatgggacaaaggaaggaaaaaaaaaggatttattaaatccctgaaaaagaaaagggtggagggatgtaatttagacttctttgggaggctcgggtacggcccaagggataagcacggcgcggccgagccattgggccgggcgcgggcgcgaggaggcggcccaacagagggggcgcgggggagagagagacggcccggtggaccgattccaccgcgcggggtcccgggtggggcccgcttgtcggtggcacggcccacggtgggatgggcgcacgcgaggtgcggcgcacgggtttcgggtgcgcatggcttaggagcggtgcaccggttggacggatggcggcgggcccacatgcagccgcacggctttccgtggaccgcgcgcacgggagggaagacggagggaggggacggctgaccggcttggcccggtcaaagccgaggtggcgccgacttggcgcctacgtggcagccacgcgggccggcgggaggaggaagaaggggaggccgagatggacggcggacggcggccgtgttcaccggagcaagcgcgacggatttggtcttcggggagcacaccggagtgacgagggcgtcgagaaggagcgagccaacggctcggattcgccggagggagttcgacggtggtggaattcgacagtggcggccggtggcgagagaaaggggaaatcaccgaggggcgacgaggactcaattaaaggcggcggaagcatctccggtgttcaaggaactcatttccggggtcggatgggtctgagcggcgccgtggaggtccggcgacgagaggcggcctccgggggtgggcggcaatggcggtggggccacgccgggtggcggcggtccttggggcggcgtctacgcgcgttcggcagggctaccgagctaccacgcaagctagcggggacgagggagagcgaggaaggggaacgggaggaggcactaccgagccgggcgggcagtgatgggcggtcgacggcgcggggcgagctctccggccttgggccggggaaggggaagaagaagggtggccggagtcctcttcggctcctcgcgcacacgccggcttcaccagcacgcgcgacggcgaagggaggcgaggtcggcagctgcaaggcggcaacaaaggcacggcggcggtggaagagagatgccgagagagaatgagatagggaggctcggcccgggctttatagatggaaaagaggcggtttgggagggggaaccgacattggcggtcaaggagagcgagctggcggtcatcgacgcgtgcagccaaggcggcgacaggtgatgacgccggcggtgtcgggcaaaaggaaaaaggtgggggaacagggagctctgctggtgttcacgggcggcagcggcggtttcgtgggcagtgcgaaggcggcgacggtgtggatgcgttgggcggcgaaggcggtggatcgagcgtcggaaaatcgaaccgcgggagcgggaggattagcgcgggctggcgcggtcaaggtgggggtggcgagccggcgctggcgtctgcgtctctgcctccgagcgctagcggccaaggagtggaggcatggcgtcgttgcttgggagggaaaaagagaagggaggacggtggaaagggggggctttaccatgccggtttgggaaaaaggaggtgggagagggagaggagagcgcgtgaggcagagagacgcgctgcctccacgtcttggacgcacgcgcgcacagggtgggggcgagcggcagggcggcatgggcggccgtgcggcgcaggcggccagggctgatgcggcggcgaccgggcggtctgccacgcgcgggcgagcgcgggaaagagcgaaggcggtggcggtttttgggcggcgacggcgggaatcggcgccaggaggggagagagcagagagagagcgaagacgggagagagaaagaatcgagagagcgagagagctctctctcggctcgcatgcgtgcaacgcacgtgcgagggggggtaagatgatgggctgggaggggagatgggctgggggagggaaatcggtccatccaaaaatacagggaggtaaagtagacttttacagagaaaactgatttggacagaattggagagattttagggtttggactcaaattcaaatttgatattcgaactcgagggtttagggatgtatcaagggggattcaaggagaagtcatggaaaggattcaaaaggaatacttgggtatttgttttcgggaacatagggtggagtcaaggaaaggattcgaggcgggatctgaatagttctggattcgtagaagtatttggcgaggatttagaggaaggatttgaatttcagaacttgatttcagagactcgaatcggaagagaaatttgaggtggaggattttgatttcgatgagagggatcaacgggatttgaaatgagatcttggcacgacttagactcgcacacaaagaacgaaaattttcgaaattaggattttgctgaattagttttttaacgcctcacgaaaagcggagcgttacatctggtttgtacttaaatgtttgtttcttatatcaactacattttatgaactactttgcattttatctaccacatgagtttatgtacagttgtagccctgcaaaagttgccaactgtcatatttgaacaaacaaaatttattccagaatcaatttccctacaaataaaaagagatataaaaatataaggactaaataaaaaacaaaattgtgaaaaaaataatgattctaaaaaaaatttacctgagcaaagtcaatcactagtttctttgttcctgtaccgagaacagaattgtctggatggaagaaaagacggttgacatattgaatcctaatgttttgaatgtctttttgagagaaatggtttgtcagctgaactcttgcaccccatagttccatgtattttagagtaaaaactccacaatcaaaactaggaaaaagaaaaaggacataagtaaccacagttacttatcataaaatataaaaaaaacaaaaaaaattaaaaaaagctaatgcagttatggtcatactatttactctataaatttactaatgaaatctattgcagttctagtccatgttgtactaagaaacaggctcttatcccatctagtaattctgaatgaaacaattgacaaacaggaactaaattttttgaatgataatcataacaaacaaactaaaattgtgcattaacagcaaaacaaacaggttatgcaacaattagaaaa

SEQ ID NO: 62518 - DNA, 33462 bp, Oryza sativa
  unsure (1)..(33462): unsure at all n locations
acttgagtgtccaaagaattatattatgcactatagatacttccttcttgctactaaattcagcggggtcgaattttaacttatcaaaatctgttcccatgtgagaagccttcatactagcagatactggcttgacaatatcatttgaagtgtcaagtacttcacgggcagaatttgtttgaaatgattcaacattggcaacagaaacttcggagcaatcactgtcatctagtcgggctagttcttttatcaggcatcttagtttatcaagagcaacagcagcagcagaagggtagcacacaagaagttttagcatactgcttaacatagatctgtacatcttgaattcagaggacatataggtatgtttccttattgtttccttgtttccagtgcttattatttgattgaccagggatatattatgatttaccattgatgttacatcttatgcacgaatttgtcctccgcattttcaactgttgacaggaagttgctggtaatcccttgacacccattgtatgtcaatgatgaaccttcctgagtaatcatgttctgatgtgaccttgtttgctgaagaaaacataaggtgccagcaataactttaagagcagtaccttgcattctccaggaagagaatgcaaagaacttcagcagccagaacaagcttagatagctcacaagtattgactaaatgaacaatnggagctttgcacagactatcttgaaagtttttataatcaatcagatatantgaggaaaaagagatgtctagacagcacgaacagtaagaccttagtgttcaccttttgaagaaccataaatgcttttttcttacaatcaagtgggaaatcatcatcatcaattagctgtaataacgtcccaaaaacagtctttaaaacaggaaaatggcagatgcttccgtgaaacatgaaacataaacatttcaatgacacagtcttcatgcaatgagaagattcatgctccaggaacaataacagcaattccacctgaaatagaaaaatcgaaataaagtttacttttaagtcaattcacaaaggaaacagagagcattggtattaatgcccccagcttctcagcaagagggtaaaaatacatagctagtaattctaaaagaaatttgaatcacctgattcttgattgtcatctctaattttaaaatgtgactaaggtgtcctttagtagcatgccaatcacaggaaatgacacaaggaaatgggatgcgattaatagcatcttcagatgtttgagaaaacacgaatcaggttataaagtgccaagcattcgaaagaaagagagtatatttacttctataaacagaaaacacatgcatatgattattgcaaagtgaactaaatgatgtaacacagaacataattgcagcgatgagttagaacaaattaagtcaaatacatatgctaccaactagtggattacactacctgattgcaaaacagaacaactgatttggatgccaatcttgaaagtgacaagagcatgtcagctttgaaattatcttccaacgtgcccagaacgatctgctttccaacctgtgacatcaagagtgaaaatgcttctttaaaatgtgatgaaaacaactgcaagaaaaaaaatcagagatcccacctaagattggtgtataaagcaaaatatatcattagtcttttatgttctactactccatttcagaaaactagccagttttattggtaggtccaatttcacaagataaagtcgacagatagcatcgagactatcatcacatatttacctatttcatagacttattttttcattggatgttttcagagctttggtcttcacattaacccgtaatgcaaaaactaacttacatttgtactccctccattcctaattgatcatcatattacatgagtgcaccaagaccaagaaaatataataactctctcatgctacatttactttagcaataaacttgatgcatgcacaatccccactattttctagccaatagcaaatcaaaacacttgtgtgtatggatgcatgaatcaatgctcatttaccccaatgcacaaataacgaatagacttaatgaatgaacacaaatacgatgatcatttaggaatattttcaaaaaaattatatgatgatcaatttggaatggagggagtaataactaacaacttaggtgttcaaggactagattactattgttgtaaatcagagcaatgtgtagttttaaattttctttccttgatgattccttggagtatgtgcacatgattggtaggcatatggagtattgttaaagcaatgaatccgtaagagtgagaaagcaatgtaaatgttgggcaacttaagagtaaataaaaaaagattaaaaaacgaagttaagcaagaaacacgtatatccatgaacacctcatgaactctatggataacagccaacgtacagtcaagcttggggaaaatcttaatcgctgccatgataatttgaggttgtgatgttggtgaagaaattaatcttcgaagtgattcaagtgtaatgtatgagaaatccactgatagcctagaaaaacaggcagctgcaaacaaagccgctttgacctgccagatgataaccataataccataataattaggtgagttgagaaatcccaagccaaattagatggattattgaggttattacaacctgtagcgcattggaggaagagaaggtggagaggatgagagagcggaggtggaggctgtggtgggcgaggtgggcgaggcatccgaacatccgcagcgcgagagccctggcccgcgggcagccagcgtcgtaggcggccttgaccctcgcgagcaccgccacctgatgttggggttccgccgccacgcatgccatggtcatgggcagcgagccgtcgaggccgaggaggaggagggcgcggaggatgcgggcccggacggcgttgtcggcggtggcgaagtgggtggcgaggcggaggaggatggtgtgggcgaagaggcgcggttcggaggggaggacgcccaaggcggaggcgaccgcgggggggacggcggccggcggcgaggctccgagctcccggagacgcggggcgacggcgtcgacggcgcggaggcgcgtggctgcagggagattgattatttgagatttaaaaaaaaaagaaagtgaggtgagggtgaagcctccatggatggaggggggtttactctactcaccggggtggcgggagcggagagccctgtcgaggtcgatgctccattgcatggcggacgacgccgccggtaacttgtccatcgccgccgacgccgacgccgacgatggcggcggaaacctctttttgtggagaggcccttgtgtttgtcttgttttacgggttcctctccttttctctagtggccgataggggtggaaacagtaccgaaatttccgggatttccggctgttttcggtttgaatcgaccgttttaatcggtatcgataattattggagttgtaaatgaaaataataacatatttcgaaaatagtagcagaaataggatagagatttttctaattatttggtcagtaaccgtatttgtataataatttccgttaaaatttagagaaaattccgaaagttccctggcggcccggccagcccaacccattgaaaaccaatgaataaagaaagcctagcaggcttgcagcccatcagggagggaaaatgataaggggaaaacgttgttaaccctagcacgtagcatgtggacttttctgaactttggtctttttcaacttatcgatattgaaaaattgttgaactttgtttatattgtttgtcgaacttattgttatatcattaatcatcatatattcatataatggtattacgtggagtgttatggtgcaagaataaaattatgaagtccccttcatgtatagttaaatatgtgattatgccacacccccattgtatccgacgtgaattttttactttcaaccagcatcggttaccgatccaactgtccagcttccaatatagcaatatcatcgatatgctatcgctttcgggtctaccatttcgattccgtttttgagaaaaaaaatagaaatgaaaatttcagaccgttttcatccataatcggaggagatggggcatccccacccttacgcgccggcggagcttcacctaccgggcttcgtgcctctgcaactgtctgccctaccttgccacctccatcttcgtcctcctcgccgtctggctcatctccggtacgctgtttattccccttcttccctcctcattctgcaaccgtccccaaatccaatttctctctggaattcagagtatatctttgatttgcttcggagtaccaagaccggcttgccgatttcccatctgctttggggcagatagctttcgagtgggatgtggtggatgtgtggatatttctggtgtctgcgtctgcttttggatggttggtcggttggtccggtccccgtttgtggttgtggccgggatgcgtcgtgaacgcgtggcggcgtctcatgccaggaaccgggcgaaatgcgtagcgtcacggtgccctgaggcgtcgagatctgagtaggaatctggttttcttttggatcaataatttcctgttgcactactgagcttgtggtgtgcgagagagtaaacgccaaggatggcatgttgcaactggctagtatatactccatgtaatgtaaatacttgcattggacagcgatttcagggtcaattcaagtagaattgacacttattttgggggattagatcagtagctgtcatagttatttcaatgatgtcctgcagatcgtagtgatcttgcgaaggtctcgttgcttcgaaggatgaggatgttcaacttcgattagttggatatctctttctgttttcctgtcttgatgaatgctgttctaaaccatggtacgttggcattggggccctggtatgttctgtttctggaagtttgaagaggtcgaacagggcagggctttgctgttggagagaagactgtagagatatgctgcccattacaatgggagctaaaactatgttcttattgcactctttataatcgatcaaagaatgaaacactggtggtacacatggagattgcttccataacgttacaacaggtgatttatatagacagatacaatgccttgcagcagcaacggccaacggcgacaatggcaacacaacatagcagtatcccctactgcattggtaggttttattactgcaaaatttgacctccgcggcgttaccggtagctgcggtatacgggggtgtacatgcagctctctgcgtatttctccagatccctgggttgaggcagccgggtcgccagtcctgcacagaacgattggccgtgtcagaggccacggttttttggcacaggacctggatggtcgtggaaagtgtgactagagtaaacgacataccaagttcataggcttttgcagccacgcttgcggcaatgcgagcagaaatctttctgatgtttgtgaagggcgggaagatcgatcccttctcaaagttctcctgagtggcctgatcagctagtgtttccgctgtttacgagaatggaattagttctggtgtagtactgcggtacgcgtcataactgtttcggatttgagcaaacattcgactgagtacttacaggcagctagaagcatatcctcgtgaacacggacagctccagagattacgacaccgaggccgaatccagggaaaatgtaggcattgttcgactgttgtgaatagcgaatcaattagtaacagtcaatttctattttggctttgctgtctcttggaataagtatttaagcaaggaagcagtacctggcctggcacatgtatctttccattgtactccacagggtcaaacggactgccgctggcaaatactgcacgaccctgcaaggatacggatggatcatcatgagttatgcattatcacgttttacaaaatcatttttttgtgctaaatatgcatagcacgatgtctctttagtaaaagttggtagtcaaatggcataggatttaaaacagtgagttcataatgccagatgctcaacaagtacagatttgcagctcacctggctccaattatatgcttcttcagcagtacactcagagtgtgatgtggggtttgacagagagaaaatgacgggtcgctgcattttgggatttccaatatcagaagttagccaatcatctggtaaataccacaaagttacaacttgacgacaaagatgtccaactaacctcgttaaaggaagccatggcctcaataacttctttagtaaaagttttgccaactccggatgttccaatcagcacagtaggtttgatggactacagaaagaataggtaaacattaaccattaggatacaagaaaacaagcataaacagcacaagtttcggcaaaaccatcagctaataattgaataaatcttggatgtgcatcagatgaatacctggacagcatctaacagtgtcgttacaggttcatgctcatgtgcccaaggctttttaaatgcctggagggattcttttcgtgagttaacgatcaacccctacaaaatagcacaaattgtatggtgttaaaactgttggatgcagaggtgaaatgttgcattaacagcattctattccttttggttctatacctttgaatccagcagccaaaccttcttgcggcactcctcaattggagcctttgtctgaaaaccaattgagaccagcaaagttataagccgtaagtaccataatgaattattataacagtacagcagttagattgtgaaacactatattacctgttttgaaatctcaagagcaatgagttctgcaataccagttccagcctgcatgcaaatgcatcatgttatgtgtttcagggattacgtcatgtttcaacagttgagcaaagattacaataagccgataagagaaatcttgaccaacctcaccagcaccaaggaacaaataagtgtgttcagccagggttccaccaaccacctttagtgatgataaaagacctgcaaggaccacagatgctgttccctgcaatccatacattttggtttaatttagagggcaacaaacagaacagtggaaatttattctataagaatatattgtggtgaaactaaaaatatcatggctcaaacaacacaagtggttcatttacctggatatcatcattgaaaacaagatgactcttgctgtattttgcaagcaaatcaaatgcgttgtgattggcgaagtcctcaaactggcacaaggaagattcagtttcattagcccttatattatgtctattatgaaaacaatgaaaagatcaaataataaaaatatattttactatgaggctggggcagacctgtatcagaactttctcaccatagatttgcttaacggcactcataaattcttccatgagctcatggtactcctgccatcaaggacaagacaaggttcagatcttaagttgtcaatttatacaacaccttcattactccaagcaaaccctttttggtggtaccttgccagtagcacgcctttgccggagcccaatgtagaattcatcattcaacaattgctcattgtttgtaccaacatcaatcgtgataggtaaacactacaaagtaaaagtgcaatttgcaaattcagatgatttggctgttttacagttttctggtagaaacagccgaaaccataatgtaatggatatgaatgcttacagctgacgggcgaactcctccaagggcagtgtacagagaaagtttaccaacaggaatacccattccctgtaggaaagatcattgcaacaacaataagtaaagtttctgaagtaagcaactaatcagacaatcatacctgacaacccaaatctccaagccccaaaatgcgctcaccatcagtaacaacaataacttgaatgtttctctctggccagttccttagcacatcaagaacctttcccctagaatgcacttccagtcagtccaaatcgaataggtagagagaataaaatcaacacactattcttggatattcaagcaaagctaggcaaacatacttgtccttcaagctgacatagagaccctgtggttgtctaaatatgctcccatacttctggcaggcctcacctactgttggtgtatacaccacagggagaagctcctccacattatcaatcaaaagcttgtagaagagcctctcgttcctctcctgataaacacaaaggtattattatcatatcttcaacatgctgttcctccacattgcccaatgcccagtcatttttgttaaattgtaaatcattcaagaagtcatcaggtaaaaaagattaatttggattacctggagatccatcatggccatgtaacgctgcaaaggtacactgtactggcgaagattatgcatgatcttcttcacctgcacaaaacattaaggagggcttaaaataaacgccacagagtgataaacaggttatagttgcttattgatgtagctcgtacttgaagatcctgagacacaactgccggaggaagaaggccacgtaagtaatgagcatcccgctccttctcactaaaggcaaggcccttgttgtgatgtggatccctcaaaagggtgtaaccactgttgcacaagatcaattacatcagcaactccatttcagcatggtgaacgaaataaatcagttctcagtgcacaaaattatggccacttattcgtatgaaaaaaaaactgccaggccaacattctatagtagcacgattctccttatgagtgcctaaattggtgttttgcagtacttgctgtaagttactgttctcagctgtattttacgatctaggtgataattattgttatataactcagcacatgtgtgttaaatttataattaatttccagctaaatttcattgtcaagggatggcggagaaaacaaagacagacaatattggcatggcatgggccagattagaatataccccacccacaggagtgcaggaaatataaaaagctactagtagaagaaaacaatcaaatctttttttctcagctacccgggacctactcaaaatccatccaacattaacccagttcagattactccagcagtataaattatcaaaaaaaaaaaacaccaacagtaatattctgcgaatttttttttttgaaaccgatattctgcgaataaaatgaatatactgtaaaaaaaataagaaccgtataatccgctgacttgaggcaagaaagaagaaaacaaatttgagctgaactgattgtaatatgtttcttcgtgaggagaaggctgcggtaaattacgcaaacaaacaaatgaaagggacagattcagctttggcaactgccacacgacaaagaaatcgactggatcaacacaaattcgagatttagcacgattcgagcaaacaagcaacaaaacaaaccgagctgcgagaaggcgacgcatcctcacttctaggcacgtcaaaattccaaaacggattagaatatttatcacgcgggcgaaaccgtatacctaacccagatcaacgcgcaagctgagctaaatcggcaaaaaaaaatccccaaaaaagtgcttcagatcgacgcatcgtaacgtccgccgcgaccccaccaagatccagcccccccacggcgatccgatccgattcgagcaccgctcacctcgcgacggagaaggcccatggcgtgacgggcacctcctcggtagccatgtcctcaaccccgccgccggccgccgcaacctcctccttcttctcggtctccgccgcggactccatcgcgaccgcctccaccctcctcggcgccgccgcacggaccctcaccgccgcggccctcctccgcacctccctgcagctcgtgcatccgctcccgctcccgctgctgccaccctcgccgcgcttccactgcagaggcacaaaaacacaaacacgtcacgctcgttcgttcgtatccccccccccccccaccccaaaaccccccaaaaccacacaagcaaactcctcgctcgaggggagtacgtaccagcggggaggcggcggcggcggcggcggtggcggcggcgcgcgcggacagcatggcggcgaggtcggcggaggcggtggtggttggtggggcgcgtcgcgtcctcgcgtcgccgatggctggggggaagaggaagcgagcgcgtgaggggggtaatgggagggaggaggccggtataaaaaaggaagggggttgcgttgcggagggtggcgcggcacacgtgacgtggacgaggccgtcgggtcggagtgttttacggtttattttattttacacgcgggggggaggggtatatgtggtgggttgtgcgcggtgtggtgcggtgatgtttccgcacgcctcgccggaccgggccacccggtcgcatgtcgcagtcggcgacgctcgctggatccagtacgttgtatttgcgtccattataaggttttgcataagtcggctgtgggtttaacttaacctaaacttgcggctctcacgcacgaataatctatgtattttttaataaccgaataatctatgaaaaggtaaagttatcgcactattttacttttttaaaaaattacacagcacatgctcgcacactaacccctatgaacacacacgtaaaccctgcatctatgagcatctttgaagactgagccggtaaatcctgaagattgacaaagtcaccacgggcgtctcgtcctacccttgaaagcacaataccgttaaatcctggaaaattcgctcccatgaaaagtcgagcccagcaccattttacttggtgatgcacaaatagagtagtgagattcatatataagtaaaaatgattttggtttagtatatgtatgtactctacgattgtatagttgatacaatgatattctgcgatatattatctgattatggataaatggcatctttatatcttctacgttttatatctctttgtatggctgacttgtaatattatcttggtttttagttgggggtatgtgttactaggtttattttttagggacgaagagagtgcatataaatgtataatagggtttattagtcatcttgataagccaatcaccaatataaaaatccatattccacgtctatttattactatctcgcgtataccttgatagaattaatctccatactcgacaataccattgccggctatatcccgtcgacatcattttcctaattcaattttttgttttgttcaactagtagttttcttcttctctcttaaattatcttatatgtaactttttttcttcctttcagaaactttaaaggcccgaggagaaagggaacactgagcgtaataagtgaaacttacggtaagtcggtaagtcgtatttcttgtaatggaactttgaggcataagatatttaaaattttcactcgcaattaagagggaacaaataatctttgggtctgccagattaacactagttgaattcaggaaaattgcaaatggatcatcatttttttacgcaaaaaaatatatgaaataagtttttttgaacgagaatgttcagaacaacttgaaactgtcccatagtcatagcctcacaggtctgcactgccggcatagagtacatcgaacacatcagatttatttgcttgtcacttgtccttgtcatatggctcgctaatcacctgtaggcacagcacatgcctatcaataattatgagctggttggttagaatggagcaaacccaagattgtggctccaaatcaccgtgtaattaagctttggaatgttagttgaaccgtggaccatatggccatcagcgtgtgtggttgtgtggactttgggcgtcaagccagtacacgtcgaagatcgaatcgtcgtgtgtcaattcaagccacctttggttgagcactggtaatatgtggtcctgatcactactgattccatcacacagctatatatgattccatcccacagatttgggggagggggggggggcataaaaaaagaaggcacttgccttttcctatgtgaaggtcggagtaggcatgacgatgggttgtttggttagtagctaactttgccaaaccacaagacatgtaggatcatatgactaaaaagtgtggcgagccacagttgtgataatgaaccaaacgattgtctaaaaagttatggcataactatccttagacatggcaaattgaagatagcaaccaaacagtcccgtagtatgtcttatagcggacgagaggttttcaaacttccatccggcttctactagtagtagaaaataatttgaaccattgatctcatttgatcgaaggattcggatctatttataatatcaccctactagttatccgtagaaacaaggagtggcgttattatataaaaaaaggtacataggggtataatcgttatttggcagggactattttttttattcgatgaaatataagtaatgccaacgcaatggataaccacatatcgatctagaaaaaaacataaatgaacaagttatacatattcactatattagtaaattattgattactcttaataataataaatagttcagattatttctatggtaggataatacttttcttttgcggggtactggtagagtaatactaataataagagcagcagagaatcgctgaaagaaaaaaaaacagcttcgccatacatatttgacagtaagtatatgcaaatttacaaatgcgttttgcatgactacttttactgacacggcaaaaaaacataaataaatcttcacataccgctacacttttttgcatgatactactacagctacatcccagcatgttccagcatggcgttcggggcccaattaagagcgaccggacggatcggcctagaaccaaaacgagcagatctagttccagttcattcattcgagagggcgcacacgcatgtggtggcgtatcaaaagcgtggatcggatcgatgcatcgacgcgcgcatgagcgtctcgtcgatcggctcgtcgtcgctggcgtgccacggtgccagtgctgttggctatgggctcatgcatggccaggtgggaagtgcggccaagtgggagcagctagcaagcaagtggtggtggtgtgcgagagtacgagcgtaccactccagttaggccacgggaaaggaaattcgagcgggttactgtacgattaccacgtgccgtaattttctctgttttaaagcacgatatagttcgggctacctgttactcgttccgtcctaaaatataataatgtccagatttatagctaaaatttattatatttgggacagagttccgtaaaaaaaatgttccgttaaaaaaatattttaggatggagatagtaaatcgtagggtaatggtaaccccatcccaaataatttgttaaaactcgatttggagtgcatttgctaattacggttccctttggtgtgctacacgattttttattattgtgcatatgaaaaacgaggcactccattcaaaatttgcgcaagagttccgtcaaaaaaaaagaaattgcgcaagagaaaggtgggtcttctacaattttgctgctgccacgctatttgactcatgcacagtgacctcgcgttttatggacacaatatcccaccccaattaaattgcccgtggctcgtgggggtcacacgacacgaggagagagagagagaggtgtgtgtcagtgcgatgtcgcagtctcgcagaaatctcgcacaagcgtgctactcgcttgttctaaaatatataaaaagttttgagattaaacacaattattagaaaaatatataaaattaaaataaaataatattataattagttgaaaaatgaggataaatgaaaaaaagaatgatatggaactgtgattggttggaaagaaaataaagttgttatatattgaaataaattaggagtaaaagttaagctctgtttagattccaacctattttttagactcgatcatatgaaacgtttgaacatatgtagagcctttgggagtccctgtttatgagtacaagccaaggaaaggtagacgataaaggcaaaaaacctgtgatgcagtctcggctcagttctccggacaaccatgaaaggaatcacactacgaccatgggatggacccccccgccgatgggctgggttaaagcaaatgtggatggctccttcattcaatgttcggaagctgctagtgctggaattgtcattcgtgaccacactggctcagtactgctcacttcctggagaattatcagccattgtggatcagcggaagaggcggaagcgactgcatgctgggaaggggtgaatctcgcagctgagtgggtgaaaaaaccgttaattcttgagacagactgtgccaacttggtatctatgcttacgagctctggatttgatcgagcgcagctctgccatgtcctccggagtattaaatttttactccaagcttgcctgattttcgtgtgcagaagattagaagggaatgcaatagagtagcccatgatttagctaaatttgccatgcgtacgaaccattcagctgtttggcgtatgcaggctccttcttgtgtttttggggctctggcaaatgattgtaatcacattgatgagtaatcaataaagcgttcccttcccccgcaaaaaaaatgcatgaaatattaaatatatgctaaaaaataactaataatacagattgtgactaatttgcgagataaattttttaaatctaattgctccatgatctgataatatggtgttacagtaaacatttaataataatatattaattaggcttaataaatttatctcgcaatataaaagcgaaatttataatttattttattattactataaatttaatattttaaatatatgttcatatatgtgatttgatacgaaaaaacttttaaacccttatctaaagacagccttttggagtagtactctccccgcaggcggtgcgcaagcacaagcagaagcaaagcggacgcgtggcgcgaaaggggggcgcgcattcactggcgcgccgcggcgagtagccccgcaaaggggtgggcccctgcgccgaccgcttctcggtccccctcccaatcctcccccctcactcaccgcgagcccccaaaccgaaggacactgaccaatggtccccacagggaaaagtggcccacacggcagcgaccggatgaacgcgacgagaaggtacgaggcgggggcggggccgggagagaaaagtggacaggagttggggagttgaggcctcccctgggtgccgccctcgcgcctcggcctcgcccgacgcgaccggtccacacgtgatactggacttccctttctctctctccgccgttgcttcctccgctgcttcttgtttgttttgttttgtttgtagcggtggatggagatggatggtagtgctagtgcgttgcgtaggcccgtacgtgcaggaaatgggcaatactcctcctacgacgatgctagtactgcagtttcgtccgtgacgattactcgttattattcctaccgtcctacgcactcctactcccgtattagtactagtattaagactcacaatgcatggatttcacatttttcgagtttgcctcggccggcagggggcggctactgataccacatcacagccactcgatccatgcatgcaccgatcgaatcccagggaaaaccacacacacatagagatctcgatcgggcggtggcacagtacgcaacgtgctccggttttgttgggtccccgttcgtacgatctttcgcgcacgcggacgcagcgtgcgtgcaccgcaccagtccctcccactctggtttcgcattgatccgttttgatcggtcgcgcttccccgatcgctacatatgcacgctgcccagcagctctctgtaaaggctgctgctagcgttaaatacaccaaaactgcctaacaacaaattccaactactcctacatccccaaatgatttatttcttctttttttttcttctactttttatttgaggaaatatcgcatggttaacttgttactccctccgtcccataatataagtgattttgatttttttcttgcaacatttgaccactcgtcttatttaattttttttgcaaatataaaaaataaaaagttgtgcttaaagtattatagataataaagtaagtcacaaataaaataaataataatttcaaaaaattttaaataagacgagtggtcaaacgttgtaaacaaaaactcaaaatccttatattatgagacggagggagtagttccctactgcaccgtgctcggagaattctgggctccatcttttgacctaaataagccaaagtcaaattcaaaattaattttgaacttgatttgaagacattttcaacacagtttattttatgttggcttttaaaacgttaagaacatacatatagaagttttactgttttattattaggaaatgtgggtaactgatgaggctgtctgatgcaaagtggtcgctgtttcactttgtgattttacatctgctgtcgtctcttctgcactgctgacctggagtgttggtcgctgcatttgcatccgacgaacgctgcgtgtatgctactccatgtttctgcagtttcagctggatgcctggatcgctatcagagtcgagtgggtttgcatgattaattgcgagaggcacccatcgttttccccggtgcagccaaggattcccctactgagctcgctactgattcgactagatcctcttaattctcatcgcttaatgtcgccgaatccaattattgccaaaaaaagataaatcatcattgcatctgtgaaccttattggacacccataggcaaattcgatggaggagttagcaaggccaggagcaaaaatatgtaagacaagcagggatatccttttcctcgccgtcgaaagaactattgtatgagtattacaaaaaaacttaaaagaaaaaaatgcgacgaatatgtgctttggtttctggttagaggctcaacaacaatcaactgaatctttcccggtccacccaacaaaagacctgaaaggtgcctgcattaatttgtttatcttctcttttctgcagccgtgaatggacaaatggagatggaaatgaggcgtaggagtactacatgcagatgcagcttcacacgagatggaaaaattagctgctgagtgcgtgctgactggacagccatcgatttcgatatgtacacatgacgacgagaccgattctgctaaaccagtcagcgcatgtgttccaggaagcgacttttttatttttatgtgaaacgacagtgtccagcttcagtgacgcacgggtcacgcaaactatgaatctgacatcttaaaacttggcgactctgctattaattgattattacgtgaagatacacgcgattcgccgttcagttttgtacagatactgcccaatatacaaagttggtcatcactcaccagcttaatcagtcgaccaccgatagccagccagaggagaattaagtaatttaatggtgaaagatactagcagctgatctcctggtaacagttcattcaatctcatacaggccattacatcatacaataccagctactaacatgtgcagttagcacaagagaaagatcatgatcagtggatgcaaataaagtaattaaagcacacgactacacgagcttggtgttaatttatggggggcaggagaatttcgatcttgagactgctgctaagtcttaaactgcactagctgccaatggcttgagacggcagagtcaaaatctatggacggcgaggagagtttttgttggggggtttgagcacagtacagcccggacagcccatcaggcccacggtttggagaccattttgtagtgggcttcgtcacagagcatgaccgttagtaggtcctgagcatttaaaatggggacgttgattgagaactgccgttgcaaattctacctgcaggtagcacactgaaaagccgaaatcatgcactgaattcgtaggattcttttctagtcaagatacagattttatctcgattatcaatagcatgctttttaaactattaaacggtacgttctatacgaaaactttctatatatagaagttgcttttaaatatgaaatatatccatttgtcaagtttgtaacaattaaaacttaattaattatatgctaatagctttctcattttacgtgcatcaacttaacattcttaatcagtttcaaacaccacagttacgtacacgtactactccattagtggtactccagttaggctcacgtcgcttgtatgtactactcccttcatctcataatataaggtgcccacacattttaagattttacattcaaaatattttgaccaatatttagtacaatatgaattgaattttacttgctaaaaattatatcattgaaattgaattcacatttgaatttactttcatatgattataattttgttactataaaccttatagtatatgagtaagacaaacattttatggagaccgtgttaagttcgaccatgtcttatattatgggatagagggagtatgatctaatataccttatacgcttatgcagactacacgacacaatctgcgttgatcttaatatattgaagtggtggatttatgtattttagactctgctgaataaactttgccggacagtgaactgtagtcacgaatacatcagcatcggtcgccaattaacgagttggtgtcaactttttttttttctgggtgggttgggatcagcttttcgatctgatcaatctcgcttgatgagttgcttcctggtcatggcgttctccaatctcagtcaggactttaggcaaccatataaattgccacgatccatctcaaattccatcacgaaaacctcaacatgccttccaaattgaaggcactcgttaattaagcagtagtgctaggaatgatggaatcgagtgaccaatcaatagtcaattaggacctgtttggtacacctcaaacttctaagtttaactctaagagttgggtttggagtggagttgtggagctgcctaaacccagctccacaactctagttcattttgtgagagagctctacccagctccactctcattttttggtggagctgtaactgtttagctgagctccagctcttaagctgtgataatcaggcctaatggcatcacacaactgagagagcgagagagccactgtgtgctggcgcggcgcggagatcgtcgatcgatcgagatggtgttcgtcagttttgtgcacgcatgaacaagtccatctgcgatgctgcggcccactatagcatagcatacacaagttgggccgggcccatctctgttttctttgggaatacacgaggggagtcccgtacatctcgtgatcgatgttgatgaggaactgcatcaaagcatgcaaattctacatgctaacatactgacaaagtctgaaattaaagccaaaaatcataagttgcaggttcggcaattgaggcattgacgttcgattcgaacaaccatgcatataaactgcctcacatctactaatctcatctcccatcgcctcaaagctcaatgctctgatagcgttcccgtggaggcggacgccgatcgatcaaggtcaccgaggagagagaggaggagggtcggaatttaattcaccgaagcccaccagctgatgaattgctggtcatggcgttctccagatgccgctcgtcctccgcgtcggtgtactgttcagcatgttagcaagcgagaatcatgaaatgtatccgacagaattgtcagaattggaattggctctttgtttgagtagggatcggagttttgttctccgaccaacaccccagtttgcgtgggctttgtaataatggcgcccttcgatcatctctgatcgagcgggccttgcacacacccggggcacaactgtcaacactgttgctctggaagaaatagaaaacgatacgagtgaaaatagaacagacaaatccacacatttcaaatcgacaagaaacctagatgcacatgtatttctaatttcatgatgaaactaggcggtgcacgtgtcacggacctggatcatctccaatacttattttggtgtgaaggaattgtggccaaactgacctctcgttcttttttcgcaggaggttcggagtttctttttccgaacccctgccttacatattatatggacaatgtgagggtttggagttttgttttccgaccccagtttcccgtgcttcttgtgatcgattttgatggacaactgcaccatctatcatgaaaattctacatgcttgcatactgaaagtctgaaagccaaaatcatataggctcaaattgcaggttcgggccattgacattcgaacaatcccaaattatatctactatatatccacgcaaaacggtgtgggggaatgatatagcgaaattggtatacaagagacagcaatctggaatttggtaaagttggagttttaagctttggtggtggttcgtgctcttcaaaattgaaggtctgtatatgtatattttatcctccactgattaaatttttgcatgacatctaggagtggcaacggggcgggttagagatggtttgggccagaacgccaccaccgagtgtgcgcgtgttatgaacaactatgttcatactgtattttttttttaaaaaaaagtgcatgatagtgaactgtagcgacgaatacatcagcatcgatcgccaatttaccagtatactttttttgtttttttggaaatcccatcttcccattctcttcgatctcgatcgcatcatgagttgctggccatagcggtccttccaaaaaccttttgatggtttttccagacaggtaagatggcatttcgctggagatgaaggagagcccctcagacatccttctggcagtagaagagcttcctttgttggaataaccggtacaatctagtagaaccttcttcttcatgtgcaccttgatcatccacgttgtggcattggggtcagcagtgtggtagcgctcgttcaacaagaagcaaacggcgtaagggttttccatatcaacaacggggaattcaggtcggacatttggaaggcggttttcagaatcgagttcccaaagttgggcagcatccaatgttgcatcttctcgccatgtctgatcctcgtgccacgaccacagggtgatgctgaagcttctgctgctgctgccgccatgttggttaacattgacgaacttgatgccatggtgggtggcacacagactacgggaggcttgagggcatcctcgcccacgatcaatgtcagcaactggatcgaccggaagtggcacgtaccatagaacaggctccggtgggtcaacccttcctggatgttctacattggcgacgatcatccctgctaccaagtagtccacccagatcatgtagcgatcgtggcacgacaacaccgcatcagtcgtccagcagcacaggtgagcgagggcgtcgccatggcggatcggcacattcctgaagactctccagtcgtcagagccagaagcgaagaggtagacgttggtttcggaagattggcatgatcttctctcgagctcagccacaacgaacgacgaagaattcttgctgccgcaggacaaaatacatgtgccttccctgctcatgatgcgcgggcggatggtgtctcccctcctccagtaggaaacgggcagccgcgtcaaggaggggtggtggttgctgctgctgctgcggctggcattgtagacgaagtagtcgatggcggaagggcgagcgtgcttgtcgggggagacgatctggaacaggacgacgttgccgtgcgcggcgatgacgtatgggtaggatgtggttcccagcgacgggcggggcccctgcggccagtcgagggtgaggagggaggtctccggcggcttcacgagctcgaaggagacggagatctggtcgccgccggaggtgtaggagaccgccgacgtggtgcggtcgcggtcgtcgcggcggaaggaatccctccgggcgccgtaccgattcaggatcgcccaggtcgaggtcggattggaggcgccggcggcgtcgtccaacgatagggttgaggaggatcgcttcagcggccgcccgggaatctccgtctccttggtcggcgttggtccgcgacgggatgcgtcggccctggcccgcgaaccgtcggacgatcccttgcgccgcctgtggctgggaatccgtgtccccgtccccgtctccgtctccgtggtggggatccgcatggcggcggcggcggcgagggttctgtgtttggttcgcgaaagagaaattaaacaaaggcgagacgaacataaacttggctcgttggaggagtatttgggttggggaaagtcgggttaaataactcttcagtgcaacccgattcggatacccgagtcggggagggagaagcgcgataggcaggactcatccaagtcgttagatcgaaacatccaacggtcaaaaaaaatccaagagctcattgctcggactcggatatgctgtgttcgggaggtaactctccagctcccgcgcacgcagaacggaacgactcgtattttgttataattcattaagtactattaattttattaaaaaatagattaatataattttttaaagcagcttttgtttaaaaatcttttgtgaaaaacacatcatttagcaatttaaaaagtgtgcgcgcgtaaaacgaggaatgtgacttattctatgctgtgcggagtcatggcctcatgggtctaggcggttcgtgtttggatcctaccctctctatccaaatatataccaacccaagaccaaatttgacgtatcataggcctacaaatctaaacatatatattcaggttcgcatttctcaaatccagtcgtatgttattatatatcacgatagagtaagattgcacgattgaaatttctcggggtgcgactctaatctaggtaaaatttttagcgcacataaaacgagaaacctcattagctgacgattgaaatttttattatttgtgtgtgcaactgacatgtgggtcccacatgtttttttttcagatctaattgccatgtaagcgctatgttaatgacacgttaggcaaagacttagtcaaaagaagccacgtaggcgttaaaaccggacacaatacggccgatggatcttatttaaacggttttgtaagttggggacctgttttgcaatgaagtgatgaaaatcggaatgggcgaaaaatagagggacccaaagtgaacttattcctctcctgaccgactcggactctcccaacctcccagccaggcccagcaattgcgttggcacttggccacttggggtcacccgtatccgtatcgggttgcactgaagagtagctgggactgtctatccatttgagagatggatagcaaaatcgagagtggtttatcttcgcctcgcctttgttttccctttcgcgcaccaaatacgtcatggccgcgcacgacgtgtgggtaggatgtggttcccaccgaggggcgggtctgccattgcttgatggagttagaagacagtagcattttcgtcaaaaaaaaaaactaaaaactgcatggatctaattaaccttcttttttttttcggtcattgcaaactttcatcgtccgattgtgaggccatacacgagagccacacgtcgttgccctagaagaaataggaaaaatatacggatgaaaatggaacagaatcgcatatttcaaagagacaagaaaccaaatgtgcatctaatttcaagaggaataagttcactttgacttccttaaaagtggtccgagtctaatttataacacttaaccgcaaaaccagatattttgacttctaaactgttaaaatcggtacaatttaactccttcaatggttttggaggacggttttactgacgtagcgtctacgtggcgatannnnnnnnnnnnnnnnnnnnnnnnnnnnnnnngtggcacttacgtgacaatagaattaaaaaatatgcgttggacccattagtcattcacgtaaaaagaaatgtgggcacaccctgtctccttccttcttcctcttccctctctccctttctctctctttctctcctcttcttcttcccctagcacggtggcggcggcgacgaagttgcacgacgcgtcggtgcggcggaggtggggcgcgaggaaggaggagaggcggcggacctggcggtgcgcgggggtgccgaaggagggagggcaatgcggtgagaattggagggggcggcgccgaacggcgggtgggggagggggttgaagggcgacaaggtcacagtcggagtggaggagggggtgtaggtgctggttgttgcgtcggcggcggcgacatggaggtgctcttcgagctcgtcgcggttggaggagcggagctcaatgctggctcgacgacgacggctccaccgacagcgtctgcggtcgtgcggaggtcgacgacggctccaccgccagcggcaggttctggagggtgaagaaggtactcaacctggggttagagcagcggctacgcgattccatcgccatcgtccacgacttcgtgaacgcatcatctggtagcggcaggagcagatccgccgctggtgccaacctacctccctcgtttcccccaaccccaagtatctccgccgccagcgccattctccactgacgccgtagctctatggccctctccgatggcggtgactgcctcgccccagcttgacggcctgcctcctcctatggctccggcgctgccattggtgccgacccacccaacttctaccatgctcgagttgaggccgtgacggaggaggagcaagagtggacgcctcggcctcgacctccctaggtcccgctggccgacgcccctctaccgccacccagctgacgcgacgccgccgctcccctcgttgtcccatcgtcgctgctgtgtagaagaggatacgtgccagcctgccaggggaggagaggagggggtgaagggaaagaggaagaagagagtgataaggggaagagggagatgacatgtgggccccacatgttaagtcagaccgggtcaaagcgccacgcaagcgaaaccactatccaaaacagagttaaattgtaccggttttaatagttgggggagttaagatatcgagaatacgaattagattggagctatatttaagggagtcaaagtggacttattccatttcatgaagctgggtgtgtgcacgaacacgtccatcaagcatttgagctgctaagcggcgaagatagctgtagcaggtggccgcttggctggtcggcacgaccgcgaccgttgggctgccaccacatggcgccccagttaagcttaggagtaagtctatcttcctctctcatttcttccccatggtcgaatccgatctttcaatcgtaaaaccgggtttaatatctcccttaccttcaaaaaccggtgtaaatcgacttccaagacagtatttagtccggttttagcttatgtggcgtccacgtggcagtaaaatttaggtggggcccacatctcagttacattatttatttctcctctcctccctcgcaggcagccacggagactgaaggggactggcacggcggaggggactaaagagcctacgggtgcggcgcgtgggccgctggtccgtcgcggacggagccagaacgtcgccgctgcgaccaccacagagaggtgcgcaggtgctgactaatcgcgatgcggccgccatcgctgtcgcggccactagccttcccgacgctggactcgtcggtggcgttggcatcctggggcacggcgtcggggaccaagacctcctcaacctctttcttactcgagctctccccgtgcgtgctcatctccgctgccatggcaccgccgctgtcgcagcaacaaaacgccgtcatccgtgctgtccatgtcgccaacgtccggatccgcaactggcacggcgcgctgctgatggagactaggcagttcctctccaacgacaggcacgctctcggagaatatgtgccctggtgagacccaggacgccggacctcgggtggtggcagcaatttttggagtagctcccagccgctgctcccacccttgctcccctgcaagctcgccgatgtcggccgccgtgtacctccccagcgacctcggtagccggggcggagaccgacgggtgcggcgctggggtcgcggaccgcgcatcactggttcgatgcggacgaagccggaacgtcgccgccaccgcgacctcctcaagctccggcatcctccatccggcattcgcccttccgcctccttcccgtacgtcggtacgtggccggccggcgagctccttcccacgcacgacgcggtcggccgcctggcaagctcctgcaccgtgcgccatcgtcgttgccctgcctctgtgttgatggatggtgaggaaagaggaagagatcaaagagagagagagagacagggagagaggtaagggagatgggatgaggtggaggccgctgacaaatgggtcccacctgatgacttgccgtgtcaaacaccacctcggataaaaccgcctccaatacaacagttttgggagttggggacccggttttgcggttggggaagcgattgtaacaagtgcatgagttgagggaggcaaaatagacttattcattaagcttattatgagcctgatatccagagaaatcgtacttgggcctcattttggcctaacaagtcatcatcagacagcgaggcagatgctcggcgacggcaggcgttagcctgagcagcctccgcctcgatggctctagagattctgcggaaaccgccgccgcttgttctcaaattatgcgagatgcaggtaccatcgctttgatgatgattgtagtttttcccaaaacctacttttctacctcaaaacgcgagacatttgcgacgatcatagagcagcacctcacgtgcgacgacaatgcaatatacttcgtacacgcataacaaaaatgactgtaccttcttcataagcctgatgttctgataattgcctggaactgatacaatgttcaggggttgtgagtagtatcagatagataacagggatttatggttggttttccatcgtagaggtgagtacgagactacgagaggacagtcgctggctgccgattggtgagagttccgtgaagtgcattctttacatttcatcacatatccaacaaaatagtgcatcgctaagaaaagaagttccagctagttatagtttactgatggacgattatgcagttattctgcctcactgctcatctggaggtatcgccatcaattccctagctttcctacaaaacatttggacgaataaaatgtcagttataacaacccaaagcgtaaaattgacccaaagaaggaagaatggcatataaaaccgaaaagaacagtcgagtgttgagttgcttcagttgcagtaaatgtgggcacaagcacaacggaatatgctagtactaatggtcatgttccctgcgcaaccacatttttatttggaaggcatactcgagagaaacggaagattgccttagttccctctcaatctcaacattccccgtatctattttttgcgcatccatgagagcatcacacgcatgtttgtactcctggttttagagtaaatcaggacacggaccataatacatggatcacaatacgttagctgcagtgagtcttaccttgggtagcatgtgagctgcaccctgacgatagcgagcttttgcccagttaggccgcatcattcagcatttgtaagcatcagatagagcaccttcagcatcacccatgagcaatctacagatgctcctgtttgcgtacaaaactgcagtcggtccgtgagcaagcctatgctcaagcatcagataaacaaatcattcccaagcttaagaataacgtacaaaaactttataacaacaataattgattagcgttaacaatcagaaataaggtgcaagaaattaccagatcatatatttttgctgcagcgccgtaattcttctgcttgaatagcaaatctgcctgtgccttcaaaacgacttttctactctccttctgatgttgatcctaaacacaacgtaaacaatagtatcctgatgcaatctgaagtaaacttttgaaattttgaataatagaacatttatttaggatgatttccattaataaagaaactaagcatctttatctccaacattcttcatgatttgtggttagtcctgtggcattcttatgctgtaatttaagcgtactcgatgatatcgataactcaaacagaactctaattttgatcagttgcagaagtcactaccactcaagtatagctctaattttcatcatttacataagtcacaatatgtgatacttacaagggaaaagtccccccccctctgatttatgtttcacatttgaattaacaacttaaggtccaaatttgactttctaagttgctgacaatcaagtcaacagacagatgggctagatgtattattatatatgaagagctcaagatgccacttatatttattattaaaatttgtatgtggaccagacttttaaagtcaggttattaagtactccagcgaaattgaagacttcacaactactccaaaggctgaaggacaaaacgggtttgttctacttcaaaggaatatgtatgataacaaagctaaaccagtactattaagacatgatccttctatctagtactattaaatgccattgatatgtaagctaacccagttttacagcctaacaacttaacaagcatcagagaactacgtgaagtggtgaaatagagctctgcaatgcaaagtgcatggtaagcaacacgaaatatgaacagagagcatagcagtatctttagtacaaaaagatcaaaagtgtgtaactgtataaaatgtaccattggctttgtatttgacttttgcatgagcgatattccattgacactccagtttgggacatttggaattgaagaagtcaatggaaatagcatttcaacttcttccctgcaatcatgtaatgcagcgctctattggcaaccaacccaactgcacaagcacaacaaaatgaagaaaagtcgcttcatacagtgtaattcagcaaggaacctaaaacaaacaatattggtgaaatcagtgtatggcctattatcacaatctgtggctttcaagtttcaaccaaacgactcattacgacccaaaaaaccatggtgttaggttcaaagctggccatgggatttttggacattgatatgaccttctatcaaaatggtcttttggatataggctggatttgagaactcatcggttactgaaaggtcatccatgctttgcacaactcgtaagatatacttacacatacaataatataaacgaacacaggttcagataatccataggaaactataaaatatgcaaatgataagtgcaatgtttttgttaacttaagccctgttcggatgtgataaggatgaagattaaatatggggtacgtaaaacgagaaaaccattagtgtatgattaattgagttttaattattttaaacttgaaaatggatttattttatatttcaaagcaacttctatatataaagttttcacacgaaatacatagtttaacaatttgaaaaatgtgctaacgaaaaccgaagtaaaatctgtatcttaatcataaagtaacatgaccttagtcaaaacagcctcaacttattgctaaaataactccctaaaataatcagagttgtaataaaacacacaagaatcacagacttatagaccagagtggagaaccaataactgactcagaagaatagaaaacatacatcatcaggaatattagggtttgctccagccttcagaagaaactgaatgaagttagtatagcctccttgcgacgcagcaagcatcaaaggggttacaactgtacccttgccattaacatcagcaccagcctgagaaaagcattgtgcaatagaatatttagctccataagttcatggaacaaatgtcttgagttagcaaaattaaaacaccgcattagttgatcaaatatagactcaataaaacactgacctttatgagtagcttcatacacttcaatgatcggtagataagggaactcatcaggggactaccggctccattattgacaattacgttagactgaaagcagaatataagaatttagcctcagtacaaccagaaaaatatgtgaaagaaaaagggaagcaatataatgctctaacctttttttttctgattaatgtttgccactttttataagtctaactgttgaagttagcaactttcgatgttgaaagaattaaagttgcattatgtgcatattttacagacttttaactaaaatagaaaaaatatattacacatgaaaccataattattataatcagagttcagatatatgtaatgccacatttacacaaatttcatgaagccaaactgaagttactgcattggaatggaagagattttagtggacatttagtgaagtcaatatcaaaccagaaggtcagcaatgagatagatggaggtacaaatatgccatgatgatcctaaagcatttcaatcattaagagatgagtagataaaagagcaggataatagcttatataagtgccatgaattgaacacctaaattctcatgctctttcccaaaagaacatcagccaaccttatttagagcatgccaaatggcaattttaggacttggaagtattactcaaaggtcagcggtataataataatcacaacgcaggtggaagatgctacgcgcgcggggtggctgtgtcgatcaggggcctctgtgaggcgcactacacaggttaagtagcacgctatcctaactctcatcacaataattcatttcataacaaaaaaaaaaacaatcctttttaagacctggaaatcccatatgatctaagatcctctataaaatgtctaaataaaaaccaaaatgatagattatgcactgcagtatctgagaatgggtcaatccaagcaaacagaacagtcccatgcaaacacgcatcagtgtacatcagctaatgagctaactatctaagtggaaaacaaaacaaacatctagctatcaaactagcagtgaaaaaaaaaaagaagaggaaataagaaatagtagcaactacatgcatctgccttgtgatccaacaaaatcttcagtgtcttatccttgccattgttagcagcatgaaagagtggtgttccaaggccacagtctatgtcaacaggtattccttttgaaagcaagaactctgttaccttacagcatcctgcaatgaatgagatgggccataaatcttgggggaaacaaatactatataaattgagttatttgaataaacatttaccaatacaatggacaaatcacaatagattgcatgtgagatgtgagcgagtataaacagagcaaaccaatacaactttgagtggtgatatataaactaaaagtatctagattagcaacacaataaaagataactgtgacgacatggttggattaaatgtaatctattaatagtaatgcagtatcgtagaatcttgtacaacaatataattggtaatataacaaggaaatggatagtgttcatatcaagggagacctgtgccagcagcatggtggagaactgtgcatcctctaacatctgcttttgttacatcaccactatgatcaagaaaatactccaccgtaggaacatcaccagactcagcagcggccataaacggtgttatatctgtaataaacagcacatcagtacacttggcacattatactgccaaagcatagacatggcaaccgtcaatttcacgaaaggatggtacagttagataatgaccttcttttccagcaatattcacgtcaccccccaattcctccaccaagaacttgcaaacattcagatggccctggcatgccgcggcgtgcagcaccccaatcccatgcttgttaagagctaagacggcatctagggatgcaagcgggccaactcgcaaacctacttatatgtaaaataagtgataacccgtgtgttttcacgtcgtggtccgatttgccgcacttagagatgcaagtgggtcgatccataaactcatttatacgggttacctactaattttgcctataagcgggttcacgggttgacccgcttgcaaccctaagtctttcctttctgaatcccaaggctctttataaaaccttctcccaaataagaacaaaaagaaaagtcatcacagtgaggaagataatctgaaaatgaacagattaactaggtagaacgtgaaaagaaaagcgacgaaaacgtgcaacgtgcaagaacctcactgagtcatgtgaacctataccttgtgacttgaaaacatttgtgtagagtactgtctgctacacatcacacattagcacttgggagaggtaattgtaatagaaagatgatcacaacattgtcgcatttatccaatgcaaggacttgctacaataaaagcctcagtcaggtcttgcaatttctagataagatggcatgcatctccagtaatccatagacctggctgttaattccttcacgcagggtgaaaaatccacgcagccataacatcaccgaaaataaaataaaatgtgggaaattcccaaaggcaacagcaacgcagcaagcgcccttccttcaaaaattccatggccaaattaattagcagtactacagccatcgccaagcgttccacacaggaggaatcacccaaacctaagggaggaaaatcacgcaacaggcgcatgcaaaagggggccaatgcgtagacgcatcgatcggggaaggggatcgacgcggcggagaagaagaaggggaggaggaggaggagaggtagtagcaacctttgaggcgtccgaggttcccgtcgaaggccgccctcaggcctcaggagagcgctctcacctgcgaacaaaccgagaaatcgccattagagcacatggccgaggagctagcaagccgatcgagctaagaggagatgcggggagagggcgtcggtggggcggcagtagacgaacggaacggcgccgccatggctcgcctcgccgcgaggagggaggaagcttgcaggaggaggagcggagtgggtggtgggttttgctcgtccaccacgacgagggcgagggtttggcggtgcacccgtgccccgtggactgtaggcctgtagctctcacgggtgtaccaagaccaggttcacggagccgtttgctcggtacggagaaagcggatagataggtagtctatgacatgggtggcccgcttacaggccagtactaccggaaaaaggaaattagtg

SEQ ID NO: 62519 - DNA, 1205 bp, Oryza sativa
tccaatagttctgtatgattattgtggagaattgtgagacgaggatcagaatccactttgtattttgccgattttcaagaaaatttatatcgtagttcttagtttataaaccacttatgttcattcactataaatgagatgatacatctttgatatgaggttatataaggctaattacgattgttaatttcatatggcagagcatatttctcaattcttatggaccactgtatacattcattttattatatacggttaccgaatgctactgttctctgatcatttttacccttgcatgatgcatcgtgataatgtcattggtaaaatcagtatcaccagcagctgcaatatttagtaacaaggatcaaacagttggttgcaatatggcgattgacgtgatttacttggagaatatctggaagtggattgtaagggtaagaccatgtcatttttatttaaccggaggaatggtagtattggtggaggactaccgtggtgtttggatccagggacttaactttagtctctttatttaaacattaatttagagtattaaatatagactacttacaaaactaattccataaatgaaagctaatttgcgagataaattttttaagcctaattaatccataattagagaatgtttactgtagcactacataggctaatcatgaattaattaggctcaatagatgttttcgttctcgcgaattagtccaagattatggatggattttattaatagtctacgtttaatatttataattagtgttcaaacatccgatgtgatagggacttacaagttttagtcccatctaaacaggatctcaggtctatcgatggctagctaaaacagccagtgcactgttctttttagagctatgcgccgtggtgtggagagaacactatgcagggttgtccactgaacagtgaacagtactactagctagacagcggtctagctagattgatcgatccatatacactggtgctgatcacttgtggatgtcaggtcggtttggtagaactcaaacttctaaatttagatttagaaattggatctcaagtaaagttgtggaacagatcaactaaactaaacccagcttcacctattttataaaaacactctatttatctccactcttattttagatcaagttaaaactgtttgacaaagctccagtttctagagttggggtgca

SEQ ID NO: 62520 - DNA, 546 bp, Oryza sativa
  unsure (1)..(546): unsure at all n locations
tttttgtcacttcatttttcatggcttattagggtataagtagaaggcctcctttaattccttcgtataggaatttttcataaatatccattccaaacaagtaattggaaatgaatcttatgtaatctccgaaattcaataaaaagtttctttgaatctttccctctcatcaaattatgtgtttttctgtggtctaaataaatggttattcttttttttcaattttctattttacacgtccatcccaatcaaaatcatgtgtttcttctattattaagttttttaacctactttccaaggagcctangtgagttcgtttgaacaacttcaaacgacaacttcatcatgttccattagtacacttcccaaaatgcaaagggatatgttctatggaaaaaattatacatgaaagtttattaaaaaaatcatattaatatattttaagtttataataattaacacttgattaatatatactaatggtttatcttattttacatgccgccaatttaccgagattcctaatgggcgatcgatcgccccgag

SEQ ID NO: 62521 - DNA, 531 bp, Oryza sativa
ttctcgatacatttggctagagtttatgagtgtacacaatgtgtagaaaagttcttatttatcctttgaaataatgcattggagttttctaaatctactactactttaaaaataagaggcgtttccatcgtctagtggaaaaaaaggcgagaaaaaaaaagagaaaaacaacttctaccataaaataaaagaaaaaaaagtcccactcctcatgtggaaaaaagagagagagaaaaaaccaaaataaaaacttatatcgttaaaaaatatgtctgacttaattccgactctccggtggagaaaaaagagaaaaaacttatacataaaaaataccgactcctaactactttatatatatatatatatatatatatatatatatatatatatatatatatatatatatatatatatatatatatatctataaagatatttttgtccgtactctactatgtcctctgggatggatcggcttttaaatgcgcgcgcttttggaaatataaatccgtatttgagtcggtttttaaa

SEQ ID NO: 62522 - DNA, 28840 bp, Oryza sativa
  unsure (1)..(28840): unsure at all n locations
ccccccagcccccacgctgcctccgccactgcatctaatgcatatgttttataccaaactttcaataaaaaaagaaataaagttttttttcttcaaaatcctctggaatacttgtcttgaaatcttgggcgcactccaggaaaaaagatggagtaggaccaaatcagttctttttactcaaaacttaatttatggctatttgattgtctcgagatttgggcatacgagagcttgcttcgctagccagctggtatacaaaatacatataagttgcattctaattactatagttacatgtgaaagctttaaaaaactaacggatattgtatagctactctatttgtaagttaaagtgccttggaggtaaaggttgttcaaaacttaaaaaatatgctccctttgttcttagcttttcttttttaaaaaagtcaaagaaaatgatttgtgtttccagcctctatcgttaggcaatcaatttagttcggactttaatttaaaatatttaaaagatacgaggttatgtgacaagggaaagcatcctatatgcacataagctttctcatgtatatatcgtgcacatcaactaataaatatcataaaatattcttaaaaaatatacatatactttcaatagtactacatatgcgtatagtgtcacatcttcaaattcattatacacagagagagaaagaattctgacatatttatagtcttaaaactgtcaaaattccttttttaggctggaatataatgaacttaaggttaaaactttacacatagatgtaatactattgaaagtatatacatattttttttaatttattgtgatatttgttagttgctatgcaatatgcataagaagcttgtgtacacataatacatatacttccatgtgacaaaccccatctcccttcaaagaaatgagttgaactaataaaaagacatcacataaatttctataacagaagtttataggaactagctacgtacaccacctaaagtaggacgaaagactcttgatcatagatttattgcaccactgcataaagtatcctgcaaccctgtaataacaccatagatccagagtgaaaccaggtagaagaaatggatataacatttattgttggatagatcattttaggatgcatgcaaagtcgctaatatactgaatttttttgagagatttgaaaacaatgttagtagatttgtcaaaaaaaaatctttgatttacttgtacttttatttttttttatgaatatatgaataggaaaacaatgaaccaatgatcaatcattctcgctggaaaccttatatatgttctgaacaagtaaaaaattaatgcagagtatgtaagatagggagaaactattgaagcaattacttttctctgcagagtatgtaaaaatgatttttggcatctaccattcagatccacatgcaagcctgtgacttgtaaattaaaacgactgaggcgttttaaacttaacttcgcttgatttttcaactatacttaattgaggacctccattgttgtgacacgtgtataattacacgtagccgtccaatgtcgtcatttgggagattcgctgaggtatcgaagtctcttgactggctccaaagatacgccttcatctgtatctcccatgatgacgaactactaagagataattaagctaggctaatcagtgcctactaaatttaattgacgtcctggacagttactaggatttttcttgctgatatatatatgaccacgttaacttggtcagttatatcacacttcaacagtaaaaattttcaaaagaaaatgtcgctcctcgatcgtacgtacgtataaattttgactttttaaccagtttgtaacaaattccataaaaattccaccaacatcctcatcttatgtgttctatcaatttttattgttaaaatttatgtgtatttgtaaggatgagtatgcccatatgcgtatgtttatatgaatatctacgtttatactatattttaagaaaaatatcccccacagtaaattgatttttgcgaggcctcaacgagtagactaagagcaggtataatagcaggctataaaccagctataaacataatttaaagagataaaataggagagataagagcagcgggctacatatttgtagccagcagcagcacagactctaagacgtatgtgtgtataacaggtgggatcaaatattgattgtgttgtatatgtttatacgtaactattgtatgaattagctattaagttgattatagatgatttggagccagcagttagctatactattaaacttgctctaagtgttagagattaatcaagcagatatgatgttaatgaactgatgcatgcaaagccagaccgatcgatatcatatcgaaggtcatgatcatcaatatatgatccgaggattaaacacaaaactcaagatctcattaggtacaaggatcattagtgacaccgatcgatgaaccatcagaagaagccttctagcttgtttgacacggccaattttaacttctccagatctacgaagataatcgaagatctaatcgtgtaccgttgacgatctctcatgctgggactgtctgacatactattatataacgaactcgattatcatctggattaatacgcgagatttcagatcagaccgaatcgctcatgatgacgatgaggaaatattttgcttgacatgaatggcacgagtttcttctgtgtttttatgacagctggttcagaaatattgacttaagttgggatcgtaggaagaagtaggcacaacgtttttctggttggatggcactgccagtcacagctgcggccacattgtactaatcaatgtactggtcctatgctttgcatcaatgtagtccatttgtcatgcacatgtaaaaacaaaaataatatttttccccacaaataataataataattttgattgcaaatagtactacgtcatattcacagttaaatttgacattgcatattaatttatgaaatatatatcatgtattgatctatatgtcaatttttgttttagattgttttagctttttttacccatgtaaaaataagaagatatccctcgagggatgaatagattttccgcctgcatgactacattgcattttcatggaaagggtggtgattgtcaatgtcatggcaacttgggagatatcttccattgatcgtaaagttgacaattgttagcaagcaaatttagcttctttcaatgaactggtaccctcatgtatatgtatatatacctgtttggctgccttttcttctagattacaacacttttgccggccattgcctgcacaacaaggtcaaaggagaaagatgtatcaaatatttgcaagttcgtagggtatggggaattttttaaaattttgaatgtttctaaataaattaatgattactcctacttactaacttcctgctatttctgaacgttggcacgccagtgtgagtgacaatcacgacaataatgccgcggctatgatggtttggccacaaaactgtgggcagctcccaccatggcgaggcaacatggtgtgtatttcaaagtaatttcgaagtaagtttcgtgtgtgtgttttctttaaaaagcttaaaaaaattcctaagctatgtatgcacatgtatagctagttgatgccacttactctcttctcttctggcgatacatatttaggcccactttgattcaaaggaaatttataggaattttaaaggatttcattcctataggaatttttcctatatatccctttgaatcaaaggaatgaatcctatgggatcctatgaaattcctatggaatgcctcttcccatgcaaattttggaggaaatttaacatgagtttctacctcattttaagaatcctttgagtctttctctctcctcaaattcctgtgttttttctacggctcaatcaaacggtcattcctatgtttttcctgtgttttgcaatcctctgttttacacttgtattcctattaaaattctatatttttcttattcctccgttttttcattcatgtgattcaaaggggccctagcttgtttgttttggaggaaaaacaaaggatctagattcctaaggattaattcctatatgtgtcattcggtttatatgattgaagtataggagaaccaatagaaaatctcggttcctacaaattgtatagcgaaaacataggaatttttccatccactgaaacctgttggaaaaattcttatagattgatgtgtgcacatattcctatttcttcacgttttctattcctatggaatagaattcctctaaaccgaataaatccttacccctttgaatagcaggattgaaaaaaaacggagtaataaaaaaaacacatgattctgataggactgcaagtgtaaaacagaggattgcaaaacacaggaaaaacacatgaatggccgtttgattggaccgcaggaaaaacataggaatcagatgagagagataaactcaaaaaaaatttaccaagaggttagagtggatgttaaatttcctacgtttttcctctagaatcataggaataggaaagtttcctacatttttccttttctcatccctacgaatcaaaggcataaatagtgtagattttcaattcctttgtttttcctttatttttcctccaattcaaaggaggcttattaacatttaggatgagacttaatcaaaattcttggtcaaaagaaacagatttgatcaaaattttgaactttgattatcaatatatataactactcaaatgcttagtttaaaaataaaagaaatggtacgtgttgcctcggaaagcattgttatcatatcataaacttattagattttataaactaatataaaattgatgatagaaaatttaaaagctttaacccaataatatcctaaacgtgaaatatttatgaccagaaggagtaatagggaactcttttttcatcaaatagtgggggacatgtgttttactcctccctcggttataactataaatatttctagaattcaaattttgtatcacaatacaagcatttgtgtgtggattcccatgattctcattacttcaatgattcgaaaatcaatccaagtatgaagtatctaagcaattcaaaattcaaaaattggcaaatgaagtaactaaaaaggaatcatttgatctaacctctgctaaataatttagaaatccttatattttggaacggatggagtactagaaaagcattagcatttcttgtagacgatgcatctagcatcttattttcaaattcgcattcatttcattcatccgttgatgtctttctctattatgttttttttataaataaaaaatataatagagaaaaggatctgagctgagcccaacaaaataaaagaatcagagctgagccccaaaaaaatagaagattcagaggattaaaattattaagaagttcgcaatcttcacatctctatatgtgcgactatcagttcatatactactactaataagtgaactcatcacttgccaaaaagaaaatgtcaactcgtcaggtgtagtgacatatatatgcagggactagctagtaacacgttgtgcagtgcaaataaactactgaaaattaagttttatgcaccgaatttgacaagttaacttaattaacaaatctacattaatagccatggtcaacagctgatggagcatctccagttctccaccgtgattaattggctcaacacagaaaaaataactgcatactgtattaacataagggcgttggaagatcatatttttccaaggaacacaatttagttaagtttcagtttataaggcattgaccgtaaccgttccaacttccatttcttgaggaaatgacttcttcaaataataactcaggggagatgtaccacatctataagttacttgtccacaatttatccccatattttatcacgtcttccaatattcaagagaaaaatatttgattacttgttccttgagttttccataacatgtttttttatgttactcagagatcagaaaaatgtaccatttatgctattggttagaactcattaggatgtagtcagttaaaatatgtcataattttgaattcaatcaatcattgagaagaagaaaattagtccaataaatcatatcccaaagtcttgctgagtgctgacacaccataaacaaacttataacgatataaaaagaaagaagtatctattccttgcttttttttatttatctatatttccaattaagatgaataacatgtatagcagcactaggaaattcgtagtcaaccagtgaaacgtctgataaacaatatgcctgtattatactttgttaatctccagcagtttgactacatttgagattatactatgaatgaatagtaaataatttccttacatatataactatatgatccttttcttcatcatgttggcaaataaatgctaatctttgtacagaggatatcattttcttgtaccaatcagattatttatcccagtctaaatgaagggaaatagggcttgaaagtgtcagatgggcagaactcttggttatgcatctcttgcagagaccaagagccggtccttccattatctagatagatgtgcataagcgataagtctagtgtattgactagaaaattagcgtgccacattatagcccgtgtgtacttgctaagtagttttcaaaattcatgtctataaaaggttggtaaatgaaatattcaatggtgttattaaccgatgcaacaagttaagctaaattagcttccatggcacttatgctaaaaaaaagtaactattaccctttaagaacaaaaaaagtaactattaccctttaagaacaatcatcaaaaactggataaaaccatagataaatatatatttacatgaattcactaagaaaaaaagcctgatactaccatagttgtatacagtctttttttttaaagaatacagtcgtttccggtctagcttctagctacggcacaaagaagaaacacaacaatgtagttacacaaaaaaatttcagaaccatagtctttcacatattttaaatccggaggtcatgatttcgagcaccttgtaggcggcaacaatttatatctttggtatcttgcatatccctagaaatataaggaggtgaacacaaattagttggacctatactgactatagaaggagatcaagagcaagagacaaggttaagccagattgttctggtgggctagtggcacagcagcaaaagctatcagagacatggcagtaaaactatgactatttttagattgaaacagcagttccagatctaaaggaaaactattgtttgtcaattgttagttcttattatgggtgcattcaaatgataatggaacaacctgttgataggcccatcaaagtgataacatccacccaacagaacaaaaaggatgggggagagggatacagagaaaaaaaaaatctctttaggaaatattttatctttatatatttgtcagataatcgcaaaattccatgttcagataacactatattttttccatatatagagaatgtggatagaaatataacaagctcatgatgtattaacttaagaatgtggtcatcatgaacagttgcaatcgatcgcaacttcaaaatttctgaagtaatactcaggacaatcccttgaatagaacaattgcaagttgcaatgagcgcactaaccaattatgatgcaaatgtcagtaaattgcgccacttttatagatcattttcttttgtcaggaggagaagtactctcgaaataaactactgagcaggattgagaccaaagaaaaaactatgtatcaatgcagaattattttcatgattataaatgttattagaaagggtattcagaagaaaaaatcaaacttgagttttgtcaagaaccattcctgattatgttcttctagcgcattaatatttcttttccagattatgctaactgtatatatactaatagctctaactcatgtataattcgattgctgctacgatggaatcagtaatacataacttaactcattagtaatccatataagagtttcataacttagcatcaaattctgcaatttctagttgtgtgtttctcctggatttctgcagaagtagtatagtagcaatagagcaattaatacactatccaacaaaatagtcctaactgtgctatcaaatgcaactctaagaaagaacaagatatattctttcttggtcatttcatcgaacaccatgaatgcacagttcgcactacaaatcagcaaccacacgttcaggaaaataaattgaacaaacattacactgtagcttgctcaccactgccggccatggcgacgaccgataagcgcgctctgctggccgccgagaacggccatggcggcggcggtccagtcaccgtgtcgttcaacaccaatgccatcgtcctgctcgccctcctcgtctgcggcctcggcgcggtcgcgctccacgtcgtcctccagtgcgcgctccgcgtcacgccgtaggctgggatccctgtcgttggctcgccggcgccgttaccgggagcgggaggcgtcgagatgagatcgattggaaggggaagaggcatgaggtcgatcgacccttcaggagaggacgagaagctaacctttttgcattttactccttcgctagatcatattttacattttagcccttcgcgggaagagcgtatgcacgaaccacgcagcgccacgtggcctcgctaatcgcacgctaatctgcatagatttcgatatatagagatagagatggcttgtccgctattgattagcaaatatcatatgtatttcccatagaattgcacttaatactattatattatcactttcagtactaggattattttatataacacacatgaaatacatttccttgtcttactaaactaacagagaagaggacattgtagttctaaaaaaaaaaagaggacattgtacctgaaaatgggcctccatacactgtacatgaaaatgggccaccaaaattctgctcggcttgctacctcactatcttctggaatgacctgtagcactcaaaagaaaacggataaaaaggatatacattagcaacacagcattcagcaatgcggattcttgatatttcagtttgattcaaacagcaagcaaacacactacagctaaaacagatatgacaaacaaaagaaacattacagattagcagaactacatgcttttcagcatcttaagcctccaagcagaaaagggtactacaatggtgtggatataagatattgtgagcaaattcagaagtcaggaattatattatggaaccaatacaagattaccaaccctgatcaacagaagttaacagaccaacccactacatccaaatcatactaacagcaaaacaactttatacaagaaaaaccttcagatcatttttctccagataatgtgagaaattatagtagtagtagtatagcatcccaacaggctaccgggtgtcaatactgtctgactaaaatgcaggcaacatttacgcaccaaaactgaaaaccattttctccaaaggatggaggatgtattatcaaaggtatatgcatacaacatttttcattatcgatatcaaagaacataatatggtgatacaactcagaagctgctacaaaagtacatgctcaggaccttatgcaacattctatggtattggggaagtaatatataatctataagatttgacccagcaggccttttccatgctttctcaaactgcatgaattgggctgttgtttctcttatttaggtcaggtccagccattggtgggttcacatgaaaagctgattgtcttgtatttgtcggtccagtaagctgaagggaaagagcagagggttctatggagttagagctgccgtcacctatggtaagcttggacatgccaacaacctcatcagccttattgatcacctcctttccattcactggagtgggctttaggatttcatgatttgtgcctgattcacccacattagcaacatttggaggccaaagagttagtggaacaggtattaatgccgggtagaatgttggcattgtcagaacaaatttagtcttgaaaggtgcagcatggttcatctccaagtctagtgctgctagtgaaggttctgtgaactcagattcctcatgcttccttagctgcaaatccgacaggtgtctagcaaactcaggttccttctgtttcacaagatgtgatattggcaattgatttgagcttgtggcttcgtcttgagtactatggagcataagctgttctacgaccactggggattcgtccatgggctgcaggttgaagatgaaattcgaacataagatggtcgtgatatagaaatatcaggacacaatttaacatatatggagataatagacacctcctgtctcaagcgaaaattgcaagcaaaaattgcataccatttctgggaccatgtcaaacaagcttgacctcctcttccttcttgatgagtttgtctgtctaatgaagtacttttgagcatggctagccacctgagttggtgtcctggaaacaacaaaattacgagagatcccacgccagtctcctttaccaagcttctgcagacccattagaaacattctatgctcttcttcagtccaaggtgtacctgaagcacaacatcagcccttgagttgaaactggactgaaaaatcccagatggtttctgtgaaaaaataatccacgaccccatttttttagaggaaagatcattatattgatagtgacctggctttttcagagagccaacagtagttcaacaaagaggtaaaaccaactcacacaccgagggttacacccactggatcattccagctacggagtacatgacaagctcagccaaaaaacacactggaactgcagggaccagcactgtagcatactccctctaacaccagaatactccccattcactagcatgtattcattacaacaaagacaaagcatcaatcactacttttgagcttgactacaatctcaagctttgggtttcttactttgtttatatataataaccatcaaccttgatgcatctcaatctagtgagtttaatattagatcagtaatgctattctctgtagaataatatgcatgagtctataattgattcatctgattccatctcacaaacaatggacactccagaaccacaataatagctttgtaaagaagaaagggtagataagtttgccttctattcagtactactccctccgtttcaaaatgtttgacaccgttgactttttagcacatgtttgaccgttcgtcttattcaaaaacttttgtgaaatatgtaaaattatgtgcctacataaaaatatatttaacaatgaatcaaatgataggaaaagaattaataattacttaaattttttgaataagacgaacggtcaaacatgtgctaaaaagtcaacggcgtcaaacatttcgaaacggagggagtaacatagttgaattctgggtatgcataatctagaatctctgttcaccaagatcaaccgctcaagcagcaggtttttccagcacaagaaaaatatgaaaggggaaaggaaaataactttgcctctcatcattaatacgattaagctctgaagctgcccaacttggatgtacatgctgcaagtcctccatagaaagtatggatatagactaaataatacagcatagcacttgtggtggacactcacggttcaaaggcctttcaatttttaaccatgtaaaaagaatgtccagaaagcatgacaaataactattggcaaattcattgccataaagttttacagcagaatcagcatgatgctgtcatgtagtagggacaggtgcttttgtttcaactaaagatgttgctcatacaagggaactccattgtgagttcccttttgagatttgttcttaattcttttagatagatggcttcatcccataaccactagcgccagctgattcataataatcaaaacagactcaggctctagcttggtctataagtaaactaggaattgcccctacagtttctttgaagccaagtgccagtaaagtctcttctacatgtaccaaaaaaatagcatatcactaccaaaccaaatacattaagaaagtacatagtgcacacctaggactggtcaaaccaactggaaaccaatgtggctagattccattaggatcaggtgattaaattaaaggtcaaagagacgtggggtccttagcccgggccagtcagtgtccctctcggaatgtgatctatacaggtcttcttgcgatgcacatgtgcacgtaacttaatcagatgggaaaagatatttagctaggttgattagtgtcggccattctggacggttcctatagattgcatcttcagcaatgatagcggccataccttgagtctagcgaacaaaatagggaggcgtgactattaaaacatgtctccgaattcattacaagaagatagcttgatcttctctacaaaattgtcaatcatttgttaatttcttgaatcaaattgggtctttaactctttgatatcaaaaggatacatctttttgtttctgttgatgattttccttatctttaatgttgctatcttggttgcataaaggatccgtgaaagtagaggaacataccacataccgacaaattaaaaggaacagtacattatgcgattcaaccacaaaattttgttttccttgcgcacaagttgcgatacctgaagcaatcgaactagaatattttatttcacaaaaaggaaacccatatttttccttgtcttggcagcaagaaatgaaaatagaaaagattcctaccgctcgctgagccgagcgtgctccatgaggcggtaggtgcatggaacgcgacgcgttaatcagaagcaaacaaacgcaaaacgcagcatttctacttgctcagttgattcaccaagcagaagagtatgaacagcgcgcagctgtacctctcgtcgccgcatttcatttcaccgagcacgcagctagcatggacaggatgcaagctagagtgtatgtttgaacggaattacagaaggaagaagaaagaagaaaaaaggaatctaacctttcttccgctcgccgcggccattcgtcgagcaggaggcgtgcgtggggtcgtcggacgcgtacccggccgcgccctctccccctcctcctcctccccttcccgttcccgccggcgacgaaccccctgacccaccgccactcccgagcgacgacgcgatgcagctcatgctcgcgctcttcttcatcgccacctccggcggcgacgtgagccgcacgccgaacagcctcaccccgcctccgcctccaccgccgccgcgggcggggcaggtccgcgcgttgtggccgttgttgctgcagtgcgagcaccgcctcgtcatcgcacacgcaccgtgacaccacgagatcaccaaaatgcgtcgcctcgtcgaccctcgccgccgccgccgccgcgcgcggtgggttttctccttctctatctgtcttcttgttcttttccggggaagatgatatttttggccacttaaaaagagcggcgagttgaagtgaaatgacggaaaaggacatgggctgcggtggtggggggcgggggtattttgggaattggcggcttagctgtggccacgagatggacaggaagcgacgggggcgagcgtttcaccggcgagtgaagcggaggaggcggacacgtggcgcctcccgccgccgcctacgacaaagtacgacgcttaattaaccacagtaaaactgcctacggcccgtactcgtaaacacaactttaactttttatttctataaaaatatttattgtaaagtgatatatatacttttataaaagtatttttttaagataaatctattcatatattttttatatttttaaactcaataatttaagagatattcatgatttatattcctaaaatttgacttaaacattatcttaaacgacttcctttataaatatagagagagtactttctttgtaaaaaaaactaacttctgaaaatgagtctgaaaaattatttatctaaacttattcctaaaatgttattttttttaatgaatggtgcattactctgtcttaaaaaaaatcctacctacgaatctagataatacgttagattcataaataagattagattttttttatggaggggtaggtagctagcttgatcacaattaaaacggtactccctttggttttaaattggagtacaaaatttttaagctttggctagtctctgtttcttaaacactttaattaatattgtacgttttagccccttcatcccaaaactctctccatttcttttttatttggcattgcttagttaaaaaggaatgaagggatatatgcatttttagattcttagcaaacaaagtgttctaatctctacagatagagctagctacttaattcttcatttatagtgagcatgtttcccaaattgctaagcggtgcaattttttaaaactttctatatgaaagttttttaaaaaatataaataagttaatttgtaagtttgtaataattgatacttaattaatcatatcctaatcactcaccttgttttgtgtgcgaagaaaactctgcaaccaaacacaccttcgaacgaagcctaagtttaacagaagatagtttcttttagtcattttagtggtaaaattttgaattctgaatagcttatgttccctttccaagcatctcactggctgaaaatgcataaattccatgcatatattgaaatcaatgtcccagaaaatgctatattatgatataaattttaaatcttaaacatacttatattttgaaacatagggaatatcgtaaatataatcagaaaaagatactatatatacatactaatttattcttatagaacttttacaaacactaatgtgtatatagtgttgcaagtacatctaattaaattctctataactctcatattttatatagtaaaattaaatggttgagattattgtttggaagagttcttttagtttcgtgtagaaaaccatgacgactttcattaatagtagttttgatacgattaatatatagtcaaccgtgacaaatacatattaggatatactagtaacaattgtacaatgattttacatttaattagcatattgacttcttgattttaattaaccgcggctgttacttgctcctgcatcttcttcttcaccaagacaacaacacacctctgaattaattatacagtagattctgccatattcactgcatctcgttgtgtgatgaaggtattgcatgcattgcatggagatctcggaatgaacgatggctagctagctacaactccagcttaattaagccattgacttgatgatagttcatacctaggtatagcagcagcagctttttttttcctctcctttttcccctatttttctcgacgccgtgaacgcacgtctcttatcttgtcgtagataaagaagaaaagaagatccatctatccatccatgctacgaaacagaattagaaacgcgtctctctctctctctctctgacttccttgctagcttctcctaccactatgaactatcctatacgctatagctactatcagatcttctattcatgaaagtcatatgatctttcttttttagtttttagatatatttatgagagtgtgatattttttttatatatatagataataatatgagtgagatttttggatgttttctcttctccatccatctcttccattgcatccatgcatccatgccaactaattatactcactagctgctagctatctagttcctgtctacagaaaagaaaaccttatcttcctctctcagcagcttcgtagcaagctcacaattcattcattttatgcatgccatggaatgttccagaaacgtacgtgaacctcatggaaaattacacgacctgctgtgcagtcaatacgtatgtaatacacgctcgtgctattactttaactcaccgctggaatattattacaggattaagggagcacatcatgttcaacttgcagaaaaaaaactgacttaatcggctccacacaccccaattcttcagataaaacaggtataaattaccgatttatctctctgcgtgtgtactgcaaattcagatatataagtgttagctcaagagcataaacatgttcttgcatacttttgactctgaattatttatttttcttcagataaaaagggggcaagaaactttcggtatctgtctgaaagagctagctagctccaaagtctccaaagtaggtcaggaacctctctgcaactttggagcatctaggatagcaactcacttgctcactccagacgtccatgtcgttttcataatcttctatcttttattttggatctcatgtataatctgaactctgtatgcactacgcaaagtgcctgcatgctgcgtctgtcatttattttatcttatcttctctgcacaggtgttcgttcctagttaaaattgacagtttgcaagctagtagtaaacaaatgctaatcattgagacgcaaaaaggctcagatcgatctcgatcgagcaagtagctagggaatcgagattaattactgttctaaactgcatccgctgtatcattagtgcgctgcagaatctgatttgctgtcaggagcgttcagtttaccggtttcagactttcagtgattctgcttgttatattctggcttagaagagatgctaaatcaaaaggttattatatgtgcagattttgtcttctagttccaagaattgccgaataagtaaacatagtttaattaatgagtgaactgattgatggttaccgaaaagattgggatgctaattcgatcaacagctcgatcccctgtagatacagttgcatcaagccgaatatattacacgaactgttttacaaaagctataacattcagtgatatttgttccattaattgtcaaaaggaacattgatttgtcaaatcaaaaggggggcatcagttcatcactgaagcatgcatgccttcacttaaattagttctcatgtatatattcagttcaggaagcccatatgcatcttttctttatccatgtgcaggccggtttagcaaagcaaacaactaaagctgggtcagctactgggcaagtgtggtcacgtgttctttgccttatcaactaaggcatggactgatcaaacccatgaaatgataaaacgcatgtgcttttgcagttgcagtgcctgttcttttcagcttttcagtaataggaaaaaaaaagatgagatttgaagggagagacgtccctccaaatatttttttaaaaaaattataagcgtattgaggattgaacacaggagttcagagttgaaaccacacatgacacaatcgagtgcatctctagtagtagaaaaaataaaaaaaaatatgaaggaaagagatggagaaagtggcggtgtatgtgtgcgattgctggagatttcggcccaggtttagcccaatgatacaagagcgacccaatttgccaaaattatgaagcccacctagctatatccaggtttacaaaatgcgataaccacggttattattaccgatgaaaatcagcgaaattcgataaaaaattgccaaccatttaaattttgattttacatctttctgggctaaatgcctgtctacagctagaagacctgcttggccagaaaattggccacggcgtcgaggatgacgtaggcacgactgtggtgtcggatcgctgtcatgagctgggaaactgttttaacaaaacagctcgagtggatatatatacccatttattatatgtcatctaaattgttatgaaaaaatagaaaaaatatgaacaagatagatcaatatataatatatcaatgcacaaatatgcaagttaaaattcaacttctacaaattgtaacaaaaataacaaacaaaactcaaattactatatgtatatttgcaattaaatttgttgtttttgttataacttgtagaagttgaatttgaacttgcatatttgtgaagtgatatattacatattgatcaatgtttttgaaaaattttcgtaaccatctagttgacatgcaataaacgggtgaacgtccactcgaactagaatccatctccgtcgtgagctctccctacttgctgtacttgaggctgaaagccgttaggggatgacataggggccccacactatttttttaatttatgtgatgagtggtttgccatgtggactcaacgaaaaccgtctaaaaaacaattgagggagacgtttgaaaaggttttaatagttagtggggtgaggatatccggtttttagagttaaaaggataacagtaagattttggcattctaacctatattgagggactcaggttgaactttttgcaatccgaatcgatttgatagatcgagtccgaattgtagcggattctcaaggcccgcaaccatactagcccactagtccgagttgctagaatttgttgactttcaggcccagtagaatctggagatttcaacacgagctaagcccaaaatattgcggcccaaatctttcagctcgatagactggccccaaatggaaaacgtccactttgactcccttaaaagtaggccgaatctaattcatacccctcaactgaaaaaccaaatgaaaaaccagataagataactcctcgaactattgaaaccagtgcaatttgactcccttagcggttttgaagggtggttttgctgatgtggcgctgatgtggtggtgttgacctggtcttcatctcatgtgacgcctatgtgacaataaaattaaaaaaaatctgagagacccatttgtcattcaaataaaaaactattgtggagcccacctatcttcctttctctctccaacctttcttcctcctccctctctctctctcccttgtctctctcttttctttcctcttccgtggtgacggcggcgggcggcgctacccctgcagagacagcgggaaatggctcccactgtcggggggggggggggggggaggtggctggcgttcgggggcgtcagtgccgtccgattttccggcggagagcttcgacgaccggcggcagaagcaggtgttcgtccgtggccggatgcccagcgcggccgccgtcgccgggtacgtggtcctgtcggtcatgtccaccattgttgtaccgcgcctctacactgagctgaagtgccaccacgtcgccgtcgcctgcatcgtcgcgctggtgctcgccttctgcaacacgtacgtcaccagcgtcatcgacgtgaacatcgcgaccaccttcggcaaggtggtggtcctcgcattcggctcgtgggtggggctcaaggacagcggcgtggtcaccgggctcgccgcctacggcgtcatcgtggcgaccgtctccaccggctccgacctcacccaggccttcaggacgggctacctcaccctcacctcgctgcgcgccaccttcctcagccaggccgccggcatggcgctcggctgagtcatcaatcacgtcatcttctgggtgttccacaacggcggcggcgacggcatcgccatgctctgatccgaagaaatttggtgtcctgctcctgcgcgtgagcgtaacgacgtcaggaaattgctcccggatttggagcggattcttgccttgtaggaagatcctaacctatcatatcttattctacccgagctttgcgagcgtttcctgaaatcttcctgtgcatcttcaagaagtcatttatctctttccctaaaacgcattcggttccaaattaaggctgacttgtataaacgctactataagcccgtaataacacggtaattcttgtttggttcaaaatcttgggtaatgagtagtagcaagctcgccatcacgaggagacgtccgcgggactccaccaggtagcggacaactcggatactgctcgcctcgccggcaaaacgggtccacctcgacctcgccgtccccggccatcttccccgcacccccgcgccgtccttggcctcctcctgcagccgcacccgtagtcccgccccccgccgccgccacgaagaggaaagaaaagagagagaagagagggaggaggaagaagggttggagagagaaaggatgataggtgggctccacaatatttttttttatttgaatgacaagtggatccctcatatatttttttaattttaatgccacttagacgtcacatgggatgaagagcaggtcagctctaccacattagcgccacgtcagtaaaaccactcttcaaagccgctgagggagtcaaattgcactggttttaatagttaggagagttgtcttatctggttttccggttgatggatacgaattagattcaggctatttttaagagagtcaaagcggacttttccgccccaaattgcatctgtttttaggtgggctagctactcgtctgaatcatggatgctaaagattagcagagggatcaagcacactaatcacgttcatttgtgtcggaagacacgacaaatcaatttttgttgattgttattatccatcgccacgtgcagagtgacgtaacgtgaatgcacaggagactggtgtttggcgtagcagcatgtgattagttagttagccgtcgggattgtctacactactgctgatataatagcaaacacgaatatgtaaattcgaattcatatgtcaaccactgttgtcgcgtcagcaatattgcataggatttgcatccaaagttggtgatgaacaagcctcaggtacaccctggatcctagagtatttggtactacaagcagatgcagttttcgtttcttacttttgcaaagtcggaaaaaggaggagagtacttttggggttacaagtcaacatgagtcaacactactagagactgcgcacatgacaaaggtgacagataagagagaacaaagaacaaagaaagttcccctgcccatccatagttgatcagattcggacgtgacactaaaattcacaagaagaaaagaaatctataaagttcttaataagtactgctagtattctctctattttataatatacatatattataaatcgtttgtctttttcctattaaaactttgttaagtttaataatacctttttaaaatatattttgataatatgtttgttttgtattgaaaatactatttatttttcgataacttgatcaaacttaaaaaatatttgattagcaaaaagaaataaaataatttataatataaaacagagggattaataaagaaaaagaaaaacacaaatatcaatgaaataaccaaaaagaaaatccagaaaggggaggaatttttcttggcccaaacaccctgaccgtccgaggccaccaagaaagaaagagagagatccctttttgctttgcgcttttgcaaacccttttccaattcttcttctttgcgcctctccaaccttcctccgtatatatcaatcatcgcccaactccagctcccaactcccttccctctcctctcctctcctctcctcatccggagacgccacgccgacacgcagctgcgtgtgcgaggaggaagaaacccagaggagcagcaggagcgaagcaggaaggaagcagaggagagggaatccaaggtgagggagggagagcatggagtgctccatctcgaggacgaatctgaattgcatcagcctgggtgacccggacaccaagaaatcggtcgcgctcctcaagcaggtcttcttcccttcttggaattcgcgattttctttaggctgtactactactctggatggatggatggatggattgtcttgacactctggataggatagcagaaagcctggagctttcttcgttgagaattacgatcatcgctaaatttcccatctttgtgttactgctatgctagtttcttatctgtacctgtccagggttgtttttccacctccataaaacgttcttcgattttatttttctaataacaacaaggtactctagcatctaggaatctgcgtgttacaaccgtttcttttttttttttgggtccatgtagcagttcattgggttggtccgtagaagtagatttctggatttcagctatgtgcatcggttcaacaaagaaaacgtgtcctttgttattgtttactctgcttggtttagtagagttatttgcactgatttgtgctaccctttgtcaactgttgctttggcctggatgctaatacctcgtccttagcatgattgcaccttaaattaaggattagtagtactaaagatttgctgaggtgagatgagagtgacatgccatggcctgcctctctgatctactatccaactgccatggaagcaccactgaagactggcttctccgaccttccacccgatcctgggcgatcccggatcgagccagatattgcctggaggcccttctccctatgtttgactcatcctagatgggttcacacttgtcgattccggtcaaagaaaaaagctttttcacggtcccatcacaccaatctacgcaacttgcagtcgtcgagcttggatggaccatgttcggtgctacttgtttggtgtagtcatatcattacctggatttgtactacattcattttcgatcacaattccccactgtgcaaatttgacctcagtttctgttacatatgcccagttttagaagaatatcaaagtacaacgcgttgcgtggaattattctagctgtaccattacattagttatctcatctattagtcagttaatctgtgccatttgtctaaactattaatgttcatcttacctataggaactgaatgagaataagatggcactttgcagtcatatgcataaacttctaacatcatagtattatattcctagttctactaaaactgtccaaggactaccatttgtgccttgagaaacattttacaaggttagaagctgatatagctaagttttctattatcgtcagatgaaaaatatagcaactgaattacatgttctatcagtgctgtaagtgggtcattaggcatgtctttgatgtgaactttcagacttcattgtcactgtgctctgctggttctatgtattttaatagtttttaaccatattttttcctaaacaaatgtttcatccttcttcataggcatgtctggattcaggcttcttctatgtggtggatcatggaataagccaggagttaatggatgatgtttttgcccagagcaagaaattctttgaccttcccatcaatgagaaaatggagcttctccgggatgagaagaatcgaggctatacacccatgctagatgagattcttgatccagaaaatcaagtgaatggtaataatatttaactcctgcatgtgttgtttattattaaaattgcatgtcatgatgtactgacatactcttggttttgagattattagcaagctattaaaattggtagcaacagtacctcccaaagaaaagttgataaaaaaaaatgttatgcatagacagctgccttgagtaaacctcatttcattttctacagttatgtagtttttcctgctccaggtttcatactattcatacttgtgcattttcaggtgactacaaggaagggtattatataggtattgagataccagaagatgatccacaagcaaacagaccattctatggtccaaatcagtggccatccgatggtgagttgtctttcttctgttattagaaaaaagaaaagatctcttccaaaactgaatgctaatgaataaaatacacactgtctaagttattccatctatactatgctgttatgaacaacagtgcagtgaacaatatatacatgtcgaacttcaccagctcaactattatactcacttcgttacaaaatataaggtattttgattggatgggacacatcttatatccaaattcgtagtaccaagatatctctcatccaaccaaaataccttatattttgggatgaagtgagtatgttggtgtggcagtaaatccaccgaataagcttagcatccattagaagtactaaccctttgatctacaattcttatactttggtacttgataggaaggaaagttcctcggaattgcatggttttatttacttattttgcaaaattttcccttgcattatttcagaagtattgccaagatggaggaaggtgatggaacagtatcatagcgaggccctgtaagttttggacatgctgaacacacaatcaaattacactttgctatatatggatcagttcaacaattaatattgtcaagtgatcagtgatgatcaattaggtttaaacacttatcaactagccgttctctaaacctgactttgcagcaagttttggtgatgctctttttgtatgatttattactgtaatgatttgatttgcattctaatgaattcaggagggtggcaaaatcaattgcaaggattattgcccttgctctaaacctagaagaggacttctttgataaaccagaaatgcttggcgagcccatagccacattaaggctcctgcattatgaaggtggacaaaaaacaggtcatgcattcttgccgttcagtattttattacacaagaaacataacgaattctgtcgtttgatgttccttttttcatcaggtaaagtatcaaatcctgcagagggagtttttggagcaggtgcccattctgattatggcctaatcactctactggcaaccgatgatgtagttggtctccaagtaaatgcatcttgaatcgacaccttatcaaatgtttcattgattttcgtgacttctaataaaatggtagttttccatctgaattatgcagatatgcaaggacaggaatgctcagcctcaagtatgggaatatgtagctcctgtaaaagggtgagcttgctaatctaatcacttagcaatatttatgccaaattctgatttctgtgttggcagtataaaattgggatgtatcaatcataaggtattctacggcctatgccaactgttagtgaagatccttacatgttttccctctattttccagaggttttattgtcaatcttggcgatatgctcgaacggtggagtaactgtattttcaggttggccaaaccatcccttaaagcatgttctttggagtcattgtttttctttaggagaaccatcttggtgtcattgttttttttactaactgttactgttctttattataatacggctgtctgcatacctgtaggtcaaccttacatcgagtggtcttagatggacgagaacgtcattctgtaagtttcttctcatacataaatcttcatacaagatgagctaactcgttaacggcgctgcaagcctctacaaatcttacaaataaatcgaatggctttaattactccttttccaattcttcaaacagattgcgttctttgtggaaccaagccacgattgcgtagtcgagtgcctgccaacctgcaaatctgaatcaaatcctccaaagtaaggacacattccctttgatgatcacaattcagcccatgtccataaccattgttcatcttcaccggggcgagaaacataatgtgtgttccattgtccaaccaggttccctccgatcacttgctcggcatacctatcgcagcggtacaaggatacgcatgccgatctgaccgcttacagcagcaacaaggcctagaaggccaagcgccattttgatctcatccaagctctcagctgtacttaagatgtacaacctgcaataataatcccttaggatggattgatggtgttctatactaattaaattaatcccagtgtacctgtaaccccagtctcatagtgatatagtagtatactagtgatagtacattgttcatgaagtgaggagtgagcagtggcatctgtttttgtactaccatatgtgtgggtgagctccagggctcatgcttttcgctgtcgatttcccatctgctttggggcagatatagctttcgagttggatgtgtggataattctggtgtctgcatctgttttttggatggttggtaggttggtccggtccccgtttgtggttgtggccgggatatgcgtcgtgaacgcgtggctgcgtctcacgccaggaactgtgcgaaatgcgtagcgtcacggtgtcatgaggcgtcgagatctgggtaggaatctgccctttcttttggatcaataatttccagttgcacgctattgagcttgtggtgtgtgcgagagtaaacggaaaggatgactacaagtagaattgacacttctatttgggaatttaccgtgtacagtacttgcatgtgacagcgatttcagggtcactaagtagtagaattgacacttctatctgggaattcgatcagtagctgtcgtagttatttcattgatgtacacttctatttgggaattcgatcagtagctgtcgtggttatttcattgatgtgctgcaaatcgtactgatcatgcaaacggctcgttgcttcaaaggataaggatgttcaattttgattagttatatctctctttctgttaggtgccttaataaatgcttctggtggtagcagaaatcaaacaggtcagggaagggcttttgctgttggggaaaataggagatttgcggcccattacaatggggactaaaactatgtgcttattgcactcattataatcgatctaaagaatgacaaacactggtggtacacatggagattgcttccataatgttacaactgatgatttatatagacagataaaatgccttgcagcagcagcaacggcgacaatggcaacacaacatagcagtatctctactgcattggagacgagcgaacggagaaggctgcgccgtcgttgagaggcagcaagctataataggcgccatctttgtcgatgcagcacgcatgccacttcatcttgtatgaaccctgaggaaattcagacacatccagcaggcagctagagaatcccaccccactgtcactcgcttcgaaacgcgcaaatgctgtcaccatatccttctgctcaacatggaccttcttcctccttttcttctccctcttctttcccaaatcatcctgtacgaactgcataagcttggtattaagaccaaccattccagcagttttcttgcgtatctcaaactgtttgcttcttgttcctgttacatctaagcaggaggatgctgagcttgcagctaaaacgcagtatagcttcgagatatcaatgtcactcctctctaacacacatttccactgcaagcaaagggtcagggaaagctggaaactacttggtactgatatcccgtctctgttttctggatttgaatcatataaatgaagttcagcaccaaagcaaggcctgcatgatatatagtaaacaagttaaccattattacagatctccgtgaccgatgcattactgaaacacaaatttcagagaggaatggtgagatatacataaaataaaactctgtgatcatctacctaggcacatgtggcttctgaaaaaaaaaattaagttatccagcatggtgaacttctcatccacaactaattttaagagaacaacatgcatacgataccttactctgaagaagtatttgggtagaacaaatggcaattccataaccctctgcaaaatgttggacagaaattgcatcccttcatgcaaaggagatacactgtcctctccagtcgctattcctctggtgtccccacgtaagcgaagcaaatatgccacagcaaacttgcaaagacgataagaatccttttccagaatacctgaacaattcattcttgtgacaatctgtatggagtgcacttcatcacaacaaatgggcattaattgttgcagttgtgaaacaatttggctatcagtcctatccactctttcatgtaaatcttgtacaactgaagcatgagaaaacctctctggaagcctgcaaggctccacactactatgtacctttgagaaatccacagaaaatgcaatacaaaatgccagaagtgagcacatgaaagcaagcctggctatgctagaaaaactttggtgatccatgtccccatgggatacagcaagcagatcataactatgtgccagttcacttaatcctaacgaacgattcaccaaagcaagtaattggctgttattatgctctctaggtacacttgaatggtctccaatagcatcatgatgagattcgtctctctgatcagttaaatctgcagtaaggataccaagaaaatctgctaggatctcaagaaacgatgccctgagactaataaaccacctctggaaaaacagctcatgacttgaagaggtgtttgataagaggggatcagtagctaagaacgttctgctgcaaatatcggtaatctttgcttgggaaccatgcaactctgaagagtcagcaagactactgtcaacatttgtttcaacccagtaaaagttctcatgaagatcgcaatctgttttaagctcattgaccaacttaatgatagctgaagggaaaagcagtagcttcatctcaatctctccagctgaaataagcagcaatgatttgaaccaaaaactgaaagagcctgacccaaaatcatctgcaagttttctgaagacagacgacgccgcaaaccagaggccttcncgacaacagtacataaaaaatctataggcatcccaatacctctggtttctgaaaagcatttttgttatccgaattgcacacaactcct

SEQ ID NO: 62523 - DNA, 527 bp, Oryza sativa
acagcgcaagtggggctacgaggaacagcaggatcggctccgccagctgcacggccggacgccggcacttgttgtggactccgccgccgatccgtctatgctgggccttactactgactccgtacatttcacggtaagataccacgttgtgccgctactagattagaatacataaaagggggggtggatggtacacaatctatgaagttatgtacgatttgttatatatccattggcgtaacaggctcacacaaattactagatccgcattggcactgataatgattctggacgtcctccactcgttctaaccttgagaaagcccggactcctctcacctgctgctttcttctcataaagaacaagtgctgaaattttgaaaacgaaatgtgtgacacctctaaaatctaaataattgatcgaaaaaagttttgaaaagctagagctagcaagctgttagccgatatatctttgatggtctatggctgcagaatttgtgggcttgtgctacgcatcccacctactca

SEQ ID NO: 62524 - DNA, 1490 bp, Oryza sativa
taattggtagagaagagagatgatgtatttattaatggcccactttaaggaaccatgggttgtggagtgtagtttctattatgatgtcttattgacatgacaccatagacactacttatggacactatgggttgggactgcccttatattttagaatggagggagtagtaactaaactcaagaatcaactttagtttgcatatactctactagggaaccggttttctgtaacaggtcaagtagttaaattagaaccatttacatttataatggcctcatctataatgggatgttaatttgaccgtcaccgatggtgctggaagagacaacccattaaatatgcaaagtcatgtgtaatggttcgttattaccattgagttccaagctctatccgccatcagagttggggcgaggaagatagtctcgatatagaatgagatcaacggtgatggtgactagaggagaaggtggtgtccgttggtggagggctagaggatccctccatcgagtcttgggtgacctccacggtggtgctgccagggtttacaaaaccgcgcggttaccacacgcggtaacctttttagtttttgaaaccacggtatgtctcgcggttatgcggttaccgcaggggtgcggtaactgcaccaaaaacggtaaggccgtaaggggaaccctgggtactgctagacgtgggcatcactcgagatccgtcggaggtagccacttgaaggcaatgcaactatgcggggaccgctggtaatggtgaacagcttcccaccaatatgctctcggtagaggccaccaaggtggagatcctatacgtgtgctgggcgaggagaactaggtctcgcatgagtgccgatggtagggatgctctggtgcggagggctctgtgtggagaggttgtggcatcaatgatgggagactggatgggggctgccatgcgtggtcttgcatgaatgtcctatgtgagcccaccgtgttatggttgtctctgcccaagctttgtcaccgttggtggccgtcactgccgttgcctaggtcaatgtcgtcatggggtcggggcacagagaaaatgcaggcgccttgggtcctagatgtgttctggaggttttggaccagattgacacactgtaacaaatatcgagatctagatgtacatttcgaaattacatgaacctagatgacatatagaatgataaatttaggaaccgcccgtgtattttaatcttcgttgaatattgcatgcatgcaatcgtaaatcgtagcaatccctcgcgccgcaacttccattggtgtacgagagataattctactcgctggttctcgaaccagtaaatcgtagcaatccctcgcaccgcaacttccattggtgttcgagagataattatactcgctggttctcgtgccagaaaattgtagcaacctctcgcaccacaacttccattggtgttcgagagataattctactcactggttctcgaaccaat

SEQ ID NO: 62525 - DNA, 545 bp, Oryza sativa
aactgggtgaggaaatggtcacctttagactctgcagcagttcttcagcgttggtttcattggagcaagggctggatggcacactcgcagatctgaggtggaatgccatggctgcagtggaagcttatcctttttctcttctctgtggaagtgaagatgagaagaatgctgtgctgcaatggtgtcgacccggctatagctttcctctatatagacaaagaggcagaagcaatggcatccctcaccgtgtagacaacaatgaaatctcaataataatgaagtgctttgctgctgcaacagacgccacccatctcctcgacaggctgatgtttttttatgtttcccaaccaagtgtagaggcatctctagctcagcttacaatgctgtcatgtcctgattattggcggcaagttcacctgcacaagtgtatagtctaatgtaatattcagatccagatcatgagaaggatgagccttgctcacaggagcagcagttgacttctctctccaggctccaaaccgtgtttcttatatggtagaatctgc

SEQ ID NO: 62526 - DNA, 12997 bp, Oryza sativa
ggaacttccagcgtatctcctgccacggcatcgacagatgtcgtgcccatgggcgggagccgggaggcgatgcctagcggccccgtcagcgatcccgctgggggtcgtagtctgccagaggccgtcctcacctgggaggagctccaagtcgagatggggcgccttctcgaagctggtgctcgtggcatcggccgcgagatctcggaggcgaggtcggaaacggcggcggcgaacgcgcgtgccgagagattggttcgcgaactggctgaggcccgcgaggacctcacgaagatgagggagctggtggccggcaacgagcgtcaacgcaaggggctcgaggaccgaatgtcggaactcgggaacaatctcttcgagatccgtggctcgctgcgcgtcacctatactggcctccaccagctcgctgaggagtgcggcatcaagtccacaatctcggcgaaccccaacgagttctagttgacttcctctcttgcggaactggcgacggcgatgggggaaatcccctccaagcatgcggccaggatcgcggaggagacgtcgaacggcatctacaccggggcgtgtcacgtcctcgcgtgtgtaaggttgtcgcgtcctgaactcgatctgcacgagatcttggatcagggggcggcaagcgacacacgtaaggaggtgatggaagaagtcggtgacctgggggagtctgtcctccccctctttgaagagtaggatttcttgtatttgttgcatgatttgtaaatcttgaactctggctaccttcgtgtgtacaattaccatccttgttcaatgttgatctcgggagtttttttgtcgattgtagagatgctaatgacgaggatgtccagcagcgggggcagcctaagtcactggcgataattccagtactcgagtttgaaccacatgtctcacctgatgtcgaggatcaaactcttgatgcggagctcgagatggcaacgactacctcaagtgagtagcctttttacctctgtgttgtcttaggggtatccagcttgtcttagtggtcgtcacgtttagtagatctcgaggatgcccttgcaacccaagatcgtcgtatccaatactggaagacgaaatttgaagtggcggaactcgagagaaccatgctagtcgtgaagaaggagcaggccgtggaaacgctccgaggccgcgaggtgtggtttgcgtcgtacttaaaaagttgctgcacctcaatggccagagtatgcagggaacttcgagtagtccgcgccgatcctggggaatcggcggccgggtatatctggtggctcaacggggcttgtgcccaactcgatggcatcggcaagtgtatcgacgaggccttgaagcaagagtgtcatcgagtgagccgatacaccggaggacatgtgctggcttgcctacgagatcaccgcccgcgcctggacctcgaattcctccacgaaggttttgctcgttcccggaggactccggcggagatagaccatcttgcgaggtcgatgtcgccgttggctgagaaggtcttccagtctatggactggcattggccctcttggtagtactcgtgccctgtcataggtatcttaggaaaaatgtaatgtagtgggagatctatgtaaaaactgtaagaattattttgtgaataaagaaatattccttaaacaaatgtatcttactctggatgttgtgtgtaagagtgtgttctcagttaacgactttggccatttgagtcgtacactctccctagcctccagccttgtcatcggaggaattttctcgggtgataaggctcttggacccttgacctgccttggttgaataagctctgatcctagccaccagccgtgaggttggaaagttgatttccgatttcacggcttggttaatacgcacggcgagaactcttacacaaccagatcttacatggtcttttgtctctacaggatctgacaaggccttatcggctctgggcgtccccagccgaagatcccttaggttcctcggaggccttgttgagacggcgtaaagggacataaggacaggtttcaacgctaggtgtcatcagagtgagggatcatcgggcgaaaacaccttgattgtgatatggggcctagaaataggctttattgatactgtaagggtgcttacaggtacagcggtattgactcatacatagaatttacgtagttggtcaatgttccaagagtttgctagttcgcgaccgtcgccgtctgcgattttgaatgcgcttggccgcaagacttgtgtgatcgtgtaaggtccttcccattttggtgagagtttgtttcgccctgcttgggtttgaactcgtcggaggacatagtcgccgatcgaaagtatgcgtgcttggatgcgcgtctcatggtaacagcgaagggcttgttgatagctagctgcttgaacggcaactcgctcacgatgctcctcgagaaggtttacatcgatgtctcgctgttcctcctggttctcgtcggaatacttctgtactcgtgtactttgatgtcgtagctcgccggggagcatggccttagagccgtacaggaggaagaagggtgtttccttattggatgttgtcggtgtggtgcgtacggcccatagtactgatgggagttcttcaacccactttttgtcgtgtgacatgagtctgtcgtagacgcgggttttcatcccttgtagtactatgccgtttgccctttcgacttgtccgttgctttgagggtgagagaccgaggcgaaacatattttgactcccaaaccgatgcagtaatcttggaagtcagcgctgatgaattgagagccgttgtcggttatgatgcggtgcggtagtccgtatctgcagaatatccctctgatgaatttgatggcgttgttggccttgatttccccagtgggtactgcttcgatccatttggtgaatttgtcgatcgccacaagtaggaatctgtagccgccctgtcctcgtgggaatggcccaagtatatctagcccccagcacgagaacggccaagtcagagggatagtctagagcgcttgcgcgggtagctttgtgtgtttactgtggaattgacaggcttcacatcgctggaccatgtcgcatgcatcattaaggccggttggccagaaaaagccttgtcgaaaagctttgccgaccaatgtccgaccggcggcgtgtgacccacatatgccttcatgtatgtcgaggaggagttgtctgccgtcgtcggtagagacgcatttgagaagtaccccgtttggcgcttttttgtataaatcgttaccgaccatacagtagatctttgctttacaggttattttctcggcctctgtatcgtcctcgggcaactcctcgctgctgatgaatttgataaatgggatgcgccagtcgtttgtggtttcgatgtcagcaatagcgcgttctgcctcggtgacctccgagctgatgtcgggggtgttcgggccaacttcgccgctaacttcttttaccgatggttttgtcaggatgtcgagaaaggtgccgggctcgagcggttctcgtctggacgcgcgtcgtgctaggtcgtctggctcgacgttgtccttgcgatagacgtgtcggacctcgatcccatcgaacctcttctctagcttcctgacttctgcgagatatttggataactcggggttagagcatttgtagtctttgtgcacctggtttgcgactagctcggagtcccctttgacgattagtcgcttggccccaagtgcggctgtagctcgtatcccggcgagtagtccttcgtattctgcagtgttattggttgccctgaagttgaggtggattgcgtgcttgaattgatcgccgaagggagatgtcaagataaatcctgcccctgctccttggctgttgagtgcgccatcgaacgccattgtccatgtctcattgtcgccttggttgtctgatttgttatctggcatagtccaatcggcaacgaagtcggcgagtacctgggatttgatggctgttcgcggcacaaagtggacatcaaattggcttagctcgactacccatttcgcaatgcggccgacaacgtctttgtttctcacgacttcaccaagggggaaggaggagacaactgtgactctgtgggcttgaaagtagtggcgtagtttccttgatgtcatgatgactgtgtaaagcagtttttggatctgtgggtatcttgtctttgcgtcatggagagcttcgctgacgtaataaactggtcgctgtactttctctctcgacgacaatgacggtgctaacggaatatggcgtggcggcaatatagaggaataattcttcattaggttggggagcaacaagtacaggagggtttgataggtagcgcttgagtgcaataaatgcctcttcggcttcctgtgtccatacaaatttgtcttgtttcttcaacaaagcgaagaaaggttgtcctcgttctcccatcctagtgacgaatctgcttaatgctgccatgcatccggttagcttttgtacctccttgagtcttgtgggcgacttcatgttctcgattgctttgatcttctcgggatttgcctctattcctctgccagagacaaggaatccgagtagcttgcccgacggtacaccaaacgtgcacttctcaggattgagcatgaggcgatatcgtcggaggttgtcgaacgtttcccgcagatcgtcaatcaatgagtcgtttgtcttggttttgacaacgatgtcgtcaacgtaagcctcgacattgttgccaagctggttgctaagtgtgccctcgacattgttgaggtcggtgaagtcgacacacattctccattttccgttggccttccgcaccataactggattggctagccactctggatgaagtacttctctgatgaagccagctttgagaagtttgtcgagctcttctcgtatggcttgtttccggtctggtgcaaatctccgcggtctttgctttactggcttggcatcgggtcgcaccatgagtttgtgctcaatcacctccctagggacccccggcatgtcggacggctgccaagcgaacacgtcggcattatcgcggaggaaggtgatgagcgcgagttcctatttctcgtttagtgtcgccccgattttgacagtcttgttggggttagcactagagagtggaatgatcttgatggcgccgtccggctttggcgtcttatttggcttgctcactttcttgggtggctcagtcatggcgggtgggctgggcatttgctcgaccatgtcgaggctccgcttgtcgcactgcaccgccagctttgtattcccctgaatagtgattgttcccttcggtcccggcatcttgagcacttgatacgcgtagtgagatgcggccatgaacttcgcaagtgcagttctcccgatgatggcgttgtaagctgtatcgaattcagcaacatcgaaggtgatctgctctgttcggaagttgttggcttggccgaaagtcataggcaacgtaatcttgcccaaaggtctggacaatgattggggagtaattccatggacgggttgatcggttggtgtcaactcactttgcggaattcccattgcgtccagagtgctggcgaagagaagattgatcgagctgccaccgtcgatgagaactcgcgctaccttgatgttccgaatagtgggttcgaccacgatcggatatcgtcttgggataacggaggttttggggtggtcttcctctgagaactctattttctgctcagaccacttcatcttgggtgcagccccctgccacgttgaacagacttcacgttccactttcttgtattctcgcttggaggaatacgttgtggagccgccaaagatgtgtgagacgtggaggtcggagtctggatacgcagaatccgattcgtgaggaggcgtctcttcgttcttctcgacaacacgtactcgcttgcctttttcaaacgccatgtgcttctcgagtgactttttgaaaacaaggcaatcctccagagaatgtatgtccattttgtgtatggggcaccataatttctttgtgtcgctgccttgtgggtctgggcgcttgggagggttcgcgtattctactgcgaggacttccgcttgagctttccttttcccatttttgcgatttttcttcttgcttgactcagatgcatctgcggctggtttcttctctcccccggtcttcggcttgtcgttcttgcgtcttagcgcatcatccacatgggcgcatcgctcaacgatctcgaataacctccaagtagttgtgatgcgtcttgtcgccaactcctgggtagtgtagcgatctctgacaccggatttgaaggcgtgaattacagaagcgtcggtgatttcgggaattgtgtttctacactcgttgaagcgccgaacgtattccctcaatgattcccccgagttctgtgttaacgcgtgtaagtcatcttcgatcgcgtggcgcttgtatgttccttggaaattggtgacgaattgttgccacaggtctgcccccgaagagattgagtagggaggaagatgcatcagccatgaacgtgcagaaccctttaacgcggttggtaaatagttagctaacgcattgtcgtctgctccggcagcatagagcactgtcgagtagacttgaaggaattcttctgggtcggtgctcccatcatacttttcaatagctctgggtcggaatctctcaggccatcggacatcacgtagggaacgaccgaaagccctacacccagcgttggggacggtgggttgtcggcggtcgtgtgaccttcgtggatgtctgtctgacgatgaagaggatgcggatcatgacgatgacgatgggtcgcttggttccggcgtacgattacgaggatgacgacctggatctcgggaatcctgtcgttgtctcccgctgttgtctcggcgccgatctccgtcgtcgtcgttgttgcggcgacggccatgaccagtattgtctggcccccgtcgttcgcgatcgttgtagtctcggtcctcgtttgggcggtttcctcgatcatggcgccgtgaagagacatgacgccgagaacgatttgcgtcgtctcgtgtgcgtcgtgcttctcggcgaccgttgatttggtctcgaagatcgccagtgccacgaggtggaggggtagcctatcgaggtaattccctccgctccggatcttcaccattggcgtcgtcaattggtggctaatcttggtgtgctgcggtagcggcttcttcaaacgcgttgctgaggttggtcaccgattcccgtagtcgttctgtccaacgctcgaggtcgtcgttcagaacgggattgtaaggagtttcccttagtataacttgaacagccctgatgtgctgggctagagtagtcgattgattcgccgcttctgcgttggcttgcgctgacgtgccaacatcatcgatagccaatacctcccgtggcgcacttgttgtcgatgacccatagtcttcgaggagatgcaagaccgatggttcgtgaggatcgatatcgattaccccaacaaatcgatctgaggctggagccgctccttgttccttgccgttatccctgacaaggacgtatgacttaggagacgaagttttcatggcgccgaggaggactttgcaactcaagaggtcgtgattctttgtcttgtgaataggacaatagacatctcgagttagagaagtacgctgaattccacgttctttgcaggcgcgaatttcaacgtggacgttgagaaaaacccagcaatcttgaagggtgtgtttcttggttttgtggataggacaccaagacctggtggcttcggaagtcatctttgtcggcccgtgatttatgtcggaaggacaaggtttggccgtatcagaatccttcccgagcttggatgtagtcggtaatccgttctccgtttcgacgggtggatttttcgacatggagtcgccttggttcgtagccactgcgttctcgtttccagtcattggaggaccggttgagatcggcatcgtggtgtaaaccgggaagatgatttcgccgacttgagtccataccagcattgttgaagcagggagtgcttggctgaagctggtgttgacgttgttgtcgatgaagctggatgacatagtagtagaaccttgagtaccaagttcccctacctggcgcgccactgtcgacgggtgatacccatagaccggatatagagggtattggggtacgttggtacaaggatctacgtagtacgacatcgagcaatcaaaagacaagaattatactggtttaggccccttgataggtaatagccctaatccagttgatgtgggattatatggtgaaaaacacaggttacaaaaggaacgatggaacttgtcggatccggcgagatcgtagtcgagtggattcgactagctctcgatgacttggctcctcgcagactccggcttcataggctgtgcgggttgttttggctctgagattcgatgttctatgccctccccggggggtcccttttatatcgcaagtctggagctctccgagtagaactcgaatatatcagacccaatacaatacgtagatgacctagttctgtccgagaaggactcttcccatctgtagatttcgtgaaaagtttccttagaacatacaggaaatatccgcgtacgcgtgggtatgccatgtcgatacgtaacgtatatcgaagggtagagggtatgcctgacccgtaaccctgacatgcacggacagagaggtggaggaggatggacgtagcggggagggggagggatcgaccgtcgaatgtcgttgggagggaagagccggatcgagaagggggagggagatgtgagaaaaagagagaacgacggaggaaacaagaataggaaagaaagaaagaacgatctaatccatttggttgaccttatccggactgggttttttactatgaaaaaaccgacaggtcttttttaaagaaaaacatgaaaatcgaataagtcaaacaaccggtgaggccataaattttgcaaaagcaccagtcatctttaaaattttagagcacagtctaatttttgtgatttcttctcctctgtatagtatatccaaagaactgaagggaccaaaataaaaaaaaacaacaagcttgatctaaatgagcttaccttaccctgattattgtaaagtatcaatacttttttgctaaaatacggacaatccgtccgggcgacgtggatgcaccatgagcgaatacttatttaaatttagccgataggtacgtctatatttatatctttatatctatatctatacctatatacctaactaaaaaatacgtaaggatgccgggaatattttcatccgtcatcatcatcatccgcatgtataggtgatttttatttacaagaaacagactctaagactggaactctaaagcttgctatagggcttaattctgaggtcgatagaatgtggtttttctctaattcttgggaaaacggaaatagaaagagataaggataaaaacccctcaattaattttagattatctccatagatgcggacagattttatggaggaggcggtttcccatggtgttgggaagttgtgggactcgatggaggtagggaatgacagtgtaacacttggacccacgcgacagtgagatgaggagcagggggacactgattagactgtggttgcaccaaccggatgtgcgcttgcaggccaaggtggaagggaccttaatgggccagctcggctgtggtctaaagaaaaaaatgggcttaaaatggcccatggagaaagtagggttttatttagattttcatttaaataaatgttgaaatgatgtttgtattattaaaactaggaaggtggcgcgtcgcgcgggcatttattttgttgaaagataagattatagtttattttgttgaaattttataggatttggcaactttgagagagttttgaggaagtttaattggcatatgtcgtatgatttgtttgagacacttatataaggataatattaaccacgttttctccctaaattcttttcgtcagctttgcttttataactttgtaacctagtagttagctttatactatatcgtagctaagtaatacatagaagctattatttatacttgtattcatcaactataaagaatggtaggcttattttctttaataaaacatgtctactaaattaagtgttaaagtaaaattaggactttttaattggatataggttattgttttctattaatggatgaattgtgtaatccactaaatgcattggtttatataatcttatatgattggtgcagttcgagatgcggcacaggaatccaagaattgagaattttttacggtggattaattttttttggattgtaatatttgtacgttaaaattcagcagctatcagtgagatggagtaacctgtcagttttgtatttttttcagaactgatgaattaaacattggtgctaattacatctaaattgtaaaaagtacgtttagttataataagaatgattaaaagaagcaatattaaacacttacctgataattgctgatcttcgttctttctacctcataatgttttcctatctgtaaactcaaagtagtagtccgagaaacatttttttttgctttgacctatttcattattgtatcgtgataaaaaaaagattgagactatttttcagtacacagtacttatcatgttccataacttcgaaatttttaaaaatgtataatgagtttatgttaatttttggcctaaagtggtttgccaattgctttaggattaaggcatgtattgagttatcatgaagaaaatagtatttacatagtagaacaatatattaaatgatatgttcgcaacaatcatacctctgcattagtagaatcatacgcgtataccatagaactcatcagccgattaaccgcatcccattgcctaatcactcttactttaattgtccacctatcatttttcttgttaacgcagtaattaaattgcaaggcgccatgttatctgcaaatgcgtatatgcaatataatgtatacatttatgttatttaatagatgcaatatagtgtagccctaattaattaatgaaggatagcattattgtgttgttctgtaggtgcacgattaccttcttttgccaaagacgatgaccagcctgaattgactaatgtcacaaaggtgtcgcacacctcttatgccaagatgagtcgccgagccgtgcatcgtggagattaaaataccatctggtcatggtgttcctgaaggagataaataatctgagattctcttgtacttaggagtaactaatcttgcctgcctcatcgatttaaaatttgctaatctgctgaccggtgtatatatgtatatgtagagaaaatctgagattacgttgatgtagggtaactaatcttgcccgctttattgattcaaagtaggaaactaatcttgagacaaatacgctccatgttatgatcacggcaaatacatgtactacacgtgtgggtcctcgactcctatgcgtaggttctcattgtgccatgtggcatgttgagagcgttttgaggaaaccacgtggcagttcgagagcatttgtagaaagttttatgggcttttagtatataatagataatagattagcaatggagctctaataattccaaaacaatttcacatagtgtaattaatcatggagaatttaataaaaattaaatccagccatattttatttgggaaatttctcatgttttcttcccgttgcaacgcacgggcattttttttttctagtaagtatgtatatatgtatgtatgtatatgtgtgtgtatatatatatatatatatatatatatatatatatatatacacacatacaccaaatctattctacgtccctcccttagaataactattctatacccccctcccatgggccaatcccacctcccacactcttcctagggcccaaatcccccctcccacctcagtcaaaggctggtcaaagcccctcccgctggtcaaacccgcccattgactccctccctcgcccaccactttattgtcctcgtctcacaggaattccgcagtaacagaacagtcatcgtgcagtaacaggacaactttctcgcagtaacgacatcaaaaaatagtcatgatggatctagttttgttaagcactttttacgaatattatggtgtagatggattagaaaaataatatataacgtgagagatattgctctctaaagattgagatttactatgcattactactatagtaccactgttactatgcatgttctctgttactgcaaattccaccatgctctctaaaaaaacattactactgtagtaccactgttactatgcatgttctctgttactgcaaattccaccatgctctctaaagaaacattactactgtagtaccactgttactatgcatgttctctgttactgcaaattccgcaatgttgttactgccaaaagtgcagtaacaacctataaattttgcagtaatcatgttactccccttttatgataatgttactgccgaatcataataacgaggtatggttcttgtagtaacataactgatttgttctcacacaatttgaacatacaaagcatgcaaacaatattttctattcacataatgtcacatgatgaattggttaggagagcttgccatgaactatgagatcatgggttcaactcttgatttcaccaatttatttttaatttttataaaaaaataaaatgataggagagagagagatgagagggatagaacaaatgaagaaaaagaaaaaaaaatgtataggaggtgggcaccgggagtagagagatcgggaggggaaggcgtaaaaaaacaaaaaaaaacaagaagggagagagagattgg

SEQ ID NO: 62527 - DNA, 2499 bp, Oryza sativa
ggacatgaagaccgagtgcattgctgctacagtaattcggcttactgtagctagcatgtatcatgtgcacgtgtgctgccatgattgaatggcaaggagaccaacaggagctggccactaggcttgtgggctggcagttcggttggcaggaaggccgagccaacccggcctaagcacgttgctgactcaagatggtgaaggctaggccgagcaagccctagacatgacgatggcccagctcggctcagcaaatgcacaggtgtgtgcatgcgcgcgcggaagcgggagatcgtacggcacctggaggcgtggcggccttctgttcgtcaaggaagcgaccgggtcccacgcggtttttcgcatggtgcgcgcgggaacatggttttcgcgagcgcgcgcagaagcggctcggtgggaggaacggcgacgtggcggcttcggactggtggtgcgcaggcgtgagaggagcaggcacgcgctctctgggacgcgtggcgcggatgcgttggcttggaggagcacgacgcggatcggtgcacgctgattggcttggagtggaatcacgcggatcgcacgagggcgcgcaacgtggagagctcggatcaacaacgtggcgactatccaggaggcttccttcggatctaaggaacaatggacagccaggattacatcaaggctagggtttcgccctagggatatttgagacaatgtcttaggggtcttaggctataaatagagagatggatgcaagggtggaggttgctccttttgtaatccttttgagatgctcggtgagagagtttcggtgtgagtttggagtgtgtttgcccgagaggcttttgtattaggattagtttggagtgtgtttgtccgagagattttaagtttgtgttaatgttcctctgaaggaatatgtttgctcttagttgagcggttattttgcatcacctttgaatgaaatgatttgaaggatttcgtttttgccttgttcatttaaattccgcaatttaaattctacttgcaatttaaactttgcgatgatgagttttgttatctcctcctcacctctcttctagtttgggaaattccttttctctttctcttctagtttcgggaatttctttctctcttcttttctagatccggcttctctaatagccgcggttctagtaaggatttttgagaaatccggcttgatgagtattttcgggggtaagatttgaattgctatattcaccccccctctatagctgttcttggtctttcaattggtatgagagcaaggttaagttcattgtaacctaaccgtggcaacgaacgccgctatggaggaaaaatattctgcgaaaccatttgttttcgatggacacaattttgtcatttggaaggcacgaatggaggcctacctccagtcgcaagggcataatgtgtggaataaggttaaatcaccttacactgtgcccgatgatgctgacatcacgcctgcaaatgtggctcaggttgattttaattatcgtgcaagaaatgcaatcattggtggaatttcttctggtgaatttaattgtgttcaacaccacaagtccgctcatgacatgtggactgctctgtgcaatttccataagggaaacaatgatattcaattggttcgtcagaatcaatttcataaagaatatcaaagatttgagatgcacccaggagagtccattgattcttatttcaagcgttttggagaaattgtttcgaagttgagatctgttggaaaagaattttctaataatgataatgctcgccatcttttgaattgtcttgattatggtgtttgggaaatgaaagttacttccatcacagagagtgcacctctgagtgaccttaccatggacaagctttactcaaagctaaaaacccatgagatggatattttccatcggaaaggcctcaaacactcgatggctttggtagctgatccctctggtagtacttcttctaatgactcagcttttgtgtgtggtggcttctctcttgccgctttacactcagtcactgaggagcaattagagaagattcctgaagaggatcttgctctttttgctagaaaattctcaagagcttacaaaaatgtgagagatagaaaaagaggaaaaaccaatgaaccatttgtgtgttttgagtgtggagagcctaaccacataagagtgaattgtcccaagttgaagaagaagagtgacaagacgaccaagaagcccgagggacaagggcgaaaggggaataaggatttgatgaagaaggcgatccataaggtcttggcggctcttgaggaggtgcagcttagcgacatcgactccgacgacgatgatcaagaaaagggggacaaggacttctccgggatgtgctgtctcgccaacaacgaggacttcatcaacctgtgtctcatggcacttgaggataaggatgactcatcggagcatcctgaggtatgtcttgatgatatcccttccttgg

SEQ ID NO: 62528 - DNA, 4237 bp, Oryza sativa
gacctaaacaagtgatctgcaagtttaggtactaggatgacatagtcgaacaagtttgaggatctgaacggtcgatttgcgagtttagggaccaggatgacacagcgatacaagtttagggaccggtgataaactttactcttgtcaaatcatgacgcaattaggcttaaaaggttcatctcgcaaattacccgcaaactgtgtaattagttttttttctatatttaatactccatatatgtgtccaaacatttaatgtaacagggtgtaaaattttgccagggatcaaatagcctttgtgtagtagtgtggttcgtgcatatatatatattgatcacacatatatagccgaatgcatatgagccacgtatggttaggccctatttagttcccacgcaaaaacttttcaccctgtcacatcgaatgtttggacacatgcatggaatattaaatatagaaaaaaaaactaattatacagattgcgtgtaaattgcgagacgaatcttttaagcctgattgctccatgatttggcaatgtggtgctacagtaaacatttgctaatgacggattaattaggcttaataaattcgtttcgcagtttacaggcgcgcggaatttataatttgttttgttttgagtctacgtttaatactttaaatgtgtgtccacatattcgatgtgacacgtcaaaaattttcatccctggaactaattaaacatggccttagccagatagatacatatacactagtacgtgcatattttgcatggcccatgcatcttatgcaaatcaacaaactagcttcttagctaagtagtaatcttgcttgcttggtgtaaaatgataaaataccatcaaattaaacaaatggcccacaccaaatgaagttccaagcacgaaatgatcaacgaaatcgacttggtcgcctcattaatattattagaagccttcgcactcgcgtcgtgctgggcgtggctgatgcgcgattagccgcgcggggctacgaccacgcggtcagttcacccaactgccaactctagtatctctcctctcctcttcatctgtatatagtatatatatctttatctattaaatgtttttatcgtacgtcgttcctgattgtgtctgtatccgtaatatggccaatgcacaaaaatatcatagatcgattcaaaatcctaatcgggcaaatatattcgtaaggcttccgtagaggattttcgtccgtcgcccagcgtgcacctcctctccaaatcccaaatcatcacaatccaacccaaaaacaaaattcaaattagaatcataacaaaatatcaactcaagggatgatgagaggagaggcaggagcgagcgggaggccattgctgctcctcgctggagctctacctcgccgcctcgctgtcattgaggtcccgacctcaggacagatcctgagccaccgcgctgccgctgcgtcagggagtagtgacccgccgcgtcgccagggagccgttgactcgccggatatggtgaggagcggggcggcggcggcaccttgacctgacgaggaggaatggggccgacggtgcgaggagggagagcgtcagtgagggagagggagcagcgagatgctggtgggggagcaactctccgtggccttggcgcaagcagcggcacctcgacgagctctgtgcgcgcacctggaactcatccgtgccgaagcaaccgtgccctcatccaccagctcacggcagctcccctgccacctcaagacccctctcccacactacctctagctgtggccgcagccgcctctgcaccccaccacggagaaagccctcctggttagcgctggcagcaaagtgaccgcggaggagtggccacggtggagcacatcctcgcctttcccggccatggtggctgctgtcattggcgagtctctcaagaggaggaggaggtgcgcactgtcgacaggtgatacccgtagactagatatagagggtattggggtacgttggtacaaggatctacgtagtacgacatcgagcaatcaaaagacaagaattatactggttcaggccccttgataggtaatagccctaatccagttgatatgggattatatggtggaaaacacaggttacaaaaggaatgatggaacttttcggatccagcgagatcgtagtcgagtggattcgactagctctcgatgacttggctcctcgcagactccggcttcgtaggctatgcgggttgtgttggctctgagattcgatgtcctatgccctccccggggggtcccttttatatcgcaagtctggagctctccgagcagaactcgaatatatcagacccaatacgatacgtagatgacccagttctgtcctagaaggactcttcctatctgtagatttcgtgaaaagtttccttagaacatgcaggaaatatccgcgtacgcgtgggtatgccatgtcgatacgtaacgtatatcgaagggtagagggtatgcctgactcgtaaccctgacagtagcccccgacttctgctcaaaatgaactcgtacgaccattcacgacttcgggtgtcaagaacgttgtcattccaggtgcgaggaccgtggagatgaagtatagtcgagcacaccgtttgaagcccaacggtcacgagtgaattttgaactgaagtccaaaaaactgccgcgcgtaacggacccagaaatttccggcggggatctctctctgttccttggaattcgcaccgtcggtagtgcgtctatttaaagggattttgggtgcgcattttgaagtccgcaaactccgtcaaacacacaccggctgttagcgctcctcgccttctccgctaccgcaaagaaccctagcttcgccaacttaggtccgttttccggcgatcttcaagcagcaatggatcttggcaagtcagcttccaccagcgcgaccttgaagaagcttcaggaggatggcgcccttcctggccgtgaaaacgcggagaggggagcaggaggtactaatcctcagcccatcttaggtcgcatggttacgattgaagattatgttctctgcggttttctccctccaccttccgaattccttctgctggttttgaattcctatggtctttctcttttgcatttgaaccccaattccatcactttccttagtgtctttgttcatctttgcgaggcctacattggggtagagccctttcttgatctcttccgtttctattatgagttgcgctggatggaacccaatagggtgtctggttgcgtcgggttccgacttcgtgatggcttgaagtcgcgttatgtccgcttctagtgtccctcttcccgcacaaatggcggaacatgtggttttatcttgaaatcaaggactcaaatccggtcctcgttgttcccgaggatcaaccggacaagattccggtctggaccgccaagccccccttgaccccctctcttcaatcgtttatcgacatcatcgatgatctccgagaacggagcttatcggggtatgaagtcgttgcagacttcgtcggtaggcgaatccagccgctccaggctcgggcccatctagcatataattattccgggcctaaagacgcgacccgagtttctcctcggggtatctttctcgcattcattttgacgtgcttgtactcatgttcctctcgacttacgaaaagttggttccctcttgacaggtctgagcagcgaagccgtggagcggcgcgtcgatcaagtgatgatcagcggtccgaccacggcgagcgacatccctgcgcccctttgtgaaaggggggcgacggaacgtgatgaagcgatcaatgtgagtttgctcgataagcgtcctgcattctctgttcgaaatcagcttatgacttgatttagcgtaggcccttcctttgactgatgtcgtcggaccgctcgcagatcatcaggtggcgacatctctaaaggagaaggtcgtcaaggaggcgtctgtcgctgcgaccaccactagtggtggcaaagttccgaccaaggcgaggaaattctcgtctgtgctcggacatcgtcgcaaggcattgactccctcggtaatttcatcttgtcgttagactatgtagcaaggaaggtttcttctcactccacattgattgtcttgcaggcttcagacgcgtctcctccacctccacgacgacagcgtattgtgacgaacagcgagaagtaagtaaataagttttcgggttctcgtgtt

SEQ ID NO: 62529 - DNA, 2947 bp, Oryza sativa
attagagaagccggatctagaaaagaagagagaaagaaattcccgaaactagaagagaaagagaaaaggaatttcccaaactagaagagaggtgaggaggagataacaaaactcatcatcgcaaagtttaaattgcaagtagaatttaaattgcggaatttaaatgaacaaggcaaaaacgaaatccttcaaatcatttcattcaaaggtgatgcaaaataaccgctcaactaagagcaaacatattccttcagaggaacattaacacaaacttaaaatctctcggacaaacacactccaaactaatcctaatacaaaagcctctcgggcaaacacactccaaactcacaccgaaactctctcaccgagcatctcaaaaggattacaaaaggagcaacctccacccttgcatccatctctctatttatagcctaagacccctaagacattgtctcaaatatccctagggcgaaaccctagccttgatgtaatcctggctgtccattgttccttagatccgaaggaagcctcctggatagtcgccacgttgttgatccgagctctcacgttgcgcgccctcgtgcgatccgcgtgattccactccaagccaatcagcgtgcaccgatccgcgtcgtgctcctccaagccaacgcatccgcgccacgcgtcccagagagcgcgtgcctgctcctctcacgcctgcgcaccaccagtccgaagccgccacgtcgccgttcctcccaccgagccgcttctgcgcgcgctcgcgaaaaccatgttcccgcgcgcgccatgcgaaaaaccgcgtgggacccggtcgcttccttgacgaacagaaggccgccacgcctccaggtgccgtacgatctcccgcttccgcgcgcgcatgcacacacctgtgcatttgccgagccgagctgggccgtcgtcatgtctagggcctgctcggcctggccttcaccatcttgagtcagcaacgtgcttaggccgggttggttcggccttccctgccaaccgaactgccagcccacaagcctagtggccagctcctgttggtctccttgccattcaatcatggcagcacacgtgcacatgatacatgctagctacagtaagccgaattactgtagcagcaatgcactcggtcttcatgtccttgcacagtcctcttctccttccaattttcttcgcgaatccgatgcttgcacacttgaccttgtgaagcccgttgtaaagacctcctcacacggtgtccgcccaccgtgtgcaaccttgcgtccaatcttgtcacccagcattcttgatcgttctggacctcaactcctccctgagtctagtcccgatccgccgttgactaagattgactgcgatcacctgcacacacatgagccaaacaaccgttgtcttggcatagatgtcacaacctaaccaatgttagtctacgcacacacttcttgcacttccggtacttgtcaatttcccatcacaaaagaactataatcacacatggtttcacaatctcccccttgatgggaacattgacaatctcaagcaaaattttgaaaatttgatttttgacacaaagcaaaccattttgcaaaagtcgaactttggtcattttgaaatcgcgaaaaatcaagaccaagtgacaagaagaaaagggatgcaaatgcaaatgcaagaatgctccccctatgtgccaaactccccctttcaccaagatctaaagcaagttttaattttcaataagtgcaaaattctctccccctttgtcaatgatgccatcaagaccaaaaagagacaaaaatgcaaaatgaaaatgattgaaacttgcaaattccagagttctgagagctttgagagttatctaaaggcatcaaaaagtagacatggatcacacagatacaagcatgtgctcaagcctagctaagcatgtgcaaaagaagtatgaaacaagttatgaatatcaggatagtatcgccagcaagcaaacagctttcaagtggattagtgatttagtgtgcatagctatttctagaagaagcttaaaaggaagcaaaccagctcataatcatgcaagatttacataatcaaagcaatgaacccatgctaatgtgctaatgcccagttcataaagagtatcaacatggtaacaaagcatagaacatgagcttttaatcttttctcatgacttttctttttatgattttttttttaaattctttaaagacaatagcacaatcacgacggtccacctgatcttatcagtcagcaagtgatggttgtgccaaacactgccgtctgacctcaatcaagttttccagctagagttcccattacaggctgtctcagtgctatcttcggcactactcatgcgtaaacacactcagtagcccggacaaaaacagagataaagcttgtaaagcaagattgatacaaagtatggacgcataagcatgagcattcatgagcatgtactgacagttattgcaaaaagaatgaaaacatagcatgagtatgagatggatacttcaacttaaacaaacttctagagcaagcattgcacattgattaagttcaaatgaatagtcaatttaagcaggtttcaacaagcttgaacagcataacatgatcacacaagctacttaagcaaatgaaagctagacaaaagatcaaactagcataagagtaatacatgcatagcatagtgatgaccaagagataacaagcaaagctcaattgaagagtgtataatacaatgcataaagtaaacatgatgcaatatgttacaaatgcatgtaaaagaaaaacaactccccctcaaatcaagccataggggtggatcacccctaactcactccgcaagaactcaaaatgagagcgatcaagtggttttgtaaaaatgtctgccaattgattttcagattcaacaaactctagcacaatg

SEQ ID NO: 62530 - DNA, 892 bp, Oryza sativa
ctccaccccataaaccctaaccgatcgagggggcgcagccagtgacgggaagtccaccgccgcgccacgcctcgtcgtcgacaccgtcgctgctgcaaccgcatcaccgccatcggaaccgagcacatcgtcgccgccgtccacgtcaagcccgcgacgacaacgacgatggccggccggacttcctcttcctcaacaacgactggtcacaaccctaaatcctctcactccctctttgttcattcatctattgttgttcatccattgcaaatagaaccacccgactagatctaaacctaggtgatccaatagacaaccctatcaatggtatcagagccaggttagcgtttagtttggttcggggatagacatccacagagaagaaagaaatccaagagaaaagcaaacgatccaacggatcaaaaagatcgaaaccctaaccctaatcttacctcgtcgccggccgtcgatgacgccggccacggaggggggaggggcaaagaggcaccgccgaggagccactcgacggccgcgcgcgcacccgcgggtgcacgcgcgcgccggcgagggggcccgcggcggcgccgccatctccgtttttcggccgccgctctctctcacacggtgggggctagagacggtggagggagcggagaagagaaaatgaagagggcgcaagggccgctggcggcggcgacgccgctccgctcggccgctccggccggcggcgcgctagagaaaaagtgggcgcgcggcagcgcgaggtcgccggccatggcgcggcggcgcaagggtcgccggcgtagatgacgccactcggcgcggccgcacccgcccgcaagagagaagaggctagggtttcggccggccggcggctggggtcgggtttttg

SEQ ID NO: 62531 - DNA, 5331 bp, Oryza sativa
tcctcctctaagttccaatatattattctgttcagaacaatagaacataatgtttatctgcgccgtgaaatttcttatcgtttttaacaccaaaatgcacttgcaattcattgcaccgtgatgttcatttgcaacaatacgaatcacaagagtgtgatgcgagctgcaaaatggctcatgggagggcattggcagcattgaggccttgatggctgatgccaacttgccaagctgctaactgttttacagataaccgggacgaatgtacgtcttgctaagaacagttgatcacaattcgaattttatttcaatgtataatgcttgttttggatactgtaacattctagacacgcctctgcatgcgccgttatcagctatcagagccccagactcagaactagtagttgcagagcaaatcaagagacataagcagaggaagaagaaaacagagaggagcgaatcgtactggagttggagtgtcgcggcggcgtggcaatggccggataggaccgccatgtcgccgctcgccatgcccgagtagaggctctagagcggaaggctctaacagccgaccaactcacaagcaagattgtcgatgagatcaacctttggatctactatggtgcaagagatatcgtgagaatcttgagatagcaatctgaaggggttgtacagtagagtgtttgttttatttttccctttttttttcaccttggtgaagttgtaaataacttttttctgctgcatatataacaccagcaatgcttggctcttttttttttaaggctgatttggtcgtattcaagagcagatttttttttctatggcaagatgaagagggccaaggtgaaggcatggtttggtgaggcctatcgtcttctgttaagagaaaaggaggaactaaaaatttggttttggtgattaatgataaatctaattatataagagtaatattgttataaacatttatttgtctactagactcatgtggatatgaaagtgaaatttatgagaggtgatttcatatgagttgagataaaaacgtttattgatggtggacctaaatcacaaggaacatcctgtagtaaggaacgcacggcggcggcggcggcggcgctccgtcttgctgctgctgcttttccttcttttccacccccctcaaacgcacgacaacctcgctccttcgtgtcgccggtggcggcaagccggcctcctcccgccgccaccgcgaacgccttcaccgccgctgtagggagcaggccgatgggttcgcatcacgcccgctcatagcaagcttcacagccacgcagccgcagggagcgctgccgatggcggcaaggaggtgagggagcaacaagaagaggagcacgcggtagggccggttgcttcggcgggaggtcaagctccatggctggccgagtgaggccgggacaacaacctctacttcgatggcagtcgtgccttcacgcttcgggtcggtcctccaccgccgcgtgaggcccgcccccaccggtgtggatggcggtcgagcctctgtactccgggccagtccttcgcctccgtcgcggccgggtcgctgtggccgggtccctatcggcagtcgaatggcggtcctcattggtggttgaatggtggacgcacctccgcgctcctggccgttcttctgcctctgccgctgcctcgtgagccccacggcgccaccaccgctcgtgctgctatcgctatcatcacaacgctagaagatgggaagaacgaaggaagaagacggggaaagaaggagatggatggaaaatgtgatgacgatggcatggttctagttttgtaaaatttgagtggcacgcttatgaatagacgaattgtaatagtatttttttaataaccatatttacattggcatggattgaattaacccaaatacttcttgttgcattgtgtagaatgtttttgtaagccctccatccaataataataacaatttactattagatgtgacatatcattttattaggttatgtcttatccaatactagttttttttacggagagagtatttgcttagtgcatttctaaaagtatttaatttatctctataatcaaatatataaccatgacaataatctcacgaataatctgtatcacttgttgaatgatttcgaagcatttctgttgctgggagtattttgaaggagaacattaccaccatcttttttagtgcaagggatggaagacataataatttggaaatggaatatttggttagatcacactacaaaattcaattgcacgacaattgaggactataacacataaatagcttggaaaactgctgcagaaggtaaatgctaaatttgcatggtttcattgcagggatgttcacatggttaattatgccctttaggcggccaggagaatgaaatgtcaaattacaacgattttaaggaagcttagccatgtggctgtaactttttttagatgcatttgcgatttgacagtaataacttagtaaggacataattgaaagaagtatataactttttttatgtcattctgaatttctggtttatacacattcgaacttagagaaggaacataatagttgaagttttgataatttttatcacggtttgtagcaggtaattgggaaaattgataagggtaaacatgagaggaagccagcatgcatagttgaactattgtagaactttttggtttaccaatctatgctatcctcgatgtacccttgtacgtgctcttgtttgaacatacacaaactttctctctctctctctctctctcaaactagaaaaggtaaggaaagcaatattccaattattaagatcattaaaaatcaccacacagaaaagaaaagtaagggtctgctgggaaggcgacgaaatccctagatgcccccaattcagtgtctgctgggacattgattccaaattgaaaaataaggctctgtttagttcacggctgtcacatcgaatatttataaatgtatggagtattaaatgtagaaaaaaaccaattatacagattgcgtgtaaattatgagataaatcttttaagtctaattacgccataatttgacaatgttgtgctacagtaaatatttgctaatgacggattaattagacttttcttctcgtagtttccaagcggaatttgtaatttattttgttactagactacgtttaatatttcaaatgtgtgtctgtatatccaatatgacacgccaaaaatttttcttcggaaattaaacagggcctaagttcatttgattcccttagctactggctaaatctgattcgtatccctaaaccacgacacctgatatctcgaccctttaagccagatgtgaggcggggctagccagcatgcagaggagaaggggcaatgggagagacatccacgatgctcttgacgatggtagcccgagtgaagctagccaccgcagtgagcgagctgctttgatgtgtaggtttcctgatctaaacatttactgatttaccttctcggattagttcgtctagtgcacggattgatgacccatggtgttgatccgttgtcagatatttatctctttgccgttttgattgttttgttcgagcaatccccatctgctcactgttcacctgctccatctgctcgaatccctcttcgcggattcacggattgcaggctaaaggcctctccgggctccggcagcttcacccgatggaggatctccccgtggggcggaacctggtggccagcctcaccgacgatcgacctcgtcgtcgacatcctccgccgcctccccgtccgctccgtgtgccgctccaagggcgtctgcccgtactggcgcgacctcatcgccgaccatgaccaccgcaagaagctgccgcagacgctgtccggcttcttctacacgagcttcagcgaggagcgctcggcggcggagcaccacttcaccaacgtcaccgggataggcatgcccctcatctccccgaccttcgccttcctgccgcagtgcaaagaggtcatccccttggactcctgcaatggcctcctcctctgccgctgcctgcagtttgatggtgttagcaagttccactatgccgtgtgcaatcccgcgaccgaggaatgggtgatgttgccggacgccaattgggctgatggcgagaaccgcattgcctgcttgtgctttgatccagccatctcatcgcatttccatgtggtcgagtatgtggagatgaagctgaatgcgtcacaggggtggagatcaattcgtctaaaactgggctatggagtgtccatgtaaatggatggaatggtgtagttcttgtcagcctttcggtcaatcgaagaagtgttttcctcaatggttttctgcactctgtcacgcctgctgatgagattgtggcggttgacatggaggggaagaaatggaggaaaattcctgtgccagaccgtgataatgacattggcataattcatcaaactcagggttgcctgagtgcttttaatgtcgatctgctcgatatcttcaaactgtcaatttggtttcttgaagactatgatacaaataattggatcttaaagcacactgttagctccttggacctgtttgaagggaagaattatcgacttgattttgagtaccaagtaattgcagttcatccagattgcaatttgatcttctttgtttatggattggacaatactttgatggcatatgaaatggatcgcaaggaagtgcgtgttatacgcaatctcggaatgactactgctggccatatctgccatatgagttgcgatcatctcctgtaatgcatgtgcagtaagtgccactgacatgtgggcccggaataggtgggacccacacgtcagtgaaacgtactgcaggtgcagtacagcagtggatttgcatccctgccatatgttccactattctctgagttgttaactgatgggcgctaatggccaacttgcagaggtgcggctccacttctgttgttgcaaaaacaacttttctcccttaggagaatcaggcttagagtgggccagccagtctctaataagaattatgaagttctgttttattgtatttgattaatcctcttcaagttattttgaagaacgctcttaaatcgtagatggtaagctaattatgtaagttctgttgttccgaaggttatgccctgtttttattccactgatgtaaccctatgctagttcccttcaaaaaccctatgctagttaagcttgatgtcatgttggaacatatgtactgtccttttttcccgcattctttttctctttttcttcttttctgaagtacctgtctgt

SEQ ID NO: 62532 - DNA, 516 bp, Oryza sativa
tcgaactctctcttctcctcttgatctctcttgttctctccgctctctctcgcccctctatctcgctcgctggtctaggcggcggcctggtggagcggcggtggcggcggcccggcggcgacgccctccccaccattctctctctcttagtggcctggcggaggtggtggccgccccgtggtggcggcggcggccgttgacgtgccctcccctcctccagatccagtgggagggaagcggcgacagctcagcgactcggcggctgcgcccttcctcggctagatctaaagggaggcaacggccgtgaggcggcaacacatcctccggcgacggcggcggtggtggttaaagcagccgggaaatgttctatgctgctaatgggttcttagatgccttctggtttctgtgctgcggtcttgacattgtcttgaagttcttgatgtgctcggtttgattcgtgcttgggtcggcttgattcgaacccacccgcaatttttttggggcctcgttcatcct

SEQ ID NO: 62533 - DNA, 19813 bp, Oryza sativa
tcacataatcgccacgtcaatgaaacgttggacaaagacctagtcaaaattagccacgtaggcaccacctcagccaaaactgggcacaatactgctgagggaccttatttaaacggcttcgtaagttggagaacctgtcgtacccggttttgcgatgaagggatgaaaattggattgggcgataaatagagggacccaaagtgaacttattccttcaaactaaggcccgaccgcccgattcaagtggaatttggagagtcttttacccctatgccattaagaaagttggaggttacgcgtgtgccacgaaaaagttttgagtcacctgtatgccatgacgcaaactttcgtttacccgcgtgccattccatccaccttctgttagagaatgagctctgacatgtgggacccacgtatgaaaatgactaaattgcccctgaagcattttcatctctactactcctctcccgtgccctagcctagccgccgtcgccggcacgccgccactgccacctcgcctcgccggcacgccgtccccgccgcctcgcctcgtctatccggcgacgcgcctcgtctatctgccgccgccgcctcgcctcgtttatccgtcgccgcctctctagtcgcctcgcctcgctggcacgccgccgccgccgccggtcgtcgccgtcgctgttggtcgtcgcctcgccggcacgccgcctcgcctcgtctatccggcggcgcgcctctagccgccgctgccggtcgtcgccgccgccggcacgccgtcgccggcatgccgccgccgccggtcgtcggcgccaataacgttgtctttcggcgctaatggcggcccttgccggcgtgccattaatgctgattccatccattagcaagggtaaaatagatctttgaaacctccgtttgtctccgttagtgctgattccatccaaagtggcgcataggcaaaagaaagtttgtctcatgccaggtaactcaaaagtttttttttggaacacacgtaatctccaactttcttaatggcgtagggtgactagaatttggaaccaatgtcccagcagacattgaattggggattttggggcatctaggggtctcggcgccgtcgccgccgccgccgcttctagctcttcttctccgtgacgggcgcacatcgcagcagggtagcgggcgcaatggttggccttaaccggcgagggcgctaggtttgccgtccaggtgtcccgtccgacgagctccacacaggtcagccgaggccgagcggcaagtcacgcgcgcggcagcatcgctcttccctgccttgatcggtaggttcctgatctcagattagttcgtttagtaggtggattaacgaacccatgatgtcgatttgtagccagatttttctttcttcaccattttgatgtcttgtttgatttaatccccatctgctcacctgcttgatctgctcttgccgcggtgaatccttttcccgcggttgcaggctgacgacttcctctcctccaccccacccccgatggaggagaacctccccagcaggcggccagcatcaccgacgagctcatcgtcgagatcctccgccgcctccccgtccgctccgtgtgccgcttcaagtgcgtcagcaagtcatggcgcaaactcatcgccgaccacgagcaccgcaagaagctgccgcagacgctatcgggcttcttctacaagagcatcgactacgagcgctgcccgcacatggcgcgccatttcaccaacgccactgggagaggcatgcctctcgtctgcccgaccttctccttcctgccccagtgccaccacgtcgtcatcttggatagctgcaatggcctcctcctctgccgctgccacgtgtctcgtgagactttgcagttccagtatgctgtgtgcaatcctgcgaccggggaatgtgtgatgttgccggacgccaactgggctattgacgagaaccgcaccgcctgcttgtgtttcgatccagccatctcgtcgcatttccatgtgctcgagtatgtggaggatgaagagtatgtggaggatgaagatgaatacgacgcactggtcacaggggtggtgatctattcgtctaaaactgggttatggagtctccatgtaaatggatgggatgatgaagttatggttagccttccggtcgatcggacaagggttttccttaatggttttctgcattctgtcacgacttgcgatattgtggctgttgacatggaggggaagaaatggaggaagattcccatgccggatcctgatggtgatattgggataattcatcaaactcagggtcgcttgtgtgcttttaatgttgatccaaatgatatcctcgaactgtcaatttggtttcttgaagactatgatacagataattggatcttaaagcacaccgttagctcaattaatctgtttggacgaaagaaataccaattagattttgactaccaagtaattgcagttcatccagaatgcaatttgatcttctttgtttatggatggcacaatactttgatggcgtatgaaatggatcgcaaggaagtccgtgtcatacgcaaactcggacatgagtcatgcctgccatacctaccatatgttccaatgttctctgagtcattacctgatgggtggtgctaacatgcagaggtgcggctccacttatgttattgcaaaaccatctttgtaccgtaatgagaatcaggcttagggtcagcagccaatctctaatatgaattatgaatttctgttttatcgtacttgtgtgatggctcatttgtgttgttttgaagaatgttgtgaaatcatagatggcacgtaacttggcctttcggaaggtatgtcctgttctgaaggttatgtcttgtttttcactggtgtttaccctatgccctatgctagttaaaatttatgtcctgtgttaacaagacataccttttgattgtaccagcagtcagcttatggaacagtgacaaatgctttggaagttggatcatatgtacttcttttatttctgccttcttttccccttttgttctttctgaactacttgtctgtgttgcggcaatgtgcccatgcagcttattgtctcctggatcatttccactcgtttttgtttggtcatctataatgctcattaatttgggcattgcttcccctgcccttacttgctggagaagaagagagtgcaaacaagagcacgtacaatggtgcaccaacaagaaactgcagaacattctagaaatgaaagataacaaagatgggtaaccaaaaagtgataaaatagttaaactattctgcactgtcttccttttatgatcacccttctgaaatttcccaattacctgctgcaaaccatgataaaaactagtattatgttcttcttaagttccaacaagtatcaatcacttcaattgtctccattctaaattacttccactttgaattcctctaagttacaacatgtttaaatcaacaatggcataaattttgttctaattctcttcaattatctctgttctaaattactgtcaaagtgaccaagcctcccaataattattgtggtgttgagagttgagacctggtagttacatccgattctccacttcctttcagacccgctgcgagaaagagcaatggataattggatattttcttttggccacatgaaagggcgtattaaaccatatttgggcatcccctgcaaagaaagctatgcaaatctagcattagttttcagttgtcaccgttttcccaaactatttctgtgttgtagagtagtcgcaaataaattgttctctgtaattgaatttagtatgatattttctccaaacttcccgtttgctgtcaatgtccaaactattatgactttgatcccttgcagtagaaaataagataacgatgttctcttttgaaaataaaactcccagcaacagcgatgttttgaagcctttcaagtttcaacacattatacatgtcatggtaaggtcaaagatcagctagtgtggtgtggtggggccaatagaacacgtcatcggacaattaacctaataatgcgacaccatcatctgcatccttcccagttcgcagtgctcgccggcattcacacttaggggttcagatggttggctggttgctcctccttcaaatttctatcgttccaacgacaaaaatgcagttgcaaaacctgcaattcattgcatttgcacttgcacaccgtgatgtttatctgcaatactcgtcacgatgatctgcagatgaggctgaggctcatcgaaggaggacaccggcggcgttgagcacttgatgatggctgatgccagctctaactgtttgcagataaccaggacgcatgtaacgtcatgctaggaacaacagaaaacttaattgcgtccaggaacattcgacgacatggtcatagtaaatactgttagtattcagtgcacaccatgtggtacagatgtatatcatgtagtactacctagttctgcagtaacatagaatcttccattgctgccaatctatgagtcaatatttagcacaacaattaggcttcagaaagaaagaacaaaaaaaacattttccagcaacagcgcagcagcctgatgatttgactaatacaacaaaacaaatcacggctacaattccatttgccaaccaccttcttaatttcaagccctttgacttgtgtgatcgcccaaagtacttaagcgagagatcgagagagcccataactacggagaaagctgagaaagaaacacgcactaatcaaacaatctcttcttcttcttcttcttcttctgttcacaagcaatcagaaaagaagaggacacgccatgtcccttctcgtcgtcttgttcttcttcttcctctcgccgccgctcgccgccgccgccgcctacacggagtactcgtgcaatggcacccggggcaacttcacggaggggagcgcgttcgggctcaacctggagctcctcgcggcggagctccccgccaacgcgtcgtcgtcgcggtcgctgttcgcgtcggcggccgtgggcgccgccgcggcgccggaggacagggtgttcggcctggcgctgtgccgcggcgacatgagggacgccgccgcgtgcgcggggtgcgtctccggcgcgttccagcgcctccgcgcgctctgcggccgggaccgcgacgcgacgtactaccacgacctgtgcgtggtgcgctactccggcgacgacttcctgtcgcggccggacgacaactcgccggtgatcaacgcgctggacgcgaacgcgtccacctactacgggtgggacgggcggaacgcgacgacgcggagcttcttcctgtcgctggtggggacgctgttcggggagatggccatgtacgggtcgtacaactcgtcggcgcggcggtacgcgagcgccgtgatgtatgtgaacccgcagctgccgacggtgtacgggctggcgcagtgcacgccggacctgtcgccggcgcagtgctggcactgcttccaggggctccaggagcagaaccggcagtggtacgacggccggcagggcggccggatcctcggcgtccggtgcaacttccggtacgagagctaccagttctacgccggcacgccggacgtcaggatcggcctgcaagacgtcgcaccctcaccaaccgcaaacaatggtaacaaccaacacatatgctacacacacgatcatttcttctcctccgaataaatttgctcaaaagctatagttggagcttaactactattgttgtacgttgttataaatgttaaacttttgaccatattgattgtgttttttttttggaattattggagcttagattgaaggaagggtccatatcaattaaaacttgctagtagtaattattaattttgaatttgggggttacgtttatatactattaataagagatttcatgattgtccagcttatatgcatggtattaattttaatgtcatctttttatttaactcaaattctgaatacaatctatggcatgataatataatccacctaatcaacaaccagatctttcattttaacatgagagatctcatagtgcttaattagtataaggtgtaaacagatagatttgttacataggggctgttcagattatatcattttcaatcataatatttttttcggtaaagttacttaaaaaatgcctatatttagttgttgccaaacattggtaaatatataaaaaatcctgctaaaattttagtaatattgtcaacttgccaaaaatatcaaattttggtaaaatttattttgactacgatctgaacgccccataaatttgtttgaattggcaaagacaaatcatattattattactattactgtcatgtttggttgtgagctcacaatggtcaaatacgtaaccacttaatggtggtgttttctgtcagtgcattatcttttctacaaataacattgaaacaatctctgtatgatcactactaattttcttctttatttatgcaggaaccaaccacaggaagaccttagttatcgttctatccgtgtcaatcacggtcttctgtttcatgctggtcggctgcctcctactgataaaaaaactacggaaaggagacggtaacaacacgatgccactaactccctctcataatgaacatcattttctccctccatttcagcatcacaaagttcttaattaatcaaccaaaccacaaatgtccaatccatcattgatcacagggaggaagtcgaatcggcagctggaagcacattccaggaacagctccaagacagaggaggcactgaagctgtggaggaccgaggagagcagcaccgatttcacgctctacgacttcggcgatcttgccgctgccacggacaacttctctgaagatcacaggctcggcacaggcggatttggacctgtctacagggcaagttatctgaaactcctataatttttgtttttacagtcgatttttgaccaaaatgtgtgaatggttgtcgctatatatgctaataatctgcggcatcatagttgctgtccctattgtttagcagtcaatgttgacgaaaatgcggatgacttggtgatgctaacatgcatgattattatttgctttgtctgttcgtgttttcagggtgagttgtctgatggagccgagattgcggtgaagaggctggcagcgcagtccgggcaggggctgaaggaattcaagaacgagatccagctcattgccaagctgcagcacaccaacctcgtcaggctcgttggctgctgtgttcaggaggaggagaagatgctggtctacgagtacatgcccaacagaagcctggacttcttcatcttcggtattattctctctttttgttcaatacaatcttcgtccaaaattatacttaacaatttacaatttagacatacagttgtgtagattcatatctataaatgcttatatttcggaacggatggagtagacaggggcggagctaaaattttctcaagcttaggactaaattagtgtaattttcatatgttcgtcgaatactaatatttgagatatgaaattgagtttttttatagattaaaaactttttatcattttcataactatgcgattaattaaaaacaataacacaaaagcaaatgccctgaatatataacaggtaaaaagggaaaagacaattacttttgtttgtagtccacttgatcaaacagcgtgtcaaactgctgttaaaaaaaatcaacgtgccaaaatttcaaaagactatgttaccgtcgacgttttactcatcttccgattttcctaatcctttctatctttttcaagtacggtttaggaaagaaaatgtatattgccaaatggtttccatatccaaatggtttccatatccaaatggtttcctaattaaacaagtaaaaaaaagtgaaatggattacttctgaacgactttgttaccgtcaacgttttactaatcttcgataatgttttcacgcatgtagaccaggagcaagggccattgctggactggaagaaacggctgcacataatcgagggcgtcgtgcaggggctcctctaccttcacaagcactcacgtgtacgcatcatccaccgcgatctcaaggccagcaacatactcctcgacaaggacctcaatcctaagatctccgacttcggcatggccaggatcttcggctccaacatgactgaagccaacaccaacagagtcgtcggcacctagtaagaaaaagaataatgatatatatcgtagcaatacttatcattttaattacactcctattttaaattacttagcattttaattttttttaagttcaaacattcgtaaatttaaccatcaattactaaaacattataaagtttagcatcataatatttatgtttttattcaccatgagatgtaatttttataatatataattgacatgttactaattaaactatataaacacttaaaatgactttaaataaactaaagtaacaagtaaattaaaacggagagagtactggtaatctggtattaagttttagcatgtcaactggctgggcaaattgattaatagccgtgatgttttccttcaggtgtttgtacctttatttttggaggataagatcaggtacctgcagtactgtacttactagctagtggtattgattgttgttttggtgttcacgtgtgcagtggatacatggctcctgagtacgcatcggagggcattttctcggtcaagtccgacgtgttcagcttcggcgtgctgctgctggagatcgtcagcggcaagaggaacagcggccaccagcactacggcgaattcgtcaacctcctcggatacgtacgtttttacgttgttttttctatcttaatttctttttctctctcgctgaaataatggcgtgttactattctagtacgacctttttgtgtgtgtgttcttaatcaaaaccgtacttgtcgtccgtggattaataaatgggcacgcggcttatcctgtacaattatcaattatgtcgaaacgttttcacgtctacactgtagctacgtttgacttacgctagctagcaacatgattagtcatcactaacgaggattaataaattggttgatcaacttggcatctttttcaataactttatcgtgctctctactgttacaattatattccgattatatatattatcatcagctgattcttctataatataatctgagctattaatttatgaattccaatactaataattaaaagatgtactataaataaatactactatctattagaatataaaagatttatatatttcaaacatagagtttttttaaaaaatatattattattttttgtcaggcgtggcagctgtggagagaagagagagggtgcgagctgatcgacccgacgctgggcgagtgcagcggcagcgaggcggcggccataatccggtgcgtgaaggtggcgttgctgtgcgtgcaggacaacgcgacggaccggccgacgatgacggacgtggcggcgatgctcggcagcgacggcgtccccctgccggacccgctgccgccgccgcactaccagctgagggtctccggcgacgactacgacgacggcggccgcgggtcgccggccggcggcggcttccggccgtcgcggtggcgcttcaccgactcgtgcagcaccaacgacgtcaccatcaccaccatcgaggaagggagataatagcggtcgatcgatctcaccggcatttcgatcattacgtttacgcgttcgctggctggccttcacatgtggccaacgcgtccttttcgtgagacatctgtgagtgagtgtactccacttgtggtcgatcgaagtcgaagataggcagggcgcaacagtggtggttggcatggttgcatcaccgtatggatgttacgtcgttgtacagagacaactcgtatatggggatgagtacctgagcggctgagccaacaaagagggtgttttttttttttcttttgtacaacttttgtgtgaagagtgtacgactaaagctggtacgtacagtgtttgttgatggatgaaaagaaagtacaaggatggttggatgcaaattggggtttggggtgtcgattgcatggttggtttccttttgccacgaacacccccatgttaggtgtggcgtgcggccgactattaattcaagccgtgttaatgcgaagcgaaacttgatgatggttgacgatttattcgcggggggagcacgtgtgagcttggtagttgtcgtcagcagaaaataatgcagtacagtacagactgatggaaatcgacggattttcccctttgtaaaaatgggacaatgtgtgtttccctttcaaaataatacacaaggtcatcccaccaccacctctcatctgcagcagcagcagtaataataataataataatttttttggcatggttaccaataaatatatgataacataacatggtcccagaaaattaggactacaaatttctttatattttaatccatactaatgctttctaatatatttaaagaccactcgttacatttttaaaaagttttgctcttcctactttactaagttggctaaaatgcgtttattttcttcagcttctttaaagtgttggatggtaatcatagccacctcaaagaactgtgctcgtgcccacaatgtgaacatgctcacgacacaattctatttagtgaaaaatatgagtctagctaagtctatttgtcacttcggtacgatccgtttatagacatcatctcaacagataagtcctttccacaaaatatgtcctaaacaaccatttgaaagatggtatgaatttcaacaattaaatctcaacctggcaatctagatttgttatttgcggtatataaactataagagtggtttcgtagtccttacaagggtacctatagttatcatattttctatatctaaaatttatttagtgtatctcggtaccttatttattaaaagctccaaaatttacatgaaattattttggtacaataaaattgctcaaagtggtctaaaccctaactctccttggttcttttgtctcgccctgctgctgctgccccctcacatttcttctccaatgcggacagtgggtggatcttgtacttgcctattgacaattctgcatcccaacagttccgtacttccgtagtctcggctttttagatcaaagatcgatcaccgaagtctcatagcaagtttgataatatagcccactactaactccaaatcatctatagccaatgtaatagctaattcttacagtacatagttgcttactatactattaatatctggtcctacttgtcatacacacattacgtcttataatccgtgctgcagctggctacagatctgtagtccgctgttcttctctctcttcctttatctttttaaaatatatttatagctggcttatagcctgctattatacctgctctcgatcagctaacaaattgtgttgcctcgggccaagagaattcgctggccacatggcccataggccatagtcatctgccgccatcggcttgcgcccttgcgtaagccttctgggccgaacatggccgatcacccaagctaactcgtatgggtcatcatttggaggtggcacacatcgcctccttttccctcatcaattgccgcgacgctccttctcccagccaaggtgaacggatcctcttcctcctcggccacctcgccggcgtccggcgagagacccaacaagatcgccgcctccgtctcgatcctgcgaccggtggcgtcccgatcgcaggagaggccctgccagtctgctctctgctgccataggtggtggagatgtggatcagtatatgtaagttcagttcaggtatgtatgtttcatctggtaattaatttggtttattcccaacaaatttgctaccaatttcactacaaatagtgtacaatatgtcgagttgtttacatcttatagacctgcatgtaacgtagacgaatcaggtctctcctttataacaaccagagatcactactccgtactgttttatcaacttggttagacgcttgttgactgatatgcgtattccaattgatatgatacagggcgttacacttgtgtgtttctaagtcgactgatcgctcacaaagaaagggcacattcttattgatgtatattttattttccatgggagatgtagccactttttccttctaagaagaatgtttaagggcctgtttagatccatttggaatggtaaatggcaaatggtaaaagttttggtggcaaaagttttgtcattgcaaaagtactagttggtgtttagatgcatgctaaagttttgccattctagcactaaagtgagagagagaaagagagagggagtggtcccaaagcactttttggcacaatttgctactatggactagcaaatgctaaatgccaaattgccaacttttgctactagtgtttagatccaaaatgacaaaaagtgctacaaaatggcaaaacttttgccattttggaggatctaaacagggcacatcttttcccatgtttgtcaggtggagatatataaattagagatcagacaatgaagggcctatttagatccatttggaatggcaaatggtaaatggcaaaagttttggtattgcaaaagtactagttggtgtttagatgcatcctaaacttttgccattctagtactaaagtgagagagagagaaagagagagggagtagtcctaaagcactttttggcacaatttgctactatggactagcaaatgctaaatgccaaattgctaagttttactactagtgtttaggtccaaaatgacaaaaagtgcttcaaaatggcaaaacttttgtcattttgaaggatctaaacagggccgaagtcacaacatacccctgatcgtggtcgcatgcattaaggcatccatgcatgtatgttatttcattatattgatatctctaatttcatcttttattgcattctagtgcatgaagtcgcgcatgcgtgtgactatcactatcttttctgattagtgtttaagaataatctattactgatattatgtcactgaagaatttgttgtgaaaatatataaaatatatgtttgttttaagatagaaatatatgtttttatcatttctctcaaccatacaaacattttttctttatttcttatgcgtctcttcgttgctctatatccctctcccacatatggagacatggaaagctctataacaccctcttttatccaatggctgaaatttattctcttgttttgtttgcttgttgatctaacggttattatttattagatgatatggctcattcttcttatgttttgggattctcttttcaagagttaagatatatgtgtccatccatccatctatctatctatacagacatatactaattagattagttacttctaagaagctactacttttattagaaagatctaaccattaatttgttagatcctattgtcgtgaacgtagatcatgtgtgtagagtccaaatgaaataaatcatgcaactagaaatagaatggtgattctatttaaaataacttattttataaatattatctgtcaaactaggatcttgatgactatatgaaaattcaaaaacactatattttaaaatagagagggtaagttgtaactgatgtgaactcttattttaatatgaacagccttgaaagtaaacaacacgtttaaaatactactaaaatattaatatctagcaatagcatgtgcaacccaaaggttacgaatctttgtctataggaatagtatatgtggagtatatatgcacatgttcatcattgcaaagatcaaaagtgatcgagttaataactaatataatgcattgtgaaagctctttagttggcagctgctgactagtcaatggacaatggaggtttgtagtcaacggtcaaagtcaacactaaccccgcttatctatgtatacctactgaactggagcagcctgtactactactccggctgaattatctcttctccggcgatgactctcgccgcgatcctcctcctcgtcctcgccctggtcgcgccgccgcttgccgccgccgccgtcctcgacgacggcggcggcggccaccgcccgccgttccacatgtgcgggatggtgcagggtcggttcgctcccaacagctcgtacgaggccaacctgcggcgtgtcgccgccacgctgccagccatggtggcgaacggatcctcctcctcctcctccggcgtcgatgtcctcgtcggcgagcggcccgaccagatctccacgtcggccttctgcggcgccaactcgtcggcggcgccggagtactccgactgcggcgcctgtgtcgaaacatgatttcggcaataataaaagggggtagcgcacgagacctaaaagtggatggatgcggagacaaaggatttagacaggttcaggccctctcaatgagaggtaataccctactcctgtttgggggtttgaatccgccgggtgtgtattgatctgacgatcaggttatgtcatatctgccccctagagggcctcctgcccaccttatataggatggggggcaggattacaagatagaaaccttaaccaatacggtatcggtttcctaaatcaggactttaggccgttccgtaatatacaaggaaacgtaacacccaagtcatgatctgttacatattacatagatataagttatcccctataactagtcggataaccatgccctgtgggtatggggtacccataatatccacagtagcccctgagaccttcgcagtcgaaaagataatcttctctcgaaccagattactccaaagccgagtgcttcaatcatctttgtcatggtctcccgagtacttttaccaaatctgaagactgtggagggctgaaaaataaagtcaggtgcatcgaatagatgcacctaataggtgtagccccccgacaatgtggttaattgaacaaaccaagcatatagtcaaggaataaataatccaaccaaccaagtggttttgataatcgtaatcaaccaagtgacttgatatcaatatatagtatatgcggtgtgaatcctccaaataacatgatccgagtgatataccaaaatagctataaaaaagctcgtatattgtgaataaagaaatttccaaagtattgggcatacgccatgcgcacactgctttaacagatgtgcttaagtccctagaagacacatggtttcaccacacctggaaatatatggcatatgtggtgtaaaatccgagtaaataaactcataaaggatttaccaaccgcctagaaaaatgaccataatatataatcagcctaagccataatattggtcaataaaaatgcacacttacgtggcaaaaagcaatgatattatatccaatcaattgcttgataaacccaaacagcaccttgactatataaaaaagtcagcggggcagctatgtaaagctttactgtttgacacattttaagatgcatcgtaccaactcctaaaaagtcgagtaactgcggtataaaaggattttaaggtattgggcacttgatcacgcgcactttggcctaagcgaaaagtgcctaagtccctaaaagaacgtgacaggccacacctgaaaatatgggctgcagacatattaggcctaggccaaaacatatgccttcgacaccctttaaaggatgacgcatataacatgctcccgagtaataaatcttccgggtaatatagatcaagcgtagctcatatgaatagcttctgatctaaatgattatcccttatgggatactccaaaataaatataataattgaatcccgactggcgcaagtattcggttgatagcccttacggggaataataattggtccagtctttgagcatagaaaatagactcatgactatgaatccatgtggaatgtatccggaacaagtccaaattggagatataatcctcacgcttgagttgatgagcccctgagcatatagcttgtccttctgtcatagtcaaaattgtttattggcaatagctgacgcagtcggcatggagatgaaatgaccaacatgaagacgaaattgctcatcaaaagtaacggaagatgtcattggtagtaaaaaacagtgacaccaatcaaagataatgaagttgcacagccgtggaggcgaagaaaccaatcggcagcagacaagtcagccaacagtgaagatgaaggcatccagcaacatcgacaaaattgagcggccatggtggcgaaataatcagtcggtgacagatgaggcagccggtgaagaagatgaagatgcccattagtggcgacataataagccatccgtgaaggcgaggataccagtcggtggtgacgaaagcaagccgacggtgaagatgtagacacgtatcaaaggcaataacgaaatccaccaatcatgaaaatgaagaaaatagtcgacgacgacaaaggcaaccgtcagtagcaacagagatgatcgactatgatgacgaaattgctcatcaaacagtagtagagtgggcaatgttgaagaggcttgacagtatgttgatgaagatgacgatgttggtgatccagccaatagcagtgtagcaaccaatgataatgacaaagacgctcatcagcatttgcatagtaggtcaaccatgaaggtgaaataataagtcggcgaaaacataatcatccattagcaacagcggagatgtcagggccgatgaagcagaggtgctggtgatgatgtcagtgacaataatccatcaaattaatgttatagctgttgtagatgcttcacttggaggagagttggtgttgttgtccaactcgtccaaaccgaaatatttgaagttgttgaagtagaatgtctgctccgaagcaaagatgaagataatgactcctggagttgactcgttggttgatgaattgatttcttcagcttgacataaaatttgtcaaattttgagccttatatttgtgtagcccctgactctttgattagttgggaaacaactgaacatagagtcgagaactgtagcttcttgtcgtcgaatagtcattgcttgattgaagatatgtgttgaagatgtccaagtagaaatcctgaatattggagagccacttgttgtagtaaaataacatggcattgcatgccgagatgtcgaggttcacaaagacgtcgtggttggtgaagtagtaaaacttgcgaagtagcaacaatagagtttgccggtgccgaagataataaagatgaagtcgctccaccatgatgacaaagttgtattgccgtaatgaagtgaacacaagtcggcggcaacagaagcaaaccggtagtgaagacgcgcagttgtgaagataaaagcacaagtcggcggcggcataatcagtcggcgacggaagatgatgatgtccatcagtagtggtagctgtataaaccagacgtagaggtaagggcactaatcagcaacagacgagacgaccggcgattaagatgtagatgcccaacaacggcggcataataggccagccgtgcagacggaaacaccagtcggcggcgatggaggcaggccggtggtggagtcgtagacgcccaacaacgacggcataataggccagccgtgcagacggaaacaccagtcggcggcgatggaggcaggccggtggtggagtcgtagacgcccaacaacgacggcataataggccagccgtgcagacggaaacaccagtcggcggcgatggaggcaggccggtggtggagtcgtagacgcccaacaacgacggcataataggccagccgtgcagacggaaacaccagtcggcggcgatggaggcaggccggtcggtgaagacgtagacgcccatcaacggtggcataataggccagccgtgcaggcggaaacaccagtcggcggcggacgaggcggccggtcggtgaagatgtagacgcccaacaacggcggcataataggccagccgtgcaggcggaaacaccagtcggcggcggcgaaggcaagccggtcggtgaagacgtagacgcccaacaacggcggcataataggccaaccgtgcaggcgaaaacaccagtcggcggcggacgaggcggccggtggtgatgttctgactgatccattcctagagcgtaagagataagcttaaagccatgaatcccttttatgcatatctggatctggatcctgcagaacaaacatataggatgagtagtatctgatataaatataatactcgagaaaaaatcaagtattttaaaatatttataaatatgtatttctcctcttgtcaattttgatttccccgagcagatgactcattacgtttaaacgctctgcccaactagtcatagccaccaagcactgggagtcggcctaagcacttcccaaacatgcatatgagtgacatgagttcgtcattaatggaacaaagtttcacggatcggagtttactactcgggtacttttgcaattattaagagcagaaaataaatttatctcatctctatgcttttgatttattccgaataatacttagcaccttgcgttactcggtccatccaacgagcccccgggtgctaggaatcggcccaaaggcaaccatccattggcaaaccaaacggaaagcataggaagatagaactccataactcgataggtacttttgtactcagattatgtcgcaagcaatcaagataaatattataaaaaatatgatataacatctgtagcccccgactcactactcaatggaagaccaattggtgtagtgaggcagaggaaaaggaaaaatatcatataaagaataaaataaatgatgacttagctttgtaatattccccttggtgatggcagaagtggccaatgtgggaacaaagtcgtccatcaataacaatgaagacaccagtcggcggcgacgaaggcggtcgacggtgaaagcgaagacgcccaacagcggcggcataataggccagccgtgtaggcggaggcaccagtcggcggcgatggaggcaggccggcggtgaagatgacgatgcccatcaacggtggtgtgaccaaccgaccgtataggcggggacaccagtcggcggcgacggaggcaggccggtggtgaagtcgtagacgcccaacagcggcggcataataggccagccgtgtaggcggaggcaccagtcggcggcgacggaggcaggccggcggtgaagtcgtagacgcccaacagcggcggcataataggccagccgtgtaggcggaggcaccaatcggcggcgacggaggcaagccggcggtgaagtcgtagacgcccaacagcggcggcataataggccagccgtgtaggcggaggcaccaatcggcggcgacggaggcaggccggcggtgaagtcgtagacgcccaacagcggcggcataataggccagccgtgtaggcggaggcaccaatcggcggcgacggaggcaagccggcggtgaagtcgtagacgcccaacagcggcggcataataggccagccgtgtaggcggaggcatggacgcccatgaacggtggtgtgaccaaccaaccgtataggcgaggacaccagtcggcggcgacggaggcaggccggcggtgaaagcgtagacgcccaacagcagcagcataataggctagccgtgtaggcggaggcaccactcggcggcgacggaggtaggccggcggtgaagtcgtagacgcccaacagcggcggcataata

SEQ ID NO: 62534 - DNA, 34616 bp, Oryza sativa
cccccccccccgcgcgcacccccatatatatagagagagagagagagattactgtgctttaataaggcaaaacagagaacaaatttccaaaggggaggggagaaaaaaatacaacaaaggggaatttacaagggggttaaaataaactgtgtatccatgattgccaaattggtttatctgcttcttttactctatgcaaatgcaaagtaaattcatacttgaagtgtgatttccatttaccaaaatgcacttacacatcgttaaagatgagatcatttcttatgctctataaagaaagggtgggagaagctactttttgctgtagatatcatattcatgaagttcaaacttatgttccagtttatgacaacgaagtgccagcactgttgagcacaggggcaagtgaaaaagggatgcaaagaatcatctgtggttaatgtgttgcatgtaacacatctgattcccccttgggtgttgaagtgttctcttggtagcagatcctttgtgtttaacctatccattaataataaccaaacaaaactttcaatttgagtgtgcatctgcttttccagataagggtgatgggaacttctggttgaatatgagcgaagaacagatcataaactctttttgattgatattgatttgaattccaatgatatgtccactgatccaagagattaccgaaattcaattcatgtaaagtattgctcaggtgctgccattgttgaactgcttgagtagtttttttttttttttggggggggggggggttgaaaagcttactccagattaaccagttctttgaaaccctcgaaagaaatatcttcattctttgcaagtgagaacagaatgatcaattcttcttgcaagattctgccattccagttgtcttttcagaatagagctgtctccaatggccaatagcaacagatgtaatggctctgaaaattggtatattagcctaaacacatccttccaccagaaaaaaccctttcctatgtgtgcatggggtggcatgttggagtgtgaataatatttgttccagattaggtctaccctgggcaactccattttgttgaaatattttgtagttccagatttatgacttctagtccccttttttttctttggttgacaaactagatcccaagctgctaatgaatgcaccttagcattagggtcatttgatttcttccaaagataatgccttctagttcgatcaatatgctgaattaccttttttgataatttgagagtgcacatgtagtaagttggaagagaggagagagaactttgtatacgtatgaatacaaagtttgtatacatatgtatataaagtttatatatatatgtatacatagtttgtatacatgcctaatagaagaaccgaaaataaaaaccaggaaaaaaagaaaaaaaaagaaaaaacgaaaaaaccggaaaaaaacaaaaactgttcgcgtattagcttttccggtgccgccgtgcgccgcaattccgcaaacacttgcaccgtcgtttatccctctctctcaaacaccccttaagaaaacaaactcatcattagggtgtctatattctcgctctcacggatcattggactgtgggatatatatggtcctctcaccagctgccacatgcaagcaagttcttcaggtcgtactctctctcctcatcaatccaatctcattaactcatcacaagcatgcatatttgtttttagagtaaatatcagaaaactataactttagtgacaaaactatcagtttgctgcaacattagcggcatgtttcagtttactgcaacaaaagcgtgggaaattatcacaaaactataacgtttacgttatatactgctacaattgtcacctatatgtattgttgcagcatctctactctctactacttaaaaaattcatagtggtgatggtgaagccaacgtagacacgcgatccaatatacaaacgtacttcgacacgttcagagcaaaaaaaaaacggggcacgctccttctccgcaccaccgtggcgcaattcctacggatcgcattccgcaataagcgccaccccaatccaaaacctcgccccccttcaccccacacccgcgttgttccacgcctccaccaccggtgcccccatcgccggcatcacctcgcgccgcgccccatccttatcgtcatgacacgccttcaccgccggcgcttccatcgccgttgtctccttcccgtcacaccctcctcgccgcgacatgtctccaccaccggcgcccccatcgtcgtcgtctcctccccgactcccggtctccaactctccatcacgtcggcgcgccctcgactgatccccgccgccggaatccctgcctcggcacgcaatcgaccgatccccgcggcgccctcaaccgattcccgccgccggaagccctcccatcgcgcctcacggtctccatcacgccggctcgccctcgacagatcctagccgccgcccgctgcccctccccggaattgaatggcacagaacaaaaacacgagccctctgcggcgatggattgggagcaggtagtgccgtagtggcaaggctggcggcgttggtgcccggcgacagccacggtagacggaacgctacttgatctgacaagagtggcgtgaccaggccatcgccgccgcttatgcatgccaccccgcctcctgtcacccctactgtgaacctgcgatcaagcctccgccggcgggcacccaaggctgtcgcctacagtgcgacttcgccatccctgcctgcgcatgccctaagccgctgcttacagcgcgacttcactgccgccgcctgcacgagccccgccgacgcccgacctgcaatacaacctccgttcccaaggccaggagcagggggcagcaccgaaggtagacggcaccatcaggtacattgctttgtgcccatgctcctggacgatccttttctttaggcaataatttctgatcatcctgttgcagctaccctgttagaggctagagtattctgtgccaacgtcctgtcatccttcttgcgtgcccttgacaagcagggcagaagattcaacatctgaaccccaaaaggagtccacggtttgtgtgtcttatcacgaaattcttgatgcttatttctgagagattgaaggactagggtttaattcggttcattgatgtgttctctgtgcacaaattatctatgaccttcatgtgtttgatgaaatgcttgaccatatacagtttctgttcatgatgccaacgccgcctcccatccctgccatatgagatcaatctacctgcaagctatttctttccttttaggaagaagtaatgtggctactctctcggctctcggagatcttctgcctagcaacatatgcgttgaaaaaaggatggtgatcaggaaagaggcatttttttctaactgaaagcgcttcgcttcgaccaatattgttactaaacatggtaggatgattcttgtttttggttatgttagtttatataatatggttttcagtatatatgtctatattcccttttggatgaaaacgattttaatgaaatctatcatggaattatattctcatttgtgaattgtgatatgaaccaaatgtagctatggatcacattggcatcctaggtctcctgattatgggcaacaaggaaattgtgggcaataagtttactatcctgattacaacaggatttgcattgtgattgcactaaaaaacaataataaattatcgtgttgaaatgcacaggtaccctgaaataattttaggcaggcaaggtaccagggtaatgtctggccatgctacaaaagcaaacagtcaagtctgatatgtatggtctatcatgaaatggatgccactgtcttaactaagattttagtaatacttattgcatcaaagctcagttataggcatccaaactgtagcttttctcttgcagctgctatttaaaaattttcttttacatttagctacagctaattattttttttcctttcctggcaagcagctagagttcaagctccaggagaaggtcacatttaggcaagttctacagtctttcaggtaattgatcatttgatttccttgcatatgagactatacaaatttattgtgtgtttgactgtatgtggtgccactaccataggggacggtagtgacatggtgatatatttatcaattctataacagaactgttgcatggtgttatatttacaattgctataacttttgtccatctgtattttaagagctatttcaatcaagtacaatgtagttttgaccatttaactgatttatgaactgtgggaatcgaaggttcagagaatataatatttatttgcttgaggctttcatgtatgcatctccaactgacaacatgtgatgtgggatatgatattgtgccttactttcaatttacaatacaagtaaatactttatccattcaaatgcagcttgaatatatcaatagtttttttcagcatgcatatatatatatttccattgcatttttgtgtaattgaattgtatacaaagaaaatgtttgttgttcagtatgagttaacctttttaatatgataggttgtgtgcaatggtcaatgatgtgcaaattgcaatgctgcagaatgagagctgagccacacagtccatgtgccatgcttttcttatccactttgtaagcatgtgctcctttaaaaaaaattatatgattcagcttgattaacatttaatttgttatttacctaaaaattaattcattctaatatgatatttttgcagagtttcatgcaaccatgctgtttccaacccctgctgaaatgctgaacataaggatgaataatctaattttatgaggaaaaacatctctggaagtgcctgctttggttagtcatagttactcttactccatgggtattttcaattttttggagaaatgatatataggaaatgaaggaaaccagaaataatcttattattaaccttcattcgattgcagatacctgatacaagatgtactagggagttacagaacaggtaggaattgtaagaatgtcatgtgcatactagggagttactgttgcaaaattaattgaggttaactattgacttattatcaagcatacatgcattaaaaacataatcaagcatatatgcattaaaaacatattatctttctcttccatggaccatggtgtatggtactatggttccaaggtttaacaggttaccaatatgtgttctttgccactgctggatatcaggatcaaattaagtaggtatttattctactatatggtggtggagggtaattcttctaggtcaacgggtacttttctcattttctgaaaacaacacgatgatcatatttagtgataagagtattatgatttgacacattgatgctacattcttattctttctttgtgcaaacctggctcaaaagaacatattttagatgagtaggaagcttgtgttcttcgatggtctgaaaggttagcggctacaaatggcttgattaagttttttaatcccctcttgcttaattgtattctttacttagaaactttaactcaattgactcaagcaatggatgtacttttcttcagtttacctcaatcaatttatgttagcgtgccttgtacgtgcacgcttttaatcaataaattttcgctgacttgaagaactctgtagagcagcgagcagcagaggtaggatgttttgatagcaggtgctcaactaaaacccgaattgaatccatcttttggctttaaactgatgttcagatctggcattttggtgcacaacatgtagttggggattttttgacatttcttaagtgttttttcattgaacttgatcaaccaaagaaactgtattacatcaatattcatgacctgttagtctgaagctaaagcagaatcagattcagcaaatgcggatgtacaactatccaataagattgatcgagcataatcttgcaagattatgagataatgcatgtacaactaaataaagatacaggcttttctatactgaactggattttatggatcatcacccatggtcctctgtactcaaatcctttttttcttttttttaatggcatacaccccatggtaaatgaaaattgtattttctttctttctttttacctaaattcatacaatctggataatatattttatatgatcccttcttatacctgtggcttagctatttgtatttgtaaaccaacgatatacaatagaaataagccggtgcgatttgatgttaacgtattaattttttttccattttcaacgcacgggcacccaactagtataacgtaaaagttgcagttttgtgataatttttcacgctattgttgcagtaaactaaaacatatcgctaatgttgtagcaaactaatagttttgttactaaagttgcagttttctgaaatttactcttgtttttaagcactcaggcagtacagcataattgttgctatgctgtgcgtgcgccgatctggccacattcatcttgcttgaatcactaatctaatcatcgtagtttgtttttggtgttccagctttccagctttcttttctctctttttttactattaccaagaaagagggaagggctcaaggatgttctgagcgggctgctcagagcaacagcaggtggcaggcaaccagtgcatcgcaggagataggcgcacagtgttagaaagagtttgttacatgtgataatgcgcatgagataataagatagaattagagatagatttctgtttttgagtcttatctcctcctttgtatgcgccactttgggagcttttcccaaacatatattaacacgtacagcgacctctaacgaggtgagaacacttctgccaattcacatatatatggtatcacagccaaacacccacgcataagatcacatctaccacaatggcgagttcctccaattccaccaccaatccgctctctggccaagctgttctggagaagctcacaaggaataatttcatgctatggaaaacacagatccttcctatgatccgtggtgcccgcatgcatggaggggtacctcaccggtgcgaaacgcgcaccgtcaacggaagtcgacgtcaaggagggcgacaaagtcgtcacaaagatcaaccctgcctacgaggagtgggttgttgccaatcaacagatgcttgggttcctccttgcatctgtatcgaaggatatcctcactcaggtcgtcaatctggagacggtggcggagacatggagtgcaatcatgacaatgctctcctcacaatcccgtgcgcgtgcgttgaacacacgtcttgcgctgtccatgacccacaaggacaatctaagtgtaacggagtacattggcaagatgaagacgctggctgacaagatgtcatctgccgacaaacctctcgacgatgaggagatgatgtcttacatcctcactgggctggacaatgattacgagcccgtcgtctcttcccttgtcggcaaggcggaggcaattccagttgttgagatctatactcagcttcccagttttgagagccgagccaagctacgacaacaggcgaacggatcctccgtcaacagcgcaaggcatggaggtaagggagacggcttcaccgacaacagccccttcggcaacaccaactccttccgcgctcgtggcaacagcggaggctatggtgatcgcggtggccgggggagaggaaacggaggcgcgcacttctccaacaaaccatgcccgacttgttagctgcgcagcaagattggacacgttgtagcagactgttggtataggtatgatgaaaatttcattccaaattcaaaaacagcagctgcggcttcctatggtgtcgatgcaaattggtatatggacaccggagctaccgatcacatcacgggagagttggacaagctgacgacgcatgagaagtacaacggcaaagaacaaattcatacggcaagctatgcaggtatggacattaagcatgttggtcactctattattcatacccctatgtgtaatattcaattgagaaatatcctccatgttcctaaagctaaaatgaaccatgtctctgctcattgcttagccgttgataaccatgcctttgttgaagttcactctcattctattgctattaaggatcaggtcacgaagaatcttcttcttagagggccatgccgcaatggactgtacctgttgccaacatcttcattctctacatccaagcaagttcttggagccatcaagcccacaatttcaaggtggcataatcgcttgggtcacccatctttagctattgttcaaaaggttgttagtaataataatctcccatgtttaggagatgttaatgagtcaggagtatgtaatgtctgtcaacaggccaagagtcatccgaccctatccaaagtcatctatcctttagagctttgtgttttcagatgtgtggggacttgctcctaagtctgttgggggcagaaaatattatgtcagtttcatagatgatttcagcaaatttacttgggtttatttacttaagaataagtctgaagtctttcttaagttccaagagatgttccaacaatgggttgagtgcctttttaatcgtaagattatttctatgcaaactgacaagggaggagagtatgaaaaattgcattccttcttcacaaagattggcatctctcatcatgtttcatgttcctatgcacatcaacagaatggttttccagaacacaaacatagacacattatagaggttgggttaattagctctccttgctcatgcctctatgcctcttaaattttgggatgaggctttcttagctgccgcttatctcataaaccgcatacccaacaacgtcattcagtatactactcctctagaacgtctccttgatcaaaagcctaattattcagctttaagaacctttggttgtgcttgccggcccaatctccgtccctataataagcataagcttcaattttgctcaaagcaatgtgctttcctcgggtatagcaatattcacaaaggtttcaaatgtcttgatatatcaactggcaaggtctatatttctagagatgttgtctttgatgacctttgcaaagttgcatgaaaatgttggagcaaggttgagatctgaaatccttttgcttcctccttccttatatccaaatgttgcaattaatggggttgaatataacgatcactggcttaatgctcctgatcattctaatgggtcttctgagcatatgacagatcaacaggaacaatccaaagaaggtgctgaaaatactggatagaataaccaagttactgcagaaaatcttgaagaagatgcagcagatccagatttcacagaagatcccggagacaacatctctgatggctcaaatcccgagggtgatacccctgcctcacttgcgcactcgcctgcgctctcattcaacaatgacgaggatgtcaatggttcgcttactcaacagcagggggatcaatcgtcggctatcacgtccccaattcctagcaatcatggcgatggcagtgaaggatcctttgtgcctacttcggatccgactgtggctcagcctacatggccaactactcatctccattgaggtataagaaaacaaaaggtatactctgaggaaacttttaaggtatggtctgttgacaactacaggagaaccccaaaatctagatgaagctttgtctaacaaaagttggaaaaatgctatggatgctgagtttactgcattgttggaaaataaaacttggcatttagtcccacctagtcatggcaagaatgttatagattgcaagtgggtatacaaaattaaaagaaaatcaaatggtagtttggacagatataaagctcgtctagtagcaaaggggtttaaacagaggtatgtgattgactatgaggacacttttagcctagtagttaaagcaactactatcagatctgttttgtctattgttgttttctaggggatggtgtcttcgtcagcttgatgtgcaaaatgccttcttcatggatatcttgaagaggaggtgtatatgaaacaaccccctggttatgaaaataagagtaagcctcgttatatttgcaaactagacaaagctctttatgggttaaagcaagctcctcgagcttggtactcaagactgagtactaagttagttaatcttggttgtcaagcatctaaagctgatatgccactgttcttttataacaaaggaagtgttacaatatttgttcttatctatgttgatgatataattgtagcagtgactgcattgctggcagacttgaggcaagaatttgcactcaaggacttgggagatcttcattattttctgggtatagaggtcagtacaacaggtgatggtatggtgatgttgtaccaacataccccaaaatcatcaagatacggtctatgggtatcacctgccgacgaatttataaaaaacaatgtcatagcacttggccgactgcattgtaaaatttgcgctaaacaatgcttaacttaaaatcgcattgtaccaactctcgtaaataaaaggttgtgtaacaacagaaaaggaggattttaaaggtattgggccctgtccatgagcatattgtgaaagcaaatatgcttaagtccctaaagacacatggcatgtcgcacccgaatataggctgcgaacgctaatggacttcgggctgtgaacgctaatgagcatcggttcaaaactcactgataccttttaaaaaaataacgtgagatagtgtatcgtcttctccgccgcttcatcttcctcgaaaattccttttcgtgcacctgttcatcagtcgccgccaccgaagctagggttcgccctccacacttgttcagccaccaaatcgcttccaaatctcatcacacacaagtgccttccatccccttccattttccatcctcaataccccataagaaaacttaatcagagctttccccatctgtaactccccgattttcgttcgggaataaaaatcaatcaacaaatcatttctagaaattatattaaaatttaaagcaatttcaccaagtgaaattataaagggaattaaaaatttattttaaaaatcatggccaggatattttgtaatattctttgtgccctaatgacctctctgaatttttccgtgaattttcggagctcaagtaatatttttaaagtcacaaagttcattaactcaattaaaataaaaagaaaaccaaataaaaactctccctcccctccctttttgggctcggcccagttttccctcccatcgggccgggcctcccttctctctctcccttagcccgctagcgaagtctgctttgcccctcctctccccgagccgccgataggtgggccccacctgtcgggctctccttcaacctccagcccgagctagcaaccgccatggccgcccgagcagcccacgtcgccgccgcctccggcatcacgcgccctctcccgtgtggcccggacaatgccgcgccctcccctccacctcacagcccacgtcgcgtaccccgctccgtgaaaaccgccaccgccaacctccccacgatgccacccacgtcgctagccgttgtcgtccaaattcgccctggctcggctccctctcgccccctggagctataaaaacattccccacacctccctctctctttttccccaatttccccaagctgttgcgccctctagccgctcccttgccgcgagcctgagctccgccgcccgtcggcgtcctccaaccacgtgccgccgccgcccctgtcctcgccacactgcgtcgtcgccaccaccggcttggccgtgcctcgccgcaccccgggctccgctcctttcccccgtccattgtcggagcaccactaccaccaccacacctgagccgcctcaccttcaccgcctccagccgcacctcgtcaccgtcctagccgtcggcacgccacgcgacaacctccaccggcttccccgctgcaagggaaagccaggccgccgcctcatttctcccattcgtcaccggaaccacctccccaccgcaaacccgaggtcgccgccctttttgccgcctccggccgcggtttggcgctactcccgatcacctctcgccacacaaccgcctctcacagtgtcgccgcgtcctgttgtaccccggttgccgctccaagccattggaaacccgccggagctccattcccctcacgcgccggtgagttccatcgcctctcccctccccggctagcgattcccgccgcctcaagccatatctccccctcctaacccctcctccacttttggcaagtctcgagcgagcccggccacccctccgcgttcgccggtcatcgccggagctccgccgcgccgtcccgtggtcccgcggacgccgccgccccccgaccgctcgccgtcgtgccctcttggctgccgcccctcgttgaccaccccatcctctccctctatctccccttcgctggctgcccagtatcgcgccgccatcgctggtggttgtccggccgggccgtcgttatcgctcccgccgcgcatagctccctcgccgccaccggctggctgcttccccttggtctcggccatggccgatctgggccgtcggatcggcctcagcctccatccgggccatccgcgtggcatcccatcttggccttgcgtcggtgcccgcgcggcgccacgtgggcgccacctccgcccgttgtctgccgtggccgccacgtggctgccgcgtgctcgcgagcagcgtgcttgtggactcggtccaccatgcacccgtctcccttgagtcaccgacaggtggcgcccgcttgccgacgccacctatccctcggatgacatcacaattcatttaaaattgtgcaataattcgagtaataattatagaaattcatttaaatggctcaaaacttctaaaacataactaattcatacgaaatccaaattgggccattcaacttgcaaaattcatccaaaattgagatctacatgtttgtttacttttcatgtactgtttacttggtttttattagtgttttttctcgttttgcatgccagcgtgtagatctcactatttcggaagatcgcgttcgcgaggatcagtgttcggaagattattttgaagaagcaaggaaagtcacacattacccttgagaattttgagcctactttacaaatgttttaccatttacaaataaatatgcatgttttgctgattacatgggattagggtttacctatctgattgctagtgccatattatttgatatctgtcctttgtcaaccttgggtgataaatcgactagcttgtatttctatgatgacctagctggaactatatgcttagccatgcttaagcatctgatgatgggataattacattattacaccccttagtatcatgacgagctacgcgctcgagacatccggccatgtttcattggtcgtaactattcaactaaaatgcgacagaatggtaggctatgggtgcatggttttgctagtcgcacccatggcaattaaggactggttcgcgggatgcactggaagacttacagcgcttgccacaagcgggaatgggtaactacctgacttgaagtatagctttcctctggctgactcatctaggcaagggtgggcatgatggagcgggatgggccctgtgacagcctttgtcacttccggattcacctaggaacgagaggggactgcccgctgcctgttgaggagtgggggtgaaacctgaggtgttgtgtgcttggtcagagggggttatatgaagggtcttgtcacaatcactcgacatggtgacgtgtctggccaggcgcggtgacatgccggtggattgtgtcttgtctgtacagttgtgcacctctggccagagtaaaacttttcgaatagtcgtgcctgcgattatgggtgatcaaccagaatcaccgtgatttgtctcacacttaatgaatcgactcaatgcactgattagttcaggtgggaatggttgggcctgttcaacatggtgtagcgttgatcagtggagatttaatgttactttaattacgcaactgttttattgttttgctcaataaaatgatttgtaaccgtctttatgcaaatagccacaagccatccttgtatccccttgcacgtctgcatcattggtgtggcttgctgagtatggtggttgtactcagccttgctattgttccccccttttcagaagtgtagtgcttctgatctgaagacgaagatagaggaccaaggctcagacccctgttgagttttgcctatggagtggagctgaaaccccactaggatcgccttttccactgctatcattctctttcggtgtgatgactaagcgcctcttctgtaagtattttacgctttatttacgtttggaactgtttattacttgtcgttttgtgtaccctggctgattcctagacagggatttaatacacaaaatagtctggaaatttgggctaaatttctgggcgtgacaaagtggtatctgagctaactcgactgtggttcaccactcatggcaggtgagagagaaatcccctttgaccaatggacgagttgtaagggagagagttgtgtgatgcttcacttatatctatgccacaactggtaaacaaacatgttaattctgtaattgatcgactatgtattgagtttaaacatgttattcacattgctagcgagaatgaagagcttagattgctatcttctttaaatactagagggctatattcaatttgatgatctttgtccactcaattgtttagagaagaaattatttgcaagatttgaactgccatgtcctcctcaagtagtttttcatgttattggcactcatgataataaaggagagtataatgtgcatagggtatatatttgttcaaatttgaatataccacattttcatgatgcgatgtattgtctagaggaccgcatgcacataaataattctctgtctagtttctctagttgtttaaatgagttataggttggtttgtaagaagggtagtgttgtggtttttcgagtgtcaaaatttcagaattcaaccatatggtcatcaagtctaccacaacttgtgataaataaagataagtttaacatgctcaatgatatggtgaaaccgagcacggtttcgaatttagaaggggaggatgacgaggatatcactagctcagatatgatcatgcataccttatgtatttatcaactaaaggtgcatgctttctatgtgagatttatgtgctacatatttgaacaaacattactgcacgatgagtttgtatcttctcgtttgcaaaaatactagcatgggtgaaggaaaggatcgtgggctcacaaagtgtttgggtaatcaaagaaattgatcggggaccaaacaaagatcttacccaagtctactcttacctcaccatgtcacttttggttaatagaaggcaagaaataaagttctacatgttttggatacggattcgggcctcctgacagcataaacttcaaacggacctagcctctgattgagaaggaatctcaaggtccatgagtacttgttggaaagcttatggagtttacttccatatggttttggtcccacatcaaaatttctatcaatctatcatgaatctgcaaaacaagccatatacctcatccaatccaagtctgatttagacattggaccttttaattgtgtcgtggacatagggtggcacccttaggataaccctaagatgtccctaaacatatttattcagtagccatcataatttagagttggattttgcttagattatttctgctactacaggtttgccgctagtttggttggtggaaccccattcaagtgcttaaattttcatatgcaattgagttgcagtttaccttgttcttggcttcttgcttatgttcttcgattcgcatgcagaaattagccttctcagtgatgtcaaccggacagtgtactgttgattaccagaggagacgtggtattgcgattgcagggttcggatcgtgttgatcggaaaccggatcatgtgtgtcaagttttcgctaaatcaagagttatcgatatctatcggaagatcgggacctagttcctcatcaggacggagtggggtcgccggagaggggatcgatgggcgatggcgttcaaaaaatgatatagcggagaagcatggagcatgattggaggcatgattagggttagggttgggagtggcgtgagagagttagggagggttgggggaggtgcgcgggtgtgtgcttggagacaggagaggtgggagtgatatgggacgttgaatttgagagagacgattctaaccgttctataatgtactccctccgtttcagattataagacattttgactttagtcaaagtcaaactgttttaagtttgactaagtttatagaaaaaataataacatttttaactcaacacaaatttattatgaaaatatattcaattattgatttaatgaaactaatttggtattatgaatattattatatttgtatataaacttagttaaatttaaagtaatttaattttaaccaaagtcaaaacgtgttataacctgaaacggagggaacggagggagtatgaagtatgaaaaatgaagaagtaatactgtgttgatgtcctatagaacagatgattatatttgaaaaacagagggagtaattaattgctagttagctaattactctagctctgagctactccactatagagaaaatggtgatcagtacaggctcgcgatctgcgagctacagaagacgagcacctcgtcgagctccgccctgctctcgtcgccgaacaggctctccttcccgtccggccgcctcgcgtacgacagcccgagccgcgaccgcgcgccgcggaggtcgccggcgccggcgctggagtcgggccccgtgaacacccccatcacggcggtcagcggcggcccgatgagcagcccgtcggcgccgaacttgtggatattatgggtaccccatacccatacggcatggttatccgactagttataggggataacttatatctatgtaatatgtaacagatcatgacttgggtgttacgtttccttgtatattacggaacggcctaaagtcctgatttaggaaaccgataccgtattggttaaagtttctatcttgtaatcctgccccccaccctatataaggtgggcaggaggccctctagggggcatgagacaacctgatcgtcagatctatactacaccggcggattcaaatccccaaacaggagtagggtattacctctcatcgagagggcctgaacctgtctaaatcctttgtctctgcatccatccacttttaggtctcgtgcgctacctccttttattattgccgaattcatgtttcgacagttggcgcgccaggtaggggttgcgtcgagtttcctatcaacgagcgcgatggaatcaatttcatgagtcgccgacttcgctttcgctttgggagttttcacttcctttgcgtcgaccacttcttcaagctcctcttctctgacttgatccaaatcagtcagggggaaactcaatctgatttttatcattatttatcatattgatttttaatctcagattaatttcttgctattttttgttgttgttcgcatataactacgcggcactattgaggcgattgatgctggtcatggactcgaggcgtctcagctttccggtcgatcggccgcgagtccactccgccggcttgtcctcgccaccgccattgctgatagcaacaacgacttcaccgccggcctgcctccgtcgccgccgactggtgtcatcgcctatacggttggtcggtcacaccaccgttcatgggcgtccatgtcttcaccgaccggctggccttcgccgccgccgactggtgtttccgcctgcacggctggcctattatgccgccgctgttgggcgtctacgacttcaccgccggcctgcctccgtcgccgccgagtggtgcctccgcctacacggctggcctattcactccgtcgccgccgactggtgtcctcgcctatacggtcggttggtcacaccaccgttgatgggcatcgttatctacaccgccggcctgcctccgtcgccgccgactggtgtccccgcctatacggtcggttggtcacaccaccgttgatgggcatcgtcatctacaccgccggcctgcctccgtcgccgccgactggtgtcctcgcctacacggctggcctattatgccgccgctgttgggcgtctacgacttcaccgccggcctgcctccgtcgccgccgattggtgcctccgcctacacggctggcctattatgccgccgctgttgggcgtctacgacttcaccgccggcctgcctccgtcgccgccgagtggtgcctccgcctacacggctggcctattatgccgccgctgttgggcgtctacaacttcaccgccggcctgcctccgtcgccgccgagtggtccctccgcctacacggctggcctattatgccgccgctgttgggcgtctacgacttcaccgccggcttgcctccgtcgccgccgagtggtgcctccgcctacacggctggcctattatgccgccgttgttggatgtctacatcctcaccgttggctcaccttcgctgccgtcgactggtgtttccgcttacacggctgacctattatgccgccattagtaggcatcttcgctttcaccgtcgaccgccttcgtcgccgccgactggtgtcttcattgttattgatggacgactttgttcccacattggccacttccgccatcaccaaggggaatattacaaagctaagtcatcatttattttattctttatatgatatttttccttttcctctgcctcactacaccaattggtcttccattgagtagtgagtcgggggctacagatgttatatcatattttttataatatttatcttgattgcttgcgacataatctgagtacaaaagtacctatcgagttatggagttctatcttcctatgctttccgtttggtttgccaatggatggttgcctttgggccgattcctagcacccgggggctcgttggatggaccgagtaacgcaaggtgctaagtattattcggaataaatcaaaagcatagagataagataatttattttctgctcttaataattgcaaaagtacccgagtagtaaactccgatccgtgaaactttgttccattaatgacgaactcatgtcactcatatgcatgtttgggaagtgcttaggccgactcccagtgcttggtggctatgactagtcgggcagagtgtttaaacgtaatgagtcatctgctcggggaaatcaaaattgacaagaggagaaatacatatttataaatattttaaaatacttgattttttctcgagtattatatttatatcagatactactcatcctatatgtttgttctgcaggatccagatccagatatgcataaaagggattcatggctttaagcttatctcttacgctccaggaatggatcagtcagaacatcaccaccggctcgcctcgaccgccgccgactggtgtttccgcctacacggctggcctattatgccgccgttgttgggcgcctacgtcttcaccgaccggcttgccttcgtcgccgccgaccgatgtcctcgcctgcacggctggcctttatgccgccgttgttgggcgtctacgtcttcaccgaccggcttgccttcgtcgccgccgaccgatgtcctcgcctgcacggctggcctttatgccgccgttgttgggcgtctacgtcttcaccgaccggcttgccttcgtcgccgccgactggtgttcccgcctgcacggctggcctttatgccgccgtagttgggcgtctacgtcttcaccgaccggcttgccttcgccgccgccgactggtgtttccgcttgcacggctggcctttatgccgccgtagttgggcgtctacgtcttcaccgaccggcttgccttcgtcgccgccgactggtgtcctcgcctgcacggctggcctattatgccgccgttgttgggcgcctacgtcttcaccgaccggcttgcctttgtcgccgccgaccgatgtcctcgcctgcacggctggcctttatgccgccgttgttgggcgtctacgtcttcaccgatcggcttgccttcgccgccgccgactggtgtttccgcctgcacggctggcctttatgccgccgttgttgggcgtctacgtcttcaccgaccggccgccgcatccgccgctgactggtgtcaccgcctgcacggctggcctgttataacgccaactgatgctatcttcttcacggctggctacatcgctgtcactactaataggcatcagtatcttcaacacaagctgcctacgtttgccatggctgccgactggtttcttcacttccatggctgcatgattctgccagtgttgattggccttaccatcttcatcgccggtcgtctcgtctgctgctgactagtgccctcgcctctacatctggtttatacagctaccactactgatggacatcatcgtcttccgccgccgactcgtgttatgccgccgccgactagtgcttttatcttcacaactgcgcgtcttcactaccggttcacttcatcacggcaacacaactttgtcatcatggtggagcgacttcatctttattatcttcggaaccagcaaactctattgctgctacttcacaagttttgctacatcaccaaccatgacgttgttgtgaatctcgacatctcgacatgcgatgccgtgttattttactacaacaagtggctctccaatattcaggatttctacttggacatcttcaacacatatcttcaatcaagcaatgactactcgacgacaagaagctataattctcgactctatgttcagttgtttcccaactaaccaaagagtcgggggctacacaaatataaggctcaaaatttgacaaattttatgtcaagctgaagcaatcaattaatcagccaacaagtcaactctgggagtcatcaattttgtcttcgcttcagagcagtaggtcaagattaaatttacatgtctgggagtttggagtcatcaaccaatcaactcatatcagattcaatgagttgaacaacagcatatactttcctccaagtgaagcatctacaacagtttgatggattattgtcactgacatcatcaccagcacatctgcttcatcagctctgacattccgccgttgctaatggatgactaagactttgccaacttgctattccgccttcacggttgacctactatgcaaacgctgatgagcgtcttcgtcattatcatcggctattacaccgctattgactggatcaccgacatcgtcatcttcatcaacatcctgtcaaacctctttatcatagcttactctactgctattgataggcaacttcgtcatcatgtttgatcatctctgttgatgcttatcatcattgctgtcggttacgtttgtcgtcgccgactaatttcctcatcttcatgattggtggatttcgtcatcgcctttgatctgcctcgtctgtcaccgactgattattttgctgccatagctacacaactttatcgctgagcgccttcatattcattgctggctgatctgactgctgccgactggtttcttcgcctccacggctgtgcaacttcatcacttttgattggtatcactatcttcactaccaccaatatttttgccacctctgttgggcaatattatctctatattggtcgtcttgtctctatgccaactgcgtcagctaccatcaatgaacaattgtgactacgtgctcaggggcttactagctcaaatacaagtattatatcttcaatttggacttgctccggatacatgcaacatgaattcatgatcatgggtctattttatatgctcaaagactggactatttattattccccgtaagggttatcaactgaatacttgcgccagtcgggattcaattgttacatctattttggagtatcccataagggataaccactcagatcagaagctattcatatgagctacgcttggtctatattacccggaagatttattactcgggagcatgttatatgcgtcatcctttaaagggtgtcgaaggcatatgttttggcctaggcctaatatgtctgcagcccatattttcaggtgtggcctgtcacgttcttttagggacttaggcactttttgcttaggccaaagtgcgcgtgatcaagtgcccaataccttaaaatccttttataccgcagttacttaactttttaggagttgatacaatgcatcttaaaaggtgtcaaacagtaaagctttatatagctgtcccgctgacttttttatatataattcaaggtgctgtttgagtttttaagcaattgattggatacaatatcattgcttttcgccacgtaagtgtgcatttttattgaccaatattatggcttaggctgattatatattgtggtctttttctaggcggttggtaaatcctttatgagtttatttactcggattttacaccacatatgccatatatttccaggtgtggtgaaaccatgtgtcttctagggacttaaacacatctgttaaagcagtgtgcgcatggcgtatgcccaatactttggaaatttctttattcacaatatacaagcttctttatagctattttgctatatcactcatcatattttacaaagcagttggtatatcactcggatcatgttatttggaggattcacaccgcatatgctatatattgatatcaagtcacttggttgattacgattatcaaaaccactcggttggttggattatttattccttgactatatgcttggtttgttcaattaaccacattgtcgggggctacacctattaggtgcatctagtcggtgcacctgactttatttttcagccctccacagtcttcagatttggtaaaagtactcgggagaccatgacaaagatgattgaagcactcggctttggagtaatctggttcgagagaagattatcttttcgactgcgaaggtctcaggggctactgtggatattatgggtaccccatacccatacggcatggttatccgactagttataggggataacttatatctatgtaatatgtaacagatcatgacttgggtgttacgtttccttgtatattacggaacggcctaaagtcctgatttaggaaaccgataccgtattggttaaagtttctatcttgtaatcctgccccccaccctatataaggtgggcaggaggccctctagggggcatgagacaacctgatcgtcagatctatactacaccggcggattcaaatccccaaacaggagtagggtattacctctcatcgagagggcctgaacctgtctaaatcctttgtctctgcatccatccacttttaggtctcgtgcgctacctccttttattattgccgaattcatgtttcgacagaactgcggcccgccccgcgcgtagtcgaacagcgccgccccgctcccgcccaccttcggcagcaccaccaccgccgcctccttcgccgctgcgtccgtgtccgtctccggccaatagaagaggaaggcgtcgagcgtgtcgtagtagtcgtctgtgctccggtacccctccgggctgaacccgccgaacctgaccccgccgccggtgcggccgacgactacgcaggggcccttgaagtcgcaccggcgatggaagtccgtcgcgctgaagccgtccacggtggccttgtagcagcatttcagctcgcgacctgcactgcacacgggaattaattaaccaggaattagttactgatcagtaatcgagcaagaactaaatcatcatcaagaacaagatgatttgggttttgcctctgaggtgggtgttggcgacgagggacatggggaacggcggcgcgacgtcgtggtactggaactccggcggcggcgcgcttctgccgccccagctgaagaggctgcgcggggtgacgaatcccgccgccggccggcagctgcgggtggtcgaaggagccaccgtcgacctgccgctcgccatgaacgccgccatggtgatcgctctctgctcggtgtcatgggctcatggctacgctgtcgcgcgcacgcgaaccttatctgcttcggtggcggctgacatggagggggtttgatgacacgtgtcgcagcttgattcgctctgtttatcgcgggctctgctctctggggcccaattgcccaagagctgcaaaaaatgggtgttcatacgtgtaaatttttatgcatatatgtaatttttgcggtatcggagtgatgaggactggcaacaaaaatatgaattacacagcattttgtacaaggcaaaagtgtgttagccataacaattcttgcaaataatttttttttcggtgtcaactagtatatacatttgggtgattcatctaaaacgagtgtgttagccataacattctagaacgagtgaattcacataattttcccctaaaaaagaattcacattttttttctcaaaaaaatgattcatctaaaattggtacacatgaattatattttttttcaaggaagaccgaagacagagtagattgtacattgttttgctcaccttagtttagtaggagtacatactttcgctttaccccagggtatactataatttccactttgcactaggttgcatcacataattaaaaacaaaactcataaaatatgagcacaacttatgaaaccttttgaatttagatcatgttttacgaggttccattaatttattatgatttttttagagatatgattatataagtcactctttagccagtgtcaggtgcaatttattctctcctgaactttgttcagtgatgaaatactccttcacaggcctattgggccataattccatatcagacgccagcccagaacaccaaatgagcccaatgaacccattttcaggcccattttcatacttggcccaactgcaacatctagaaaaaaacattatttttttttaaaaaaaacttaaaccctaccaaagcaccaaacctcgtgacctcgccggaagccgcgccgccccagccgccgccatgccaccgaaggccaagaagaagcagtccgcggcgtcgccgcagccgtcccctcgcacccctgcatcccgcggccgcgaaggtggaagcgtcgccgcgggcggcggcgacggaggaggaactctcgacctcccgtccgtcgccgcggcggcggcggcgcggcacccggcgctcgtgccccgtggcggcgaggggtgcttctccgggaccgtcgcggaagtggcccccaggggcaggagccgcggcggggaggcgaggctctggctctccgagcccgccatggtcggcgccgcgctgcggcctgggtgcctcgtctccgtaagctcatgcttgatgctcctcctcctccttgagatttttggaatgcttcgtgtgcccaacttgctttttaagctaaggaagctatgattgttctgtaaatgtgatccttctgtagctaaagatgctgcgattttaggaatgtggctcgatttggcataggttagtcgatggtgagctgctgagcttacctttgatttgtgtgagtccatttcactgttgcttattgctgcaatgtttgctttgatgctgtatagcttgtcgcagttgagaagttgaatttatctcttggtgctgaaaatcatcgttttgtttactagcttcagcaaatctttttaatgaatcactagtgatcccagttcgtttcccatcagcttgagcattgtcactaaacagccatgtccagatatgtgttatcgtgtcgagttatgttactctcatcgtagaacaaaacttccgtgtttatacttcatgcaatgatgcaaaaaccgtttagtatgctagtctaaatgtcctttttggtacataagctgaaactgatctccttatttctaggtatctctcatttcttcaaataggggtcgatcagatggttcaccacttgatagtttatttgaggagtgcaacgagttctttgatcttgatgtggataatgatctcatgcctaatgaagctggtcgaaactttgtgattgccaaagttttcccctcacgtgaggtatgtgtgccttgtacttataaagcaatggttagaatgcttaataactgataaagtttttaatcttgtcccagcgaaaaagtttttaatcttgttgttttcttaggtccaaaagaatggtatcaagctgtcttgggaccttgcttgctccctgggaaatccttcagtaggttgttccttgttttttagccccctatatacatctcaggccccaaaggaaactgatagtgttgacattttacgggtgataaaatgcagcaatctttaccttagttttgtcccagctaaagttggatcttccagcgagattgaatctgagtctgtacaccatcctataagaaatggaatggttatagaatcacctaagagaaattcttcagttctgtcaggcaggaatgagtcctatgatattgcatcccacagtggcccttcattgtgtttggatccagctactgcaagatcatcattagcagatgagaaaattaatgagttgctgcagacttgtgcatcacgctggctcagtggtaggcacctactgaaagcaaactatgttcccctcctgatgtgtgggaaattgtctatgtttattgttatgggagcagaagtagatggttctgctcctgatgtggtgcatgataaagataagttaccgtctaatgaagagatttctggtaaatttggggaagcgcctgtttcattccttgttgacagaaccacgaaagtgcatctttctggtccagtctgctcagaggagattgcctttgttaagccaggcccatcagcacacaattcctttcgtactgatgcaagaaacggagatttcaatcacggtccaagacttggtgggctatccaaagaatcaaaagaaataaaagaaatcatttcattttcaatcaaagaccaaattggcttgcaaaggtatactgtgaaatattgattcatcgctcacgtctaaccataaaaaagaaagttatttccatcactaatatgttgactggtttcagggtcaaagataacctctggtacagaggtatccttctttctggtccacctggaacagggaaaacctctcttgctacttcttgtgcctatgatgaaggagtcaatctttttacaatcaacggaccagagatcattagtcagtattatggtgaaagtgagcaggcactttatgatgttttcagttcagctaagcaagctgcccctgctgtggttagactctctaatgctttcctacatttttttcatcatgtcaactatgctttaaaattaagaaaatttgcctctttcatagttttggtttttcacttatatgttgtgaaactgaaaaaatataataattctttgtggtaacttttggaatctatctttacaatggtatctcctatactcggatagttagcaaggtattgaatataaagcatctttactaccttctgataatttgctgaatacatttaaattttgaattctaggttcctgagttgtaagatgttctttgcagctcatatgttttaagttacattttgttctcttaaaaatttatgccgccaaactggccagtttacattgatatattgaaatctatgtttcatatttcctctgtttataatgtaaaaactccaagccaccacataaagccacattgtcaccattttttcacactgttcgatggctctttgatactttagatcatcacctattttttctaatacaaacaaataattttctttatgttggattcggcacttctcgatgagaatgatgacttccagtccaacatattttacagtgcacccatcaatgtccacatcaatgtgctaggtatcatctagatatgattatggcagtggtttactagacatatactatggataacaagtattgagtgccctgattagttttcttcaaactacatgttaccattgtaaaagaatcaaggattgattacctataatatttttttcttttagatatttattgatgaattggatgcaattgctccagaaaggaaggatgggagtgaggaattatccattagaattgttgtcactctgttaaaactgattgatgctatgagccctagagaccgtgttctcgtgattgctgcaacaaatcgacccgatagtattgatccggcattgaaacgcccggaaaggttggaccgaaaaattgagataggtacaaatatctgatgctattcttgtactcaagttaatgttatgggtgtaatctactttacttgcttgttgtctgttcagttattgacaccaagaactatttaaattctgagatttgttgagtacatggatggatcattatatgttgaataatcataacgtttaaaccaaaaaaaatttctaaacaatggattatctttgaagaaacatggtatcatccctaccctatagattattttatcattttctccacgtgcttataggtgatatcaaatgtgatatgagaacaatcaattctaatggtgcaatagcatggttgtccagttgataaattgcttaccttaagtcatctgttgattttttttcccctgaaatggcttgcttgcaggagtaccatctccagtacaaaggctggacatacttcaacaccttctagttggagttcagcattctctcagttgtgagcaacttgagtcccttgcttccgctactcatggttttgtgggtgctgatcttgctgccctctgcaatgaggctgcgttaagtgctcttcgccgttatatcagcctaaagaagagttctcaacaactagggtattatgacaataatgcagaaaagcctgatattagagagattaatgatcctttggggtatcaagtaaactcaatagcatcctctctctcaaagttaacaatgtcagtggatgatgtcctgtgcaccagtaggagcaatgacacagaaaacaatggatctagtggcaagaaagatgacttgctcttgttagtgaccactgaggactttgagaaggctaaaattaaagtgaggccgagtgcaatgcgtgaggtatcatattcaccctcccgatctacccaatttagtctgatgacaatctcttctataataatttgctatttttcctttctcataacagtttgctgcttaagcaatgttgttgttctctctcatcttttcttctctttttttttgtttgtgtcaatcttttcattcatgaactccaatttagtctagaagttgcatattcgttgaaaattgatacaaagctttgtcaaatagttcagttgattgtatgttccttttgtgtttcattactcaatgtgcttcataaatgcattattatcctatgggaaataaaaaactagtgtttttttttttaatctgtagctgatcgtcatattttgatatctatgatttcctttacaggtatcacttgaacttccaaagatacgatgggaagatgttggcggccaagtgagaatcaaggagcagttaatagaagccatcgagttgccacagaaaaacccgaaagcattcgaaaacatgggggtcagcccccctagaggattgctaatgattggaccacctggttgcagtaagacattgatggcccgggctgtagcttccgaggcaaaactaaacttccttgcagttaagggtcctgaacttttcagcaaatgggttggggactccgagaaggcagtgagatcactatttgcaaaagccagagataatgcaccagcaatattatttttcgatgaaatagatgggcttgcagtaactcgaggccgtgaaaatgatagcgtatcagttggtgatagggttctcagtcaattgctagtggaaatggatggtgagttttaatacctcattgtgttatccattattttagtcctgcaattagctcagcagttattttaattggattatttcgttgttaagagtacaatacaatttggtgttttaagcttgtgattgtggattatgaataattttaattggtaactgtattcatttgaagaatatcatggttgttccctgcaaaaaaaaaaaaaggactgcttctgaatatgaacattggctaacaattgcatgccaaaaatcctctctttggctattcctgtcaatgtcattagcttctcttcgtattcatgtttttgtcatgtacaacctctaaaagatcctattgatgttttggttagagcatgcataacttattatggttgctacaggtttggagcaaagaattggtgttactgttattgcagccacaaatcgccctgacaaaattgattgtgcacttctgagaccaggttatttgtccggttattcacattttgtctggcttacatacattggttgggttacttatatagtacttggtctgactttatgaacaatgtatgcgctaggtcgtttcgataggctgcttgatgtgcaaccaccagatgaggctgatcgtgtggatattttccggatccatacacgcaacatgccatgtagtcatgacgtcaatctaaatgagcttgctagacttacagaaggttacactggcgctgacataaagcttgtctgcagggaagctgctattgccgccttagatgtaagctatttgttctttcccccattgttgcacatgactattggattgtacttagatgtttgtgattcactgataaacaattattttctccaggagaacattgatattccagaagtagaaattagacatttcaagtctgcaattagcagaataaagccatctgatgttaaattttaccaagaactggcggcacagtacagcagattcgttgatcctatgtcgcagagtaaacaatgatacttggcagtggacggtaaggcacatatttgaacctgccactttgtagcccattagatatttgtgtgtaaatagagaagctaagcttttgttagttaccagttacgcagaaaaaagaattaggcaacatcacatttccccattgcttcagagcacctatactgtttgtagcatttttactcttgagaaacttggccagtgctagcaattgagttgttttcttttttttttctttttctttccctttcccaactgcattcttgtccagcattttgtgtagctggaaaattttctcagaggaggctacttctgtaagtccatgaaattcatgtccagttgtccaatgggactctgaaccggcagtgatgactcggtcactgccggtttcaattgaactgacagtgataatccaacaagtctagatttgtttttagagcagtaggaaagttgctagtgccagaactttcgatgaacggtattggaaattgctataggaatttcagaagttgcacgcttatcaagtacagtacagaatcatttacattttgtaccgaatttgttttctatgatgttgagctgcaatccgagtgatttgttgttgggtttacatttccgatagccctacaaaccgtagtacctggtggggggttgggggagggggggggttgcaaaaattgacaattcaatggaaaaccaaaatttcaagtacttgagtttagtagtggaaactgatcagctttttggatttttcgatcgaaatcaccagaatttcaacggggaaagacgtgcgaaatgaatgtttactgggaaactgacctatgtgagcgtgaaacccggtgatactttttgtttgctgaaaattacaaaatactagtagagaaaccttgaaaaaaaatagtgaggtgaggtgtagtctatgaaaaattgtaagtaacctaataaaaatttgcatgacctttcatatacactacatgcaacataatatatattcatatattcaggaaggcaatagccccaaaaagaatatatcactcacaattcaatgtgcatcaccaatcatacgaggaataagttcaccggaggtcactcaacttaacagcgagattttttgaggtcgcttaaccacaaaaccaaaaatatgtacccctaaactcacacaaactgtgcactcaaggtcctatggtaatatatatgggcggtttcactgacgtggcattctacttagcaaaaaaaagaattaaaagaagtacatgagatccacatgtcagctgcacatctttttttcttctcttttcttctcctccttttctcttttctctcttctctcctcttcttcagtcaggaaggccggcgggcggagcggaatgaaaattcatctaatccatgttaatgcatatgaatgtatttaagaaccaaaaacaagccacataaattcaaaagacagagggacacacatttcattgcccataattcaaactttgagttttacaaattttgggtctattaccaaagaagatcgatggtaagataaattaaaaattaataataaaagttaaaaataaacaatggtacatgcaaagttaaattattgataccagacgtgcaaatgtgcaggcactaaagaatacatagtagagcaaacaatttgatatcttgacacacacttcgggctccaacctgaaaaaaaaaactcaacttttatcaaatatcttaggcagaatttgacttcggctacatgttagtcccagcagctgaaccatcatcttgtggtgaagtttgttttttcttgcatatgaagaacaaacccccaacgaagagttgtatggggatgagcaggaggaagacattcttggatgtttcccaatcccgaacgctgcctgctgcgtaggctaccaggagggcaagcatgtccaacactatgaccgtgtgcatcggccaaaagaccttttcgccacccgttttgggcgacaacatcctttggagtagcagcacgatgacagtgatagaagccatgaaggaagtggagttgctgtagaagaaagtattgtatcgtcgcatgttaatgtcatagaggaccggattgcccgcagagtgtccatcgccttcgtccctccataggccgccgggtggttttaggcctgtcaggtaggtgatagacgcggctagtatccctaccagcatcaggtacttgatcacatcttcttcttgcatcgaaagctttggcgaggagaacccattggttcccgttggtggtggtggtggttgtcgttgttgttgttgttgtgtattcttctttaattctctgaaatggttgattgccagacagattacacctacaaaaaccccaagaaccaatcccagtacaatgatgaaggtccgtagatatatggagcttccagcagcgtaggcacccagaaccccaaacatgcctgctaccatgcagataatgagggcatagctccgaatgcctggccgatatagatttttgttcataagaagaacaattagagccacagacgccatgaagcttgccgcgttgcagtagaagaatgccttgtagcggcaagggtccttgtttaggagcacggggaagcccgcatggtagccaaacttctcatcgttctcccagaaaccacctggcggggttaggccagcttggtaggtgagtgtcgcagccaagaccgtaaaaagaagcagcacctcacgatgctcctccaactgatcatcaccgccatttttagtctccaatgtgaagaagacaatgtgaatcactacatagacaaggacagcaccagccatggcgatgatgtaaatggaggtgctcgtgtccctgcaacacccgacagcgtacgctcctatgaggccgaacaggtccagtatcatggtcgcctccagtacagcatggtatctcctcaccaatcttttattctgcgacagtgccatgatgaccagggacgccacaaaagctgcagagttaaaatagaagaagaccttgaaccgcctgggatgcgttgtgaggagtattggatctccaaccctatgacccttcccgctctctccccagacaccaccaggtggatctattcctgcttggtaagcaatggtcgctgctagagtagcaagcaactgaatgtactcacaaatcttatccacctctttgtcttgtttgctgtcactggtaattgcaccaatagataattatattgcagccaagggtaattgttttgaccataaaaaaaggcacttgcatatttgctcaaattaaactagggtcttaaattctcagttggcatgaaaatgtttttttcttacagcacaagaataatctactataagaaaacttaatgacggacacaataggtaggcaaagggggctcgcgtacccctactccctaggagagcatgccacgggaaccccaatgcgcctccatcgatcctaggggcttgcttcatgggcttccacgtaaatagcatattagaataagtttagtagtaagctacaaaccacctat

SEQ ID NO: 62535 - DNA, 5683 bp, Oryza sativa
aaaatcaacgtcaaagtttaaaagtttgacaattattaccgtcaaatgtcaaatgctttgtatctgattgagtagttaattatttcacaccagtggcggagtcaccgaccggctagcccaggagccgcctaggctcgtctgcaaaaactccattaaattttaatattgataagtaaattgatgataaaatttctatagtaaatactacttctattaaaggttggccagactcaaaaatctttctagcattcgcaactgtttcacacttcctttctcctttgaaacagatattgtttttgtgcaaaacaactaatatagttcaagccagttccttctactaatatgttaacgagcaattcttttacacgttcgaaaaaatatgtagtttaagccagcgctgtagctccacattgaaaatgattaaattcacgcaccaagtatatatgtacgtgtgttacataaatgaatatatgatgttgagttttaattgccagcgggcggccggcgtgctgctctgcttccatgcaacattgactatacttgattgattaattattggtagctctctttagctgctcttttcttattctctgctttcatttttattgcccttaagactactacaatgccttgagtacgataatctagacttgttgagccgtgttagtaggagtagtagtgtcaattgacccatcaattcgtagctcacgctttgctgtgcattgcgtgacagttactaagcaaaacctatcgatgaagataagctagctaatgttgttctcgataactgcgtggtgcgtgccattaaaagttcagtaggacgttaagtacctgtgccagccaagccctagggtttagcggctaagcttggatcatattcgatctgttctaaaatataaccatttctaaaattaaatatggatattaagataatgtgtgagaataatcaagagaagtttgtgattggtaaaaaaaagattaagtaggtgaaaaaaattaaatagagattgaaaagataggtgtagaaatagttttattctggaacatggattaaatgcatggtagaaataattttattttgggatgagagaacatgaccaaggttatcaattatgttctggtatcagctggaatggctggtacgtaccattcgaccccttaaaaacgttacgtaactagcggcggtactgttcattccggtcaaatgccaacaaatattgaatggaatagtacgaactgacatatcacttgttccggtacaatttacctacgagtgaacgttcagtcgaatttaacataattggttattaaactatatttagctacaaattatttatcaaaatggaggtctatagtgcgagacagtagaaaggatgagtgagagataaagacagagaatgttagggaagggggattattgggcccgtgggatttagataaggagaattggccggacgattcactatttattcactaactagtttagacataaattcgacgtgaatcgataaagatggactatcgaggatgattttttaaagtgatggtaattgttgtatgcaataatctgcacgtcgtttcttgtaaaaaggcgaccacaaatccaggatgcaagcaaccggtgaaatacagagcaagcttatgcattagaaagaaggagatcacacacaaagcccacgacacatgcatcatcagcaacacgaattttttttaataactcagcaacacggttggatcaatatataataagttaataactggtaattaagcgtgtgggtagccaaggctgcatcgtatctagagtttttaagtgtgtgttggcaaacagcagatatgtgcaagacaagcaaagtgccacagaacagtgggtgcgtacgtgtaccacatgcatactttaatttgatatactgttgtcaagctaattatgtaaactaaactgagcaaaattaattatattatttcctatgtgagatcattaattattttgataattgatactccctccgtttcatattataaggctttctagcattgtctatattcatagagatgttgaatattaacaatactagaaagtcttttaatatgaaaacggagaaaatagtaaccaaattaaggtcatatcaattccatcacttatcttatagtggagtactaatgtactatcgtagaattcaagtaaaccgtaggattggaggtcgtttaattagtaggtctgacagtaccggtcgataatgtaccatcacgcccaattaattaggtatagtgaacattatattgctggagtaaagccttatgaccaagttatcaacagtaccggagctagttttgtccttgaagggaaaaaaaaaagggaaaactgtagtgcaatattgaagagcatgtgcctatcatgttacacgagatgaaacctttggcatttctgtaggattatgtgacaatggtagaaattagttacaagatggattgctttgtagctaaacgatgttcttgatttgtgtatgcaccattgatcaatagttcaaaaataccataacaattgagatgatgcagtttggagagaagtgagatatataatccgaacaaagcattaaccatccatctgaacttggaaggtaagaaataattgagatgatatttctttgtgaggaaacaggccggagagaaataagagagctaattaggccatatataaattattcatcgaagggtttaaaataagcaaggtagcgtggcttcctgaaaaaatagagaaatgacattaactatatttatttggtggacagtacccgatctatattgctattttcattttaaaactatttcttgccaccatgcatacaaggcgccatatgcattgcatggaaatcaccttataaccaaccctatatattaaatttagcctttgatttcttctctacaaaataaatttccttaacacagtaggagttagtaggagacgaaaatatatagttagcacagagaaacccccatcatctgatgtcacactcccaatgagtgaagaataatactgctgctacctcgctcaatcattagtattcgcatacgaccgcaaaagatcatcgacggcaagagagagagagagagagagagagagcgacctcgatcttgatcttgatctcgatccagcccaaccaacggtcgctgttacgccacgtcacctcaccgacgccgacgcgccatcgcctcgcctctcacctactgcctcgtcctcctcccctctcccgccattgatataaacccccacctcctcctcctcacacctcacaccaatctccacctttcttcctcgtcgacgagatcatcggcatggcggcggcggcagtagcgttgctcgcgttcctcctcgccgcggcgtcagcggcgtcgtcggcgtcggcggcggcggcgacgctggtggagggcggcgtggtggggcgcgcggcggtggtgatgaggcggggagggaggacgtgccgtggcacggtgggggagtgcatggagttcctcggcgtcgacggcgagggggaggacgagctggcggcggcggcgacgggcaagcggcgggtgctgcagggcgggtcggggtacatcgggtacgacgcgctgcggcgcgacagcgtgccgtgctcgcagcgcggcgcgtcctactacaactgccagcccggcgccgaggccaacccttactcccgcggctgctccgccatcacccagtgcaggggatgatcgatcgatcgatcgaccgagctagctaattaatgaaattaaatccaatgccatgtagttcgcagcaagaacacacgcacagtgtccccttgatcatagctgagcttatatgctatagctgtcaagatctcagtgttgtccttgcatgcctctcatgcttgattgattagatgtgtaatggtcctaatggatggatggtgttgtttgctatgctgcttgggtgaaattaaagtgatcaagattatgtttttttgtatctatatgcatgcaaattaactggcgcttgcaattttgcttcagttttttgtttatctgcttatctgcatgattaatgatttttgtttgaatattccaattaggataagcagatatgtttgatagattttttagcttgggtatagtttctgtgggcggaggcagatgatcattaattttaagggaaattttttttctttgattaattaggttgtggaaaagaatttagtactagctatgatctaggccaaattcatgcatacaagctactccagcttgtaagaaaagaaacatcggcgtctatcgagttgagctgtcatttccgagttgattttattttatttcattttatttgggtcagatcaggcactatatggtggacagtttttaatcagtgttactttgaaaaaaagaacatttttgggcccaaaaataaaagattgcatatttggtgaaaatgacccatgtttgagaggatcaattcaaggtgggttaatggaagtggtctttagctacctataacaacacatgttatgtgcaattagtaaaatagtcatttggtaatgccaccaaactgtggttgggctgtcatttttcatctttgtgtgtagtcaatgtacctaggaactttatgcaccaaggaaaggggacatgattagttcccctttttaagagaggatagggaaagtctttgaagctaggaccacacactgtacaaaatggtcccttgaaaaatatgaatatgttttcttttagagtcctaactggagtactgttgttttgattttgtaattaagtcatatcaaatgttacacggtttgcagtttactacttaacttggtgtcattactttcttttcatgtgttctcacttctcatagtttagtgagtggattacacagtaaaagttacaaccgccatgcaccatatttcattatttgcacaatcaatggctagctatatgaattttggctagttcaattacttgattgtcccaacgagtgcaatgctaagattgtgctgtgcctctgtttgagttggttcacacgtatgcgccatcaagattgtgctaccttttgagttggctcacacctgatactgcattctgaatcaaagggaatttttgaatgggctttggtggtcagaatgcagtgtcaacaacccatgacatgtagtataaagtagtgtgatatcacctagacatttatttgctgatgttgaagggggaggagacgagacacaaatttttgactcctgtctttatgtgatgatcaacaaaatcttataacaaacgtcaaatatttatgatcaagagaaccaacttttataattttgataaaccgaaatgatatattttgaactatctctttgtttcaaaatataagaaccaccaacatttgtagtttgcactaaaatataaacactcctagcactataaagtataaagtactacttattttaattgtttcccattaaaatttctttccatctcttccttaaccactttcttgcccctaaccatatcttatttaagccgcattcgtttattcaactctaaaatgcaactttatcttttttaacatgtttttcaaactgttaaatgttttcttttacaaaaacttattatatagaagttatttaaaaaaatcaaataagtttaagtttaaattttacggtaattaatactcaattaattatatgat

SEQ ID NO: 62536 - DNA, 151003 bp, Oryza sativa
  unsure (1)..(151003): unsure at all n locations
gcgagggtggttttggtgctgtatacaaggtaagttagcacgcaaaaatacaaagagaaaattttcaaatggattgtgcattactttccaaaagatggattatattgcttgctccctgtgaaaaacaatatgttcagggagtgctctcagatggacaagaagtagcagtgaagaaacttttaggaactggtcatggattggaccagctatacaatgagatcaagttgttggctgagcttcagcacaagaaccttgttaggctacagggattttgcttgcatcaggagcagactctgcttgtttacgaatacctcaagaacaggagcctggacaactttctatttggtaattttgccttctcattcatctgttcacaaatgacaaacatatatactcaataagtaaatatcctcagtatcactaaatatgttctgtagcatttccagcaaacaaatcacataactaagaccagaatttgcactttgccactttctgaattctattgaatgtgggtaattatgattaagttgaagatttgtcccaatagatcccagtagagggaatgccctaaactgggatcaacagtacaacatcattctgggaattgccaaaggaatattgtatcttcacgaggattcaagcttgaggatcattcaccgggatctaaaatcaaacaacattctagttggagatgatatggaaccaaagattgcggactttggattagcaaggctgctaggcgaaggtcatactcattctaagacaactagagttgttggaacattgtaagctcataagtataataataccttcattaatagcacatattaattggatgtacgtttccaagtgtaatgcttaccctctgcagtggttatatggcaccagagtacgcaatagatggaaatgtgtcaaccaagatcgacatttttagctttggtgtgctggtcctcgaaattatcacgaggagaaggaactggcattctgacgatcatgatctcgttagtgatgtaagtgcttaataacccttagctcacaccaatatggttctacttttagtgtattggggagaacactgctatattgatgatttttacgtgaaagtaataatctcttaagtttgtcaacatgcctaacaggtttggaattgctggacaaaagggactgctacaaaaatgatttaccagtcgctcaatgggtactctgaaagccaagcattacgatgcatccacattggactactttgtgtccagccagaccccgatgacaggccacacatgtcatctattattttcatgttgaccaaggaaaatatgaagcttcaaccaccagcagaacctgcattctttttgggtagagaatcagcttcctctcctccatcctgtgggcaacacggctataactgtgattgatctggtttagctaaatctagtcattaacatgtgattcgcccggcaaatagttctgaaagaatttttagtataaacattcatttttttctagctagtttggatcataaaagtcatcatgggatttcaaataaattgtgaagtgtagttttttgcttgttttattatttatcatatacttttttctactataattttgtactgaaaattcgaattatttttagtcaactgtaaaataattatatatatgttgccctggaattctcaaacgaatgtaaaacacgagctttgagcatatgtttaaaatcctttcttaaaactgaataaatggaagcaatccatttttatcctctatggacttgttcgatagggctacaacaactaaatgtaactctaaaaattgattctgaagtggagttgtgaaacaggatgaagccggcttcacccgtctagttcgttttgtaaaagcgcttcagctgactccactcttatttttgaatggaggtgaaactgtttgactgggcttcaatttcagaaaagttaaagttagagttagagctatgctaaacagactccatatagctccatattgctaatttgctagtggtaagtttggagcttgatttttcttttctttttcatggccatatgcccattcatgtcacggtcttggatgaccactggtgagccgaataccttgacgagtccaattagcatgcctggccacttggccagtcgcctacaaacttgcaaagtttgcaaatttgtggataattaattcgctactgatgcgatgcaacattgccacttgattacaagttgcaatacttggattattgcgaattgcattgcacattgggcgtgattatcgctgccatgcaagttgcaactggaagcctgtgaatcccaaggccggtgaagtcatcgactagtctttggtctttggcttttgcgactccatcgcctccttttccatagccgcctgcgcactactgtcacttctttccgctacgatgaatcgatgatagaggaggttggtcagttggtggcccgaatgaagcgtgttcaccttgaaatttgaatacgttttccctgatttcaacaattaattgctaatttcaaacaaattcaaaagagtgattatacagtttttatgaaagtatcgggagacactatgttttctaaaagatttgctccggtctaacagaaagtatctcgaggtaccgatacctcgtgataccaaatcgtttctgatcgttggatctaacaatatccatcctgtccagttagatccaacgatcggaaataatttggtacagtgaggtaccggcatctcgagatactttttgttggaccggagcaaatctcgttttctaatataaaatttggcgcgatagctaattcgcgcttgcgcgttggcggcgcgcgtttcaggcctataaggcctagcgctggcgcgtatgcgtgcggacagtgtccacatccgtatatttttcccataaaaaatctaacgtccgctttttttttattttttcctttttcgtgattttttaattttagaagttgaaatctttcatcttcaattttagttgaaaattttgaatttgagttaaaaattattaaaggtaaaaaattgagttgaattttttttaatttagatatgaaagttttcaaatttgagttaaatgttttgaatttttagacaaaaggttttaaatttgaattgaaaattttcaaatctttagttaaaagtttttaaatccgagttgaaagttttcaaatcttgacttgaattttttcaaatctagatttgaaagtttcaaaatctaagttgttttttttgaaaaaaataaattgaaggtgttcaaatcttgacttgaattttttcattatctgagttaaaagtttttaaaaaatcttgacttgaaagttttcaaatctaagttgaaagtttttaaatctgaattgaaagttttcaaatctgggtcgaaatttttttatctgaattgaaagttttcaaatctgggttgaaagtttcaaatctggttaaaagttttccaaatcagagttaaataaaaaactaatactaacaattatcagtatcgctaattaatgacatcaacactaatcagcgttgttagcgctgaggagaggcgagatagggggcatgcgcggctgcaccagttaggcagctagaactcacgcgtccattcggaagacccaaaatttggtatctctggtacgactagatactaaatttgtacttaaaagtttgggtatctcatggcacctcttaaaaactataaaatttgctcaattcaaaaactttgagcagagatactccctacgctatattcaaattcactgctaaaccggtatcttggttgtactagtgtgtgcaaggagacatggattttctatatctcgactagctggatgcaatcgtatccattgttaagcgacaaagttggttcaagaatcagggacgacttgtatggtcgtctctgtctctctgccgtgttggacggagattactcactactatagtccatccccgtgggaacgaacatggattgagctcctctttgcgcacgccggaaataccccgatggatcgccgtctcatcctgtccgtcgccgtcgccgtcgcgctgctcgcgccccgcgctgccggcgagccatggccggtgtgcgggcaggacttcggcaccttcacgcccaagagcaggttcttcgccaacctccagctcatcgccgccacgctccccggtaacgcctcgtcgtcgccggacctctacgccaccgccgtggacgttggcgccgtcccggagcaggtcaccgccgccgcgctctgccgcggcgacgtcagcgccagctcctgcctcggctgcctcacccaggccttcgccgacctgcccaacgcgtgcggcaactccagggaggccgccacctactacgaccggtgcatggtcagctactccgccatcaacttcctctccggcggcgccggcggcgaagacccggcgaggatcgacgcgtacacggtgaacaacgagaacaaggtcacgtcggagcaggggcggtacaaccgcctcgtggcggcgctcgtcaacgccaccgccgactacgcggcgtacaactcgacgcggcggtacgcggccggcgaggccgacttcgacgcggcgctccccaaggtgtacagcctggcgcagtgcacgccggacctgtcgccggcgaggtgccggagctgcctcgccaagatcgtggcgcaggagctttggtcgtacaaggacgacatcggagggaggaccctctccgtcaggtgcagcttccggatcgagaccaagcctttcctcaatggcacgacgatggtgcggctaccggcgacatcggcgccgtctccggcgccgccggtcaacgcgacgccttcagcggccacgccgggacgaggtgagtcgaagtgtgtattactttcgggcggcattactgacattattgcacaattagtcaactacacgtttattatttccaagaaaacccggcaaaaattatttccaagaaaaagctatattttaagtcatttaatttttttctgagtacttgtaggttgtaagtcatttctattatctaaaatgattatttaggtttgatcacgtttgtagaaaaatttagcaacattaacattgaatatattttagtaatatgtttgttctatattgaaaatattaatatattttttttatatattttgttaaatttaaaggaatttgactaagaaaaaattaaacgacttgcagcatgaaataaggggagtagtacagtacagtagtacggaatctgtccatacaattcgacatgttttaacatgataaccttggaaatttgtgaattggtcaattcgcagagacaaagtacaaggttccgcgcctggttcttataatactgctccctataatagcagccgtaaaccttgtcgtttgcttctgtgtctggaggaggaagcgtccagtaataacaaaagcaaagcagacaagtacgtcctacaaaattctccattttaatcatttcagctgacaatgcaaaaaaaaaaaacttatccaattgttgtgatgctgacgtttatgcagatgccaactattacgctgaagcagatgacgttgacagcgtagactccatgctcatggacatttctactctgcgagctgcaactggggattttgcagagagcaacaagcttggtgaaggtggatttggagcggtgtacaaggtactgaaaaagggaaaaaaaaaacaagtctctgaattacaaaccaaaactaatttaattagcatattttgaatcttttcacagggtgttcttccagacggcaacgaaatcgcagtgaagaggctgtcaaagagctcaacacagggagttcaagagctgaagaatgagcttgctctggtcgccaagctgaggcacaagaacctcgtaagctttgtaggcgtctgcctggatcaacacgagaggctgcttgtctacgagttcgttcctaaccggagccttgacctgatcctctttggtaacaatactactactaattgagtctacattaccaattctctcctctgttttctctgcaaagattgatgtcatatcatcgcattgatctattaattaacaccttctctttgatcattgtcagacactgagaaacgcgagaagcttgactgggaaaagaggtacaggatcataaacggcgtcgctcgaggcctgcaatacctccacgaagactctcagctcaaggtagtccaccgtgatctgaaggcgagcaacatcttgctagacgcgaacatgaaccccaagatctcaaactttggcctcgcgagaattttcggtcaagatcagacccaggctgtcacgaaccgtgtcgtcgacacatagttagtaacaacataaactgtagtagttgttcagtcatccagtaattaagtagtgactaatcatgacttcaaattatctttgctgttgcagtgggtacatggcacctgagtacatgatgcgtggcaactactccgtcaagtcagacgcgttcagcttcggcgtcatggtgctggagatcgtgacgggaaggaagaacaacgacttctacaacaactctcaccaatctgaagatctcctgaacacggtgaacatacaacatagtagttcatatctctgaacatctgataacctgcactctgcagattacagtgcagtttggctgatctatgtgtgatgctgcactacaaaaatgatgcagatatgggagcgttggatggccggaaccgtggatgagatggtagacccggccatgagcaggtacgtctcggcgagcgacgtgcggaagtgcgtccacgtagcgctcctgtgcgtgcaggaaaaccccgcggatcggccggtgatgtcgtcggtggtgatgatgctcgacagcgagacggtctccctccaggtgccctccaagccggcgttcttcgccaggaacggcggcgctaaacccggcgtcgcgtccgacgagtcgaccgcgtcagtgtagaacctgtcatagagagagcttcgatcggtccaggatatggaacttcttgcgctgctgattagtggctcccactctgaaaggaggattgtgctactgtacggacaatgtaagaatcatgaaaagtttgcacaatttttgtacaagcccacgtgcattacatggagcatcggaatgaaggaataagtacatttgaggttacttaatttgtcaatgaattcgattttcatccttcaaccaaaaaaccaaatacagcgggtctcttaactattaaaaccggtgtaatataggtcccatgatggtttagatggcgattttagttgacgtgacgcctacatggctaatttgacttagtcttcgtatgacatggcatatatgaagtgaaatttaacaattttaaagataaaataaaatatatgggcccacatgtcagtcaaataatacatactaaaaatagtgggacccacgtgtcagtgggccccaacttcctccacctcatccccttttctctatatcatccccttctccttctctatctcagcctggttaggtagggggaggggggagggtggcttcgagggcgcggctctggcagctatagcctatgggtgacatgagggggcatggctccactggctatgggcggaagaggagggggctgttggaacagaactcacaagtgtgcaataagtgtctgtctagcttctatccccccttccgagggtaacatttacatatttatactaggttgtatgtaaaggaaattacaaccctacccctatctccgtagctaccccgaggtggctgagaggtgggccgacgaatggtccgagggtccattcaccaggccgagagttggcggtgcccatcaaggggagcggtatggcgctagcatgatgctagcctttactcgggtaatagctagcatcggccttcacatcgctagtcgtgccgtaacatcggtggtggatgggagatgagtagtgcgcttttatggcaccccatactcattcccggtgtcctccctaggctccgggcccggagccatggcaagagccccggaacacttgagctggctcctggacctccgaggcccttgaaccggctctggggctccgggggccttgactgggctccgagatccccgaggccctttggttggctccgaacttctcggagccgactgccctcttcaggctcggtcagcttcctaggcgttcgatcagggccctccctgtggagatgggctccgcagggcgttggcggcaggcccctagaggccctacctcctccggagccaataggggttgaatggtgcaaggtcgcaatccttccccaataggggcgctgggaagtggcattggctgtagcggcgctggggttggagcacgggtggttccaaggaatgctgtcggtggtagcagtggggagaatttgagggaagagatagagagggtggaagaagatccgcgccagtctcaagcgttggggaagagcgacggtcggcggcattggggaggagtggcggccggcggaaaggatctgagcgtcggtggaggcattcggggaagcgttcaacctcggcgagcttgtgggcgtaggagcggccgagagccaccgccgtgttccttccccgccagccacaaccacgttcaccgcaccagtccttgtcccaattggcaagtcaagcatccacgacaacatatgtggaggaggctagcgagcggcacaccgacgaggctggtggagtagtggaggaccgtggcaccgggcgctcgtcctttcccggtgacggaaatcagatgacgatggcgttaggggcgggggggagaccaacgggaggtgctaagaggattgcggggaggccgaggggaggcgggaatcagtgtgggtgacggcggaggaaggtggtggtggcgacgggtgaccgtggaggttgaggaaggcgaggtcggcttccgggatactgccaccaacaagcgccgctacctctacctctgccgcctttccatcacgcacccaccattgctcgtccccctttgcgtgcgctcactagcggaccgtgacacccgcgggctcagcagcggtggccagtgcgcgaagaggcctggccggtgacgctcctccctccccaccccatcccctctcaccggcctccgccgattcggcattcgttgacaagttaagggaccttaagtgaacttattccgctcaatgcaggccaacatatctctaagattactcaccttatacatgggattttctgttcgatgggccataatcaatatttgttcggctagaaatatccccttggatgaaaagaggcccattacacacaagactttagattttcaggcattgggatccgtgacctggaatgctaatactatgatacgctagatgctatactctttctagtctaaaatataagtatttctaaattatttcacagagattaaaattgaggagaaaagattttggtgcctctcaacaaaaaagagagggttagagacttaggtgtgggaggatggttgggattaagatggggaaaaatattgaatggaaaataatttatgtgataaaatgtagtgtaaatagtggtacaaatgcttatattattgaacaaaactgaaatcctagatatacttatatattgaaactgatgaagttattaataaaatgcaaccaaactcacaaccatacattaatatattcaccaaaaaaaacccagtactctggcattcttatcatcaagaagaaaatctcaagtggtgcacgtgcaaccagacaggctagacgcagggtcgtaggcggcagtgcggcacaagatagtcaaccgagaaaaatcaatgaaggcggcatatcaaagcatatgccgggatacacgaacatagatgattgatcgaacaatgacaaattcaacttattttacgtgaaaatgtggcaacacatgtatatcaaaattgtactaccttcgtcccaaaatacttatcgttgtgagtttttgtttgtaacattttgatcattcgttttattaaaaaaagtatgaaattattatttattttgtttatgacttgctcaatagtactttttaagtaagacttatattttttatatttgcactagttttttaaataagatgaatagtattacaagtaaaaagttaaagcgacaactaatttggaagggaggtactattattttccttgtatcgcgctagctcctaaacgacggccatatatactgctcgttataaatttactgctcacacagtcacacagtggaattcgactatcctcagtctgccacggcgccaaacaggactagagatggcgctcactcatcacctcctccgcgttctcttagccaccgcattaccgttgctctttctctcccatgcaggtaattaactcgatcagagatgtacaaactacaaattaaggctgaaaggtaattaatctcactttcgtaattaacaatcacaacgacgtcgtttgtttgttcttaatttgcacacagcagatgcgggcgagttgggcgtgtgctacgggagggacgcggacaatctgatggacccgcaatccgtggtgagccttctcagggcgaacggcatcacgatggtgaggatcttcgacgccgacccggcggtgctgagggcgctggcgaacaccggcatcaaggtgatggtggcgctacccaacaccgatctgggctccgccggctgggatccgagctacgcacagaggtgggtggagagcagcgtggtgccctactacccggccacgctgatcaacggcgtggccgtggggaacgaggtgttcgatcaggcgcctcacctgacccagcagctggtgccggccatgaggaacgtgcacgcggcgctggcgaggctgggcctcgccgatgccataagggtgtccaccccgatcacgttcagctcagtcgaggtgtcattcccgccgtccgcaggcgctttccgggatgacatcgcgcagtcggtgatgagccccatgatcgacttcttgcagcagactgactcgtactttatggtaaatctctacccattctttgcatatgcggatccttctaccggaatctccctcgagtacgccacgttccgtcccaatgctggtgtgttcgatccggtgagcggcgtcacatattacagtctctttgatgccgagctagatgcagtttactatgcaataaacaaggtttctggtagtaacgagagggcctcgttagcccaagcaggaggacgggtgcccatcagagtttcagaatcaggccacccctctggtggtagaatccgctcaggggtcacagaagccaatgctgatggggactcggtggcaactaaagctaacgctcaagcatacaacaatggccttgccaagcgagtcttgttcggggcctccaatatggaggatgtttctgcgtacatattcgctttgttcaacgagaacaagaagggtgggccatctatagagagcaacttcggcctgttctatccggatgggacgaaggtgtacgatgttgactttcatggtggtggtacatgtcccacaaaggagagctggtgtgtggcaaatgcagctattgggaatgcacggctacagggagcactggactgggcgtgtagtaacggcgcggactgcagtgctatccaacagggaaaagtgtgctatgagccaaacaccatggttgcacatgcatcttatgcattcaatgactactaccagcgtaatggcaaggcaagtagcgcgtgcaactttgccggtgctgcttacatcgtctacaagccatcaccaagttagtttccattcaatggccatcttttaagatcaataagcttttgcaattgtgcattcaattcatattgtgatatccatcttattatgttttacatgttctatatatgaattgtttgttgggatttaggcatctgtgacccgaacccgagttggtgcgtggcgaacgcagaggtcggggacatgcggttacaggcagcactagactatgcatgcagtagctgcgcagactgcagtgccatccagcctggtggacggtgctttgatcctaacaccaaggtggcgcatgcgacctatgcattcaatgactattaccagactgccggcagggcaagtggctcgtgtgactttggtggtgctgcttccatcgtcaaccaggcaccgagtgagttcacacgcttatgcatacttttatttcgtgttgttaattgttatcttattagcgtttgttcaatcattcataggaattggaaactgcgtactcccaccaagcaagacttcttcaatgaacatattttactgaagaccgaaggtagcttaccagaagctcaataatgaaagtgggattgaagaatagccccgtattactgtgctgagaaaataaggatgatattgtatttagattctggttaagaattttaagtgtattccgttcgctcttgttgaataaaattcctttctacacaatgcagaataaaatgtacaataaactccatcaaactcctagagtgcaatggaaaatttgggaatgcaaatacacttagctgcctaaatagtccatattctgtgctcaaactatgagaaccagcgactacatactttagaaaattaactaagccaaaagttggaaaaacaacgatttctaataattgctccctctcccaaacaaggccttacactgctatacattatattgttaatgtgtccaaattacctgtttcgatggttagttgttcatttatatgctacaaatctagaactctacctactgcagactgcagacaaggtgtttgatgatatgccatgtttaggaacattagttcagagtgtgcaaagaacataagataactggccatataagaatataatgtaatgacaacaactagaatatttaaatgtgccttctaaggtgcagatcaaaccatacgcagatggttcaatgaagttgacaaacaatggtgacaattgcgccactgggaaaggggggattaggaatggggagggggaagggttatctggggtatatgtcagtaactgtcatcctattcacggagatatcctcttcatagattgcattaggccgattatacacgggttgctcaaagggttgagaacatgagtttgagtctccatcaaagaagaatgcaggttgtgccggtggctgaagattcatgttttccctactcaacatgaaaatgacagatgacatgtgaggcctgtcatcaggatctgactggacacacagcagcccgatatgaatgcatcgcagtgcttgtcttcggaattgctcttcaagtgattggtcaattagttgtgtaaccgtcccttttgtccagcaattccagacctgttagacgatttgaaattagtttgttatctaaaacttgatatagagtactttcgggtatgatatcatgaatattgcagtatgtaaatgcactaaaagtatatatgtacaggagcaagctcaaccttattgagcacttacatcactaaggagattcccgcgatcatgatcgtcagaattgaggttccttctccctgttacaatttcaaggaccaacacaccaaaacttaaaacatcgatcttggttgacacatttccgtgtattgcgtactcaggtgccatataaccgctgcagaggataagcattaggcttgcacattcaatatctctatgagtgaaggttttattatgcacatgagcttacaatgttccaacaattctagttgtccgagtattagtatgaccttcttctagtagccttgccaatccaaaatctgcaatttttggttccatgtcctccccaagtaggatgttgtttgatttcaggtctcggtgaatgatcctcaagcttgagtcctcgtgaagatacaatattcccttggcaattccaaaaatgatgttgtacagttgctcccagtttggtgtgtttcccctactggtatctgttgagatgaaatgtttaatttaatcataatcactcacctataatacgtcaaattctattcttagccatgtaacttgtttgtcagaaatgctacagtacatattcagtaccccacactaacttgcagttgtgcattgctcagtttattcttattgatgttagtgtttatagtacagcgactccactattataaatatgtctgtgcatacagaaaagggggagtttttgtacttgcaaagtagatcagcactgcaatctttttttacattgacaaacgaagatagagttatgattatgcttctgaaatgataaattagaagggaaattaccgaatagaaagttatccaggctcccgttcttgacgtattcataaacaagcagtgtttccccctgatgcaagcaaaacccttgtagcttaacaaggttcttgtgttgaagctctgccaataacaacacctcattttgtagctgatccaatccatgctcacttgttcccaaaagtttcttcactgctacttcttgtccatctgagagtactccctgaacacaattggtgcaggcaatttaatcttcgtttgatcactaatgcataatacatttcaaacatttctcttacatttttgggtgctaaccttaccttgtatacaataccataaccaccttctccgagcttattattgtccgagaagttatccgttgcctcttgcagagctggcaggtcaaaaatcaagcattgtgctcttgttatcttcctcaactctgttgccatatgacaaggattatgtcagtgaacagtaaattcgagctactgaacagaggctgtatgctactcacggtggtcagtctcagtaaccttggaccttctcctgaagagaacaactgcaaaaaatgaaaggatcaacaataccacaactgaagaagcgacgacggcagcgattccagctgcactctttttcttccctgcaaacaccaaacatgaacttcaattggggaaaccttgatttcactgtaacttctgttatttttttttcttcaggaaaaatgaagaacagagtaggtcatactccatacctgctccaggctctagagatagaaccggagcctcggctgctggtggtggtggcgccgacagctgcagcatcgcccggcctccgtagaacggccgcacactatacatcagtctgcaccacaccgaattcataccaacccagctaaggctcttgccaaagtacacttgttttgcttgaaaaaggaaggtgttgaggcattccttgcactgctcctgcgtcaggtccggcacgcactgcgcgaacccgtagatgttggggtcgaagtcctcctcacccgtggcgaaatacttcttggtggtcgagttgttgcccgtcgccgtggccacggcgtggtcgaccagggcggcgaggatcttcgcgatggcggcgttgaaccagccaaccgccggcgcattgacgctctccgaggcttgctcgggaacccaactgtttgtaacgagctactcgaattagtctatctgattctagcaggaagagatcgaaagaagggagatatgtagattgtccgtacatcatctcggtgacctgccactgatccggactgaggaaatccatgaacctctggccggagaagcgaactacgcaggcgtcctcgtacacggtgacgccattgatgccggggcaagcattcttcccgtcgacgaacgccgccgcgacgcacgcgcggcaggctgtggcgttcacgtcgccgcggcagagcgccagcgcgaacacctggtcgggatccgcgccgacggtggcgaccgcgaagccgccggtatgcgccgtggagacgttgccggggagctccgcggcgaggtggttcaggttcgcctcgaacgtgctgttgcccacgtacgtgttgccgacgccgaggtcgcagtcagcgatcccagccggcgtggccgacggcggcaggaggacgaggacaacggcgaggatgccatagccggcgagcatcatcgcagcaaaggggggaaggggagaatttttttttctttttgtcaagtaaattggaacaccaaaatggagttgcggcggccgacgtcaaatcgagtggcgtagtctagtcggtgcgacatcatttagcacgttgcggcgacttgaacgcgtaagtggagtcaaacatttcctttccgccagactggctagctatggatggcatgcatggcgttggagtcttggggcgaaattccggtgagactttaggagcatcagcacgatgggggcgaaagccaatggtgggtttgtgatcgacggatgcgaattggattacataagcccatagtcgagactgagagaggtaaaattgattttttttggaaaaagtatacccaaggtccctcaactagtcatcgagttacaaaatcgtcctccaaccacaaaaccagatatatgacatccctcaacttacaaaaccgttcgcttgaggtccttcgatggttttgaccctgattttatttgacgcggctactgagtcagcgtgggacccacgtgggccccacatgtcaggatgccacgtcacaccctttctttcccctcctctcctttcctcccctctctctctctctcttttctcctcaatgggcagctagccggtgggtgggagaaggtccggccggtggatgggcaagaggctggcgagccgagacgggagaggaggaggtccgacagctggcgaccgacaacgggcgacgcggcggcagcggtgacgacaacgaagcaagaggcaacagcggcggcagggatgaggtgggggaagggagaagagagcctcccctcatggcgacggcggcctcctcactctcccgttgcactccccgtccctgctgctcgttgccgtgtcggccccaaggcacctcgccgtcggcatccccatcccgagtcctggctcctccggcggcaatggggatgaggtggggcaagggaggagagggcctccccccatggcgacggcggcgtcctcactttcccatcgcgctcacgtccccgctgctcgttgccgtggcggccccagggcacctcgccgtcggcatccccatcccgaggcatggctcctccgggggtggcggggatgaggtgggggaagggaggagagggcctccccccattgcgacgggcaacatgatgacgatgacgtcctcgctcttccgtctctgctgctcgttgttgcggcaccctcaggccttaggccaccttgccgtcactatccctatctgatgcttggctcctccggtgacggcagggatgaggtgggggaagggaggacagggccaccattcgcaatggccttcaccgcacaaccctttgcagccttggcgtccaccacacatgcgcggccagccatcccacgccgctgtccttcgtcgcctctccacctagagcgacggcgcgccacccacctccgccagtgctgcacggcctcccgcacccgccctcccacaccgcccggcctccccgacgagccaggcgccgtcgcgacgacgcggctgatggagaaggcgtcgtgagtaggctgaggggaggagaggggaaaggggaagaagagactcagatctcactgacatgtggggcccacgctgactcaactgccacgtcggataaaaccagaatcaaaaccgcctgaggatctaaagtgatccggtttcgtaagttgaaggatgatatatatttggttttgcggttagaggacgattttgtaatcgatgacaagatgagggacctctggtgtactttttcctctttttttttcacctcagaaatatcctcctccgatcaaaagtggcccattactcgtatgggctgttctgtcaaatgggccttccgattaattttcatgggctgtaagatgggcctaccaactaggatatcatcgatcgagcncggcgaggagggagaggagggccaaaaggggggggggggggggggggttcgccgttcgccagggaggcgacggggtgatgcgccgccgtggaccggaagggctatcggcagcaccactggaaatgcagatcactagacaaggaggagagttggagccacgtccatgagcaagaagaagggcggcgtgccgtgggagcccgggatgccgggacaggctgagcagagcaggtgcgggttttgcattccgtaggatatgatatgaatatctcttgttgtgatatttttttctttccaggttgcctgtttcgttgattatagctggtctgaatgctacaaatctagaactcaacctagtgcagacaaggtgttcgatgatatggcgatactctggaagatcactaatagctcgagtctgcaaataagatgagataactgaccatataaaattacaatgttacctcaataggcagaatatctgcatctgacttcgaattcaaggaccaaacactagcgaagttcgcctttgatcactttagatgcatacacatttcacttatctatgaaaaactaaaaactaaaagggttatctaggatatatgtcagtaagtgtgatcccattcgcagagatatcctcttcatagatcttaccagaccgatcgtacacatagacgcgctggtcagatgtttgagaagctgagttcgagtttccgttgaagaagaatgcaggctctgttggtggctgaagctccatgttatccctggtcagcatgaaaatgactgatggaatgtccggcctgtcgtcaggatctgattggacacacagcagcccaatgtggatgcatcttagcgcctggtttcgaaagtgcccttcaagtgattggtcaattacctgtgaaatcacaccttcggtccagtaactccatacctgtcaggtgttcttatcagtttttcaatcttttctgaaggagtttttcatgttccttgaagttattgagagttagaagtatatactatagttaattttgcttccattttattctgatcctcacatctcttgtccctcatgattaacactaggacatactacctcttaataccttcaaggagcaattaaagatttccttttgaatatatttcttcaattatgtttgttttagaaatgggaatgtggataccgcaatgtagtatgtaaaaatgcacttacatcacttaggagattcactgtgtcagtggtgccatcgccatagctgcagttctttctcttggttacaatttcaagtaccagcacgccaaagctgaaaatgtcaatctttggtgacacatttccatgtattgcatactctggtgccatatatccgctgcagatgatgagaagttaggcatagaagcacacattttggtcccagcgatttgaattgaatacataagcttactatgttccaacaattctagttgtctttgtgtgagtatgacctcctcctatcagtcttgctagtccaaagtctgcaatttttggatccatatcctcatcaagcagaatattgttagctttaaggtctctgtggatgatccttatgcttgagtcctcgtgaaggtacattattcccttggcaattccaaaaatgatgttgtactgttggtcccaacttagtgcatttcctctactagcatgtgctgcaacaaagtggttagtttgtatcaggcagtgactctgattgataagtagagaacaactttatgatccttttgcaacttggttcttagaaagaaatcctgagaaaatgtttactgaatttttcagtcttagctatggtcctttttgcaacgtcgttgttagaacagtgattacttatttggtttgcagttctgcttgtataactgtatggaaaaaccatttagtactgcaaacattttgaccatgcatgttgcaatttgcaaaaatataattccaatctccaggttgcaacagtttcttaaacttgataaagcaatgggaaatcttatgaacacgaaatcaattaacattgaacaaaattcaggattagtattacttggagaggaaatcagggagaataccaaataaaaagttgtcgaggctcccattttttatgtattcataaacaagcaacatctcatccttatggacgcaaaacccctgtagcctaacaaggttcttgtgctgaagctctgccaacaccagcacttcattgtgtagctgattcagtccatgcccacaactttctatgagcttctttactgctatttcttggccgtctggtaattttccctgaaacagactctttctcataagaaaaaggacctgcaaattttactcttcattttgcttgcataacagtaccttatatacagtaccaaatccgccttctccaagcttatgcttctctgagaagttctcagttgcctctttcagtgtagccaaatcaaagatcgtgcattttcctcttgccattttcttcaatactgttgttgtgttttttttttaatgcaatacatatcaataaatgtaaaataagaaaacagttcctgaacaaacatcaagctactcatcagttacttacagttgtctttctttgcagccttctttctcttgaaacgaatgaaagcataagctgacagtatcaacatcaagacaacgaagcaagcgacgcctgcagagatccctgcaactctccttctcctcgctgcatacaacaaacagacattcagagaagttgaattgatatgtgcagtgtcaaagtttgcgagaaaaaagtatcgtttcttcaatggaagaagaagaaaaagaaggcaattcttttacctgttctagtcggcggagcagcaagtgaaggcatggccggcggcggtggctccggcggcgcagaaatctgcagcattggctggccctgatagaacggcttcacgctgtacctcaggttgcaccaaatcccaagaactctccctccgggcttcccgttcaagaaccatgggatcgacgagacgaagccgccgaggcagctccggcactgcgccgccgtcatcaccggcgcgcactgcgccatcccgtaaatcttcgggtagtgcttcgggtcgaagtcctccaccgccgtggcgaagtacttcttggtgttgttgctgccgctgccggcggccacggccgtgtccaccgtcgcgttcatcagcgcgacgacggcggcgttgaaccaggccaccgggacggccgtgatgttgctgtcggcgtcggagtagagctcgctgaccggcgagttcacgccgacgaagtcgaggaaccgctggtcggagaagcggacgatgcagccgtcctggtaggtggtggcgtccttgctgctggggcagtcccgccgcgcgacgcggaacgacgccgcgacgcacgcgcggcacgccgtggcgttcgcgtcgccgcggcacagcgccagcgcggacacctggtcgggcaccgcgccgacggtggccgtggcgtagccggccgccgccgcggtggacgcgttgcccgggagcgccgccgcgaggacggcgaggttcgcctcgtacgtgctgttcgccgcgtaggcgccgctggcgcatgacgagaactgcatggtctgctgcgccgcggcgagcggcagcagcacggcaacgacgacgactacaactgcgagcattgccgcggccggcagaatgcaacgtacaattcctctttcccttctttgacggacgaaccttgcgcggcaactctgagcctgagcttaactaacaattttttttcttttgcaggaaaaaaacgcgcaattggcggtttttgaccgagacaatgatcagtagctctcgcccgccattacagttgcgctgtttgtcgtttgagaatattcatttcctctgcgttgccgctggtacttgtcaagttctcgtcatcagataaacgtacagcaacttgcattgccaattggctgaggtcggcatttccgtgtcggaaggtgaggcccattctccccggcgaactccggtctcgcgtcggtctccctacataagtcgcctgcctccacctcttgacagtgtcagctgtgtccatggcgcatcgcgctggctgcctctcgatgctgctcaccgccgccgtcgtgctgctggcgctggcgccgcgtggcgcggcgtacccgtggcaggtgtgcggcacgacgggcaacttcacggccaacagcacgtaccaggccaacctcgacgccgtcgcggcggcgctgccccggaacatctcgtcgtcgccggacctcttcgcgaccgccatggtgggcgccgtgccggagcaggtgtcggcgctggcgctgtgccgcggggacgccaacgccacggagtgctccggctgcctcgccacggcgttccaggacgtgcagaacatgtgcgcctacgacaaggacgccgccatctactacgacccttgcatcctctactactccaacgtccccttcctctcctccgtcgacaacgccgcctcgacgagccgcgtcaacctgcagaacgtcacgtcggacccgggcaggttcaacggcatggtggcggcgctggtgaacgccaccgccgactacgccgcgcacaactccacccgccggtacgcgtccggcgaggccgtcctcgacagggagtcggagttccccaaggtgtacagctgggcgcagtgcacgccggacctgacgccggcgcagtgcggcgactgcctcgccgccatcatagccaagctgccgaggttgttcacgaaccgcatcggcggcagggttcttggagtcaggtgcagctaccggtacgaggtaaaccccttcctcaatggcctggtgatggtgcatctgactgcgccaccgattccgacagcatcaccgcccgccgctgccgcggcggcggccggagaaggtgagtcaaagcatgcttcttttttttctttttgcttactctagattttgcacgtgcgtgatggctttcaaatgattgaaacattgtttagttcatccattggtgacaaaaatgattagcgaagtcccctgaagttggtttgatgtgattgatcttccgttgattaattcaactggtagttaaccttgtgagagtcgttaacgaacactgctagcattgtggagtactatacacatataggctgcgtttgtttcagggtgttcccaacccctgttcctcgttaatagactgctccatttttcgtgcggagtagatgggttcccaaccccatgtgtcgaacacagccataatcggtaggtgatctatctgtgttgtttatttgtgggggtggtgtatagggacagtgtcatttcattttcagtatgtcagcttcagtgtatctacaaaaaaataacaataaaattaaagaatggaattcgtaggccaagtgggattagagatgcagtgcaccaagtagataagatgtcacatttgttggcatttagcccttcacaatgttcctatcatcatacagcctgtggttttgttcttcagtcagcgcctgtaggtttgctccaatacagaggcacattctgaaggcaacacactgtattggctacggcattagcagttagaagcaatgtttgtttaaagagtaaatttcacaaaactatatgtgttttgcacaatctatctatctattatataataattatataattaaagtaatagaaaaaggagccttcacgttcgctctcacggcttaggaattctcacattaatcgaaagaaaataagagaaaaaaacaaaacaccaagtgtattaggattaggtcatgcaaacggacaagaaaaattaaaagttaaaatggacagaacaaatagaaaaaaaaacaaaggatattataatgatagtgtgtaaacagataatgattctttggaatccgtatgagagaatttctgcatgcccatatcacggtaattgacttatcccttttttaattgtacacaatacatgtcatctcaataaatacatgtcctagaaaaacataaataacaaaagtaatcgcatgattttctcgccgcaaattagcacatcagtaatctttttactacaatccacttcatcagcagattaacaaacataaatcttttcatgcaatccgcttcgtcaactagcagaccgaaaatatatataatttacaaataactaaaatttgatattaaaaataattaataaataaaacatatataaaataaaatatgaatattacacatcagtagtttcgtaaagttattgcaaaatttaaaattatgttgtcattttaatatatttaaataatataatgagaaaacatatatgctattatatgagagaaaatataatgatgctagccgcgcaatctgcgcgggccaccatgctagttaacttattaaaggaatagaaaaaggagcctccacgttcgctctcacggcatagaaattctcatattaatcggagaaaaagaaaaacaaagtccatatagaaatacaatttataaataactgaaattcggaattaaaaagtaaggaatattagaagtagagtatagagtccatatagaaatacaattatgaaataatagaaattcggaattaaaaataaggaatattagaagtagagtatagagtccatacagaaatacaattaggaaataatataaattcggaattaaaaataataaatattagaagtagagtatagagtccatataggaatttaaaactaactaaaattcggaataaacataataaaattaaaagtagagtttagagtccatataaaaatacaatttacaaataactaaaattcaaaattaaaaaaaaacatgggaagaagattctaaagtcaatatagggatataatttagaagtaactgaaattcgaaattaaaaattaaagaatattgaaagatgagtttagagtccacatagaaatgcaattagaaataacaaaaattcagaattaaaaataaaaaaatattggaagaagagcctagagtctacatagaaatacaatttacatataacgaaaattcagaatttaaaaaatattaagaataattaataactatacagaacaaatagaaaaaaaaacaaaggatattataatgatagtgtgtaaacagataatgattctttggaatccgtatgagagaatttctgcatgcccatatcacggtaattgacttatcccttttttaattgtacacaatacatgtcatctcaataaatacatgtcctagaaaaacataaataacaaaagtaatcgcatgattttctcgccgcaaattagcacatcagtaatctttttactacaatccacttcatcagcagattaacaaacataaatcttttcatgcaatccgcttcgtcaactagcagaccgaaaatatatataatttacaaataactaaaatttgatattaaaaataattaataactaaaacatatataaaataaaatatgaatattacacatcagtagtttcgtaaagttattgcaaaatttaaaattatgttgtcattttaatatatttgaataatataatgagaaaacatatatgctattatatgagagaaaatataatgatgctagccgcgcaatctgcgcgggccaccatgctagttaacttattaaaggaatagaaaaaggagcctccacgttcgctctcacggcatagaaattctcatattaatcggagaaaaagaaaaacaaagtccatatagaaatacaatttataaataactgaaattcggaattaaaaagtaaggaatattagaagtagagtatagagtccatatagaaatacaattatgaaataatagaaattcggaattaaaaataaggaatattagaagtagagtatagagtccatacagaaatacaattaggaaataatataaattcggaattaaaaataataaatattagaagtagagtatagagtccatataggaatttaaaactaactaaaattcggaataaacataataaaattaaaagtagagtttagagtccatataaaaatacaatttacaaataactaaaattcaaaattaaaaaaaaacatgggaagaagattctaaagtcaatatagggatataatttagaagtaactgaaattcgaaattaaaaattaaagaatattgaaagatgagtttagagtccacatagaaatgcaattagaaataacaaaaattcagaattaaaaataaaaaaatattggaagaagagcctagagtctacatagaaatacaatttacagataacgaaaattcagaatttaaaaaatattaagaataattaataactatcacgtatataaaatacaatatgaatattacacattagtagtttcgtaaagttagtacaaaatttaaaattatgttgtcattttaatatatttgaataatacattaagaaaacatatatgctattatatgagagaaaatataataatgctagccacgtaatctgcgcgagccaccatgctagtttatcataaaactaaatatttaagagcttgtttcacaaaactaaagatttagtgtctccgtttatcacaaaactacaagtactttgtacaatagatcacaaaactacagatttaagaatttgtttcataaaactatagatttagtgtattcgtttatcacagaactacacatttagtgtctttatttatcacaaaactacaaatttagtgttttaaaacctatagttttgtgataatggagacactaaacctgtagttttgtgataaatgaagatattaaatctgtagttttgtaaagcaagttcttaaatatgtagttttataatatattgtgtaaagtacatgtagttttgtgataaacgaagacattgaatctgtatttttgtgaaacaagttcttaatctgtagttttgtgataaatcgtgcaaagtatctgtagttttacgaaagagtgaattgcattggcggtacacgaatttgtcaggtgggtgcaatctagtgcatgaacttataaaatgctcatgttggtgcatgaacttgtctagtgcgtccggaggaaggcgaaaaggacattatatatatagctaatcttattgatttaggggctaattaggatattatgtaaacatatatctgagaaggttgctattagacatacacctcttcaataaaaaaaatagaatatgatatagtgatagtagaaaaagatgaaaaaaaccaagcaaatgatattttggtcctcgttcgcacgaaatagacaagtttgtgtactgaaatgaggattttacaagtttatgtaataaattgtacccacctaacaagtttgtgtaccaccaatacaatttactctttacgaaatttactcttgtttaaatgatcttgacagaataaaaaaatattttttccttcagttttctgaatatacatgacaagaatatggcaaatgagattgaaaatgactgaaaggcgatgttggtacttgcctattagcttctggcagctcttgcacgttgcttgcgtaatgctattgattatgtgtttagttgcaacttactcatttgatctgaaattagtctacatctgtcaattcacagggaaagattacaatgttcctcgcttggttctagcaattttgctgcctactatagcagctttagtgctaatcaacattctagtttggctctgcttctggaggaggatggagaggctacgatcaggagcaactcagccatgtatgccctgcaaaatttttcaaggagaatttgaaacaaattaagttgttagcttacattggcatttatacttgaacagattccagcaactctgctgaatcggagaatatttcaagtgtggagtcgatgcttatcgacatttcgactttacgagctgctacagggtgttttgcagaacgcaacaagcttggcgaaggtggatttggtgcagtgtacaaggtgctgactctaacataactgaagaaagtatcactaaaaatatattcattactaagtgttactattgatttggtctgaacagggtactctgcctgatggcgatgaaatagcagtgaagagattatcgaagagttcagcacaaggagtgggagagctgaagaacgagctcgcattggttgcaaagctccagcacaagaatcttgtcaggcttgtcggtgtctgcctggagcaagaggagaggcttctcgtctatgagtttgttcccaaccgcagcctcgatcagatcctctttggtaccaccaaacttactaatccactcaattttagctaaatatcttcaccattttctctgcaaagttcaataacatcaagctgatcattcactctcaacatgtttttttatcaatatcagacgccgacaagcgtcaacagcttgattggggaaagaggtacaagatcatcaacggcattgctcgtggcctgcaatacctccacgaggactcgcagctcaaggtagtccaccgtgatctcaaagcgagcaacatcttgctcgacatgaacatgaacccgaagatctctgactttgggctcgcgaggctcttcgggcgagaccagacgcagggggtcaccaacctcgtcatcggcacatagtcagtggcagtaacccaaatacagagaacataacaatttgttgaaagctgttgcttggatggtcagttaatgaatagtactttacgctgttgtatttcagtgggtacatgtcaccggaatatgcgatgcgaggcaactactccctcaagtccgacgtgttcagcttcggcgtcatggtgctggagatcgtgacggggaagaagaacaacgactgctacaactccctgcaatccgaagacctcttaacccttgtgagcactaaccatatgatcctactcgtctgttcatggaaaaatgaggtgattgcttagctaaaattgactggattactcgtttttgtgcaggtgtgggagcagtggacggcgagggcggtgtcggaggcggtcgacccggtgatgggcggcggtttctcgtggagcgacgtgatgcggtgcatccacatcggtctgctctgcgtgcaggagaaccctgcggatcggccggtgatgtcgtcggtggtgatgatgctcggcagcgacacggtgtcgctcagggcgccgtccaagccggcgttctgtgccaggaggaacggcggcaccggcggtgccggtgccagctcggggggcacgtcgtctggtacgtcgacggcggcgtcggtgcaaggcaagtaactgtagaagtgtgcaacggtgaaactgtgctcgctgtgtgggatctgccattccgctgaagcattctttgccaggttaggttaggctttcataagtatataacgcaatgtaccagactgattaccaaaagaatcaaagacagcaaaatatactgaaaacttgtggttcagtggctccatggagcctgagttcctgtgctacaaaccagtgatttcaaaatatttgtaaacttttgtaatagagagtaattttacggtccttgaagagattacatgaggttttactttttctattgtaaatttgttacctaggtaatatgaggtaccaaattttacattaaatttttggtaactcatggaacctcctcaagcactgtaaaattgctctttttaatagaagcgcatggagaaaagggtaaagtttttgttgacaaggttttgctaaattttggttgcttgaagttttattatcttgtagtcaccaaaaattgcaaggctaattttagttaaacttcactgcaattttgtttatgtacttgggtttacgttacctcagtattctgtatttacatttttgtataggttcgtcattttgaaatttattgtatggttagattaatttgttcaacctgtataaaaagaaacaatgagaaaagttgtgggaatgatgagcatagttagatctcatccaaaggataagaaaagtgggaggcattgaaatttctgtcacttgatgaatagcccttttccaaatcgtaaacaaatgtgacgtgtactaacaattaacgaataaactaaaacataatatattgactcaatcaatggagaaatgcattcagaattcagtaatacaaattatcgaaggctttctccctgtaagtttgacagatagcaatctgattgtccttgcaattgattttcctatctttcattcagaaaattgatttatttatcttggttcaagctctgtaacagacacatcattaactgacatcatcccagacctatgggtcggttgggaagtttgtgggtatgattccgagtatatatttgagtctgtaccactcttgggaatgaaaaatgatggcttggatggggattgaagagacactgtgttgctgctaagcatgatattcactgttgacatcataggtcgatctgctgggttatcttgaacacacagtagcccaatgtgaatacacttgagcatctggtctcgaggagcatggcttgtaagagagggatccatcatctccaaaattgttcccatggtccagtgctcccatacctgcatcatattggcaaagatgattcagaatttttgtaacaagttaggagatcattctgattagctttgtagaatagtccaggaaaaaggacttacacggcttaggagatcatatgattgatcaaagctatatgaaccactgcttcttcttcctgtcacaatttctatcatcaatatgccaaagctaaagacgtctgattttacagaatagtggccacgcatcgcgtactctggtgccatatatccactgcagtaagagaataaagttactcatgccagcatactatttgtatctgattgggttagtttagacaatacttactatgttcctaccacacggcttgtgacttcccttgtttgatcaccctcaaatagtcttgccaagccaaagtctgaaatcttagggttataatcggagtctaataaaacattgcttgctttgaggtctcggtgaattattctcagttgagaatcttcatgaagatactgtaatgcgcgagcaattccatttattatcctaaatctttttccccagtctaactccttccttttctcaagatctgtcaattgaacaagaaatgtcttagtaaactacagttttaccactaatatatattcatgatgacaagggcatgtgaattccaagtgtttggcttgggttgaagacctgattcaagaaggttggggggggggggtgtaaagaaacacattttggaaaggaaatgtacagttcagatctagtagtgcttgtgcaattgttgaattctgagaatagtaccaaatagaatggtgtcgatacttctattgggcatgtattcatacacaagcaatttctcatgttcttgcaagcagacaccaacaagcctaacaagattcttctgctgaagtttagcaaccaaaacaagctcattttttagctcttctattccttgtcctgaactcatagagagcctctttacagctatctcttcaccactaggaaggacgccctgcataagtgcaagcactcgcttattgaagctgtacatagttatgcactatataaagtgaatgatatatatgattgcattggcaccttataaactgaaccaaatcctccttcaccaatcctattgctctcagaaaagttacccgttgcagcacgcagtgttgatagatcgataaaaagtgaatccgtgctttcaatgtcctccgccatttgaattgaatctatcaaaagagggcaacaacattatgatgcaatgtaactgaaatattaacttttcctgaaatataacgtcgacatttccaactatgaaacccttttttcatttctagggaataaaagaattcaaataatcaaagggaatcactgtttccctctcactataatcaaaattgttggtgaacttacatgaagattgctgttttgaccttgatctttttctccacctctgaacagaaagacaaatgacaaccgtagccaacaatataacaactaggggcaatgcaatggctagagctgtgccacttttatttttctttcttcctgcaggcaagtgatttcagcttcagacagataaaacttgtttttgttgcgaagacagacatatagaagtatagaacttaacaagactaattcataacctaaatatgatgacacatatccactataattaaggtttctgttcaaaaaggtacatgctacgaagtcacaccagaaacttatttagtgcaggtcaacactttgacctatacagcacaccgcaaagctagtaaagtcaagcaattttcaatatattataaacgactattttttactgttaaaaaaggtattttagaatatggtttcatcttctcgtgtcttttcctaattaaacgggaaaacatggaggaaaccaaaatcattgttgaactttacatgtaaagcacatacatacaagttgcataatggaagtgcagttaattaccaacactacattggaataaatgtgtgaactgaccaagtaatcaggctcaattggaaaagacacgagaagatgaaaccatattcacctagctctggcgctggagtgatcagatctacaattctttttattattactggtggtatccacaaatctcggcaaagtagacaaccaggataattgaatacaaataaaaatatgaaagattgtggggaaatttatggaaagtgacggagacgtgatcaagtgataaggaaaagtacttctaaaagtattcctgaaaacatcatactagtattatttattggtaaataaatgcattgcagttggaaatgttgagtaagacgtgcttttcgccgtttctggtcaagaatccgatagaaacaggactaaagaaatgtcaagatcaacccaaaaaaggaagaaaagtgtacagggttataatatgtgatagctaccagcgtaccaggctcctttgaccagtaatccccatgcaaccagttgccatgattgagatatttttatatttccccacatttttattttgttatttttgcaattcaacagtactgcaaagcaaaccacaattcttaacgcggtaacattttttacctaaacagcagaaacaatttgaagacatagtacaagtttgtttagagttttcttcttcaatagtcgtttggttgtcttcattttgtcaaaattgatggaaaattaattatgagcagatgttgtcgcgctaattaaataccaagataaattactgcaaaagaagtggatcccctttgtctgcaacacacctccggttggcgccgtcggcgtcgagttcgccggcgccgggagccgcagcatcgagcctccggcgaagaaaggacccacctcgtacctgaaattgcagcgcatcccgatagccctcccgcccttcctccggctgaggtaccgagggatcagcgcgattatgcgcccgaggcagctccggcagtcgtccggcgacatgtccggcgtgcactgggacagcccgtagatggtcggagtagcggcggcggcatcgaaggcctcctcccccgtggcgaaccgcctggacgagttctccgccgcgtagctgctggtggcgttgaggagggtggcgacggcggcgtcgaacacctccgccggcgcgctcgcgttctgcgtgttcatcaggaacctggggctcccgtcgtcgtcggcggcggcggcgaggatgttcctgttggagaaggcgaggtagcagaggtcgtagacgatgaacgcgtccttgtcgtaggggcacagctgctgcgcgtcctggaacgccgtggcgacgcaggactcgcaggcggtggcgttggcgacgtcgccgcggcagagcgcgagcgcgtagacgatgtccgggacggcgccgaggctgtccttggcgaagagcgtccgggacgcggaggcgttcttggggagggtggcggagagcccggcgaggttggactggtaggtgccgttcgccgagtagttgccgccctgcccgcagaactgccacggctgggccgccgccaccggagcgaggaggagcgccgcggcgaggcggcagaggaggacgcggtggcgcgcaaaggtggccatggctgcggactgcggagatgctctccgtcaagctaagtactgtcgcttcgtttgaccgggtgcgggctgtgactgacgtataggacccctactgctctcaaggtgatgaagctgcagagacaaaattgaagaagaaattgaagtgatgtgacttgtctcttgtttgacctcggacttcttcatcagctcagcaaacaaagaaaattcaggatctgtttagatccactaaaatagtaatttttttttgtcggtttggacaatattttagcaaaatagatctaaacactagtagtaaaaagtagacaaattgacatttatcatttgggagtccagagcagcaaatttggcaaaaaagcgttgggccccatgcgggacgcgcactgcccctcactcgctctctctctctcatccgctcccaaaaatttccctatccgctcgctctctcacccttgctccgctcgcgccgccgctcatgccggctctgcctccgctgatctcacccgtcgctgccaccactcatgcccgcatccgcctccacctccgccgaactcgtccgccgcaccagtccaagacctagccggagatggacggcgacggctccggcacgagggacttcatgtcgcaggccgattcactttcccccgccggcgggtaagaccctttcaccaacttcccgtaccactttattagatccgacaacggtagtgcttcaggataggcatggcccccctcgacgtcaactccgacgatgatgggtggccgggaatggaaagctacaagggcctccttcgctccggcacaaacactagcagcagcaagagagattgctagagtgcagagacaacagcaattaataaggtgccattaatatggacaaatcagtttttaatggtaaaatgaaaatactttaccatacatctaaacaccaacttgtaaaattgcaatgtcaaattttttgctatcaaaacttttgacaaaaaaaaattaccgcatcaaattgattttaagaggccctcagagaaaaatgttcttaggtgagggttaggaacccttacctcccatacggaaaacagagtgatggattagtgcacgattaattaagtattagctaaaaaaaatttaaaaatgggttattatgatttttttaaaccaactttcctatagaaattttttgcaaaaaatacactgtttagacatttaagaagcgtgcgcacggaaaacgagggaggagatgataggaaccagaagagccgaactctagtaacttgcgaccaaattcgtacaaaaagcggacggtgaaaaccaatcgattttatcatgtagggaaacgtgctccatctttttaatttttcccccgaacctgcaaaaaagttacgtatcattataggcttgtttaaattgatggtattttaaactatatcattatttgataaaattaataattatgtagctatatgtagtttgctatctaattttggtaatgtccatagaattttgataatattatggccttgtttagttcgtggtaggaaaagttttggtatgtcatatcggatatacggatacatattttaagtattaaatgtagactaataacaaaacagattacagattctgcctgtgaactacgagatgaatttattaagcctaattaatccgtcattagtaaatttactgtagcactacattgtcaaatcatgaaacaattaggcttaaaagattcgtctcgcaatttacacgcaatctgtataattagttttattttttttgtctatatttaatactctatgtatgtgtccaaatattcgatgtgataaaggtgaaaagtttttccctaggaactaaatagggcctatactgagcacatcctagtagaacttggcaatgttgccgatttaccaaaattttaacattatcaaattccgaaaaggttcattttattatcaaactgaacagacctatatttagaagaaaaaaaagtacttcctccgttttaggtcacaagacgttttgatttggtcaaagtcaaactgctttaagtttgaccaaatttctagtaacatttttaactcaagataaatttattatgaaaatttattcaattattgatttgatgaaactaatttagtattataaatattattatatttgtttataaacttagtcaaacttgaaacaatttgacgttgatcaaagtcaaaacgtcttataacctgaaacggagggagtacccgtacaagcccttaagagcaagtttaatagtatagcccactacgagctccaaatcatctatagctaatgtaatagtcaattcatacaatagttgcttactatactattaatatctggttcatctgtcatacacatattacgtcttagagtccgtgctgcagctggctacagatctgtagcccgcttcttttttctctctttctttatctttttataatatgtttatagctggtttatagcctgctatttacctactctaaggagagaaggatccaggaggctagcgcttcgtccctaatggctgcacatgggcactgtttggtatgtgtttgtgccatgcgggtagcatcttctgttttggtcagaaagattggttggtaattgctaaagtcggttctagtggatacaaccaattgtgttcattttattcggacatggcacataatactagtgattaattcagggtgaaaatcctgatgtagtttatctcgatttggcaaattcggtgctggtttgtcacttttttttttgttgacggtatcatctcagtctttttttcgatggcagatgtaagcaagcgttgggtccttcctcaaaacgttgttttggagtagatatataaaactttatggttttgtcttggcttgtcttgactgtatatattttggatgtgactaaccatatatttttgtaatgccattttcaatggaagatattatttttatatttccaaaagttccacataagcaaaaaggtatatagttgattaaaatagctcatacaatttattgttttgtttttcttgtttcatagacaatacatacaagatacaagttgtattaaaaacaatgtcgacatggttttatcatctgaccatttcattaatttcttgccacatcataaataatattgacatgacaccccgtttaatgagaatgaaactcatattgggattggcctaaattgttataagataacataatatatttatgtttgtcttaggtttttttttctaagttgtgtacatgcctggttgatgcagaggtcgtgtgtaatttcagtcttaccactatctgaagaaattgaaaagctagatttattcgcagtatgccaccttagcatcagtaaaaggtttgcaacaaatttttattttgtgtgtatagcttctacataaatttttgtcactggatgtgcaaccaaccaattttcaaactataaaataaacaagggtggcttgtacgaacaaacaaaaccaaccaaaatattgactcagccaatggagaaatgcactcagaattcaatgcttctcctacaagtttatggccttctccctgaagtttgtttcttaaaagtaacaattcaattaccgttgtcactgattttcttatcttaaattcgaaggatttggtttccttatcttggttcaagctctgtaattgacacatcattaactgacatccctcccgacctaccggtcgaggcagtcgattgggaagttagtgggtgtgattccgagtatatatttgagtctgtgtcacttttgggaatgaaaaatgatggcttggatggagattgaagagacactgtgctgctgctaagcatgacattcactgttgacatcataggtctatctgctgggttatcttgaacacacagtagcccaatgtgaatacacttgagcatctggtctcgaggagcatggcttgtaagagagggatccatcatctccaaaattgttcccatggtccagtgctcccatacctgcatcatatattcatattggcaaagatgattcagatttttgcaagaagaagtaagctacttaaatttgtagaagagtccaggaaatgagcaaggactcacaagacttaggagatcgtttgattgatcaaagctgagtgaaccactgcttctccttcctgtcacaatttctatcatcaatatgccaaagctaaagacatctgactttacagaatagtgcccacgcatcgcatattctggcgccatatatccgctgcagtaagagaataaaattactcatgctgacatactatatttgtatctgattgggttaatatggacaatacttactacgttccgacaacatggcgtgtgatctcccttgtttgatcacccccaaatagccttgccaaaccaaaatccgaaatcttaggagtatagtcggagtccaatagaacattgcttgctttgaggtcccggtgaattattctcagctgagaatcttcttgaagatattgtaatcctcgagcaattccgtttattatcctaaatctttttccccagtctagttccctccttttgtcaagatctgccagttgaacaagaaataccattagtaaaccacagttttaccagtaatttgttgaattctgagtagagaatagtaccaaatagaatggtgtcgatacttctattgggcatgtattcatacacaagcaatttctcatgttcttgcaagcaaacaccaacaagcctaacaagattcttgtgctgaagtttggcgaccaaaacaagctcattctttagctcttctattccttgtcctgaactcatagagagcctctttacagctatctcttcaccattaggaaggacaccctgcatataagtgtaggcactcacttattgaagcagaacgcgaacataattacatgaagtgagagatatatatgattgtaccttataaaccgaaccaaatcctccttcaccaagcctatttgtctcggaaaagttacctgtcgcagcacgcagcgttgatagatcgataaaaagtgaatctacgctttcaatgtcctcccccatttgcattgaatctatcaaaagagggcaacaaaattttgatgcgatgtaactgaaataaatgtgacgtcatttccaactaaaaattgtagggaagaataaaattcgaattgtcaaagggaatcactatttccctataataataatcaaaattgttactgaacttacatgaatgttgctgttttgaccttgatctttttctccgcctctgaacagaaaaacaaatggcaaccatagccagcaatacaacaactaggggcagtgcaatggctagagctgttccacttttatttttctttctttctgcaagcaagtgatttcaatttcagacagatatgaacttaacgagactaattcataacctaaatatgatgatacatttccactataattaagtttctgttcaaaaaggtacatgctacagttcaacacttttcagtttttgacctgtacagcacatcgcaaacttttcaatatattatacagggctttcttcactgtaaaaaaatggcattttagaatatggtttcatcttctcatgttttttcctacttaaatggcaatacatggaggaaaccaaaatcgttgttgaactttacatgtttaaggcacatatatattgcataatggaaatgcagttattaccaattctacatggaataaatgtgtgaagaaacaggacaacagaaatgtcagatctatccaaaaaagggcaaaaagagcacagggttatctatattaatatgtcatagcaaccagatttctctgaccaatgttcagtaatccccatgcaaccaatttccctgataaagacatttttgtctttacctaaaaaatttgcaattcagccctactgcagagcagccacaattcttaacgcagtagcatttctaacctagacagcacaaaacaatttaaagacatgcaaattagtttaggggttctttcttcctttttcttcgaactgattgtaagtttctctctttctctactcaaaactactactatattggtatcttcggtaaattttttttcctagttttctcaaaattgatggaaaactaattatgaggagttgttattgtgctaaataccaacaccccatctgttttaaattactcatcgttctagctttattttaagttaaacatttatctttcaccattaacttttagaaattcatataatttaacatgtgaattatatatattatgaaagtatttctcatggtaaatcttaaaaacataaatagtgtgatgttaaactatatgattttctacacatcgatgcttaaatatacaaatttttgactaacaacaaaggtaaaacgacaagtaatttgaaaaatggagggagtgctataaatttactccaaacgaaactgatttttgaccgcaaatctgcaactcacctccggtgtgcgccggtggggtcatgtttgctggtccaggtgcaggcggaggcgccgccggcgccgccggcgccgggagccgcagcatcgagcctccggcgaagaaaggatacacctcgtacctgtagttgcagcgcgtcccgataaccctcgcgcccctcttccggccgaagtactgaggtatcaacgcgattatgcccccgaggcagctccggcagtcgtccggcgacatgtccggcgtgcactgggacagcccgtagatggtggggtcggcggcatcgaaggcctcctcccccgtggcgaaccgcctggacgagttcgccgccgcgtagccgctggtggcgttgaggagggtggcggcggcggcgtcgaacacctccgccgtcgcgctcgcgttctgcgcgttcatgagcatcatggggctcccgttgtccgtggcggaggcgaggaggttgcggttggtgaagcggaggtagcagaggtcgtagacgatgaacacgtccttgttgtaggggcacagctgctggcccccctggaaggcgttgtcgacgcaggactcgcaggcggaggcgttggcgtcgccgcggcagagcgcgagcgcgtagacgatgtccgggacggtgccgaggctaccggccgcgaagagggcggcggaggcgttcttggggagggtggcggagagctggcggaggttggactggtacgcgctgttcgccgagaagttgccgctctgcccgcagaactgccacggctgggccgccgccatcggcgcgacgaggaggagcgcggcggcgaggaggcagcgtacgcggtggcgcgccatgaccgcggagacccgtcgtcactcgtcacctgtgggttggagaaaagttgtcccgcaagctatgtaacgtgcggctttagtttgaccaattgaccgtgtggtgctggctgagaatgacaggtggggcccagcttctcggtgctcaactgctccagaacctgcagagacaatcatcgcagaagaaatttgctgtgatgtgacttgtctgccgactctgacctcagcctcagcgtcgaagacttcaagaaactgttgatcagctcaactaaaatgatatcaaagacttctctcaactgaaagaattcgtagtttagtttgaccaatttcatacaagtgaaattttccattatgaaagaattcgtacaaataatgaacaccaatctattctggcagtcacattctgagtttcagatcatctaggatagggatcagtattggtgacatcatttacagagaatttatcctcaacaatcacgccactcttatcatacatgtagttgcgatgtctgtgttgttgttgataaactgaactgaagtcccctccaaagaagaatgccggttgccgcggttgctggagttttattctgcgtctggttaacattagaatcactgaagatatgcttggcctgtcaatggggctctcttggacacaaagaagaccaatgtggatgcatcgtagcactttgctgtcggaatatccatcaagtgattgatcagccagctgcagtgccgtcccctttgtccagcaattccacacctgttatatcaatgtagtcatttttttttcagttgaaacttgaaagtctcttcagattatcaagcagtagaggccaccataaaagttctaaatcaagtagagctgaaaatagggcttacttctgtcaggagattcactgcgttgtatgtggtgtcgaaaccgctattccttctcccggttacaatttcaagaaccaaaacaccaaagctgaaaatatcgatcttaggtgataccttcccaaatagcgcatactctggtgccatatacccgctgcatgtagaagatcagcaataagtctacactttggaactgggaaacttacatttatctcattcaagtttcagttatgtttgtgaacttactatgttccgacaactgtagccgtcttagtctgagtatggccacctcctagtagccttcccaacccaaagtctgcaatttttgggttcatgttttcatccaacaatatattgttcgctttcaaatcacggtgaatgatccttatgcttgaatcttcgtgaagatacaatattccctttgcgattccaagaatgatattgtaccgttgctcccagttaagtgtcttcgccctactagtatctgtttcaacaaaataaattatttgaattaaacattttttatcatatacaatatatggaaggccatactacaatcatgtcatatctaaaaaaattactacaatcatgtaaatggagattgttaattgtacattctagtattagctaatttctgtagcaactcgtttgccgaaaatgctacagtgcttggattatccatcacactccatcactacttatacaatactcatttaattcttgtcaatcccttggcatagctggttatagtatagctttttagaggaaaattaacaattttgtgctcaaatgtaagcataagtttcaaaagagatcagtttgcagtgtgtcaccagacaaaatactggatcagcagccatagaggaaggaaagtaccaaaaagaaagatgtcaaggctcccgttcttaatgtgctcataaacaagcatcatctcatcctgatgcgagcaaaaacccagtaatctgacaaaattcttgtgctgaagctcagccaacaactgaagttcattgtgcagctggttcagtccctctctggtgtactgtgcttgtgacagcttcttcactgctactttttgcccattaccaagctttccctgcaaaacgaacctgttatagagaagaagagaaaatggtagtcaggtctattttttttttatcttacatactatggttatttaccctgtacacagtaccgaaaccgccttccccgagcttattactgttagagaagttatcagttgcaatttgcagtgttggtaaatcgaagatcgcgcaatttcctcttttgattttgttcggtgctgggatgattggagctggcattggggtaaaaatggcatcaacagactgaaactcatgctaattctgaatgaaacataaaatgtgtgccactcactgttctggtttttggaagccttcctcctcttcaagcagatgaaaacagaacctgaaataatcaatacaaagacaatggaacaagcgactgatgcagatattatcacagctgtcctctttcttcctgcatgaatcattatttacaaacagaaaatagtattagtactcgcagaaatggtcaaggaaggacacctccgcgttaaatttgtcattaactggtcaattaagcaactgattgtgacgggactgataaattaagaggtagcagatccggtttttatgcaggcgatgtgtagtttggtcgtgcctacccctaccaaactttgttgacaatggtgaaacaagttaaaactggagataatcttttcgatatgagaggaggcaaacccatggaaaacgatgtaactaacgagatttatcgatctaataccttgagcttgactaacaaccatatgataatcataaagtggacaatttataccttgagcttgactaacaactataagatgtgcatggctaacgcgctttgaaaatatttccatcttcttcttttgatgtctttgtagcctgacttttcttatttgacctcgtaaaactaactagaacattttaaaaaaaaacagagaaatgtgtataccacataacttatgttatgaaaaaatgactcttcagttactcgctagtcgctaaactatgcgctccacaggttattggtattagtactcccttcatatcaaaatataaaaacatattttgtttcggcaggacaaaattttgatcaacaattgctctattaggatatcttatgtgatacatattataaaagcataatgataactaagtactttcgaatacgaatataataaattcaattttgtgtcacctaaatatattataataaagtattgttggtcaaaaacttgtcctaacaaaataaaatgtgccttctctttcgaaacagaggaaataatgtacaaattaaaattttaatcatatggtgactacattttgaatcatattgaattactagatggaaagaatagtctacagcagttactacctgtcaattattaatttcaaattatagaataaaataaaatactgattttataatccatcctagtaatatagtttctgtgtttttttgtgttttatttaatattttggagttttggaattaatcataagtaattagtgttggggtttcaatttaatatttcaaaattaaagattaataaatatagggttgtcctcatattggactttggaggcttataattagcacttttatgtcttttttttttgctcaaaattcggatataaaaattagtaaatactccagtttgtaattgatatagccttttgttttatctaaactacagtattataagtaggagtaaagattaaagagtccaccatatttctataattgcatgttttattgaacataaactctaaatacgatatacggtcacaatcatataatccatccagggttgacggcacggcagagactaacttgagatgtaaaccattttgtcactgacactacaagaaaacaaaatgcccttggcggtcaatttagttattccgtcggccgaccttcaaatctagagagccggagatattaagaatttcttggtagctaaccacttcctccgtttcacaatataagtcattttagcattttccgtattcatattgatgataatgaatctagacatatatatgaatgcgggaaatgctagaatgacttacattgtgaaacagagaaagtataagaaaaaaattttagatctctatcaactgtcaaaaaaaaaaagaacaaaaaaaaactcacctgctctgtccgccggtggtgtcgtgtccgccgccaccggagcgggtgatggcgccggcggcgatacatcaaacgccggcgcgtcgagacgcagcagtgggcttcccgggaagaacggatgcacgtcgtaccagtagttgcaccgcaccccaagaaccctcccggtcgggctcccgctgaagtagtcgggatcgttcacccacgagattatgccggccaggcagctccggcagccggccggcgacatgtccggcgtgcactgcaccagcgcgtagatgtcgcggacgccccagccgcggaacgcctccacgcccgtggcgaaccgcctgggcgagctcgccgccgcgtggtccgcggtggcgttgaggagcgcgaccacggcggcgtcgaacacctccgccggcgcggtcacgttccgcaccttgctgaagtaggccgcgaagttgtcgccgtcggcggcgaggaagttcctgccggagaagcggaggtagcaggggtcgtagaacacggtggcctccctggcgtacgcgcacagctgctgcccgtcctggaacgcggcggcgacgcacgcgccgcaggcggtggcgttcgtggtgtcgccgcggcagagcgcgaggccgtagaccgtgtccggcgggtcgccgaccccgccggcggcgaagagggccggggaggcggaggcgttcttggcgaggccggcggagaggagcgcgaggttggactggtacgtgctcctcggcgcgaagacgtcgccgctgctgccgcagaaatgccatgccttggcaccaccgggtagcgcgacggcgaggaaggcgaggaggagcgtagtggtgcacgggtgcatcgccatgagttgagatgagagttggtagtgatcgattatccccgcgtaatcttttttgtaaatgatggagatggttttttgatccgggtcagacgacaaagaatatgattatataaacggtagtacatgtgttcacaatatcctttgatccggaatgaaagaaaggacgaggtttaatgaaatagacatgacgtctatatatgaacacgctgactacctacaatattccaacgaattttgacactacaatgaaagcgtgctaaattttcgtcatgaaggggttgttcaaattgaagtcatttcaaactatacaatttttttaagttgtcaaatatgtgtatccatttagtttcttactaaactctggtaaatatataatggtaaatatataagaaattctaccaaaacttagcaatattgtcaaattgtcaaaatttggtaagatttattttagctacaatctgaacagacttgaattcttaacccaaactaatttagcaacatatagaattaaataagtaattaaagtcccttaaaaaaactaaacagcgaaatcccgtagaatatcttgaattaaataagcaattaaaagttaaaaaaaaaaccaagaatcctgtagagacaggaatagaataagtggaaagccatctagctttccgctctatagtttgtgtttttgcagcgtgtggtgtcggggcatgtgttttggtgtatatccttcctcgatgaaaaaccttattgtaaccctttttccctctatcttaataatatttgaatgacttctttcggtcatcctagcaaaaaaaaaaaagaaagaaaagaaaagaaaaaaaccatctagccttacctattccccttctgtctctctagggtttagaaagagtgtcacaccccaatctgataccgccgtacaacggcacctgacaggagcgtgtcgtagggaaaacggcgcgaaccgcttcctacgaaaccgcgatctcggtaccagtcccaggacatagtgctggtacccacggtgacaaatatgaatcatagcaatccttaaaataaatagaggacttatttaccttaacttaggttgcagctcagacagcccgagaatacaaccgacgacgcggacgaggaagcaccaacagcagcagcagcagcggaaccaacggtctaacacccaacaccacaggcgacggctgggaaccaggacgaaaccctaatcttcacttcaccttatcttctcttcagggcgggggaactatatatatatttatagagcaagggtgagtactttcgtactcagcaagtcacgggaatttaggtgtttaatgcaagcttggaagagaggcaaggttgttttgcaaatcttttgtttgaaatcattttgaaatcactaagtgatttatttctttctatgtttgggcgaaaagagacttgcgtctcgattcgactttaagagatgcttttcaacaactcaattggtaatgtaccgacctcccgggtcggatcattacttctcggctcccagagccatttcacttggttaatcggctcccagagcctttttcattttctcggactcccagagtccagctgcccagcagcacaacaatccgcttccactcgggaagcctagtctatgatgcccacagacatcctgaatcacacagattcgtttctgaccactcaggtcatccatctgccacataggctgattctggttacgattcccacaccacaacaacttttcacaaagcacaggcaaacaaatctacgcaacgggaaccacctcacatccgcccatgaccgtgggcacggctgttcgaacagtttgttaacctctgcagaggggtacactttacccacaagacacgaacttactctagacactggccggtgtcagaggttcgcgacaaagcctttcccaagccgacccagggatacctcatgccacatagaaggatcaaatcctcacataaatataggccattttaggcatacacaaatcaaactccaaccacctcgatcggtaatctggcaagcttcgcgttcttgccttaccaggaacccggtttggctccaaccgaccccgccccggcgttcccaactattggcatgcgaggtttccctgaaccgactagctacttagccagggtgtcccattccaccttgtggttgcactttgattatgttcgatgagtttcccacaggaatcggtccttatatgcgaatacgggacagtgccacataggcacaacccccgcatcgcgagttttcacaattcattttattttcaaacacaccgacaccacatgtcgggtttcgaaggcttcacaaacccatttcccaagtttttgacaagcaacggtgtatgtgggatatttggtatacgcgctcagagagcacgaataccgaggtaccacaagggtggagcgacaaggaatcagggtagtacgacctacggaaattagtgcgactactgggtaggtccgtcggtttggcacgcaaaccgaggccaagcaagttaagtgtgtgattctaataatgcaagttaccaacaaaataataatgattttccaattataggagcaattggtcaaagggtgacttgccttgctcaaggtcttcacgaagcttcacgaatcttcgagaaaacccgcgatcgacgaaaatccgataaccgcagctatacgcaaacaattgaaaacctacacaagacccaaaagaaagatcctatttagcctaattaatagtgccattaaatagatctcaattttacggaattactggaagtggaacggagtcaatcggaagagcggttgggaagatatgaattttggaagtttgatttggattttctggtcaaggaaatgatttatcggaattttctagaatacgagaaatggtttatgggatttgtagaaataatattcccaagaatattattgacagtcactgtcatgtgggaccaaaggaaatggtttatggaattttggaacaaggaattgatttatgggacaaaggaaaaaggatttattaaatcactgaaaaagaaaaggatggagggatgtatattagactttttcgggcggcaaggacgcggcccaagggtcgaaggaggctcggccaagccatttgggccggcgcggtcgcgggaaaggcggcccattagggcgcgcggaagggggagggagcggtccggtggaccgggtgcacctcgcggggtcccgggtggggcccacatgtcggcggcaaggttcacggtggggagagcgcacgcgggtgtgttgctagggtttggtgggtgcggtgtgcgggcggtgcgccgggtggatcggatggcagcgggcccacatgcagccggttggcgcaccgtggaccgcgcgcacgggagggggggaaggaaggaggcggctgaccggctcggctcggtcaaagccgaggtggcgccgacgtggcgcctacgtggcagccacgcgggccggcgggaggaggaagaaggggcggccgagatggacggcggacggcggccgagttcaccggagctcatcgcgacgattcgagagagagggagtacaccggaacgatgggacggacgagaggaagtgagccaccggatcggattcgccggaaagaggccagaggcggcggattgcggcgacgcacgctggcggcgagaaaaaggggaaacggcggaggggcgacaaggattaaattcaaggtggtgggagtatctccggggttcaaggagttcatctccggcgtcggatggggcagagcgacgccgtggagatctggcgacgagcggcggcctccgggagcgagcggcgatggtgacaagcctatggcgggtgacggcattgctagggaacggtttggggagaccctagggagctcaaggacggtgtcggtgagggtggtcgatgagctggggcccgacgacggcgcgcgactgcgcgcggcggctgaaacagagcaacggcgaggcgcgcggcgcattgtgcggcaggaggaggaatacggtgggggagctcaccggcgagggaggagcggcgttggcgacgcagagggagtcgtgacgaggcggtcgcgacggcggggaggcgcggcaccgagagggcgcggccgggcaaggagggaggcaacgaggccgaaaggatgatgtgtgcatgcacacgctcttggccacggcagtgcggcaccgagcttgacgaggccgacgccgaggctcacgcggccattggcacagcgcggcagcgaggaggcagtcgcggggcgagcagctagcggctggcaacaatggcgcgggtggttcgagcgaggcgaagacgaaacgagaggggagggcgcgggctttataggcgaggaggagaggtcggtttggaggagggaaaccgacattggtggtcaagcttcttcggctggcgcggcgcttgcggtcaaggagcggcaggtggtgacagcggctgtggtcggggaaaaaggcaaaaaggggagggaaaagagcttggctcccttgccactttgggaggaaggagaaagagagaacgagggagaggagcacgagctctgtctcttggttttggaaggatgcggcatgggggcatcggggccgagcgatgacagcggcgatgacggctaaaggcgagcggggccgggcggctgcgcggcgcaggcgcggcagggccgacgcggcggcgaccgggcggtcggccacgcgcgagcgcgcgcgcggacgtgagggcgtggtcggattcaaacggcggcggcgggaaatcgacgccggggagagggagagagagagaaacagagagaacgagagggagagagatagagagaaaaccgagagagaaggagagagagctctctctcccgagcggctcatgtgcggcgcacgtgggaagggggaaggcggctgagggagggaggtgggctgagggagaggaaatcggtccatccaaaatacagggaggtaaagtagacttttacagagaaaactgatttggatagaattggagagattttagggtttggactcgaattcaaatttgatattcgaactcgagggtttggggatatatcaagggggattcaaggagaagtcatggaaaggattcaaaaggaatacttgggtatttgttctcgggaacatagggtggagtcaaggaaaggattcgaggcgggatttgaataattctggattcgtagaagtatttggcgaggattcaaaggaaggatttgaatttcagaatttgatttcagagactcgaatcggaaaaggaatttggaggtggaggattttggtttcgatgagagggaacaacgggattaaattgagatccttggcacaacttagactcgcacacaaagaacgaaaattttcgcaattaggattttgccgaattagtttttaacgactcacgaaaagcggagcgttacaaagagctacaatgaatttgtgctttatatatgtgtctaaattcatacttagatgagatatgaagataccaaaacgtcttataatatatgacggaggaagtatgtaaataacccttcaggaatgagtatgcgtatgtgaagtaacatacagagggttacaacttacaattatctgcttatactatcattttgctagtatacatattatattaccgtgccctactatatgtggatcatagctaatatttctttgaagtctgatggtgtaataatacatatgatcggctgtgttcggatagcagggatgggaacccaatctcccctcacggaaaacggagcggtccattagcacgtgattaattaagaatcagctaatttctttttaaaaaatggattaatttgaatttttttaagcaactttcgtatagaaactttttacaaaaaatacaccgtttagcagtttgaaaagcgtgcgcgcggaaaacgagggagaggggttgggaacttggagttccaaacacagccgaagtaggtctttccctacatcagcattttttttttttttttgcaaaacaaaaagggtacaatatgaattcagcatcacattggatttatcttggctcaagctcagtgatcgaaacctcatttggtgacataggcgatctatctgtggactatagttggccatgtgggccgcccggcacggcacggcccaggcccggccgtgcctgggccgagacttgtcgggccggcacggcccgaccgacgcaccgggccgtgccgtgccagcccacgtgccgcactcacggcccaggcacggcccaacacgcctcgggccgtgccgggccggcccgaaggcacgatgggccatcgtgcttttcctcagaataagtctaaatttcctccctcctattgggctgtgacatatgtacagctacaaaaagtctattttacctccctcttctttgggctggggtatataaatagctaaaataagtctatttaaggtccctattctttagacagttacatttatatgtctatttttagtccctgtactttatgtaccgggcctggcctaccggcccatcgtgccgggccggcccgaccgtgccgggccagcccagcgtgccggtggggaggcccaggcacggcccgacagtcgggccgggccagcacgggcccgacccaagtcgggccgtgccgtgcttgggccgggccaaaaaggcgtgccgtgggccgggccttcgggcctcgggccttatggccaactatactgtggactgattagctccacggaatggctccgagtacgaatctgagttgacactactcttttggatgcaaaatgccggcctagatggagcttgtaaagacacggtgctgctgctaagcatcacattcaccatcgacatcattggcctctccgtggggtcttcttgaacacacaggagtccgatgtggacgcacttcaagatctggtctccaggacaatgccccgccatggatgaatccgcaagctccacaactgttcctgccaaccagtgctcccacacctgcatattttgataggtaatgtaaatgctctgatattaatacaaaacattacttgggtgtagagtttgtaatatatagctgatctctcctgaggtactcactaaagttaagagatcaaccgattgctcggagtcgtaggagacattgtttttccttcccgtgacgatttctaaaatcagaacgccaaagctgaaaacatctgatttgatggagtaatgcccgcgcatagcgtactcaggggccatgtatccactgcagtgagaaattctgttatgtcaaggactaatgtgtactaccgaatatattagtagccaataatatcatcagaacttactatgttccgacaacacggttcgtgacgtcttgtgattgatcattcccaaatagccttgctaagccaaaatctgaaatcttaggattaaaatcggaatctaacagaacattacttgcttttaggtcccggtgaattatcttcagctgagaatcttcgtgaagatattgtaagcctcgagcgatcgcattgactatctttaatcttttccaccaatccagcacattgcttctatcaggatctgtcacatagaagaaaaaacttcaaaattatacataaaaaagtttcagttattgattcactgttgaaaaggctgaagagtacccaccaaacagaattgtgtcgaggcttttgttaggcatgtattcatacacaagtaatttttcatgttcttccaagcaaacaccaaggagtctaaccaaattcttgtgttgaagcttagcaaccaaaacaagctcatttttcaactcctctatcccttgtcgagaactttgcgatagccttttcactgctatttcttgatcactagggaggactccctgtacagatagagaatttttactggctgaaactgtaaagtattgaatataaaaactaaaatggaatggtataattagcaccttataaaccgcaccaaaacctccttcgccaagtttattgctgtcatcaaagttgtttgttgccactcgtaaagttgatatactaagaataagtgaatcaatactttctatgtccgctgggtctgttggatctattgtttcagaaaaaaaatacaacaataatggtgtaatgcattaatggaattcttgcttttgtatgagaatgaagtcactgcatagacaaaaacttaattttgccatttcaagtgtattgagaacacgtactggaaattaatggaatttgaatgaactacaggaacttacctgctattgatggctttcttgctcgttccgtcttcctcttccagatataaaagcaaattactacagcagccagtattgcagcgactataggcaatgcaatggctaaaaccctaccagtggtgttccctgttcatcccgtaaacggaatgcatcaattaatgtaagacataagacagaaacacaagtataaataattttgacatcattaaccagtatacactaaccatctttttttttttgaaaacttacactaaccattcttaaaggagcaattttacgatcctttaggaggtatcaattttttattgtaaatttggtacctcacagtacgtaccaaattttacactaaattttttgtacttcatggtacctcctcaaggatcatagaattgatcttcttaaaaaagaaactgcatggactacaaaagaaaatgacaaatacatatttacttacacattatttttatcaaaattacagtgcacttacatatcatatcaactgaatttacaaatgtaattttagttacatagatctataattttatattttaaagaaaataacaaatgcatatttacttacacaatattgttataaaaatacagtgcacttacatgtcatattaactgaatttacaaatgtaattttagttatataggactgtaattttatatgtttttaaaaaaataacaaatacatattcacttacacagtatttttaatcagaattacaatgcacttacatgccatatcaattaaatttacaaatgtaattttagttatgtaggagtgtaattttatattttaaagaaaataaaaaatgcatatttacttacacgatatttttatcaaaattacagtgcacttacgtgttatatcaactaaatttacaattgtaattttagttatataggactgtaattttatttttatttttttatttttagttgtcttattttttcaatggttaaagaaatcaatttttacatagaaaatcgaaagaaagggagagagagaatgagaaaagaaagcgcatgaaagagagagcgagaaggaaggcgggagagagagagagagtgagaaatacgccgtaacagctagaaaatggccagaaaattcggaccagaccggcccacgtggctccccacgtggcctcatagcgctaaatccaccaccaatctagacgcacaatccgacggccagaaaaacgtcaaatttcagacgagaaatcacgcgacaaacgtttagcaaaattgatcattagcaaaattgatcatggaaacatctggtatatgactagtctaaaaggaaactcatagattcatgcgattaaagatgtgaacatcagaccagtccacaaaatgacaaagaaaatattttcttccaaattaagttgttcgtactaaaaaacaaatcatgaaagactaatctaacttcaaaaagaaagacgagttcgtaacctctacacagggccggccctagccctatgcagccgaagcgaccgccgggggcccatgatggtggggggccatgttagggggggggggcatctaattctagtagtaggggggggcatctaattctagtagtcgagtacctcatccgatgttgagatcaatgatttttattcagaattaaaggtgttgcaagtgagtttaccagattcttcgatgtctccgcgcctgagattttaaagtttgttatggatgcagattgctatacaaatgtttcagctgcctatcgaattcttttaactgtacctgtgactgtagtttcagctgaaagaagtttctcaaaaattgaagttgttgaagaactatttgagatcaactatgtcacaagaaaggttaaatggcttggctatgcgctcaatcgagaaggatatcttgaacactattgatcttaataccgttcttgatgattttgcatcaagaaatgcccaaagaagtatcttttcatgggaagcaatggatatgatggggttctattcttcattaagttaatgaataatgatattagttccaagttacaaatatattgttattttgatcgattttatttcttgataattaccatacatgttaaatttaatatatggatgtttttgtttttgttttgcaagtaaaattagcatatatatatatatatatcataaaattttatatataccttagagggtccatcgtgatgagtttgcctagggccctcaaaatcataggactggccctgcctctacaacaacttctatggctaggaatcagtcacgatggacaactcgaggtttacaaatgccattttcaccaaaaacaggtccctagaggttttttcaatagccacgacaatggaacggttatcgacaaaaacaggtagaatttggacaaattttgccaaaaaaataaattttttttctgtatttggacgattcagtttcttcatgtggaccgactcaaagccaataacagtgttgtggaactgtggaccaatcgataattagattgctgatagcatacttaggtaccgaatcaaatatcgtttcaaattcctacggtgaaatcaaacaccacttctattcaaacccatcgaactaaaattgctgcacacatgcatggactgatcctctgtccgtgaccaacacaaaattcaggccatttaggatatcaggatactgttttccccccttttgagtttagcatatcgcattgttgaaatgagatctacttcgtatatcagtttcacccaactcacctcgtcgtctggtaccggtggtggtggccggcggcgtgacgtttacggccgccggagatggcgccggcggcgctcccagtgatgccgccgggagctgcagcagcgagaccccgtcgaagaaaggatatatctcgtacctgtagttgcaccgcagtccgagaaccctgccgccctgcttcccgctgaaatacttgggcatcatcccgacgattccccccaggcagctccggcaggtggccgtcgccatgtccggcgtgcactgcgccagcccgtaaatcttgctgccgttgaacccttcctcccccgtgccgaaccgcctggacgagttcgccgccgcgtagtcggcggtggcgttgatgaggacgcccacggcggcgtcgaacaccttggccggcgcggacacgttctgcgtgttcatgaggatgaggaacttgttgtcgccgttggtggaggcgaggaagttctggttggagaagcggagcgcgcaggcgtcgtagaagacggtggcgtccttgttgtaggggcagagctgctgcgcgtcctggaacgcggcggcgacgcagccggcgcaggcggtggcgttggcggtgtcgccgcggcagagcgcgagcgcgtagacgatgtccgggacggcgccgagggtggcggtggcgaagagcgtgcgggacgaggaggcgttcttggggagggtggcggagatgctccggatgttgccctggtaggtgctgttcgccgtgtagttgccgctgtcgccgcagaagttgccgaggggctggcccgcgacgggcggcggtaggagggaggttaggagcgccgccgccgccgcgacggcggcgacgcaggcggggagatggccacgtggcgtggccatggcgcgagggtggaggtggtcggcgagcaaagagggataaatggagaagagatgatagatgagcggtgggcccttggttgactcgagtggagcttgcttgactcgtctatgttgcgctgtcgtcgatcctgacatcatgggacccaggcataaatgctggtgggcccacgtcaagctgccgtgacgaccattgcatggccggcgtgagggcaaacaatggggattttttatattttagatttttatttacaaaaacttattttataaatagataggctagacagcaataagtagtgtcgagagcctattcgtgaaaggaatatttttaattaaaaaaggatttacttgtaatataaaaatatttacatatagctctcagtgccatgttattggcattgaagtcctatttgtaaataaaataggtccttaatactaatatcattagcacctatacaacactatcatgtttagacgggataatatcttaaaagatattatacgtcgatacctaggaatcgcatgatacatataagtatttcgaatgggatacatcattataccattatcctcagcaataatatccagtgcgcttccatcacggcaaacaatgtgccgaaacatgaattcggcaataataaaagggggtagcgcacgagccctaaaagtggatggatgcggagacaaatgatttagacaggttcaggccctctcaatgagaggtaataccctactcctgtttggggatttgaatccgccgggtgtgtattgatctgacgatctagttgtgtctcatgccccctagagggcctcctgcccaccttatataggatggggggcaggattacaagatagaaaccttaaccaacacggtatcggtttcctaaatctactttacaatcttatcaagccaggactttaggccgttccataatatacagggaaacgtaatacccaagtcatgatctgttacatatttcatagatataagttatcccatataactagtcggataaccatgccgtgtgggtatggggtacccataatctccacagtagcccctgagaccttcacagtcgaaaagataatcttctctcgaactagattactccaaagccgagtgcttcaatcatctttgccatgacttcccgagtacttttaccaaatctgaagactgtggagggctgaaaaataaagtcaggtgcatcgactagatgcacctaataggtgtagcccccgactatgtggttaattgaacaaaccaaacatatagtcaaggaataaataatctaaccaaccgagtggtttcgataatagcatatgatgtgtgaatccctgaataatatgatccaagtgatataccgactgctttgtaaaatatgatgcgtgtaacttaaagtcgactacattattgaaaattcacatagcaaaacagctataaagaagcttgtatgttgtgaataaagaaatttccaaagtattgggcatacgccatgcgcacactgctttaacagatgtgcttaagtccctaaagacacatggtttcaccacacctgaaaatatatggcatatgtggtgtaaaatccgagtaaataaactcataaaggatttaccaaccgcctagaaaatgaccaaaatatataatcagcccaagccataatattggtcaataaaagtgtacacttacgtggcaaaaaacaatgatattgtatccaatcaattgctttatgaacccaaacagcaccttgacttatataaaaaagtcagcgggcagctatataaagcattactgtttggcaccttttaaaatgcattgtaccaactcctaaaaagttgagtaactgcggtataaaaggattttaaggtattgggcacataatcacgcgcacttttgcctaagcaaaaagatgcctaagtccctaaaagaacgtgacaggccacacctgaaaatatgggctgcagacatattaggcctaggccaaaacatatgccctcgacaccctttaaaggatgacgcatgtaacatgctcccgagtaataaatcttccgggtaatatagaccaagcgtagctcatatgaatagcttctgatctgagtgattatcccttatgggatactccaaaatagatataaaaattgaatcccgactggcgcaagtattcggttgataacccttacggagaataataaatagtccagtctttgagcatagaaaatagacccatgatcatgaattcatgttgcatgtaaccggaacaagtccaaattgaaggtatgatacttgtgtttgaactagtaagcctctgagcatatagcttgtccttctttgtagtcacaattgtccatcgatggtagctgacgcagttggcatagagacaagacgaccaatatagagataatattgcccaccagaggtggcaaaaatattggtggtagtgaagatagtgataccaatcaaaagtactgaagtcgcatagccatggaggcgaagaaaccagtcggcggcaaacagatcaactaacaatgaagatgaaggcgcccagcgataaagttgtgtagccatggcagcgaaataatcagtcggtgacagacgaggcagatcaaatgcgatgacgaaatccaccaatcatgaagatgaagaaaatagttgacgatgacaaacgcaaccgacatgatgaagatgacgatgtcgatgatccagtcaatagcagtgtagcaaccaatgataatgacaaagacgctcatcagcgtttgcatagtaggtcaaccgtgaaggtgaaataataagtcggcgaaaacataatcatccattagcaacagcggagatgtcagggtcgatgaagcagaggtgctggtgatgatgtcagtgacaataatctatcaaattaatgttatagctgttgtagatgctttacttggaggagagttgatgttgttgcccaactcgtctaaaccgaaatatttgaagttgttgaagtagaatgtctgctccgaagcaaagatgaagataatgactcctggagttgactcgttggctgattaattgatttcttcagcttgacataaaatttgtcaaattttgagccttgtatttgtatagcccccgactctttgattagttgggaaacaactgaacatagagtcgagaactgtagcttcttgtcgtcgaatagttattgcttgattgaagatatgtgttgaagatgtccaagtagaaatcctgaatattggagagccacttgttgtagtaaaataacacggcatcgcatgccgagatgtcgagattcacaaagacgtcgtggttggtgaagtagcgaaacttgcgaagtagcagcaatagagtttgccggtgccgaagataataaagatgaagtcgctctaccatgatgacaaagttgcattgccgtgatgaagtgaacacgagtcggcgtcaacagaagcaaaccggtagtgaagacgcgcagttgtgaagataaaagcaccagtcggcggcggcataaccagtcggcgacggaagacgatgatgtccatcagtagtggtagtggtataaaccagacgtagagacgagggcactagtcaacagcagacgagatgaccggcggtgaagaagataaggccaatcaacactggcagaatcatgcagccatggaagtgaataaactagtcggcagcagacgtagacagcttgcgtttgaatatgatgacgcctattagtggtgacggcgacgtagccggccgtgaagaagatagcatcagttggtgtcataacaggccagccgtgcaggcggaaacaccagtcggcggcggacgagggcaagccggtcggtgaagacatagacgcccaacaacggcggcataataggccaaccgtgcaggcggaaacaccagtcggcggcggacgaggcggccggtcagtgaagacgtagacgcccaacaacggtggcataataggccagccgtgcaggcggagacaccagtcgacgacggcgaaggcaagccggtcggtgaagacgtagacgcctaacaacggcggcataataggccagccgtgcaggcggaaacaccagtcggcggcggacgaggcggccgatcggtgaagacgtagacgcccaacaacggtggcataataggccagccgtgcaggcggagacaccagtcgacggcggcgacggcaagccggtggtgatgttctgactgatccattcctgcagtgtaagagataagcttaaagccatgaatcccttttatgcatatctggatttggatcctgcagaacaaacatataggatgagtagtatctgatgtaaatataatactcgagaaaaatgcaagtattttaaaatatttataaatatgtatttctcctcttgtcaattttgatttccccgagcagatgactccttacgtttaaacactctgcccgactaatcatagtccccaagcatcgggagtcggcctaggcacttcccaaacatgcatatgagtgacatgagttcgtcattaatggaacaaagtttcacggatcagaatttactactcgggtacttttgcaattattaagagcaaaaaaaaaattatctcatctctatgcttttgatttattccgaataatacttagcaccttgcgttactcggtccatccaacaagctcccgggtgctaggaatcggcccaaagtcaatcatccattggcaaaccaaacggaaagcataggaagatagaactccataacccgataggtacttttgtactcagattatgtcgcaagcaatcaagataaatgttatgaaaaatatgatataacatctgtagcccccgactcactactcaatggaaggccaattggtgtagtgaggcagaggaaaaggaaaaatatcatataaagaataaaataaatgatgacttagctttatcgtattcccttggtgacagcagaagtagccgatgtgggaacgaagcagtccatctcaatagcgatgaaaacacctgtcggcggcggcaaaagcaagccggtggtatagatgacgaggcccatcaacgacggcggagtccgccaaccgtataggcgaaaacaccaatcaaaggtggcgaaggtgcctggtcggtgaagacgatgaggcccatcaacggtggcggagtccaccagccgtgatggttaaaaaaccagtcggcacggccgtgggcgaagaagatgacgcctagcaatattaatgcagttgaccaacctattatgtatcccgcgtcttggaaaaaggacttggagcctatgtttgccgagtgctgatatagcttgctgtgtgcccataaccatatgtctttattaaattggaagaattgatgctgagtccgagtggattaaaacatccattaatcagcgagtctgaatttgaatctactcatgcacgcctgatacgagatgcgatgcactcatgctgctcggtcagctcctattccgatctgacatgatagtaattaacaggcaggcatatacatcttgacaaggaaacgagggccctctggcgctgcgagttcagccaatggaggactcggaagtcgtagccgataacaaaacatgcaggaaatctttagattgatttgatcagaagattgtgttgacggcgacggatcaatgtatctcctggcatatggcttgcatggtgtcagctttgcatgtaatgacctagtcatccttttgattgtatatctccacggctgatctagagaaaagaaaaaactccatggctgtccagtcttgtatcttgcttgattgctttaattggcgagtgatctcttagccgactaattggagcatgtcggattttcggcagcagtgatgaagtccaagaagatcctggggaagacggaagtgaaggtggtggcagccatagtagattgaaactgtcttgactggtttgaatccgagtcaaagagtaagagcttgtcgaaattgtcgacgacgaggaagcgaaaactcccaaaacgaagacgaagccggcgaccgataaagttgattccatcgcacttgtcgatagaaactcgacgcacccctacctggcgcgccaactgtcgaaacatgaattcggcaataataaaaggggtagcgcacgagccctaaaagtggatggatgcggagacaaaggatttagacaggttcaggccctctcaatgagaggtaataccctactcctgtttggggatttgaatccgccgggtgtgtattgatttgacgatctagttgtatctcatgccccctaaagggcctcctgcccaccttatataggatgggggcaggattacaagatagaaaccttaaccaacacggtatcggtttcctaaatctactttacaatcttatcaagccaggactttaggccgttccataatatacagggaaacgtaatacccaagtcatgatctgttacatatttcatagatataagttatcccatataactagtcggataaccatgccgtgtgggtatggggtacccataatctccacacaataatagtcaagtgatgtgacaggctccaattggaacgttgtccattgccggactcggtaaatgcagcgatcgatcgtatgatgaacgctattggattttttacgatttcattcttttgaaaaacttatttcgtaaatagatctaagaaacaacttatccccggaaatagtcttttttgggcgccagagtcattggcactgtcgtccaacgggagggcgccagcctcctgccaccgtagcgggtcggcgctagggtagcagggggagagcgccaatgtagctggcgtcctccccccaatttttttttatttttcttttgatatagcacatgagaaccaatcatagaaaaattaaactcaaatagatgaaatatgtgacatgtagaattttccaaagctctaccgaaaagcttctcgtctcgaaaacataatattgcaagtggaatttggaggttctaattttgcctaacccgacgaatcggggagaatcggatgtaactttttctatagatgtcagtggatgtattatttgcctgattccgagtccgtatgagaaaattatgcatgttttaaaaaatgatacccaaatgtaacaaataaaacacaaaccctaactttttttcatgtaagaaaaagctaagattgttcgaaatctaatctatttttttgactttatgaaaaactaaaacaacgaagagcaggaaggggcttttcgatatagctttgaaaaattctacaagtcgcatatttcgtccatttaagtttaatgtttctacggttgattcttgtgcgctcctaagtgtgaaaaaaatatattataataataataataataataataataataataataataataataaaggatgcatatatttctcctctacactagagaggaaaaaatgcctggggggcagccacataggcgcgttctccctaccacctcagcgccgacccgttggcagtggcggagctagagagaattgaagggggggtgcaccactcaatcatgtgttcatacccatcgaaccatatagaattttcaagtgatatattatactaaataattgcgcctcccatcaaatattaaaaaatgaaatcaatatgtgatgccaattgtatcaaaagaggagtgcaatgataaaaatactgtactgaccaatatgagtgaatgcattataccagcaaaactaaaatacattgccccaacctccatgttagctctcaactaaaaaagcttatgaactaatcatgtcaaatagatacatcatacattaccttctactatttatgactcaatatttaatttttttaatgtttgttaaacagtaaggcaagcctagatatattatatatattccttcactgttggcttgttctatcgtccacttcttttataaaaaaaaatcccaaaaaaatcacctatacaacattgataaatagtccttaattttactattttaggtagtatgatctaatccatcagaagccttgctatgaacacattagtgcattgaaaatttgaaaccttcctagtagcacctgttcggcctggtgatctgcagtgcacgcgctgggctttacgcctctgtggcttaactttcagtctgggggtacacatacgtgaggcaaggggggtgcccacatggtcattagggggtattaatcactaattttactttcctagccgggttcctaggaaccccctcgggacaacatagcttcgtccctgcccgttggacgacagcgctagcgactctggcgcctaaaaaaattatttttagaataaattattttagagtctatttataaaataaatttttcaaaatgacccaattgtgaaaaatccagatgaacactacgatcgctagtctggatcattcgatttgcgtctgtcgatgtcacgatagtgtgtatgcgatgagacttctcacttctcaggtcaggacgtcaggtacaagccccacgataatgcatggccccaaataaagatacaatatatatatatatatatatatatatttaatttaactttaggggccacagtatcgaccattatcttttcctcccaagtgttgggaaggtctcaaaataggcagaaaccctcacgggtgtattagttagggtgttcagatatagaggtgtaaagtacttgcgtgtcatatcgggtattatataaagtgtcgtatggggtatttgggcactaataaaaaaactaattacagaatccgtcagtaaatcgcgagatgaatttattaaacctaattaatccattattagcaaatatttcctgtagcaccacattatcaaatcatggagcaattaggcttaaaagattcgtctcgcaaattagtcgcaatctgtgcaattatttatttttttacctatatttaatacttcatgtaggtattcaaatgttcgatgtgacagcgtgaaaaattttagagtgggatctaaacagggttttattctttgtggaatcaaatacttcatccattttatttcatattataagtcgtttagattttcttcctaagttttattaaatttggctaagtttagtgaaaaatttagcaatatctaaaataccagattagtttcattgaattaaacatttgatatattatgatgatatatttgtcttatgttgaaaatgctaatatattttttataaatttggtcaaactgtattaaatttgatttagaaaaaagataaaatgacatataatgtgaaatggagggcagtattatataggaataaagcttcaaaagtaaaccatagtactaggtagcaagacaggcagacacaatttcgggtactgctatttagttccacgtttgttcgtagtgcgcactttttcctgaaaacttttatctcagtatatgcacatttatcagttcgcactctccaatattacatcagtatcatcctttccatttgatcaatcagaagagcaagagaaaatatccctattaatttctgaatgaacagtcttagacacgaaaactgcatctacatcttgtgtagaaatgtgcccttttcttttgggcaactggattttgcttgttctgtggtctacgatcaaccgcggctacagacagaagttgacaaccctgtaccaaatggaatttgaataccagtgaagagtccgaccaagatctccaagaactctggtttgtctacattatatttgcatttaaccaagttggagtattctatgatatttgtaacaacttttcgaattaacaaaaccagatgaaatatacctgaactgaacctccacctatggcagccgattggcctgggttcttctccttctaccgtctccccattcctggaggaaaatgaacagaacacaggctattccgatcacttcgaacaccaccatcacagggaaatcatagatcgaaacaattttccaccaaggtgaagtatctgaaaaaaataaaagaagaagaaaaatgctgattcggatgatgcagagtctacctgaaattctgaatcaataaaggaaggcgaacaaaatcacagtataatcaaaagacaaaaatttatcgagctattccctccgtccaaaatataagtatttttttctctaacacggtctccaagatgatactttgacttgcaatatctacccctaattaactgcgcattgtaaggtttggtctcgttttctcctaaaaaccagacaccttctttttatataaaacgtcgtcaacagcctgactgttcgaaaaaaaagaccagcaatatctataaaaataatatgttttaaataaaaagagttacatattatgatagttgtccaatgacaaatctagtaacattaattttacataattgatcttttttatttttttactattaataattaaagctaaaaatatttgactttttactatgctaaaaatttatattttaggatggagggagtaacaaatagatcactcacggcgaacggctgacacggcgcgcatctcccgctccatgcgttcgacgtcgtggtagccgacgcggcaggcgccgaggtcgaccatggcgcgcctgctgtacccgcacagccaccgcgcgtaccggaacgccatggcgacgcaggcgccgcagtcggagtacgccggctccgacgagtcgcagcagaaggccgacgcggagatctggtccggccgcacgccagcgaggatgccgacgcagctggagcgatttgaggtggaggatccgttcgccaccatggctggcagcgcggcggcgacatgccgcaggttggcttcgtgccttcgtacgagctgttgcgagcgaaccgcccctgcacagccccgccgcactggtggatcggcggacggtggccgccgtcgtcgtcgtcgagggcgtcggtggccgcggcggcggcagcaagcggagtagttcagtggtagcagtggtagtggtacaggctgctccagttcagtggttatggtttactatgattaatccacggtagattacttgggttagttgttaactttgaccgttgagtactaacctccataaagagcagtaacaatgaatatatctatactccctcaagcaaaaatataaggaaaaatcaccactaacgcaaagataacaaaaataatcatctcttcggctgtatcgtctcgatgcatgcaaataatatgattgagcggtttgaattttgatggtaaagaatttaaaatgagtaaattttagaaaattgtaactttagtggaaaaactatcaatttgttacaacattagcgacatatttcagtttgctgcaacaatagcgtgcaaaattatcacaagactataacttttacgttatatgctgcaacagtgcggcatatatgtattgtagcagcatataacgtaaaagttgtagttttgtgataatttctcacgctattgttgcaacaaattgaaacatgtcgctaatgtggcagcaaactgatagttttgtcactaaagttcactacgccagatcctcacacctctgacgggatacctgtgacgggcaaacgaattggtcagtagtgaccattacctttgacgggttatacgggatgcagtcaccggtgaggcatctggccgcggcccgtcacaagtatcccctcacctgtgacgggccgaaaggaaaacccgtcagaggtataccagtgacgagtttttaatccaacccgtcactggtatcccctcacctgtgacgggccaatacattagaagccgtcagaggtgatgggccgccacctgtgacggctttaatttctggcccgtcacaggtgagatgataccagtgacgggccgttgaatacaagcccgtcaaaggtatgagcaatacctttgacgggctttttttatctaacccgtttgaggtgtgttggctctataaatacccccaaactgccaactgctttccatcccgaccattgtactgctcacacatcggttgggagggcaaggggggcgatttttttgctaaaattcaaggtaaaaaacacattattctccattcattctcaacatatcgatcatcatttatttttcttcgtatgttgttgatttcagatggatcgtagatggatgtactatgcgcatcgttcgtctaccgagtatagagagggggtcactgaatttgtcacatttgcggataatgacagaaaaagtaggatgagcatgcacatgttgtgcccatgtagggactgtaagaatgaacagatgatcgaagacaaggatgaagtgcatgctcatttgataatgaatggattcatgaagaaatatacctgctggaccaagcatggagagcaagaggcgcctgatgtcgcagctgaagaagtgttggatcaggatgtagagaacaccgccgcagctcgagaaggcatgttcgtaccttctcctttaggtggagagaccatagatttagacactcaatgtctatctacaatgttgcatgacattgaagacgcagaggacaacgacagagattatgagaagtttagtaagttggtggaagattgccagatgccgttgtatgatggatgcaagtcgaagcacagcaagttgtcatgcgtgttggaactcatgaagcttaaggctagtaatggctggtcggacaagagttttacagaactccttgagctgttaaaggatctgttgccagaggggaacaatttacctcagacgacatatgaagcgaagcaagtattatgtccgttgggcctggaggtcagaagaattcatgcatgtccgaacgactgcattttgtattacaaggaatacgctgacttggatgtctgccctatctgtggggcatcaagatacaaacgagcaaagagtgaaggtgaaggaagtaagtcaaagaggggaggcccagcaaaggtggtgtggtatctcccaattgcggagcgcatgaagagaatgtttgcgaacaaggaacaagctaagcttgtgcgctggcatgccgaagaacggaaagtcgatactatgctgaggcacccagcagattcagtacagtggaggacaatcgataggatttaccaggaattctcaaatgacccaagaaacatgcgtttcgcaatgtgtacggacggcattaatccttttggtgatttgagcagtcgtcacagtacatggccagttctgcttgttaactataaccttcctccctggttgtgtttcaaaagaaagtacattatgcttgccatgctcattcaaggaccgagacaacctggcaacgatatcgatgtgttccttgaaccgataatcgatgacttcgaaaggctatggaatgagggcacacgaacatgggacgcatatgcacaagagtatttcaacctccatgcgatgctgttttgtaccatcaacgattatccggcccttggcaacctttctggccaaactgtgaaagggaaatgggcgtgttcggagtgtatggaggaaacaagaagcaaatggttgaagcattcacacaagacggtctacatgggtcacaggagatttctcccaaggtatcacccgtataggaatatgagaaagaatttcaatggacacagagatacagccggacccccgacagagctaacagggacagaggtgcacaacttagtgatgggaataaccaacgagtttggaaaaaagaggaaagttggaaagcgaaaagagaagagcacatcgaaggaaaaaacagaggagcatgtggaaaaacaaaagacaaaagagaggagcatgtggaaaaagaagtcaatattttggagactaccatactggaaggatcttgaagttcgccactgcatagatttgatgcatgtcgagaagaatgtatgcgagagtttaatgggattactgcttaacccaggtactacaaaggatggtctcaacgcccgacgagatctggaagatatgggtgttcggtcggagctacatcccataaccacggaattcggcagggtttaccttcctccagcctgctacactctctcgaaagaagagaagattgatttgctaacatgtttgagtggtataaaggttccatctggttactcatcaagaatcagtaggcttgtttcactgcaagatcttaagttggttggaatgaagtcgcatgattgccacgttcttatcacacagctgttgcccgttgcaataaggaatattttgcctcctaaggtgcgacacacgatccagcggttgtgttccttcttccatgcaatcggccagaagatcattgaccccgagggactagatgaactacaggcagaacttgtgagaaccctatgtcatcttgagatgtactttcctccaactttctttgacataatggaacatcttccggtgcaccttgtgaggcaaacaaagtgctgtggtccagcattcatgacgcagatgtatccttgcgaaaggtacctggggatccttaagggttatgtacggaaccgttcacaccctgaggggagtatcatcgagagttacaccaccgaagaggccatcgaattttgtgtggactacatgtcagaaacatcttcaattggattaccacgatctcatcacgaagggaggcttgacggtgttggtactgtaggaagaaagactattaggttggatcggaaggtgtacgataaagctcatttcacggtactacagcatatgactgaggtggtgccgtacgttgacgaacaccttgcagttatccgacatgagaacccaggccgatcagagagttgggtcaggaataagcacatgtcttctttcaacgagtggctgaagaaccgaattgccaggttgcagaacttgtctagtgaaacacttcagtgcttgtcacagggtcctgaatggagtgccaccacctggcaaggatatgacataaatggatacacctttcacacggtaaagcaagacagcaaatgcacagtgcagaacagtgggttacgcatcgaggctactagtgacggtggtcgtcgtgatcaatactatggtaaagttgagcaaatattggagctagattacttgaagttcaaaatcccgttgtttcgttgtcgatgggtcgatcttcgcaatgtaaaagttgacaatgaaggtttcaccactgtcaacttggctaacaacgcgtacaaggatgaaccgttcgttctcgccaaacaagttgttcaagtgttctacatagttgacccgtgtaacaagaaactacatgttgttcgtgaagggaaaaggagaattgttggattggacaacattgcagacgaggatgattacaaccagcacgtccacggcataggtcaagaaatacctctagaagaggaggaagaagaagatgaagttcaatatgcacgtgtcgaccatgaggaaggattatttttgtaatttatgtacgtagtttatgtctacatgtctgttatctgtatgactctaatatgttcgcaatgaaatagtcaaataaaataattaagtaaagcacccactagaagtgaattaaaataattaagcaagtataagcattggaactaaaataattaaagtagtatagtaatgaagtgcaattacaactgttagtgaaataaaataattaagtataaaaaaatatgtagtgtatgtgaaaatatgttaaggaaaataaaagaactaagtgaaataaaattgctctaggcaaactcacctgtgacgggctctatctgtagggccgtcacaggtgacctcacctgtgacggcccagagtgttgggcccgtcacaggtggtattacctgtgacggctccacggttggcgcccgtcacaggtgagggcacctgtgacggccacatagttggcgcccgtcacaggttcatgttccgttgtgcgagtcctggtccggttcatgttccgtgcactggaagcgtggtcccgcacacagtaccagaaggacggcttgtgaggcgacgttaacggcgttaacggatgtgagaagttgccgttgcgcctcggcttttccgtcagagtcagggcatccaatgctctcgatccctctttcttcctcctctcgctgttgcttccgcggtcgtcgatgcgacgcaggcctggcggagaatccctctttcttcccctccgctgcaggctcccgtcctcccctttcgactgtggcttgcaggcccgtgccccccccaatcgattctcgtccgcgcgtcgtcttgcggcagcggtcggttcaaggtgctcaaaatcggggggaagtggaagagctccacgcctgtcgagctgtctgcgtcgtcctcgaggggagtaaaagctggccggcgtgctcgctgtgaagcagcaagcagtctggctgcctgtgtgctcgtcctctctgcctctcgggtcagacagtgctggcctgaagagtctcatcaaggcatccaagctggcggagttgaggagtctctatttcaggccgagcgtgtgcgtggtccgatggagacgacagcgaagaagcggaagcgagagcgggatctattgtcgatccaagaggaggggacgattgttcaatcccctcaaacaggggagatctctgtccgcggcgccgatctggagtccggcgaggactcctccgactctgtcacctccgacgctggcagcgccaaggctgctcccgacgacgtgcttcatatcgcgcatgccctctgcaaagtttgcgccaagtctcctagagccgtcatcgactttgttcgaagagtgagccctgccaccgtcggccgttcgattgattgggacgtcgtccgcgaggaagagtcatgtaaggtattggtttgtattaatttgttcatttccgattcaattttatttgacttgcacggagtagatgggcgatggccgtagccggtggaccgatatggaggttcgtgtgtttcttgagagctgcttggaggagatggcagcgttcaccatcacctccaactcccccaagccgcaggcatggcagaacctaatacacaagatgtacaccaagtgcaagaagaaggtgaacaaggctcaattggagtacatttgggggcagtgtaagaagcggtacaacaggtgggtgtggctagaatcgcatgcaagcgggctgggtcgtgatccccatacatcagccattgttgccgatgatgagtggtgggaaagcaagaatgcggtacgtacacttgaccataaatattttgaaccaacaattttgcctacaattggtattatctgaaatttagtacatgcatgcaattatgaatacagttttgtgaggtgtaataatttttttgttcaaattgtgtgtgccaacaaatgactagctgcagtaaaatggaaggattgtgatcacatatgtttcatagttgttactgtcatgtcgtttttagtaatgtgtgccattcccttgtatttaagttaacaaaatgatgtttaggaaagatctatatgtagtgtatatgtagtgtatcagtaaattaggaaagatcttgtacaagtcatttaggaacatgttaatacatattcaactagctgtacacaccttctttgtgatgtatatagagagaatgaacaaaaatgtgctcatctacaaagaatataatatatgcagtttatcttatgtttacaatgttcaaactatctttctttcattctgtcagatgtgtggcccattgtaacatgtactcctgattatatttgataacttggtaccaatgtgcacatttactgccagcattttagtagtaatgcacattggactgcacatattcattatgttcaatgtttgcacaagcctaatgcacttgccttgtactaacttatttttactgtctacttatgttgcagcaaaataaaggtgtcttaagcttcaggaatgatcctctgaagcacattgaccttcaccacgcggtattcagtgggcacacagttgtcagaaaccactccgccgtcgcaggggcagccccataggcaccgcaaggagcagttcagtggcagaccatcgacatggcgcagctcgctgctgcttatagaccaccacctccaactccacccccaacggcagcagaccggggcaagggaaagaggccagcagcaaacactactgcctcagggagttcttccaagaagtcacgaagcgactccgctgacttggctttggagaggattgcggacatccgagagcagagctaccagagtcgtgttgctcagatggaagcagagaagtctatgggccttgatgcgtgcatggagttggtggaaaatgatggccatgaaattggaggaagtgtgtggtatgctgcttgtgcgctattccgtgacccattcacctgcaaatgctttgttcgaatcaaggacgccgctaggcgcttggaatttatacgcactggtggtactggacagtcatctggtggcacctggtagtttgtgcactgtactttactttgagttgtgatgggcgatgtttttcaaataaaccattatttatgtttagaactcagtgtgctaacaatttttacattctgtgagtccgtaaacatttgtggctttatatccaattcgagcaactacgtattccattgcattgcttttatatccaaataattcttcgattgcatagatcactgccattattaatttctatccttttgattatgacaaacattgcatattcttcggttctcatatgttaaaggaaatcggcgatgagttacggcgcgggtggatcgagttggaatggaggcggtcacacaagcagcgaagaagaagatgccatcattgagtacatggctgctacccttgatttcaatgagagggcaccaaggagaataccggtgcaaaccggtatcagttggatgatggacacgatggcaaatcgaagccaatgcagggcaatgttcaggcttactgcagaggagatacacaatttgcatgatctattggtcacttcttttggtcttgtaggaacagcaggggtctgttccatggaaaagcttggtattttcttgtacacgatgggtggaaatcgtccaatcagagacgcgaacaatcggtgggtccgctccaactcgacagtgtcggttcacttccaccatgttttgcaggctatgaatgatctcgctgggaaaatattgaaaccggttgatcccaacttcttagattacaaccctcagattctgcaagagaatcctttcaagcctttctaccaatcagtgggagctgtcgatggcacacatattccagttctgcctaatgcagctagcgctatgcaacacaggaaccgtcaccacataacaaccagaaatgttctagtaatatgtgatcatgatgggagaattattttctgtgatgctggctggcctggatcagttcacgaccaaaggattctcaatgaggcagtgcaggcttacccctacgatttcccacgggtaccgttaggtgagttgtatcggtcaatacacttttttttattgccaaatgtcttgattttatttaattctatacatgtgcactaatatttaattatgcgccgttaaccaggcaggtacctacttgtcgactccggatttcctaccaggatgggcttccttgcaccgtacccacatgtacggtaccacagggatcaacttgcggtcgagggagccccgccacccgtaggacgggaagagactttcaaccatcgacactccacgttgcgagggatcgtggaaagacaatttggcatcgcaaaaaagatgtggaaaatattgaaagaaatcccttattaccgagatgacgacatccctgcacgcatcattcatgcagctttcgctctacacaactttaggttggatagtaaagatccgacctatcggttcactaatgctctctacaacggcaatccagtgccgctgctgaacgattcattcgaccatatgtattacgcaacaaatagcgaggccgctatgtgcatgttgcgtgactgtattgctgatgatgcgtacaataactaccattaggtaggtgatgttatccataatgcttgtcgtatgttcagtacttcaattttcaggattgtatggtttaccatttatttatgtccgaatcttcacatattatgaaaattattattaaagaaatcacatgtgtgtgcatatcaaatatttctttcacaattggtgccgcgtagcaaatatctctttcacccgcgtagcaaacacccattaattcgcatgctacagtacctccactgccagcccctgcccggcatcgcacggcacggcgacggaaagtgtcggccatagacggcgtccaggctgccgctttcaatattttccagtgtctctgacgccctgacactgctacagtggtctacagtactacatgttcccaacccaaaagtcaagctccgatccggcacttgcgaacgaaagtgaaataaaattgctctaggcaaactcacctgtgacgggctctatctgtagggccgtcacaggtgacctcacggttggcgcccgtcacaggtgaggccacctgtgacggccacatagttggcgcccgtcacaggtgagtttgactaggcttgacctagggttggacatcgatccagatccggcacccactctcactccactctcatctctcgaccgccgcctcgcccctatcgacctctccgctaccctctacgccctcctctccaccgccgcctcgacctctccaccgccgccctcgccgccgccaaatccgccgacctctctgccgctcaccctctccgtcgaccttcccgacgccggcctgcaccaccaccgccgcagtccatctccaccgccatctccaccgtcgcctcgacctctccgccgccctcctctccaccgccgcctcgacctctccgccgccatctccgccgccctctccaccctctacaccgccctctgcactgctgccgcctcactcactctctcgaccgccgccgggacctcctcttagtcgccacgccaggaccgtcatcgccgccaccgggacctccacggtgagcccacggcccccgcctcccctcgtttactattggtcgccgattaaccccctcttctcctcctcagcgccgtcgtgccaagaagccgccgccgcgccgccgtgccgagaagccgtgcgccgtgcgccggccgggactcgtcgtcaccgtgcgccgcctcctctgctcgtcgtctcctctccaagtacccctctctctctgatgccgatgaatggaatggtgcagttaatgcatgaatgaatgatgcaatggaatggatgaacgaatgatgaactttggggaatccgaggttatcaaaccatcacagaatacaaaatgcatggggaattttggtggattggtcagtgtagtccatggacggaaccgacctagacaccaaaattctccatgcattttgttttctgtcattctttgataatgaaggaactttattaggtttagggtttgaaatttatatacccttgttgatagattggccacagattacctacacttgttgatttatatacccttgttgtctatgaataggtgaattgcatgaattgttgtttatatacatgatttatatacccttgctgtctatgaataggtgaattgcatgaattgctttttatatacatgatttatataattttttttgatgccttgctgtctatgtttgcccatgctgctgcctatggttgcctgtcattttgttttctgtcattctttgatgatttatatacccttgctgctgctgcccaatgtgttccttattaaatggccagtgatgaattgctcaataagaacagattttgtgcacttgctctttttttatgcataagaacatattttctgcacttgttcatttttttatctacaataatatatgcatgatttatataccactgctgttgttgcccctgtacttcttgttaaatggccaaggatgaattgcttaataacattctatctatacctgttattttctttatggataagaacagattatctacacttgttgatttatatacccttgctgtctatgtgaatttccctctgctgttgctgtttatgtgaatctccccctgctgttgctgcccctgtggcatatatacccgtactgatgttatatggccctgctactgctcttattgctgctattatatggccatgctgttgctactgctctaatttcctgcacttgctcttttctttatggataagaacagattacctacacttgttctattttctttgggttgcttttttctcctagtagctgatttcctctttttatcccttcatgcaaatgattgtaattgatgcatatttctcagcaaaactgaggccatatctttcatagtataccccgtattacattggatctaatgctatttagtctaatggtaggaaatttataatctttttcgcgaaagttaaaccatgtcaacgcccggcgcaaacccaccctccccaacacctgcgagggtccaggaagaagcaaacccagccacagaggcagttgcagaaggtcatcccgcgacaacggcggtccaacaacacgaaattcatggtaatttataggataaattttcaccacatgaccacataaattttagctagcaccccttagcaaatattgccttctgtttgtgctgcagaattgccgcatgaacaacatacgtcgatgtcgggcgggacaagtgcaagtaggtctagtagaaatccgcggtcacataatatatggccgaccacagtgcaagttataagagaggttgacgctagtggtaggcccacggcgcccaggactgtcattggaagatggtctaactgctgcgggatagcggcacgtgagaacttcgggatcctccataaagatatcgggaaggtcacagaagccgagaaagagcgagcttggacggcaatggagaaatggttcacatttccagccgaagcaaaggataggctcaagcggaaggcattccaaaagatgggcaaagcttggaagaattggaagtcgaagctcttcaccgagtttgtcaacccgcccggcaatcatacgccgttcgatgaataccctcaaataaccgaagcggtgtgggaggaattctgctctctcaagaccacccaacagtttagggaatcaagcgaggcacatcgcgtactgcaacagcggaatgagcacccgcatcggctgggcaccgcagggtacatcggcaaggaggcaatatgggcccaagaagatgcagccgctgcagcagcgaatgtccctgccccgttttcagacatccctgaacaaagagctcgcaactgggcgcgggcaaggggtaaggtcaacccggacggctctgtcacatttgagaacaaaagtgatgccgtcgtctatcaggaactggtgagttcactacttaacctaactaatttccgttcgtataaagtacaagttcgtataaacgactatcttcttttctagttgggcttggttgctgaacaagcttcacaaagcgaggttgagtccgcgccgaagaggcgcgaagatgacatcctcacaaaggcgctcggaaccaaagaacatcctggccgaactcggggaattggtagcgatgtgccctggaagcatggactccctcagtacagatcccaatacaggaaacggaaagtctccaaggaagagagggacgctcgtttgaaggccgaacttaaggttgaggtcattcaagaactagaagctagcatggatgcaagggtggaagaaagggttaacaaggtcctcgccgacatgaatataccccgagtcacaacacctgctgtgcaaccaactcctcgtgtacaacacgacgcgagtccgtcacagcataggagtagttgtgcatccacagaggtgccggcccctggtctccctatcgcaccactagctgcagtggaccacatcgaggtaattgttgttatccgatccatatgtaataaaagacatgtacacattccaatattaaattcaaactttcaccttatgcagggcgcagcacaatgtgtcctactagcgagagtccacccaactttcgctcctgaagtcgctgagggcatggctttcaagccctctgttacagacaaggtccacggcgcagacctgctagctgggtatgccaaggtgtccatcgatacagtaaaggacacctggtccggctatccgctgcccgtgcccccaaatgatgaaatcatgactttgggcgatgcgcgcaagacgttcatacaatggcccaaagaagacatagttgtgaagatgactcctcgtccaagtcgaccgacggagcttacacctcccaagtctaagctatcatttgaggctccccgtggaccggcattgtcagtacctcattctcccggtggagctgatatggacttggcagatatagctcaaagcttggctccaataaagaccacaagaaaggccgatagctccccaccacttgtcaagggccagaagcgtgaacgcggcaaggggaaggtcggggagttggcgccggagccaaaaaggggcaaggctgcgacgtcgatgccggtgagcaaatcggggaaggtcgtgagggcgccagcccaatttgagctaggcatgccattggtggaggacaatgtgttagctgtgatgggtattgcttgccgagagctacataagcaatacatggagctaagcaatgccaagcggaaaatgagggagtcatccatagttggacatcacgaccaccagccgttcctatcgtcgcctgtatatataactctaggctttgatgacctcttcgaccttttcaggatccggaagttggacactggtcttctaaaatgctactccttgtaagtgcataccttctatacttgtgatatgactggactatatctcctaattaaattagttctaatacgtacatattttaaggttgtgttggatcgagagtcgtcgccatggtaatcaggttgggttccttgatccatccatggtgaatgaggttaatttacgacagagcttcactgaggtggttgactatgtcaaccggtgtttatgggcccatcaagacaaggagtacatcatgtgcgcacacaaccaagagtaagaggacaatacccttcgtgtatattgtttttgaagttaaggttcttagtactaacgctacataaccactgcgcaggcgacattggattctcctagtcatcgtacctaagtggagtagggttacctaccttaactccaataagtccaaagattatgatttcagtgaaatcaccaaggccttaaatatggcttggggcccatatgtggaaaagggtggtaggcacaaggagggcaagaatgaactttatcatgacaccaagtttgcatgcgcacaacagatcggagaccaatgtggtttccacgtgtgccacaacatgtcaacacttgtaagagaggtgaaagatttcgaccctgaggttgttgctaatggcgaataagctcatttcaatatctacattgctattcaaaacgtgctaattaacctcttatttattaaacagaaaggtagagctggcttgaagatctcacccatcaacccccccgctatcagaggcgaattgtgcgcctttattcttgcagaaataatgaacaagaaaggacgttttcatgccaaatagactcatgaacttggctagataatttattgtgatgtaaaaaagatgtttttataatttctggcgatgtaaaaaattatgtttttcatatgtgcaatatttatggtactttactaaattgtcatcacatttgatcaactacgatttatgttgtactattcatctgttttctccttttttttttccttattgacaggttgtgcaggtcgatgacattatggctttaatccatttggtaagtatatatgcggttctatgagcaacgaccgaaattgtggctttcaaggggtgtgaatttgctgtgcaaaattgtggcatttgaactgcatatatgtgttgttggggatctgtgatgttatattgggggggtgatgtatctgtgatggatctgtgactggaatatatctgtgatgtttctatttttcagagggcatggctagcaaatcctgaggctagccaatatttagcatttattttttttctggaattaactcatcagtgacgggtcggaacaaaaatccgtcaaaggtaacataacctgtgacggactagcaaataaaggcccgtcagaggtgacctacctgtgacgggcctttacttttggagccgtcacaggtagatcacctgtgacagcttctaactacggagacctcaacctctgacggcctttatttaaagggccgtcagagatgagtcacctgtgacgggtcctaactcgctcaaggctagcggagaccaacacctctgacggacttctagtaacttgcccgtcagaggtgggtgtcacctgtgacggccggccacccgtcaaaggtgactggactcaccagtgaccactgatcattgaccatgcgcgaagccgtcaaagatgagggtttgggcccgtcacaggtgaccttggccagtgtagtggttatagttttctgaaatttactcatttaaaataaaggaatttagagaaagaagagttgacagttaatgtgtacatgcatgcacgccttatattatgaaacatagagaaaaaatggttgtgccttactccctccatcccagtttagttgtccctgcggggtagctagagtcattgtcccagaaaggatgtcgtttaggcccggggcagctagcaggttagccactagctagcatgagtacttctattaattttcttccttatgcttgttgcagacatatcagaatggcagacgcagtattagtttagtgtcaatttttaagcattgaaatgattaacataggggcacattagtcatttttacaacaccatattttgtaatttctttgatagaacgactactgaactagaacagagagagtatattttaggatggatgagatattacttatagaaaccttagtggtggcggtgactccaatcctggcacacgccgattctcgaccgttcatcttgatatccaatgctctgaatctctcgtccatacctcgcaacccgcacctcgctgcatcgttttgcggttccctcctccaaaacccatgctccctcacccatcacacccccatcgctcttccccaaaacctaatctcctatatccactcttcgccgccgaacttcgacatgcagatcgccgttatgcgtcaccagtcccccacagccaggtcatcattgcgcctccatttatcaaaattgtgcccttcctatccccgctcgctccgcaacacctcgccaattggtgacaagaccccttgcatccttcccacgctcgctcagatccatcacataggtcatcgtcgacttgccactgttcagtctccgttgcgccgccacctgactgtccctggcgattggtcttcctcaccgtcaagcctcctcaccctcacgtcgaggcagggccacgggtgtccgggcgaacaagtgggatgagctcgatggacgaccacataactagggtaaggagagtaggttctgtcgctggcccacttagtctggttcatatatatgacctcgggtagggcaacgccgtctccttctcacaccgatgtcatctcatggtccccatctcacccaggtacctcaggtggtaatgggccagtgctcattggcccttttgcaacccacctcagcccttaaatatttttagataaaaaatctattaaatctcagcctaattctttttgcccaaccctcacattttgtatgctaaaatattaggcctattaccacctcttggtacccctccattacttcagccttcctcttctctcctcttgaatcactagttctgatataataggtgtcgaatatactagtcctatttgattataattggacttggagttgtaataggtggtagggggtgaagttagagtcggactctgaaacccgacatctctcttaaatagagaggggggcaccacaatataactatagcgaccacaatgtaacgtagacacgtaaggaggggatagcggcgaggtcatggactcgtagcggctaggagttatattggttggggatgggcgcccataatcagagcctcggggatgtaggtttcggctgaacctcgttaacaaatatcgtgtgttcatgtgtcgttatcttgtgtgtcttggatgatcaataactgaatcgatcgagaaggttagtcgtcattccgctatatcgactaacatttattacaagttcgcgattttcttctgctcatcaaacttcgagtgttagtcaacatcacaaatctccggtcaatcttcgaggtgtgccatgaatcggagattgcagacatggtcatactgtaccgcctacccctgtaatcgtttaggcgtgttaccgatgtacgttgtttttcttctaatatattaacgtgcaaggtttttgtgcgtttgcgaaaaaaaatctcctgtcaactatgattggcaaatcggaatcatggtatgtttaattttcacttgaggaggataatcagcagtaatttggtaaactggttactggaagaaggaaaatgcgcctattaattcttttgatgtacattcttattagcaacaaaaaactggatctacatattattgtacgaaatgtgcccttctcttttgcgtcaaactgaatttgtttgttctggtcagcgatcaatcggcttacaaacagaagttgataccctgtatcaaacggaatatgcacatcagtcaagagtccgtcaaagttgataaacggtacgatggtttgtgacgtttgtctgcggggataagtccattttacaccctccaactatttatgttgtctaaaatacacccaaaactttaaaaccagatatttcaccccctccaactttcaataccgttcactttacaccctcaggtagtttttcagctggttttcatctacgtggcaatgatgtggaagtctactcagcaaataaaactaaaaataaaaattagagccacacgttagtggccacttcttcccccatctcctcttccctttctttctctatccttcttcctcccagacagagagcagcggtggagctgagcaggagatcggtggccatggagcaggggactcgttgcggcgacggagctcaagcacatccccagccttcccttccgtgccgaccgccggcgagcacgagctcaaaggtctacctctcctgccggctccaggagctccataactccatcttctccatgttcgagctcgccggtggaactcgagctgcttggggatgaggaactcaagctcaacgaggcggcggcggatgtagagcttgagctcgacctcgtcctcgaccaagcggtggcggcgcgagcgcatagggatgactcctccccgcgcgtatggctccggcgaggtcggccacttctgagcgaggcagcaagctcgtgattcgcagcgtcgccgccctcacaccagctccccgccgccaccgccctcgcggctccacgccgacgccgacgccaccgccctcgcggctccacgctgccaccgcagccgccaccctcgcagctccacgcaaccgcagccgccctcgcagctctacgccgccgccgtagctgtcgatttcgcagctccgcgccgccgatgccgcagctgccgccctcgcaccagctccccgccgccactgccctcgcagctccacgccgccgccgtagccgccgcccttacagctccacgcagccgccgccgccgtagccatcgatttcgcagctccgcgccgccaccgccctcgcagctctgcgccgcctccgccgccgccgccaacggccgtgagagaagataatgaacaggggagggggagggagagagagggggagagaatatgggcttggcccatgttaatgttttgcgctgatgtggctagggctgacgtggcatccgatgtggcatccgacgtggcaaaaaccacggtaaaaatagcccggggggttaagtgtccggtattgacagttcgagggtgtattatatccggttttgtagttcgggggtgtattttagacaagcacaagagttcgagggtgtagaatggacttttccctttgtctgcgttacatttgcatttaaccaggttgaaatggtttatgctaactactagcgtaataattctgtaggaaatgaataaaaaccagatgaaacagacctgaactgaacagatacatcatacaggcatacagcagcacctacggcagcagcttggcagtgcctctttttctgtctcgccattctcggaggaacatgaacagaacacaggcgactccgatcacttggagacttacttgaaacgcaatccttttataccaattatgcaacctaaagttccaccagaatgacgtatctgaagaagtggacatgaaattcggatgaagtcgaatctacgaaaactaaaataaaggcgaaccaaaaatcaaagcataaaacgcatcatataggaggtgtttatatatagggttgtaaagtttcgacgtatcaaatcggatattatatatatagtgtcgtatggagtgttcaggcactaataaaaaaattaattatagaatctgtcaataaatagcgagacaaatttattaagcctaattaatccatcattaacaaatatttactgtagcaccacattgtcaaatcatagagcaattaggcttaaaagattcgtctcgcaaattagttgcaatctatgcaattagttatttttagcctaaatttaatacttcatgcagatgttcaaatgtttgatgtagaatggaactaaacatggccatattcataatccaaaagacaagttttgtagagcgagtagagatcactcacgctccttggtgatgcctccggaggacaccacaccatgagcacctccgcatgctccgtgcgctcgacgtcgtagtacctgacgctgcacgcgccgccgccgaggtggaccacggcgtgccggctgtacgggcacagccgccgcgcgcaccggaaggcctcggcgacgcaggcgccgcagtcgtggtactccgacgacgacgagttgcaggaggccgacgcggcgatcaggttcggccgctcgccggcgaggacgtcgacggaggaggaggaggatccgttcatcaccttggctgggagcgtggcggcgaggtaccgcaggttggcttcgtaggtgctgttggcagcgtacggccccggcaggatcccgcacatgtggaacggcggcggggtgtggccgtcgtcgacgagggcatcggcgtcggcggctgacagctgcggcgcgacgagggcgagcacgaggaggaggatggtggcgcgaggcatcgccggaggaagaggtgattgatcagctgaagggaggtggtggcggtggactggtacgtacaggatctgctccagtcttgtagcacatttatatccacgtttccatggtggattgtttgagctagttgttgacattgaccgttgactacctacgaccattgattagtccagaaagatcaacaatggattacattatgttagttgtgttgatgggatcttcttttcatcttcctgatgatgatcaacgtacgtatatatagttaacatacttactttacatattactctctcgatattttaatgtataatactgttgaatttttttatcaacgtttgaccatttatcttacttaaaaaaatttatgtaattataatttattttaaataaatcaacagcgttatacattaaaatacggagagagtataatactagcaactcatcgggtttcaactagttgttgatgggatcttcttttcatcttcctgatgatgatcaacgtgcgtatatgcagttaacatattttaccgattagtacaatactagcaactcgggtttaaagaaaagaaaaatactagcaactagttgatgggatcttcttttcatcttcctcatgatgatcaacgtgcatatatgcagttaacatattttacagattacaatacccaactcgggtttaaaaaaaaaatactagcaactaggctatacgcaggacccatcatttctgaacgaaactactcgcaccgtcccaataaaaaaagatttggtttttaatggaatggatggaatacttggttgcagttttacatattactatccggttattctaaaagacatggctacctataaaaatgtctaaagaatttttctaaaaaatctttcaaatgtaattacagtgtaacaaacattttaataactcgggtgtaactatgtaactaatatgtaactcgtctagtactataacctttcagaaacttgcgatagggagcaaggtcctgagttcgatcccctgcaagcgcacaagctaattctcactagaactcttcctactcggtttgccttcaccgttcttggattggctgggccggtagccacggcgcataggcccagctacttgaaaaggcatgataggtgcgcacattttaaccgagaatgctaattcacgcacgcgcgttgccgacgcacacttccggcccacacggcccacacacgcgcgtttcttttcttttttttttaacgcaagctaccgctatttcttttttttttcttttttcgcagttcgctgccgcacgggtaggagaaaaaatcgtaattagtttactaatgattagtttcctatttttactagtaatttttaaatcttaacttaaaattttcaaatttggacttgaaagttttcgaatctcgagttgaaagtttttaatctcgagttaaaaattttcaaatctcaagttgaaagttttcaaatctagacttgaaagttttcgaatctcgagttgaaagttttcaaatatcaagttaaaaattttaaaatctcaagttgaaagttttcaaaattttcaaatttggacttgaaagttttcgaatctcgagttgaaaattttcaaatctcaagttgaaagttttcaaaattttcaaatctagacttgaaagtttttgaatctgagttgaaagttttcaaatttcgagttgaaagttttcaaatctgagttgaaagttttaaaaatttgactctaaaatttaaatcttaagtcgaaagttatcaaatctaacttaaaaatttttcaatctgttagtaaaaaaatctcctgaaaaaaatcttcacaatcttttctaattactgtcattagcgttaactaacggagttagttacgccggaagtgtgcactagaggcgtgcacgcgccttctagctttcccccattttagcaggaccaaccaagtctcccaagtacgaaaaatgttaactgaaagtgcatctaggcccctaataattttgatgattaattacaatgtgattagagagaactaacatttttatttaagcaaatgtgagggttgttatgtcctcaatgaattagcataatgcatatcccgccaaatacgttgatgagatgtgatgtggcaaaggacaaatagtatattgtaacttttcttttcatttgagtcaataggaaagtcgcactattaagagggatgatgcattgacatatgaggagtgatcaaagtgctcaaaatctatttttaaaagtgtttctcctcagtttggtgtgttctggattttttcggagttttccaaaactcattttcggactttccgaaaacacacagaaccaaattttcgcttctggaaattttcggatatgtccaaaagtgattttcggactttccgaaaatgactgcgaaggcaaaagtggttctgtatattttcggacttgtccgaaactgatttttggattttctgaaaatcatcagtagagtcaatttcgcttctgtatattttcgaacttgtccgaaagtgattttcggacttttccgagaacatccagaacgatgttgttgttttcggacttgtccgaaaagttttcggaatgtccgaaaaatacttcgttgactttgctgtcggtgctgagctggaattttcgaacatgtccgaaaatctttcggaatatccgaaaatctcaattattgtgcataacgggcagaatttgggctgtggctataaatatccccctcccctcacttgtgagggctgctggttccatttcaatcatttgtgcccttggcttgctctctctctctagcccttttgagccttgctttcttgtttcccctctcacccgtgttcgatttggattaggtgtgtgtgtgagagttatggattcgagttttgtgagtgcttgttgttgacttcgtgaagatttgtgagcacttgcatcatctccgggagttctttgcttcatttgttactcttggaggttgaggactcctaggcggctaggtgtcgctcccgagccaccgatctacttgtggttggccgggagaagtttgtgaaggtcggatcttacctccgaaagggaagagatacccttagtggaaggaggagtgcttagtgcaaccttttgaggaaagggttagctaagacccggctcttagtgagctcctcaacggagagtagaatcccctcaaggattcgaacttcgggaacaaccttatgagcttcaactttggtgactttacttcctccctctccactagctttgcttgtttgagccgctataggtctagttgctgtatgtgctagcatattcttgttgtaggcaactagatctaggatttactttgctatttgtgctgactccgaaaaattttcggatatatccgaaaatttcggaaatatccaaaaattactgcttccgtttttaattgatttttaaattagcctattcaccccccctctaggcctaattgacactttcaacccattccacaagcaagggaaaatgtatatctgaggtctctcatcttgtcaccgaattacaaaattgtccctaaacccaaaaacaagatactccctccatccacaaaagttacacctatttcacatttaagtttttccaaataagttgtttctatttatagtctttatacattcaagacttaaatgaagagataaattaaatattttattagaacctaaggagtcatctaaatactcattggttgcatgcttgcattcactcattgattttgtaacatctaaggtgacttaatttctccttggtcttagtgtcaaaagtaatatgtgtaacttttatggatggagggagtatatggcatcccttaacttataaaaccggatcactctgagtccttagacaatattaactctggttgaccctggttttgtccgacgtggcaactgagttagtgtaggacccacgtagggcccacatgtcagtgaaaccttagcttctttataccctttcccctctccctctccatctccctctcttcccccaacatgtgatgtcagggacgattttgtaattcagtgacaagatgagagatctcagatatacttttccacaaccaaataagaaataacggcccatatgctacgagtatatgctctgatgggctgttctgggcccagattgctaggatagaactccgcctacaatagacgaccacaaagattactggaaaaagtccatttgagtccctcaaatataggtcggatctgatttatatcttttaaccgtaaaagcgggtatattgatctcttcaactatttaaattgtgtaaaatgactccctcaactattgtgaggatggtttcagctgacatgatgtccacgtataacccagtcatcaaaaaattaagaaatatgatacccacatgtaaatggctacactcatctccttcctcattcactctctcctctctccccctttctcccctcgaggcaacacctgctacacctacaggtagcgcgaggagggggtcgtcacccaggtaacagtgaagagggccataggtgtaacgctccgcttttcgtgagacgttaaaaactaattcggcaaaatcctaattgcgaaaattttcgttctttttgtgcgagtctatgtcgtgccaagatctcatttcaaatcccgttgttccctctcatcgaaatcaaaatcctccacctcaaattcctcttccgattcaagtctccaaatcaaattccgaaattcagtcgcatcctttgaatcctcgctaaacgctcgctcccaattcccaaaaatgccaaactctatcttgagccttccttgattcctccctgaaccctcgagtttgaatatcgaatttgaatccaaatccaaactccaattctctccaaatcagccttctctatgaaagtctattttacctccctctggctcggtgggccgactcttcttccccggcccatctcctttcagcccgctcccctcctcacgtgcgttgcacgtgccctgcctgagagaaagtgcctctctctcccccgatctctctctctcgttttctctcgctctctctcgcccgcgctccgcgctgcttctttgtcgttcaaacccgccaccgccttcgctctttcccgcgcgcgcgcgcgtggccgaccggccggtcgctgccgccgtcagccctgccgcgcctgcgccgcgcagccgcccggccccgctcgccttttgccgacgtcgccactgtcatcgcctggctccgatgcccccatgccgcatccttccaaaaccaggagacagagctcgtgctcctctctctcattctcacatcctccttcctcccaaaatagcaagagagcaaagctcgtttccctcctcttttcacctttttccttagccagcgtcacgcccgtgaccgcctctgccgccgattggccgctagctccgagcacgaccgccagttgtcgccttgaccgccccaaggtcggtttgaaccgacctcccgcgcgaaccgacctcgcctccactataaagccgagtccctcctctcaatccctcccgcttcagtctccaccgctgcagtgccatcgccgccttgctgccgccatcctcgccttcctccgccgtcgcgtgtgccgggaagacggcgtgcgcgcggagccaaagaggactctggtcgccctctctccctccccttccccggcccgagaccgaggtgatcccgcctgtgctgtcggacgctcttcccggcgatctcccgacgcggtagcccccgttctccctccctactcttcctctcccccctagcttgcgcatttgctagcctagaccttcccaaacgcgcgtggacgctgccccgagccccgccgccgcccggcatggcctcgccgccattgccgtccgctcccggaggccgccgctcgtcgccggctctcctcggtgctcctccgtcccatccggtgccagaaaaggattccttgaaccccggatatgctctcaccaccgtgaatcgatccctctcctctcccggcgagttttcctctttccctcaccggcggtgacctctgccgtgattcgtcgtcgtcggcccttccccttctaatccgtcccgtaggctcactcctcctcgatccgctcgtcgctccggtggtattccctcctcccgccgtgcctcgcaccgccccgccgacgcgcgccgccgtccgccgtccatctcggccggccttcgtcttcctcctctcgccatccgacgcgaccgccacgtaggcgccacgtcggctagaccaagtcaacccgccagcctcgtccccgctcgcgtgcgctcggtgcatggagagcctaacggctgcgcgtgggcccgccacccttcggtccacccggtgcaccaaactgcgcgccactcctatccgaacactagcgcgcgccgcatgcaccgctcccacggtgagccgcgccaccgacaagcgggccccactcgggaccccacaaggtggactcggcccaccggccctctctctccctcactctccccgcgccccttgggccgcctctccgggccggccggcccattagttcggccgagccgcgcctctcctctcgggccgcgcccaagccgcccgagggagtctaaatcacatccctccttcaatttctttccaaaaagggtttaataaattattaagtcctttttcctttgattagtaaatccaataaacttcgaaaatccatatattcccaaccgctcatccgattgaccccgttccacttccagtaattccgtaaaattgagatctatttaatggcactattatttagtctaaatagggtctttttcttggtcttttgtctaggttttcaattgtttgcgtatagttgtggttaccggatttccgtcaaccgcgggttttctcgaagattcgtgaagcttcgtgaagactttgagcaaggcaagtcaccctttgatcaattgctcctataattggaaagtcattattattttgtttgcaacttgcttcattagaatcactcacgtttaacttgcttggcctcggtttgcatgccaaaccgacggacctacccagtagtcgcactaattcctgtaggttgtactaccctgattccttgttgctccacccttgtggtacttcggtatccgtgctctctgagcgcgcataccaaatatcccacatacaccgttgattgtcgaaaacttgggaaatgggtttgtgaagccttgaaaacccgacatgtggtgtcggtgtgtttgaaaataaaatgaattgcgaaaactcgcgatgcgggagccgtgcctacgtggcgctgtcccgtattcgcatataaagaccgattcctgtgggaaactcatcgagcataatcaaagtgcaaccacaaggtggaatgggacaccctggctaagtaactagtcggttcagggaaacctcgcatgccaatagttgggaacgccggggcggggtcggacaaaccgggttcctggtaaggcaaggatgagaagcttgctcacttaccgatcaaggtggttggaattgatttgtgaatgcttaaaatggcctatacttacgtgaggatttgatccttctatgtggcatgaggtaaccctgggtcggcttgggaaaggctttgtcgcgagcctctgacaccggccagtgtctggagtaagttcgtgtcttgtgggtaaagcgtacccctctgcagaggttaactaactgttcgaacagccgtgcccacggtcatgggcggatgtgaggtggttcccgttgcgtagatttgattgcctgtgctttgtgaaaagttgttgtggtgtgggaatcgttaccagaatcagcctgaatggcagatggatgacctgagtggtcggaaacgaatctgtgtgattcgggatgtctgcgggcatcatagactaggcttcctgagtggaagcggattgttgtgctgctgggcagctagactctgggagtccgagaaaatgaaaaaggctctgggagctgattaatcaagtgaaatggctctgggagccgataagtaatgatctgactcggggggtcggtacattaccatttgagttgttgaaaagcatctcttaagtcgaatcgagacgcaagtctccttttcgacccaaacttaaaaagaaataaatcacttagtgatttcaaaaatgattttaaacaaaggatttgcaaaacaaccttgcctctcttccaagcttgcattaaacacctaagttcccgtgacttgctgagtacgaaagtactcacccttgctctatataaatatatatagttcctccgtcctgaagctgaagatgaagtgaattgaagaatagggtttcgtcctggttcctagccgtcgcctgtggtgttgggtgttagaccattggttccgctgctgctgctgttgctggtgtttcctcgtctgtgtcttcggttgtattctcaggctgtcctgagctgcaacctaagttaaggtaaataagtcctctatttattttaaggatttgcaatgattcatatttgtcaccgtgggtaccagcactatgtcctggtactggtactgagatcgcggtttcgtaggaagcggttcgcgccgttattcctacgacacgctcctgtcaggcggcattgtacggcggtgccggattggggtgtgacaataggggtggcaccttggttgatggcgtcctccatgccctgtagcatttggtgaggtcaacatagtgattgtggccatgcaaggtgagggaggcgttgtgacaggaagttgaatgaatggcaggacccatggtcggtgtagtccttcgcttgggacgcaacagtgtggactacctctctctatccatattctttttccaagccgccttccatatctgcttgatcatgagggggatcaagtgaggccaatgacaacattgtgacaaggagtagacaccggcgtacgtggagaattttgtgttggatctgctctaggaggctagttgggtatcagagctccttcaactgatgtcaagccctaaactgtcatagacctctagtctcctgcgccaaactattccatctcgagctcattcctccgctgctacgtcatcggcatggcagagtctacttgttcgacggcgtcgtcatactcgcgctcttgcctgagcaacatgccatcgaagcggaggtaggcgaaaggggatccccgccctttgccctccaccacgcagggcgacggtgagatcgggtagcggcatgggaaagcctcgcctatttgcgtcagacgccgacgagcttgagtgggtggggagagatagagaggaagatgatgcgttggcatatgaaccccacatgctgagtcagccagttgaccagggtcaatgagccaccttagccaaaatcgctctcaaactaccctgggagttaaattattctggtttaaggctgcgttctttacctccggttcccaactttcctccctcattttccgcacgcatggttttcaaactactaaacggtgcgttttttgcaaaaaaaaattctatacgaaagttgcttcaaaaaatcatattaatccattttttttaaaaaagcaaatagttaattaatcacgtgctaatcgctcatccgttttctgtgccagggagtgagggttcgaacacagtctaagcaattgaaggagtcgttatacctggttttacggttgaggaataaagatcagatccaacctacagttgagggagtcatattggactttttctataataaacaataacaaggtgacatcgcaagtgatgcctacagccctacattgatttctgtatctgcatatttatcagtccgcactctccagtctccaacattatacggagtatcagtatatcgccttttccatttgataaatcggaggaacaaggaaacagtccctatcaatttctgaatgtacaatcttgtatggaaatatatgggcccttttcttttgccgcaaatggatttgcttgttcaggatcagccgatcggtcgaattacaaacagaagttgaaaccctgtatcaaatggaatatggatatcagtcaagaatccgaccaagatctcaaagaactctggttaacttgtctacattatatttgcatttcaaccaagttgaaacattctatgatattataacgaacttttcgaattcttgttgggaataaacaaaaccagatgaaacatacctgaactgaacctcccacctatggcagccgattggcctgggctcttctccttctaccgtctcgccattcctggaggaacatgaacagaacccaggcgactccgatcacttggaacaccaccatcatagggaaatcatgggtcaaaacaattctccaccaagatgaagtatctggaaaagaaaacgactaaaatgttgattcggatgaagcaaagtctatctgaaattctggaatcagtactgaattaaggcgaacaaaatcacagtataattatatctatcgagctagcagtagcagatcactcacgctcgtcgaagatgcgaacggctaatgaagcttgtatctccagctccacgcgtccgacgtcgtggtagctgacgcggcaggcgccgaggtcgaccatggcgcgcctgctatacccgcacagccgccgcgcgtaccggagcgccttggcgacgcaggctgtggatattatgggtaccccatacccacagggcatggttatccgactagttataggggataacttatatctatgtaatatgtaacagatcatgacttgggtgttacgtttccttgtatattacggaacggcctaaagtcctgatttaggaaaccgataccgtattggttaaggtttctatcttgtaatcctgccccccatcctatataaggtgggcaggaggccctctagggggcagatatgacataacctgatcgtcagatcaatacacacccggcggattcaaacccccaaacaggagtagggtattacctctcattgagagggcctgaacctgtctaaatcctttgtctccgcatccatccacttttaggtctcgtgcgctaccccttttattattgccgaaatcatgtttcgacagttggcgcgccaggtaggggttgcgtcgagtttcctatcaacaagcgcgatggaatcaatttcatgagtcgccgacttcgttttcgctttgggagttttcacttcctttccgtcgaccacttcttcaagctcctcttctctgacttgatccaaatcagtcagggggaaactcaatctgatttttatcattatttatcgtactgatttttaatcccagattaatctcttgctattttttgttgttgttcgcatataattacgcggcactattgaggcgattgatgctggtcatagactcgaggcgtctcagctttccggtcgatcggccgcgagtccactctgccggcttgtcttcgccaccgccattgctgataacaacaacgacttcaccgccggcctgcctccgtcgccgccgattggtgcctccgcctacacggctggcctattatgccgccgctgttgggcgtctacgacttcaccgccggcctgcctccgtcgccgccgattggtgcctccgcctacacggctggcctattatgccgccgctgttgggcgtctacgacttcaccgccggcttgcctccgtcgccgccgattggtgcctccgcctacacggctggcctattatgccgccgctgttgggcgtctacgacttcaccgccggcctacctccgtcgccgccgagtggtgcctccgcctacacggctagcctattatgctgctgctgttgggcgtctacgctttcaccgccggcctgcctccgtcgccgccgactggtgtcctcgcctatacggttggttggtcacaccaccgttcatgggcgtccatgcctccgcctacacggctggcctattatgccgccgctgttgggcgtctacgacttcaccgccggcttgcctccgtcgccgccgattggtgcctccgcctacacggctggcctattatgccgccgctgttgggcgtctacgacttcaccgccggcctgcctccgtcgccgccgattggtgcctccgcctacacggctggcctattatgccgccgctgttgggcgtctacgacttcaccgccggcttgcctccgtcgccgccgattggtgcctccgcctacacggctggcctattatgccgccgctgttgggcgtctacgacttcaccgccggcctgcctccgtcgccgccgactggtgcctccgcctacacggctggcctattatgccgccgctgttgggcgtctacgacttcaccaccggcctgcctccgtcgccgccgactggtgtccccgcctatacggtcggttggtcacaccaccgttgatgggcatcgtcatcttcaccgccggcctgcctccatcgccgccgactggtgcctccgcctacacggctggcctattatgccgccgctgttgggcgtcttcgctttcaccgtcgaccgccttcgtcgccgccgactggtgtcttcattgttattgatggacgactttgttcccacattggccacttctgccatcaccaaggggaatattacaaagctaagtcatcatttattttattctttatatgatatttttccttttcctctgcctcactacaccaattggtcttccattgagtagtgagtcgggggctacagatgttatatcatattttttataatatttatcttgattgcttgcgacataatctgagtacaaaagtacctatcgagttatggagttctatcttcctatgctttccgtttggtttgccaatggatggttgcctttgggccgattcctagcacccgggggctcgttggatggaccgagtaacgcaaggtgctaagtattattcggaataaatcaaaagcatagagatgagataaatttattttctgctcttaataattgcaaaagtacccgagtagtaaactccgatccgtgaaactttgttccattaatgacgaactcatgtcactcatatgcatgtttgggaagtgcttaggccgactcccagtgcttggtggctatgactagttgggcagagcgtttaaacgtaatgagtcatctgctcggggaaatcaaaattgacaagaggagaaatacatatttataaatattttaaaatacttgattttttctcgagtattatatttatatcagatactactcatcctatatgtttgttctgcaggatccagatccagatatgcataaaagggattcatggctttaagcttatctcttacgctctaggaatggatcagtcagaacatcaccaccggccgcctcgtccgccgccgactggtgttttcgcctgcacggttggcctattatgccgccgttgttgggcgtctacgtcttcaccgaccggcttgccttcgccgccgccgactggtgtttccgcctgcacggctggcctattatgccaccgttgttgggcgtctacgtcttcaccgaccggccgcctcgtccgccgccgactggtgtcaccgcctgcacggctggcttattatgccgccgttgttgaccgtctacgtcttcaccgaccggccgcctcgaccgccgccgactggtgtttccgcctgcacggctggcctattatgccgccgttgttgggcgtctacatcttcaccgaccggcttgccttcgccgccgccgactggtgtttccgcctgcacggctggcctattatgccaccgttgatgggcgtctacgtcttcaccgaccggcctgcctccatcgccgccgactggtgtttccgtctgcacggctggcctattatgccgtcgttgttgggcgtctacgactccaccgaccggcctgcctccatcgccgccgactggtgtttccgtctgcacggctggcctattatgccgtcgttgttgggcgtctacgactccaccaccggcctgcctccatcgccgccgactggtgtttccgtctgcacggctggcctattatgccgtcgttgttgggcgtctacgactccaccaccggcctgcctccatcgccgccgactggtgtttccgtctgcacggctggcctattatgccgccgttgttgggcatctacatcttaatcgccggtcgtctcgtctgttgctgattagtgcccttacctctacgtctggtttatacagctaccactactgatggacatcatcatcttccgtcgccgactgattatgccgccgccgacttgtgcttttatcttcacaactgcgcgtcttcactaccggtttgcttctgttgccgccgacttgtgttcacttcattacggcaatacaactttgtcatcatggtggagcgacttcatctttattatcttcggcaccggcaaactctattgttgctacttcgcaagttttactacttcaccaaccacgacgtctttgtgaacctcgacatctcggcatgcaatgccatgttattttactacaacaagtggctctccaatattcaggatttctacttggacatcttcaacacatatcttcaatcaagcaatgactattcgacgacaagaagctacagttctcgactctatgttcagttgtttcccaactaatcaaagagtcaggggctacacaaatataaggctcaaaatttgacaaattttatgtcaagctgaagaaatcaattcatcaaccaacgagtcaactccaggagtcattatcttcatctttgcttcggagcagacattctacttcaacaacttcaaatatttcggtttggacgagttggacaacaacaccaactctcctccaagtgaagcatctacaacagctataacattaatttgatggattattgtcactgacatcatcaccagcacctctgcttcatcggccctgacatctccgctgttgctaatggatgattatgttttcgccgacttattatttcaccttcatggttgacctactatgcaaatgctgatgagcgtctttgtcattatcattggttgctacactgctattggctggatcaccaacatcgtcatcttcatcaacatactgtcaagcctcttcaacattgcccactctactactgtttgatgagcaatttcgtcatcatagtcgatcatctctgttgctactgacggttgcctttgtcgtcgtcgactattttcttcattttcatgattggtggatttcgttattgcctttgatacgtgtctacatcttcaccgtcggcttgctttcgtcaccaccgactggtatcctcgccttcacggatggcttattatgtcgccactaatgggcatcttcatcttcttcaccggctgcctcatctgtcaccgactgattatttcgccaccatggccgctcaattttgtcgatgttgctggatgccttcatcttcactgttggctgacttgtctgctgccgattggtttcttcgcctccacggctgtgcaacttcattatctttgattggtgtcactgttttttactaccaatgacatcttccgttacttttgatgagcaatttcgtcttcatgttggtcatttcatctccatgccgactgcgtcagctattgccaataaacaattttgactatgacagaaggacaagctatatgctcaggggctcatcaactcaagcgtgaggattatatctccaatttggacttgttccggatacattccacatggattcatagtcatgagtctattttctatgctcaaagactggaccaattattattccccgtaagggctatcaaccgaatacttgcgccagtcgggattcaattattatatttattttggagtatcccataagggataatcatttagatcagaagctattcatatgagctacgcttgatctatattacccggaagatttattactcgggagcatgttatatgcgtcatcctttaaagggtgtcgaaggcatatgttttggcctaggcctaatatgtctgcagcccatattttcaggtgtggcctgtcacgttcttttagggacttaggcacttttcgcttaggccaaagtgcgcgtgatcaagtgcccaataccttaaaatccttttataccgcagttactcgactttttaggagttggtacgatgcatcttaaaatgtgtcaaacagtaaagctttacatagctgccccgctgacttttttatatagtcaaggtgctgtttgggtttatcaagcaattgattggatataatatcattgctttttgccacgtaagtgtgcatttttattgaccaatattatggcttaggctgattatatattatggtcatttttctaggcggttggtaaatcctttatgagtttatttactcggattttacaccacatatgccatatatttccaggtgtggtgaaaccatgtgtcttctagggacttaagcacatctgttaaagcagtgtgcgcatggcgtatgcccaatactttggaaatttctttattcacaatatacgagcttttttatagctattttggtatatcactcggatcatgttatttggaggattcacaccgcatatactatatattgatatcaagtcacttggttgattacgattatcaaaaccacttggttggttggattatttattccttgactatatgcttggtttgttcaattaaccacattgtcggggggctacacctattaggtgcatctattcgatgcacctgactttatttttcagccctccacagtcttcagatttggtaaaagtactcgggagaccatgacaaagatgattgaagcactcggctttggagtaatctggttcgagagaagattatcttttcgactgcgaaggtctcaggggctactgtggatattatgggtaccccatacccacagggcatggttatccgactagttataggggataacttatatctatgtaatatgtaacagatcatgacttgggtgttacgtttccttgtatattacggaacggcctaaagtcctgatttaggaaaccgataccgtattggttaaggtttctatcttgtaatcctgccccccatcctatataaggtgggcaggaggccctctagggggcagatatgacataacctgatcgtcagatcaatacacacccggcggattcaaacccccaaacaggagtagggtattacctctcattgagagggcctgaacctgtctaaatcctttgtctccgcatccatccacttttaggtctcgtgcgctacccccttttattattgccgaaatcatgtttcgacacaggcgccgcagtcggagtactccggcgccgccgacgagttggcgccgcagaaggccgacgtggagatctggtcgggccgctcgccgacgaggacatcgacgccggaggaggaggaggaggatccgttcgccaccatggctggcagcgtggcggcgacacgccgcaggttggcctcgtacgagctgttgggagcgaaccgaccctgcaccatcccgcacatgtggaacggcgggcggtggccgccgccgccgtcgtcgaggacggcggcggcggcaagcggcggcgcgaccagggcgaggacgaggaggaggatcgcggcgagagtcatcgccggagaagagataattcagccggagtagtagtacaggctgctccagttcagtaggtatacatagataagcggggttagtgttgactttgaccgttgactacaaacctccattgtccattgactagtcagcagctgccaactaaagagctttcacaatgcattatattagttattaactcgatcacttttgatctttgcaatgatgaacatgtgcatatatactccacatatactattcctatagacaaagattcgtaacctttgggttgcacatgctattgctagatattaatattttagtagtattttaaacgtgttgtttactttcaaggctgttcatattaaaataagagttcacatcagttacaacttaccctctctattttaaaatatagtgtttttgaattttcatatagtcatcaagatcctagtttgacagataatatttataaaataagttattttaaatagaatcaccattctatttctagttgcatgatttatttcatttggactctacacacatgatctacgttcacgacaataggatctaacaaattaatggttagatctttctaataaaagtagtagcttcttagaagtaactaatctaattagtatatgtctgtatagatagatagatggatggatggacacatatatcttaactcttgaaaagagaatcccaaaacataagaagaatgagccatatcatctaataaataataaccgttagatcaacaagcaaacaaaacaagagaataaatttcagccattggataaaagagggtgttatagagctttccatgtctccatatgtgggagagggatatagagcaacgaagagacgcataagaaataaagaaaaaatgtttgtatggttgagagaaatgataaaaacatatatttctatcttaaaacaaacatatattttatatattttcacaacaaattcttcagtgacataatatcagtaatagattattcttaaacactaatcagaaaagatagtgatagtcacacgcatgcgcgacttcatgcactagaatgcaataaaagatgaaattagagatatcaatataatgaaataacatacatgcatggatgccttaatgcatgcgaccacgatcaggggtatgttgtgacttcggccctgtttagatccttcaaaatgacaaaagttttgccattttgaagcactttttgtcattttggacctaaacactagtagtaaaacttagcaatttggcatttagcatttgctagtccatagtagcaaattgtgccaaaaagtgctttaggactactccctctctctttctctctctctcactttagtactagaatggcaaaagtttaggatgcatctaaacaccaactagtacttttgcaataccaaaacttttgccatttaccatttgccattccaaatggatctaaataggcccttcattgtctgatctctaatttatatatctccacctgacaaacatgggaaaagatgtgccctgtttagatcctccaaaatggcaaaagttttgccattttgtagcactttttgtcattttggatctaaacactagtagcaaaagttggcaatttggcatttagcatttgctagtccatagtagcaaattgtgccaaaaagtgctttgggaccactccctctctctttctctctctcactttagtgctagaatggcaaaactttagcatgcatctaaacaccaactagtacttttgcaatgacaaaacttttgccaccaaaacttttaccatttgccatttaccattccaaatggatctaaacaggcccttaaacattcttcttagaaggaaaaagtggctacatctcccatggaaaataaaatatacatcaataagaatgtgccctttctttgtgagcgatcagtcgacttagaaacacacaagtgtaacgccctgtatcatatcaattggaatacgcatatcagtcaacaagcgtctaaccaagttgataaaacagtacggagtagtgatctctggttgttataaaggagagacctgattcgtctacgttacatgcaggtctataagatgtaaacaactcgacatattgtacactatttgtagtgaaattggtagcaaatttgttgggaataaaccaaattaattaccagatgaaacatacatacctgaactgaacttacatatactgatccacatctccaccacctatggcagcagagagcagactggcagggcctctcctgcgatcgggacgccaccggtcgcaggatcgagacggaggcggcgatcttgttgggtctctcgccggacgccggcgaggtggccgaggaggaagaggatccgttcaccttggctgggagaaggagcgtcgcggcaattgatgagggaaaaggaggcgatgtgtgccacctccaaatgatgacccatacgagttagcttgggtgatcggccatgttcggcccagaaggcttacgcaagggcgcaagccgatggcggcagatgactatggcctatgggccatgtggccagcgaattctcttggcccgaggcaacacaatttgttagctgatcgagagcaggtataatagcaggctataagccagctataaatatattttaaaaagataaaggaagagagagaagaacagcggactacagatctgtagccagctgcagcacggattataagacgtaatgtgtgtatgacaagtaggaccagatattaatagtatagtaagcaactatgtactgtaagaattagctattacattggctatagatgatttggagttagtagtgggctatattatcaaacttgctatgagacttcggtgatcgatctttgatctaaaaagccgagactacggaagtacggaactgttgggatgcagaattgtcaataggcaagtacaagatccacccactgtccgcattggagaagaaatgtgagggggcagcagcagcagggcgagacaaaagaaccaaggagagttagggtttagaccactttgagcaattttattgtaccaaaataatttcatgtaaattttggagcttttaataaataaggtaccgagatacactaaataaattttagatatagaaaatatgataactataggtacccttgtaaggactacgaaaccactcttatagtttatataccgcaaataacaaatctagattgccaggttgagatttaattgttgaaattcataccatctttcaaatggttgtttaggacatattttgtggaaaggacttatctgttgagatgatgtctataaacggatcgtaccgaagtgacaaatagacttagctagactcatatttttcactaaatagaattgtgtcgtgagcatgttcacattgtgggcacgagcacagttctttgaggtggctatgattaccatccaacactttaaagaagctgaagaaaataaacgcattttagccaacttagtaaagtaggaagagcaaaactttttaaaaatgtaacgagtggtctttaaatatattagaaagcattagtatggattaaaatataaagaaatttgtagtcctaattttctgggaccatgttatgttatcatatatttattggtaaccatgccaaaaaaattattattattattattactgctgctgctgcagatgagaggtggtggtgggatgaccttgtgtattattttgaaagggaaacacacattgtcccatttttacaaaggggaaaatccgtcgatttccatcagtctgtactgtactgcattattttctgctgacgacaactaccaagctcacacgtgctccccccgcgaataaatcgtcaaccatcatcaagtttcgcttcgcattaacacggcttgaattaatagtcggccgcacgccacacctaacatgggggtgttcgtggcaaaaggaaaccaaccatgcaatcgacaccccaaaccccaatttgcatccaaccatccttgtactttcttttcatccatcaacaaacactgtacgtaccagctttagtcgtacactcttcacacaaaagttgtacaaaagaaaaaaaaaaaacaccctctttgttggctcagccgctcaggtactcatccccatatacgagttgtctctgtacaacgacgtaacatccatacggtgatgcaaccatgccaaccaccactgttgcgccctgcctatcttcgacttcgatcgaccacaagtggagtacactcactcacagatgtctcacgaaaaggacgcgttggccacatgtgaaggccagccagcgaacgcgtaaacgtaatgatcgaaatgccggtgagatcgatcgaccgctattatctcccttcctcgatggtggtgatggtgacgtcgttggtgctgcacgagtcggtgaagcgccaccgcgacggccggaagccgccgccggccggcgacccgcggccgccgtcgtcgtagtcgtcgccggagaccctcagctggtagtgcggcggcggcagcgggtccggcagggggacgccgtcgctgccgagcatcgccgccacgtccgtcatcgtcggccggtccgtcgcgttgtcctgcacgcacagcaacgccaccttcacgcaccggattatggccgccgcctcgctgccgctgcactcgcccagcgtcgggtcgatcagctcgcaccctctctcttctctccacagctgccacgcctgacaaaaaataataatatattttttaaaaaaactctatgtttgaaatatataaatcttttatattctaatagatagtagtatttatttatagtacatcttttaattattagtattggaattcataaattaatagctcagattatattatagaagaatcagctgatgataatatatataatcggaatataattgtaacagtagagagcacgataaagttattgaaaaagatgccaagttgatcaaccaatttattaatcctcgttagtgatgactaatcatgttgctagctagcgtaagtcaaacgtagctacagtgtagacgtgaaaacgtttcgacataattgataattgtacaggataagccgcgtgcccatttattaatccacggacgacaagtacggttttgattaagaacacacacacaaaaaggtcgtactagaatagtaacacgccattatttcagcgagagagaaaaagaaattaagatagaaaaaacaacgtaaaaacgtacgtatccgaggaggttgacgaattcgccgtagtgctggtggccgctgttcctcttgccgctgacgatctccagcagcagcacgccgaagctgaacacgtcggacttgaccgagaaaatgccctccgatgcgtactcaggagccatgtatccactgcacacgtgaacaccaaaacaacaatcaataccactagctagtaagtacagtactgcaggtacctgatcttatcctccaaaaataaaggtacaaacacctgaaggaaaacatcacggctattaatcaatttgcccagccagttgacatgctaaaacttaataccagattaccagtactctctccgttttaatttacttgttactttagtttatttaaagtcattttaagtgtttatatagtttaattagtaacatgtcaattatatattataaaaattacatctcatggtgaataaaaacataaatattatgatgctaaactttataatgttttagtaattgatggttaaatttacgaatgtttgaacttaaaaaaaattaaaatgctaagtaatttaaaataggagtgtaattaaaatgataagtattgctacgatatatatcattattctttttcttactaggtgccgacgactctgttggtgttggcttcagtcatgttggagccgaagatcctggccatgccgaagtcggagatcttaggattgaggtccttgtcgaggagtatgttgctggccttgagatcgcggtggatgatgcgtacacgtgagtgcttgtgaaggtagaggagcccctgcacgacgccctcgattatgtgcagccgtttcttccagtccagcaatggcccttgctcctggtctacatgcgtgaaaacattatcgaagattagtaaaacgttgacggtaacaaagtcgttcagaagtaatccatttcacttttttttacttgtttaattaggaaaccatttggatatggaaaccatttggatatggaaaccatttggcaatatacattttctttcctaaaccgtacttgaaaaagatagaaaggattaggaaaatcggaagatgagtaaaacgtcgacggtaacatagtcttttgaaattttggcacgttgattttttttaacagcagtttgacacgctgtttgatcaagtggactacaaacaaaagtaattgtcttttccctttttacctgttatatattcagggcatttgcttttgtgttattgtttttaattaatcgcatagttatgaaaatgataaaaagtttttaatctataaaaaaactcaatttcatatctcaaatattagtattcgacgaacatatgaaaattacactaatttagtcctaagcttgagaaaattttagctccgcccctgtctactccatccgttccgaaatataagcatttatagatatgaatctacacaactgtatgtctaaattgtaaattgttaagtataattttggacgaagattgtattgaacaaaaagagagaataataccgaagatgaagaagtccaggcttctgttgggcatgtactcgtagaccagcatcttctcctcctcctgaacacagcagccaacgagcctgacgaggttggtgtgctgcagcttggcaatgagctggatctcgttcttgaattccttcagcccctgcccggactgcgctgccagcctcttcaccgcaatctcggctccatcagacaactcaccctgaaaacacgaacagacaaagcaaataataatcatgcatgttagcatcaccaagtcatccgcattttcgtcaacattgactgctaaacaatagggacagcaactatgatgccgcagattattagcatatatagcgacaaccattcacacattttggtcaaaaatcgactgtaaaaacaaaaattataggagtttcagataacttgccctgtagacaggtccaaatccgcctgtgccgagcctgtgatcttcagagaagttgtccgtggcagcggcaagatcgccgaagtcgtagagcgtgaaatcggtgctgctctcctcggtcctccacagcttcagtgcctcctctgtcttggagctgttcctggaatgtgcttccagctgccgattcgacttcctccctgtgatcaatgatggattggacatttgtggtttggttgattaattaagaactttgtgatgctgaaatggagggagaaaatgatgttcattatgagagggagttagtggcatcgtgttgttaccgtctcctttccgtagtttttttatcagtaggaggcagccgaccagcatgaaacagaagaccgtgattgacacggatagaacgataactaaggtcttcctgtggttggttcctgcataaataaagaagaaaattagtagtgatcatacagagattgtttcaatgttatttgtagaaaagataatgcactgacagaaaacaccaccattaagtggttacgtatttgaccattgtgagctcacaaccaaacatgacagtaatagtaataataatatgatttgtctttgccaattcaaacaaatttatggggcgttcagatcgtagtcaaaataaattttaccaaaatttgatatttttggcaagttgacaatattactaaaattttagcaggattttttatatatttaccaatgtttggcaacaactaaatataggcattttttaagtaactttaccgaaaaaaatattatgattgaaaatgatataatctgaacagcccctatgtaacaaatctatctgtttacaccttatactaattaagcactatgagatctctcatgttaaaatgaaagatctggttgttgattaggtggattatattatcatgccatagattgtattcagaatttgagttaaataaaaagatgacattaaaattaataccatgcatataagctggacaatcatgaaatctcttattaatagtatataaacgtaacccccaaattcaaaattaataattactactagcaagttttaattgatatggacccttccttcaatctaagctccaataattccaaaaaaaaaacacaatcaatatggtcaaaagtttaacatttataacaacgtacaacaatagtagttaagctccaactatagcttttgagcaaatttattcggaggagaagaaatgatcgtgtgtgtagcatatgtgttggttgttaccattgtttgcggttggtgagggtgcgacgtcttgcaggccgatcctgacgtccggcgtgccggcgtagaactggtagctctcgtaccggaagttgcaccggacgccgaggatccggccgccctgccggccgtcgtaccactgccggttctgctcctggagcccctggaagcagtgccagcactgcgccggcgacaggtccggcgtgcactgcgccagcccgtacaccgtcggcagctgcgggttcacatacatcacggcgctcgcgtaccgccgcgccgacgagttgtacgacccgtacatggccatctccccgaacagcgtccccaccagcgacaggaagaagctccgcgtcgtcgcgttccgcccgtcccacccgtagtaggtggacgcgttcgcgtccagcgcgttgatcaccggcgagttgtcgtccggccgcgacaggaagtcgtcgccggagtagcgcaccacgcacaggtcgtggtagtacgtcgcgtcgcggtcccggccgcagagcgcgcggaggcgctggaacgcgccggagacgcaccccgcgcacgcggcggcgtccctcatgtcgccgcggcacagcgccaggccgaacaccctgtcctccggcgccgcggcggcgcccacggccgccgacgcgaacagcgaccgcgacgacgacgcgttggcggggagctccgccgcgaggagctccaggttgagcccgaacgcgctcccctccgtgaagttgccccgggtgccattgcacgagtactccgtgtaggcggcggcggcggcgagcggcggcgagaggaagaagaagaacaagacgacgagaagggacatggcgtgtcctcttcttttctgattgcttgtgaacagaagaagaagaagaagaagaagagattgtttgattagtgcgtgtttctttctcagctttctccgtagttatgggctctctcgatctctcgcttaagtactttgggcgatcacacaagtcaaagggcttgaaattaagaaggtggttggcaaatggaattgtagccgtgatttgttttgttgtattagtcaaatcatcaggctgctgcgctgttgctggaaaatgttttttttgttctttctttctgaagcctaattgttgtgctaaatattgactcatagattggcagcaatggaagattctatgttactgcagaactaggtagtactacatgatatacatctgtaccacatggtgtgcactgaatactaacagtatttactatgaccatgtcgtcgaatgttcctggacgcaattaagttttctgttgttcctagcatgacgttacatgcgtcctggttatctgcaaacagttagagctggcatcagccatcatcaagtgctcaacgccgccggtgtcctccttcgatgagcctcagcctcatctgcagatcatcgtgacgagtattgcagataaacatcacggtgtgcaagtgcaaatgcaatgaattgcaggttttgcaactgcatttttgtcgttggaacgatagaaatttgaaggaggagcaaccagccaaccatctgaacccctaagtgtgaatgccggcgagcactgcgaactgggaaggatgcagatgatggtgtcgcattattaggttaattgtccgatgacgtgttctattggccccaccacaccacactagctgatctttgaccttaccatgacatgtataatgtgttgaaacttgaaaggcttcaaaacatcgctgttgctgggagttttattttcaaaagagaacatcgttatcttattttctactgcaagggatcaaagtcataatagtttggacattgacagcaaacgggaagtttggagaaaatatcatactaaattcaattacagagaacaatttatttgcgactactctacaacacagaaatagtttgggaaaacggtgacaactgaaaactaatgctagatttgcatagctttctttgcaggggatgcccaaatatggtttaatacgccctttcatgtggccaaaagaaaatatccaattatccattgctctttctcgcagcgggtctgaaaggaagtggagaatcggatgtaactaccaggtctcaactctcaacaccacaataattattgggaggcttggtcactttgacagtaatttagaacagagataattgaagagaattagaacaaaatttatgccattgttgatttaaacatgttgtaacttagaggaattcaaagtggaagtaatttagaatggagacaattgaagtgattgatacttgttggaacttaagaagaacataatactagtttttatcatggtttgcagcaggtaattgggaaatttcagaagggtgatcataaaaggaagacagtgcagaatagtttaactattttatcactttttggttacccatctttgttatctttcatttctagaatgttctgcagtttcttgttggtgcaccattgtacgtgctcttgtttgcactctcttcttctccagcaagtaagggcaggggaagcaatgcccaaattaatgagcattatagatgaccaaacaaaaacgagtggaaatgatccaggagacaataagctgcatgggcacattgccgcaacacagacaagtagttcagaaagaacaaaaggggaaaagaaggcagaaataaaagaagtacatatgatccaacttccaaagcatttgtcactgttccataagctgactgctggtacaatcaaaaggtatgtcttgttaacacaggacataaattttaactagcatagggcatagggtaaacaccagtgaaaaacaagacataaccttcagaacaggacataccttccgaaaggccaagttacgtgccatctatgatttcacaacattcttcaaaacaacacaaatgagccatcacacaagtacgataaaacagaaattcataattcatattagagattggctgctgaccctaagcctgattctcattacggtacaaagatggttttgcaataacataagtggagccgcacctctgcatgttagcaccacccatcaggtaatgactcagagaacattggaacatatggtaggtatggcaggcatgactcatgtccgagtttgcgtatgacacggacttccttgcgatccatttcatacgccatcaaagtattgtgccatccataaacaaagaagatcaaattgcattctggatgaactgcaattacttggtagtcaaaatctaattggtatttctttcgtccaaacagattaattgagctaacggtgtgctttaagatccaattatctgtatcatagtcttcaagaaaccaaattgacagttcgaggatatcatttggatcaacattaaaagcacacaagcgaccctgagtttgatgaattatcccaatatcaccatcaggatccggcatgggaatcttcctccatttcttcccctccatgtcaacagccacaatatcgcaagtcgtgacagaatgcagaaaaccattaaggaaaacccttgtccgatcgaccggaaggctaaccataacttcatcatcccatccatttacatggagactccataacccagttttagacgaatagatcaccacccctgtgaccagtgcgtcgtattcatcttcatcctccacatactcttcatcctccacatactcgagcacatggaaatgcgacgagatggctggatcgaaacacaagcaggcggtgcggttctcgtcaatagcccagttggcgtccggcaacatcacacattccccggtcgcaggattgcacacagcatactggaactgcaaagtctcacgagacacgtggcagcggcagaggaggaggccattgcagctatccaagatgacgacgtggtggcactggggcaggaaggagaaggtcgggcagacgagaggcatgcctctcccagtggcgttggtgaaatggcgcgccatgtgcgggcagcgctcgtagtcgatgctcttgtagaagaagcccgatagcgtctgcggcagcttcttgcggtgctcgtggtcggcgatgagtttgcgccatgacttgctgacgcacttgaagcggcacacggagcggacggggaggcggcggaggatctcgacgatgagctcgtcggtgatgctggccgcctgctggggaggttctcctccatcgggggtggggtggaggagaggaagtcgtcagcctgcaaccgcgggaaaaggattcaccgcggcaagagcagatcaagcaggtgagcagatggggattaaatcaaacaagacatcaaaatggtgaagaaagaaaaatctggctacaaatcgacatcatgggttcgttaatccacctactaaacgaactaatctgagatcaggaacctaccgatcaaggcagggaagagcgatgctgccgcgcgcgtgacttgccgctcggcctcggctgacctgtgtggagctcgtcggacgggacacctggacggcaaacctagcgccctcgccggttaaggccaaccattgcgcccgctaccctgctgcgatgtgcgcccgtcacggagaagaagagctagaagcggcggcggcggcgacggcgccgagacccctagatgccccaaaatccccaattcaatgtctgctgggacattggttccaaattctagtcaccctacgccattaagaaagttggagattacgtgtgttccaaaaaaaaacttttgagttacctggcatgagacaaactttcttttgcctatgcgccactttggatggaatcagcactaacggagacaaacggaggtttcaaagatctattttacccttgctaatggatggaatcagcattaatggcacgccggcaagggccgccattagcgccgaaagacaacgttattggcgccgacgaccggcggcggcggcatgccggcgacggcgtgccggcggcggcgacgaccggcagcggcggctagaggcgcgccgccggatagacgaggcgaggcggcgtgccggcgaggcgacgaccaacagcgacggcgacgaccggcggcggcggcggcgtgccagcgaggcgaggcgactagagaggcggcgacggataaacgaggcgaggcggcggcggcagatagacgaggcgcgtcgccggatagacgaggcgaggcggcggggacggcgtgccggcgaggcgaggtggcagtggcggcgtgccggcgacggcggctaggctagggcacgggagaggagtagtagagatgaaaatgcttcaggggcaatttagtcattttcatacgtgggtcccacatgtcagagctcattctctaacagaaggtggatggaatggcacgcgggtaaacgaaagtttgcgtcatggcatacaggtgactcaaaactttttcgtggcacacgcgtaacctccaactttcttaatggcataggggtaaaagactctccaaattccacttgaatcgggcggtcgggccttagtttgaaggaataagttcactttgggtccctctatttatcgcccaatccaattttcatcccttcatcgcaaaaccgggtacgacaggttctccaacttacgaagccgtttaaataaggtccctcagcagtattgtgcccagttttggctgaggtggtgcctacgtggctaattttgactaggtctttgtccaacgtttcattgacgtggcgattatgtgacaattagatcaaaaaaaaataataaaatctatgggacccataagtcagttgcacatataaataataaaaaatggtgggcccatgtggacccatacgtcatcctctatctctcttcccctcctctctctctccggcggagtaggcagtgcccggctggcgaagcgggttgggcggcggccggagcgggctacaagggggtatcgaggatgacgtgtgggtccacatgggcccaccattttttattatttgtgtgtgcaactgatatgtgggtcccacgggttttattattttttgcgaatctaattgccacgtaagcgccatgttaatgacacgtcggacaaagacctagtcaaaatgagccacgtatgcgccaccttagctaaaaccggacacaatactgccgagggaccttatttaaacggtttcgtaagttgggggacctgtcgtattgtcacaccccaatccggtaccgccgtacaacggcacctgacaggagcgtgtcgtaggaaaaacggcgcgaaccgcttcctacgaaaccgcgatcacagtaccagtcccaggacatagtactggtacccacggtgacaaatatgaatcattgcaatccttaaaataaatagaggacttatttaccttaacttaggttgcagctcaaaacagcctgagaaatgcaaccgacgacacagacgaggaaacaccaacaacagcagcagcagcggaaccaacggactaacacccaacaccacaggcgacggctgggaaccaggacgaaaccctattcttcacttcacatcatcttctcttcaaggcggaggaactataaatatttatatagagcaagggtgagtacttccgtactcagcaagtcacgggaatttaggtgtttaatgtaagcttggaagagaggcaaggttgttttgcaaatcctttgtttgaaatcattttgaaatcgctaggtgattaatttctttttaggtttgggtcaaaaagagacttgcgtctcgattcaacttaagagatgcttttcaacagctcaattggtaatgtaccgacctcccaggtcagatcattacttctcggctcccagaaccatttcacttgattaagcggctcccagagcctttttcattttctcagactcccagagtccagctgcctagcagcacaacaatccgcttccactcgggaggcctagtctatgatgcccgtagacatcccgaatcacacagattcgtttccgaccactcgagtcatccatctgccacataggctgattctggttacgattcccaatccacaataacttttcacaaagcacaggcaaacaaatctacgcaacgagaaccacctcacatccgcccatgaccgtgggcacggctgttcgaacagttagttaacctctgcagaggggtacactttacccacaagatacgaacttattccgaacacccgtcggtatcggaggttcgcaacaaagcctttcccaagccgacccagggttacctcatgccacatagaaggataaaatccttcacataaatataggccatttcagttttcgcaaatcaaactccaaccacctcgatcggtaatctggcaagcttcgcgttcttgccttaccaggaacccgggttggctccaaccgaccccgcctcggcgttccccaactattggcatgcgaggtttccctgaaccgactagttacttagctagggtgtcccattccaccttgtggttgcactttgttatgcttgatgaatttcccacaggaatcggtccttatatgtgaatacggaacagtgccacgcaggcacaacccccgcatcgcgagttttcacaattcattttatttttaaacacaccgacaccacatgtcgggttttcaaggcttctcaaacccattcacaatttttcgacaatcaacggtgtatgtgggatatttggtatacgcgctcagagagcatggatactgaagtaccgcaaaggtggagcgacaaggaatctggatagtacaacctacaggaattagtgcaactactaggtaggtccgtcggtttggcacgcaaaccgaggccaagcaaattaagtgtgtgattctaataatgcaagttacaaacaaaataataatgattttccaattataggagcaattggtcaaagggagacttgccttgctcaaggtcttcacggagcttcacgaatcttcgagaaaacccgcgatcgacgaaaatctggtaaccgcaactatacgcaaacaaacaaaaacctaaacaaaagaccaagaaaaagaccctatttagactaaataatagtgccattgaatagatctcaattttacgaaattactggaagttgaacgaagtaaatcggatgagcggttcaaaagatatggattttcgaagtttaattggattttccggaatatgagaaatgatttattgcaattctagaataaagaattgatttagggaacaagggaaaaaggatttattgaattttctggaaaagaacattctcaagaatattcttttatcactcattgacatgtgggggccaacatatggcgagagagaggtgaattgggagggagcagatatagacttttggtcactgtgtttggggagggagttataatggacttcctttctcttatcaggccgaggaggagggtggccgatgggccaagcccacaagcacgggagagagaggagggggtggctgactgggcgctgacggggcaggcgcgaccggtcagcttgacttggtcaagccgatgtggctgccacgtcggatggggagggagaggaggctggcggcgcatcggacggctgacggcgcgcggcggaatccggcgaacggtggcaaaccggagtgggcggcgggcaccggaagcgagagggggtcacggaggttccatccaccggctcggatgtgggagaggaggcgcgacggaggccgtgcgacggcgggatgggtggcatggcgcgggagcaaaagaggaggccggcggcggaattggcggtttggggtggttcattggagctcaaggtgggtggcggcgaggggattcggcgcgggaccgaccggcggcgcgcgggcggcggcggaagcaaagcatcggcaagggcgcgatttggaggacgaacgcacaaactaccatgccccagtgctgtttaggagtcgctagaggatatagacgagaggatttgggcggggagctcacccacgagcgggaacggcggggcggatggagtcgcggcgaggcagacgcgacggctgggcggcacggcgcggagatggcgcggccgggaaagcaaggaggggcgcgagggactccgttggcggcgcttggccgagcggcggcgcacggtggcgaacgcgacgccgaggcgggcgctccgaggaaggaggggacacggggtggaacggcttggtgtcggtgcggcgttcttggccgtggcgacgaaggaggcgggggtagtacttcgttccaaggagcacggggcgaagggggaaaggattgtgggcgtggggttgggattttataggcgaagaggcgctcggctggcgacagcggcgttttcgtgggcgatgcgaaagcggcgacgacgtggatgcattgggcggcgaaggcggtggatcgtgcggcggaaattgaaccgcgggagcgggaggagcagcgccggctggcgcggggcgagctggcgctgggtcaaggtgggggcggcgagctgacggctgccgtcagcggctctgccttcgagcgcaagcggactgtaacgccccgattttcgttcgggattaaaaatcatttaataatacattttctggaaattaaataaaagttaaagcaatttaatcaagtgaaataatgggagaattaaaatttttcccttaaaaatcattggccgggaatattttgtaatattctttgtgccctaatgtactctccggaattttccgtgaattttcggagctcgagaaatagtttcaataacacaaagatcattgcatcaaataaaataaaaagaaaacaaataaaatttcccccttcctctctttgggccattttcggcccaagtcttctttcctctcccgcggcccgcgcgccttctccctctctcgggccggctcccctctctcttggcccgctcgcaaaagtctgttttgcgtccctccttctctcccttcgccgacaggtgggaccggcggtcccacccgtcagctcctcctcctacctctcgccggccgatcccaaccgccatagccgtccacgtcgccgcaaaatccggcgccctcccgcacccgagctcgcatccaacgacgtgggcacgatcccctccacgtcctccaccatttcccccactctccccgcgaaaatcggcgccggttaacccctccaccaccccacgtcggcgccccacttcgccggccgattccgccacgtccggcctcgatcccgccttcccgagcccataaaaaggcatccccgtgctcccctcatccattttccccattttccccaagccgccgcgccctccctcgctctccccgcgccgagcccacgcaccgccgctctccggcgaactccagcagcgccgcgccgccgctcccgtccgccccgcactgcgccgtcgccctccccggcaccgcagtcgccgtgcgcaccccgtccaccgctcctcttcgccaatccaccgccgcaacgccgcttccaccgccaccccgagccaccttcgcctttagccgcctccatccgctccccgccggcgagcgccgcctcgcccggccgtgcttttgcctccaacggcttcgccgcgtcgtgccgcaccccggcatccactccgtcctccccttccacccccgcagcaccattcccaccgtgcaccgagccacagccgcctttcgtcacctccagtcgcgcgccaccaccgctcccgtcgctgccgcgctgcgctaccaccgccatcggcatcgccgttcctcgccgcaccccggcccctactccgtttcccctccctgcccctggaacgccgccgccgcgttcaccatctctttccgccgccagccgcctccctgtggtcgtctcgccgtcgccgtcctcggtgagaatccccaccgtcccttctcctttttttcctcctccgccgctccccgtgcccgctgccgcgacgcgccgctgtcgccggcggtcgtctggccgcacgccgccgcgcgctatcgctcggccgagccggtttcatgccgtgcccgtgccctagccgcgccgcctcgtggccgtccgatcggcttcgggccgatctgggccatccacgtggtggacgcgcacccgaggccacgtgtggacttggtccaccgtgcgccgcccctttgtgccgctgacgtgcggggcccgcctgtcggcgctggtttccccttgctgacgtcagcgaggtccatttcctttgtaaaaataaataataattgcgcaataaatcgagtttaattctagaaattcattaaaatggctcaaaacttctaaaatccatatctaattcattcgaactccgaattgagctgttcaacttgcaaaattcatctaaaattgagctctacatgtttgtttactttttatgtactgtttccttggtttttattagagtttttcctcgttttgcgtgccagcgtgtagtttccgtcgtttcggaagtccgcggtcgcgaggaaaagagttcggaagatcaaagtgaagaagcaaggcaagtcacacattccccttgagcatgttgatcctaatttacaaatgttttaccgtttgcaaataaatatgcatgttttgctaattacacgggatcagggtttacctatctgctcgcttgtgccatgtttacttgatatctgttctttgtcaaccttgggtaataaatcgactagctcatgttacttatgtgacctagctagaactatatgcttagccatgcttaattactactagctcagttgatggggtaattacagtattagacctttttagtatcagattgagctgtgtgctcgagacacctggccatgcttcatggtcgtaattatccaactaaaatgcgactacatggtgggctgtgggtgcatggttttgctggtcgcacccatggcagttaaggaccggttcgcgggatgccctggaagaacttatcgtacttaccacaagccagcgtgggcaacggctgggcttgtagtgtagctttcctctagtcgacgcatccaggcaagggtgggcgtgatggagcggggcgggccctgcgacggcctctgtcgcttccggattcacctaggcacgagaggggactgcccgttgcccgctggggacgggggtgaaacctgaggtgtggtgtgcttggctagagggggttatgcgaagggtcctgtcacggcctctttccggtatgtcgtggtggcatgtcggcgcacggaaacgtgtcgtggggctgtgtcttgtgggtacagttgtacacctctgatcagagtaaaactattcgaatagccgtgcccgcggttatgggcggtcgaccagattcaccgtgattagtcccacctcaataaatcgacctaatacactgtagtttaggtgggttggttgggcctgttcaacgtggtgtagcgttgatcagtggagatttaatgttactttaattactcaactgttttactgttttgctcaataaaatgttttacaaccgcctttatgcaaatagccacaaaccgtccttgtgttccccttgcacgtctgcatcgttggtgtggcttgctgagtacggtggttgtactcagccttgctattattcccccttttcagaagtgtagtgcttctgagctgaagacgaagttagaggaccaaggctcagaccccagttgagttttgcctgtggagtggagctgaagccccgctaggatcgcctttttccgctgctgctgcttttgtttcggtgcgaggactaagtgcctcttttgtaagtattttacgctttatttacgtttggaactgtatattacttgtcgttttgtgtaccctggctggtcctggacagggatttaatacacaaaatagtctggaaatttgggctaaatttctgggcgtgacacggacaagggcgagagagcgagcggttgagcccgagggggaaaaaaggcgaagagggcggtggaaaggggaactcgtcccttccgttttgggcggcgggcaggcgagtcgcggaaaggcggtcacgcgaggcaggcgacgaccgggtggtcggcctccacgcgagcgcgcgcgggaaaggcgaaggcggtgggagcggcgtccttgccggtcggccatgcgcgagcgcgcggaaaacggtgacgcggccggaattttggggcggcgtcggcgggaagcgacgccgagagagagagagagagaaaggagacggcgctgtctctcgctcccgaacacgtgcgacgcacgcgcgagagagctgggccgagaggaggggatgggccgggagagaggaatcaacccatcgacaagggaggcaaaatagactttttctgaaagattttgatttggagagatttggagtttgggttttgaatctaaatttgatactttgtacacaagggttcaaggagtcaaggaaggaaacaaaacgggagtttggatattttgggattcggaaatgtatttggcgaggattcaaaggaaggatttgaatttcggaattgatctaggaagttaaatcgggatttgaaatcttgaggtggagggttttgacagtgacgagagggaacaaggagattaaaactgagatccacggcacgacttagactcgcacacaaagaacgaaattttcgcaattcggattttgccgaattagtttttaacgtctcacgagaagcggagcgttacacatatccggttttgcgaccaagcaacaaaatcagactaggcgacaaattgagggacccaaagtgaacttattcctagtttgacagacaaaactcaaccacgggagttacatgggctgggttactcgtttttgactaactctcaaattacaggggaaataagtttatctgtggtcccttaacaacgaatccgatttcatcctttaaccgaaaaaccatatacaacggtcccttaactgtcaaaaccgatgcaatataggtcccatagcggtttgaacggcggttttcgctgacgtgatgcctacgtggctattttgactcggccttcacatgacgtggcaatgacatggcgcttacgtgtcaaatcgatttggaaaatattaaaaattgtagacccacatgtcagtttacacaaaaaaaattagattaaaaatggtaggacccacgtgggccccacatgtcattctcaccctcctctcttcccaactcccctgtgataatgaagttgtcgcagacccccggctcggtgaggtcgttgttgtcgacctcgatgtctctcagaaatggtgagtgcttgccgagctccgccggaagctggccggagagattgttctcgaacagcttcattatcaccagcgatggaagctgagcaaggcttgctcgtatctcgccggagaagttgttcgccatcaggactaagttagttaggttcatcaaacttccaaagctctctgggatcgttccagtaagctggttctcagatatgtccagataaattaagcttgctgctccaatcttgccattgacgacgacgtcgccggtgagctggttggtgtacaagaacaagtactgcagttttggaaggttccagatcccaggaggtatgcctgacgtctgacgagcactaaaacctggccaaaaccgaacacaggttttaggagagggattaggagaggcaaagggaatcatcccccacagggtttaagtgagatgggagggaccctggataggttcctttggggattaattcccaagcaaccgaacaaggacttatggggccaaaagaatattcattgctctttctcttcttattcttctgagaacttccattgctctttctcagaacaggactgaaagaaagtggagaactatatggaactaccaggtctcaaaaccacaatgattttagggaggcttggtcactttggcagtaatttagaacagagataattgaaaagaagaagaaaattcataccatagttgatttatacatgtcggaacttgaggagctcaaagtggcagtagtttttatcatggcttgaagcaggtaagtgggaaaattcagaacggtgcccatcggaggaagccagtgtggtaatagtataactattgtataccagtctttgttacctttgaagtctaaaatgttgtgtagtttcttgttggtgcacaattgtatgtgctcttgtttgcactctcttcttctccaactagtaagggtcagagaagcaatgttccaattaatgatcattgtggatcacttaacaaaacgagtggaaatgatctaggagacattaagctgcatggatgtaacatagacaagtatagttcagaatgaagaaaagggaaaaaggaaggcaaaaatcaacaaagtacatgtgatccaacttccaaacattagtcacggttccataaactgactctgctggtacagtcaaaaggcctgtcatgttaacacaggacataaattttaactagcctacggtaaacaccagcggaataaaacaagacataaccttcggaacaaccggacataccttccaaaaggccaacttacgtaccatctaggatttcacaacattcttcataacaaaggagccatcatccaagtactacaaacagaacttcataattcatattagagattggctgcccactctaagcccgattctcattagggtacaaagacggttttgcaataacaaaagtggagccgcacctctgcatgttagcagttaccgcccattaggtaatgactcagagaacattggaacatatggtagatatgactggcaggactcatgtccgagtttgcgtatgacacggacttccttgcgatccatttcatatgccatcaaagtattgtgccatccataaacaaagaagatcaaattgcattctggatgaactgcaattacttggtagtcataatctaattggtatttctttcctccaaacagcttcattgagccaacggtatgctttaagatccaattatctgtatcatagtcttgaagaaaccaaattgacagtttgaagatatcatttggatcaacattaaaagcacacaggcgaccctgagtttgatgaattatcccaatatcaccatcaggatccggcataggaatcttcctccatttcttcccctctatgtcaaccgccacaatctcatcagcaggcgtgacagagtgcagaaaaccattgagcaaaacacttcttcgattgaccgaaaggctaatcacaacttcatcattccatccattttcatggagagtccataacccagtttcagacgaatagatctccacccctgtgaccagtgtgacgtatgaatcctcatcctcttccacatactcaagcacatggaaatgcgacgagatggctggatcgaaacacaagcaggcggtgtggttctcttcgatagcccagttggcgtccggcaacatcacccattccttggtggcaggattgcacacggcatagtggaactgaaaagtgccacgagacacgtagcagcggcagaggaggaggccattgcagcaatccaagaggtcgacgtcgtggcactggggcaggaaggagaaggtcgggctgacgagaggcatgcctttcccggtgacgttggtgaaatggcgcgccgtgtacgggcagcgctcgtggttcatgctctcgtagaagaagcccgacagcgtctgcggcagcttctttcggtgctcgttgtcggcgatgagtctgcgccagtgtgaaaccatgtgtggttatagttcttttgtgatgggaaattgacaagtaccggaagtgcaagaagtgtgtgcgtagactaccattggtcaggttgcgatatctgtgccaagacaacggttgtttggctcatgtgtgtgcaggtgatcagagtcaatcttagtcaacggcggatcgggactagactcagggagaagttgaggtccagaacgatcaaggatgccgggtgacaagattggacacaaggttgcacacggtgggcggacaccgtgtgaggaggtctttgcaacgggcttcacaaggtcaagtgtgcaagcatcggattcgcgaagaaaattggaaggagaagaggactgtgcaaggacatgaagaccgagtgcattgctgctacagtaattcggcttactgtagctagcatgtatcatgtgcacgtgtgctgccatgattgaatggcaaggagaccaacaggagctggccactaggcttgtgggctggcagttcggttggcaggaaggccgagccaacccggcctaagcacgttgctgactcaagatggtgaaggctaggccgagcaagccctagacatgacgatggcccagctcggctcagcaaatgcacaggtgtgtgcatgcgcgcgcggaagcgggagatcgtacggcacctggaggcgtggcggccttctgttcgtcaaggaagcgaccgggtcccacgcggtttttcgcatggtgcgcgcgggaacatggttttcgcgagcgcgcgcagaagcggctcggtgggaggaacggcgacgtggcggcttcggactggtggtgcgcaggcgtgagaggagcaggcacgcgctctctgggacgcgtggcgcggatgcgttggcttggaggagcacgacgcggatcggtgcacgctgattggcttggagtggaatcacgcggatcgcacgagggcgcgcaacgtggagagctcggatcaacaacgtggcgactatccaggaggcttccttcggatctaaggaacaatggacagccaggattacatcaaggctagggtttcgccctagggatatttgagacaatgtcttaggggtcttaggctataaatagagagatggatgcaagggtggaggttgctccttttgtaatccttttgagatgctcggtgagagagtttcggtgtgagtttggagtgtgtttgctcgagaggcttttgtattaggattagtttggagtgtgtttgtccgagagattttaattttgtgttaatgttcctctgaaggtgtatgtttgcccctagttgagcggttattttgcatcacctatgaatgaaatgatttgaaggatttcgtttttgccttgttcatttaaattccgcaatttaaattctacttgcaatttgaactttgcgatgatgagttttgttatctcctcctcacctctcttctagtttgggaaattccttttctctttctcttctagtttcgggaatttctttctctcttcttttctagatccggcttctctaatagccgcggttctagtaaggatttttgagaaatccggcttgatgagtattttcgggggcaagatttgaattgctatattcaccccccctctatagctgttcttggtctttcaattggtatgagagcaaggttaagttcattgtaacctaaccgtggcaacgaacgccgctatggaggaaaaatattctgcgaaaccatttgttttcgatggacacaattttgtcatttggaaggcacgaatggaggcctacctccagtcgcaagggcataatgtgtggaataaggttaaatcaccttacactgtgcccgatgatgctgacatcacgcctgcaaatgtggctcaggttgattttaattatcgtgcaagaaatgcaatcattggtggaatttcttctggtgaatttaattgtgttcaacaccacaagtccgctcatgacatgtggactgctctgtgcaatttccataagggaaacaatgatattcaattggttcgtcagaatcaatttcataaagaatatcaaagatttgagatgcacccaggagagtccattgattcttatttcaagcgttttggagaaattgtttcgaagttgagatctgttggaaaagaattttctaataatgataatgctcgccatcttttgaattgtcttgattatggtgtttgggaaatgaaagttacttccatcacagagagtgcacctctgagtgaccttaccatggacaagctttactcaaagctaaaaacccatgagatggatattttccatcggaaaggcctcaaacactcgatggctttggtagctgatccctctggtagtacttcttctaatgactcagcttttgtgtgtggtggcttctctcttgccgctttacactcagtcactgaggagcaattagagaagattcctgaagaggatcttgctctttttgctagaaaattctcaagagcttacaaaaatgtgagagatagaaaaagaggaaaaaccaatgaaccatttgtgtgttttgagtgtggagagcctaaccacataagagtgaattgtcccaagttgaagaagaagagtgacaagacgaccaagaagcccgagggacaagggcgaaaggggaataaggatttgatgaagaaggcgatccataaggtcttggcggctcttgaggaggtgcagcttagcgacatcgactccgacgacgatgatcaagaaaagggggacaaggacttctccgggatgtgctgtctcgccaacaacgaggacttcatcaacctgtgtctcatggcacttgaggataaggatgactcatcggagcatcctgaggtatgtcttgatgatatcccttccttggatggttctctttgtgatgatttttgctcagataatgactctgttgatgatgaactaagcaaagaaagaatggcacacttgatgattgaaattagtgacaagtataggtcttctaagtataaaattgagaaactaaaatctgaaaatgatggtatggcgctagaaattgctaggcttcgatccatgattcctgaggaggatacctgttctacttgtgcttcatatctctctgaaattaatctcctcaaggataagttgaaatcatgtgctttaggagctgggaatccttctagtgctagtgttgcttgctctacttgctatgaaatgaaagttgatatgggtttgcttgagatggaattgaaagaactaaaagaaaaaaaatttcatgataggattggtaggtgtgaaaattgtcccattctcactagtgacaatgatgaattaagacaacaagttgccatgcttaggaccaagaatgatttgttagaatcttttgctactaaggaacctattcattcttcatgtgctaattgtgctatcctggaaactgaactaaaagatgctaaaactgtcattgattctatcaaatctattgattcttgttcatcatgcatttctctgaaagttgatcttgagtctgctaagagagagaacttttacctacaacaatctttagagaggtttgctcaaggaaagaaaaagttgaacatgatcctagactaatccaaagtgtccataaacaatcaaggtataggctatgattttgatgagtctttgaggataggtacccatgagatattaggtgtcacagatgggatgatagaactagctcaaaagcctataaccttcaagtctgcaggtttcattggaaacactagttctagttcacccaaaacctcagaaccaaagatggtacctatgactagcaagtctaagcctgtagagttacctagacccaaaaatccaaaacaagttgagcacaagcaaaaccagaaacaaaccaagcctgtagagaaaaccaagtatgagtgcacctattgtgggaaagctggtcatttggtaggtttctgctttagaaaggctagaaaagagcgacaagaacgttttaggactagaagagatactagagtccctgagaggttcaagtgtgcatgtcgttcaagtggtgtatctcgctttcctcgccgagatgtgcaccctcgacgtgacctagcaaggttggggcaaaacagacatggtcatcttgcatataattctgctcataacactaaagatgcttgtacccctcgcatggttcagtactggattcctaagtcatttctcactaaccccagtactgaatcatcgagatttgctttgtttttcttgtaggattttggagtggggagaagtaattcttggcttgtggactccggttgctcacgccacatgaccggtgaagccaagtggtttacttctctcactcgtgcatccggtgatgagaccatcacttttggggatgcgagcagtggacgcatgatggctaaaggaacaatcaaggtcaatgacaaattcatgctgaaggatgtcgcgcttgtaagtaagcttaagtacaatttgctctctgtttcacaactctgtgatgaaaatctagaagttcgtttcaaaaaggataggtctcgagttcttgatgcttctgaatctcctgtttttaacatttctcaagttggtcgagttttctttgctaactttgactcttctgctcctggtccttctcgttgtttcattgcctcagagaatagggatttgtttttctggcatcgtcgtcttggtcatattggctttgaccacttgtctcgcaatagtggtatggatttgattcggggtttgcctaagttgaaagctccgaaagatcttgtgtgtgcaccatgtcgtcatgggaaaatgacatcttcctcccacaagcctgttacaatggttatgacagatggaccgggacaactgcttcacatggatacggttggtcctgctcaggtccagtcagttggggggaagtggtatgtcttggttgttgtggatgatttctctcgctactcttgggtctattttcttgaatcaaaagaggaaacgtttggcttctttcagtctcttgctcgtagtttggctttggagtttcctagtgctcttcgagccattcgtagtgataatggctctgaattcaaaaattctgcatttgaatctttctgtgattcttctggagtcgaacatcagttttcttcgccatatgtcccacaacagaatggggtggttgagaggaagaaccgcacccttgtggagatggcacgaactatgcttgatgagtttactactccaagaaagttctggactgaagctatttctgctgcttgttttatctccaatcgtgtgtttttgagaactatcttgcacaagacgccatatgagctcagatttggtcgtcgaccaaaagtttcacatctcagggtcttcagttgcaagtgctttgttcttaaacctggaaatttggacaagtttgaatctcgatctgtggatggcatttttcttggctatgctactcattctcgggcttatcgagtttatgttctttcaactaacaaaattgtggagacttgtgaagtcacttttgatgaggctagcccaggagctagaccagaaatttcaggtgttccagatgaaagcatccttgtggatgaggattcagatgatgatgacgatgattccatttctccacctctagacagtacaccaccagtacaagaaaccggttctccatcgactacatcgccttcaggagatgcaccaactacatcatcttcagcagctgaggagattgatggtggcacatcaggaccaacagctccccgacacatccagaaccgacatccgcctgactcgatgatcggaggcctgggtgaaagggtaactaaaaatcggtcttatgaacttgtcaattcagcatttgttgcctcttttgagcccaaaaatgtttgtcatgctttatctgatgagaattgggttaatgccatgcatgaagagttagaaaattttgaaagaaacaaagtttggtctttggtagaaccttccttgggttttaatgtgattggaacaaaatgggttttcaaaaacaaactaagtgaagacggttcaattgttcgaaacaaagccagactagttgcacagggtttcacccaagttgagggcttggattttgaagaaacttttgcaccagttgctagattagaagctattcgaattcttttggcttttgctgcttcaaaaggtttcaagctttttcaaatggatgtgaaaagtgcttttctgaatggtgttattgaggaagaggtctatgtcaaacaacctcctcgttttgaaaatccaaaatttccaaatcatgtgttcaaacttgataaaactctttatggtttaaaacaagctcccagagcctggtatgaaagattgaaaacctttttgcttcaaaatggttttgaaatggggggagttgataaaactctctttactcttcatagtggcattgattttcttcttgtccagatatatgttgatgatatcatatttggtggctcctctcatgcacttgttgcccagttttctgatgtgatgagcagggaattcgaaatgagcatgataggagagttgactttcttccttggacttcaaatcaagcaaacaaaggaaggaatctttgtacatcagaccaagtactccaaagagctcctgaagaagttcgacatggccgactgcaagccaatcgccacccccatggcaactacttcatcgcttggtcctgatgaggacggcgaagaagttgaccagcgcgagtacagaagcatgatcggctccctcctctacctgactgcgtcaaggccggacatccacttctccgtgtgcctgtgcgcgaggtttcaggcttctccaagaacatcacatcgccaagcagtcaagtgcatcttccgctacatcaagtctacacttgagtacggtatttggtacccctgctcttctgccctttcagttcgagctttttcagatgctgattttgctgggtgtaagattgatcgcaaaagtacttctagcacttgtcattttcttggcacttctttggtctcttggtcctctcgtaagcagtcttctgttgctcaatcaacagctgaggctgagtacgtagctgctgctagtgcatgtagtcaagttctttggatgatttcaactctgaaagattatggtctgtctttctctggtgttcctctgctttgtgataatacaagtgcaatcaatattgcaaaaattccagttcaacactctaggaccaagcacattgagatacagtaccactttctccgagacaatgttgagaaaggtaccattgtgctagagtttgttgaatctgaaaatcaattggcagacatttttacaaaaccacttgatcgctctcattttgagttcttgcggagtgagttaggggtgatccacccctatggcttgatttgagggggagttgtttttcttttacatgcatttgtaacatattgcatcatgtttactttatgcattgtattatacactcttcaattgagctttgcttgttatctcttggtcatcactatgctatgcatgtattactcttatgctagtttgatcttttgtctagctttcatttgcttaagtagcttgtgtgatcatgttatgctgttcaagcttgttgaaacctgcttaaattgactattcatttgaacttaatcaatgtgcaatgcttgctctagaagtttgtttaagttgaagtatccatctcatactcatgctatgttttcattctttttgcaataactgtcagtacatgctcatgaatgctcatgcttatgcgtccatactttgtatcaatcttgctttacaagctttatctctgtttttgtccgggctactgagtgtgtttacgcatgagtagtgccgaagatagcactgagacagcctgtaatgggaactctagctggaaaacttgattgaggtcagacggcagtgtttggcacaaccatcacttgctgactgataagatcaggtggaccgtcgtgattgtgctattgtctttaaagaatttaaaaaaaaaatcataaaaagaaaagtcatgagaaaagattaaaagctcatgttctatgctttgttaccatgttgatactctttatgaactgggcattagcacattagcatgggttcattgctttgattatgtaaatcttgcatgattatgagctggtttgcttccttttaagcttcttctagaaatagctatgcacactaaatcactaatccacttgaaagctgtttgcttgctggcgatactatcctgatattcataacttgtttcatacttcttttgcacatgcttagctaggcttgagcacatgcttgtatctgtgtgatccatgtctactttttgatgcctttagataactctcaaagctctcagaactctggaatttgcaagtttcaatcattttcattttgcatttttgtctctttttggtcttgatggcatcattgacaaagggggagagaattttgcacttattgaaaattaaaacttgctttagatcttggtgaaagggggagtttggcacatagggggagcattcttgcatttgcatttgcatcccttttcttcttgtcacttggtcttgatttttcgcgatttcaaaatgaccaaagttcgacttttgcaaaatggtttgctttgtgtcaaaaatcaaattttcaaaattttgcttgagattgtcaatgttcccatcaagggggagattgtgaaaccatgtgtgattatagttcttttgtgatgggaaattgacaagtaccggaagtgcaagaagtgtgtgcgtagactaacattggttaggttgtgacatctatgccaagacaacggttgtttggctcatgtgtgtgcaggtgatcgcagtcaatcttagtcaacggcggatcgggactagactcagggaggagttgaggtccagaacgatcaagaatgctgggtgacaagattggacgcaaggttgcacacggtgggcggacaccgtgtgaggaggtctttacaacgggcttcacaaggtcaagtgtgcaagcatcggattcgcgaagaaaattggaaggagaagaggactgtgcaaggacatgaagaccgagtgcattgctgctacagtaattcggcttactgtagctagcatgtatcatgtgcacgtgtgctgccatgattgaatggcaaggagaccaacaggagctggccactaggcttgtgggctggcagttcggttggcagggaaggccgaaccaacccggcctaagcacgttgctgactcaagatggtgaaggccaggccgagcaggccctagacatgacgacggcccagctcggctcggcaaatgcacaggtgtgtgcatgcgcgcgcggaagcgggagatcgtacggcacctggaggcgtggcggccttctgttcgtcaaggaagcgaccgggtcccacgcggtttttcgcatggcgcgcgcgggaacatggttttcgcgagcgcgcgcagaagcggctcggtgggaggaacggcgacgtgacgtgtagcgcccgttccgtcgtggcacctagcgggaaaattatctcttaaaaaccctaattgcgaaatttgtttctttgcttgttgtctagtgtccgtgccatctcggatctcaatccccaatctatcgtcgagtccatttccgaatccaaatccttccaaatcaaatccctccgcaaaagtctattttgcctcccccggggtcgatgggccgaatccctctcggcccatctccccctcccttcccctgcgctctctctctctctctctcccttcccccgctccgcccgcgcgccgcacgcgcgtgcgcgagagccgcgccgagcgctccctccccctccgctctgcccgcgcgcgtgcgcgtgagccgcccgcgccgagccgagtcctccctctccgctccctcgctgccgcttcccgcgcgccgtgttcgcgtgcgcacgcccgcgtggtcgccgcccttgccgcgcctgcgccgtctgtgccgcctggccccgctgccctgccgcgcagccgcccggccccgctagccagcgcgcgtgcccgagccacgccgctcaaaccgccacgccgcccgttgcttcccgcgcgcgcgtgccgtggtggctgaccgcctggtcgccgccgtcgtcagcgcctgccgcgcctgtcgctcgtgtcgccgctccgctccacaccgccccgccgtcatcgccgtcgtcatcgcctcggccccgcctctccgcgcgcaagccgccaagagacggaggcagagccctcctccctctgccgcgtcgcccccgctcccctcctccttttcccaaagaagcaaggggcaagccccctttctcttccccattttcctcctttttccctctcgccggcgtcacctctgtcgccgttttggctgctagccggagcgccagctcgcgccttgaccgccctaagtcggttcccaaaccgacattgccgcccttaaaacccagctcccccctttcccttcctctcccattcgcctccacgccattgccgccgcctcccgtgctctgttcgccgtcgccgttcgtcgttgcgcgtgtcggaggagccggcacgagcaaggacgcggaaggggactccgggcgcgcccttttcttcctcttcctcggcccgaggccggagagattactcccgcgccgtcggcctctcgtcacagcgcccctcctcatctcggtagtgcctccctccgttcttcctcctcgctccacctctcccccttagttttcggtagtagcacgagtagcctccccgtagctagccggcgccgccccggccgttgccgccgctcgccgggtgctcgccgccgtcgccgcccgagctcggaagcgccgctcgtcgccggcctcgctcggcgtagctccgcccaatccgacgctagcatcggattcccgtggccgcgtagatgctcttgccaccgggaattggcccctcgtgacctcgtcgccgttttccccttttctctccgccggttgccgccgccgcaatccgccgccgacggactccctccggtgaatccgagccgttggctcgtctccccttgtcctgttcaaccacccggtgtactcgcttccgcctatatcgccgtggttcgctccgccgctcgccgttgtcgtccgccgtccgtttcggccggcgtcgtcgtctacctcccgccggcccgcgtggcagccacgtaggcgccatgtcggcgccagctcggccgagatcggatcgggccaatcccggtcagcccctccccgtgcgcgcggtccaccgcgagccgagaggctgcgcgtgggcccgccgcatccgcgtccaccgcgaaccgcgcgcgtgcaccgcatccctcccccaccctagcgccgcgccgcgtgctccctccgcacggtgagccgagccgctgacaagcgggtcccacccgggaccgcgtgtggtgagcccggtctaccggctcactctctcctcccttccgcgcgcacgccttgggccgctctgggccgccttcttgggccggccggcccatttagctcggccggaccgcccatctctctcgggccgcgccctagccgcccgaggaaaagtctattttccctccccttttttttcttttcttttctttttcaaaaaggatttaattaaatccttttcctttagaccaaaaatccaataatcttagaaattcaatatcttcccaaccgtaaatccgtttgactccgttcaacttccaaaattcctcaaatcttgagatctatctaatggcacgcttagaggtcattaatagggctttattttcgccgtttgttgagttgtcccgtttcgcgtgtagtttcggagcccgaagatccgcagcgcgaggctttcgaggatcaagctccagatctcgagcaaggcaagccacctttgaacatcttgagcctatatttgaaatttaatcatattgcttgcaaaatattatgcattgataggattgcacttaatatgttgccccgtctgcaaggcagatcggtgggcatacctaacttgttgcatttgatccttccattgttaattgctataccatgtccccttgtaaccatccagttgcgcctcgatattcgtgcactctgtgcgagtatcgacggtcgccttcaaacttaaaatctgagtaacaacttgggtaaaactggagttttacaaaagacttggaaaacccgacacctgggtcggtgcttgcgaactaaatgaatttccaaaaccgcggaccggggaacgtaccgggtgtacggttttcccgctcttgcacttaaggaccgtttccttggaatttcatccaaacataagataagtacgaccatatgggtggaatgggacacccctggctgagtaactagcttatcaggggagccttgatgccgagagacatgtggattcgccggggtggtgtcggggaggacccctgggcttcctggcacagtatggtctgggacctaacctgttgttagtctgggacccctctcgtcggtatatggtaaacctgtgtcggctttggaaatgccttgtcatgaaagcttggaggtctcccgacgtggctgatccccacgggctgggtgatccgggttagtaatgtcgtgtgggtaaagtgtaccccatctgcagaggttaacaaactgttcgaacagccgtgcccaccgtcatgggcggatgtgaggtgattcctagcgtagttttgtttgactactgcttgtgaaattgttgttgtagaaaggggttcgctgtttgaaaaatctgcagctgatgggatcagctaggcccgggtggccgtttgaaagttgttggcccgggtggccgtttgaaaagctgttggccgggtgccaaccttgttttcaattttaaagactgatacattgcacatactccgaccggacgagacgcactgtctcaaccgtgtcgtttgagaaacactcacttagctgtttttagaaaagagttcaaataaaatcaacagcaaaaacaacagcctttccttgaagcctacattaaacacttatttcccttggcttgctgagtactcccgtactcacccttgctctatataaataatccccccccagttgctgaagaagaagaagcggatcctgctgatgaggagttctttcaggagcaagccggctacgatgagttttagggtttcggtctagttcccaagtcgcgcctgtgttggttggtcctagtcctggcttccgtttcccttttgtaatgcagttgtgagctcgggatctgtccgtagcccaacatgactgtatctctactctataataaagtgaccgctgttgctgtgatattctgtctccctgtgataccagcactgtttcctaggactggtatcgaccaacaggttaatttggagcgtcacgggctagttccggtcgggattagttcggggcgtgacatgacggcttcggactggtggcgcgcaggcgtgagaggagcaggcacgcgctctctgggacgcgtggcgcggatgcgttggcttggaggagcacgacgcggatcggtgcacgctgattggcttgaagtggaatcacgcggatcgcacgagggcgcgcaacgtggagagctcggatcaacaacgtggcgactatccaggaggcttccttcggatctaaggaacaatggacagccaggattacatcaaggctagggtttcgccctagggatatttgagacaatgtcttaggggtcttaggctataaatagagagatggatgcaagggtggaggttgctccttttgtaatccttttgagatgctcggtgagagagtttcggtgtgagtttggagtgtgtttgcccgagaggcttttgtattaggattagtttggagtgtgtttgtccgagagattttaagtttgtgttaatgttcctctgaaggaatatgtttgctcttagttgagcggttattttgcatcacctttgaatgaaatgatttgaaggatttcgtttttgccttgttcatttaaattccgcaatttaaattctacttgcaatttaaactttgcgatgatgagttttgttatctcctcctcacctctcttctagtttgggaaattccttttctctttctcttctagtttcgggaatttctttctctcttcttttctagatccggcttctctaatagccgcggttctagtaaggatttttgagaaatccggcttgatgagtattttcgggggtaagatttgaattgctatattcacaccccctctatagctgttcttggtctttcagccaggacttgctcacgcacttgaactggcacacggagcggacggggaggcggcggaggacctcgacgatgagctcgtcggtgagactggccgccgggttgcgccgcttgttgggaaggttctcctccatcgggggtgggtggaggagaggaagtcgtcagcctgcaaccgcgtgaagagggattgaccgcggcaagagcagatcgagcaggtgagcagatggggattaaattgagcaaaacatcgaaatggcgaagaaagaaaaatctggtaacaaatcggcatcattgggttcgttaatccacctacgaaacgaactaatctgaggactaaatgtgtagatcaggaacctaccgatcaaggcagggaagcgatgccgccgcgcgcgtgacttgccgctcggcctcggctgacccgtggagctcgtcggacgggacaccaggacggcaaacctagcaccctcaccggttaaggccaaccattgcgccggctatcctgctgcgatgtgcgccggtcacggagaagaagagatagaagcggcggcggcggcggcgaaggcgaaggcgacgaaacccctagatgcctccaattcagtgtctgccgggatattggttccaaattggaaaataagggtccgtttagttcacggctgtcacatcaaatatttgatacatgcatggagtattaaggctccgtttagttcgcgaaataaaaatttttgggtatcacatcagacgtttgaccggatgtcagaagggtttttcggatatgaatgaaaaaactaatttcataactcgcctggaaaccacgagacgaatcttttgagcctaattaatccgtcattagcacatgtgggttactatagcacttatgactaatcatggactaattaggctcaaaagattcatctcgtaaattcccccttaaatgtgcaattagtttttatttttatcgatatttaatacttcatgcatgtgtctaaagattcgatgtgatgtttttgggaaaaaaaaatttgaaactaaacaggcactaaatgtagaaaaaaaccaattatacatattgcgtgtaaattatgagataaatctttttaagtctaattactaaatcttttaagtctaattacgccataatttgataacattgtgctaagtaaacatttgctaatgatggattaattaggcttaataaattcgtctcgtagtttcaagtggaatctgtaatttgttttgttattagactatgtttaatacttcaaatgcgtgtccgtatatcccatgtttcacaccaaaaattttcgttcgcgaactaaacatggcctaagttcttttgactcccttagctactggccaaatctgattcgtatcctaaccataatatatgatatcgcgaccccttaagccattactatcttggactgtgcactccacgtcttcaaaacacatttcctgaaaatactttttgttgcattgcgtacaatgttttttaaggccatgtttagattctctggcaaattttttcaccctatcacatcgaatatttggacacatacataaagtattaaatatagaaaaaaaactaattacacagattacgtgtaaattgcgagatgaatattttaagcctaaatgctctatgatttgtcaatgtgatgctacattaaatatttgctaattacagattaattaggcttaataaattcgtctccagtttacagacggatcatgcaatttgttttgttacttcaaatgtgtgtccgtatattagatgtgacacggcataatattttcacccatgatctaagcacctcctaagctactccctctattaaaaaaataatatagcattagatgtgacatgccattttattagattatgtcttgtccaataataggttttttatggagtttgctaagtgcatttctaaaaatatttaatatatctttataataaaatatataaccgtgacaataatctcacgaataatctgtttcacttgctgaaagattttgaagcattcttgttgctgggagtattttaaaggagaacattatcaccatcttttgtagtgcaagggatggaaaacacaataatttggaaatggaatatttggttagatcacactacaaaattcaattgcacgacaattgtggactatagcacataaatagcttccaaaactgctgctgaaggtaaatgctaaatttgcatggtttcattgcaggggatgttcacatggttaattatgccctttaggcggccaggagaatgaaatgtcaaattacaacgattttaaggaagcttagccatgtggtagtaacttttttttagatgcatttgcgatttgacagtaataacttagtaaggacataattgaaagaagtgtataacttttttttatgtcattctgaatttctggtttatacacattcgaacttagagaaggaacataatagttgaagttttgataatttttatcacggtttgtagcaggtaattgggaaaattgataagggtaaacatgagaggaagccagcatgcatagttgaactattgtagaactttttggtttaccaatctatgctatcctcgatgtacccttgtacgtgctcttgtttgaacatacacaaactttctctctctctctctctcaaactagaaaaggtaaggaaagcaatattccaattattaagatcattaaaaatcaccacacagaaaagtaagggtctgctgggaaggcgacgaaacccctagatgcccccaattcagtgtctgctaggacattggttccaaattgaaaaataagggtctgtttagttcagggccgtcacatcgaatatttataaatgtatggagtattaaatgtagaaaaaaaccaattatacagattgcgtgtaaattatgagataaatcttttaggtctaattacgccataatttgacaatgttgtgctacagtaaatatttgctaatgacggattaattagacttttcgtctcgtagtttccaagcggaatttgtaatttattttgttactagactatgtttaatatttcaaatgtgtgtatgtatatccaatatgacacgccaaaaatttttcttcggaaactaaacagggcctaagttcatttgattcccttagctactggccaaatctgattcgtatccctaaaccacaacacttgatatctcgaccctttaagccattactatcttggactgtgcactccacgtcttcaaaatacatttcctgaaaatactttttgttgcattgcgtacaatgttttttaaggccatgtttagatcccctagcaagttttttcaccctgtcacatcgaatgtttggacacatgcataaagtattaaatatagaaaaaaaattaattatatagattgcatgtaaattgcgagacggaacttttaagcctaaatgctccatgatttctcaatgtgatgctacattaaatatttgctaattacggattaattaggcttaataaattcgtctccagtttacaaacggatcatgtaatttgttttgttacttcaaatgtgtgtccgtatatccaatgtgacacggcaaaatattttcaccctttgatctaaacaccccctaagctactcacctccattaaaaaaataatatagtattagatgtgatataccattttattagattatgtcttgtccaatactaggtttttttatggagtttgctaagtgcatttctaaaaatatttaatatatctttataataaaatatataaccgtgacaataatctcacgaataatttgtttcacttgctgaaagattttgaagcattcttgttgctgggagtattttaaaggagaacattatcaccatcttttgtagtgcaagggatggaaaacacaataatttggaaatggaatatttggttagatcacactacaaaattcaattgcacgacaattgtggactataacacataaatagcttccaaaactgctgctgaaggtaaatgctaaatttgcatggtttcattgcaggggatgttcacatggttaattatgccctttaggcggccaggagaatgaaatgtcaaattacaacgattttaaggaagcttagccatgtggtagtaacttttttttagatgcatttgcgatttgacagtaataacttagtaaggacataattgaaagaagtgtataacttttttttatgtcattctgaatttctggtttatacacattcgaacttagagaaggaacataatagttgaagttttgataatttttatcacggtttgtagcaggtaattgggaaaattgataagggtaaacatgagaggaagccagcatgcatagttgaactattgtagaactttttggtttaccaatctatgctatcctcgatgtacccttgtacgtgctcttgtttgaacatacacaaactttctctctctctctctctcaaactagaaaaggtaaggaaagcaatattccaattattaagatcattaaaaatcaccacacagaaaagtaagggtctgctgggaaggcgacgaaacccctagatgcccccaattcagtgtctgctaggacattggttccaaattgaaaaataagggtctgtttagttcagggccgtcacatcgaatatttataaatgtatggagtattaaatgtagaaaaaacccaattatacagattgcgtgtacattatgagataaatcttttaggtctaattacgccataatttgacaatgttgtgctacagtaa

SEQ ID NO: 62537 - DNA, 1383 bp, Oryza sativa
acatatgcgtagaatgagatgtaatttagcgctaaaattagtttaaaaattaataattattaagcacatggtacggcatgactctttactgtagtacatggcccaaccaaccccaagtctcttattcgcttgtgatcaaatcaactatactcacatgtggaaagcacgcttgttttctagcacaacgaactaaggaataattatttccctacgtctcaacggcaaatctaccacgatcgattctcttccaagaaaaattaactagtctaatccactagtttagccataaactttggtcctgttattttctcataaagattaagattttacctcggtttccattactactaaacggtatatttcgtgcgaaaactttctataaaaaaagttattttaaaatatcaaatatatctatttataataattaaaacttaattaataataagttcataactttttctcgttttaactttatctttatcgtcatgagtttcgaacccaaccaaaatatcaccggcctggggaagttgtatactcgtataggccaccttcggcaaccgattttcatttcccttagaggatatttttttccaaactatgccatctgtgtcgatttattaatcaaaaagaaaaaaaatcaccggccaagattactacagctaaaatgccaataggtagcttgcactttctgtatgtcaatcaaaagcatcattctgctgcattgccctgaaagcatcacacacaaacacatatatactcctactgttcttgatactggcaaaaagtcaactaatctcatcatgccaccacaaatccaccatccatacatgcactcgctcactaggccccgttcagatctcacctcaaatttttcaccatatcacatcgaacgtataaacacctacataaaatatttaatataggctaaaaaataactaattacacagattacaagtaatttacgagacgaatcttttaagcctaattgctccataatttgataatgtgatgctaccgtaaacatgtgctaataacagattaattaggcttgataaattcgtcttgctatttactaacggaatatgtaactagttttttttttattaatggccgaacaccccatacagcatcctatataatacctgatgtgacacgctaaaattttacaccgttgcatctaaacccctcactaacccccggccagcatcacctactctactctacctcaacgcaccaaccaaccgccgaaaagaaagaaagaaaagaatccgtcaagaaaaggagcgtgacgtgagaagcaaggaagcaaacggggtatgtaccgttacgatagtttgtgtgtgtgtgtgtgtgagagagagagagagaggggggggggagagg

SEQ ID NO: 62538 - DNA, 9049 bp, Oryza sativa
gatgattgacacgtatagtaccccaagtactcctacgggggcccgtgggcggccgcatcctatgcccgaattttcatcgagccaggcgtgcgggtttgtcctcgttaactaattcattaattaattactccctcagtccccttaaaagggatacttgtactgattgatcattcgtcttatttaaaaaaaattagaattatttttttttatttgtgacttactttattatctaatgtactttaagcttaacttttcgggttttatacttacacaaatttttaaaataagataagtgatcaaacagtgcaaacaaaatgtcaaaatcccttatattaagggatagagggagtagcttattatcttatttggtttcatgggctgatccaaacaggtgggctaattcattagcccatacaagaggtactaatgggctaattttctatagggacttaaaaaaagcagttatctctctcctatctctctaatctctcgccacattttagtcctgaattagcctatggttccaaacatgtcactctaagctaatgtttagcctaccgattcaagactaaacattagctctcaaaattagtcctgggctaatcttccaaatagggccaatttggatgttgtatagaggagcgcatgtgcatgccgttggttagtcgatacgttgttgaggtggtggtagtactttctcctccgtgaagacttagagcctgtttatgagagtttcgggtagtttgcagcttctctcggaattaaaaatttctcaaacagtataactttttttttatactatgagaagttctatttgtaaaatttagaaaaataaactagaaacctgaagctgtttcttcatattctcaaaagctgagtaccaaccagctgcttctcaaaatcttaagctaataaatccttaacagtgtttgagagaaggagaaagaaaaatgttgatataatacgtaaaacgagatgggtcattagcatatcattatttaagtattagttatttaaaacttaaaaatggattaatattattttttaaaacaactttcctataatttattttggaaaagtacaaattacctcccgaactattgcggtcgaccgaattaccccctaaaacccgaaaatcagacaacgttcaccccctcgacccaatctagaacagttttgtcctacgtggcgtacccgtggcagtccagttagaattctatttgtataaaagcaggactcacctgtcatactcctcttccactcttcctctctctctcgtgggtcggcggcaggtgggggacacggagcggcggcggcaggggacacggagcggcggcggcgggggacgaggaggcggcggcggcggctgcggccacgatgagcagctgtcgccttggcgcggggacggacggaggcaggggcgggcggtgggcgggcgtggacggcggacacggaggcaacatgcacagtgcgcggagaccctcctgcgccagagggagttcgccgctccctcctctgtgtcccgcgtcaactgccgccggctcctcgtaccccgcctgccgccgacccgtgagagagagaaggaagagtgagagagagaggaagagtggaagaggagtatgacaggtgggtcccacattttttaaaaaataaaatactgactgaactgccacacgtacaccatgtaggacaaaactgttctggattggatcgaggggggtaatttgcccggtattaaaagttcagggtgaacgatgtctggttttcgggtttaggagggtaattcggtcgaccgtgatagttcgggggtaatttgtactttttctttttttagaaaaaaaggcacaccgtttaacaattcggaaacgtatgcacggagaacagcagaaatctaatatgtttagccccgtttgaacctaaataagatacgtattttactgattttttgttagaatattttttaaactactaaatgctaatcttgcttgcactactagaaaaaaacattttttaggcggccaaaagcaatttttccagacggaggagaggaccggctgcagaccaacgacacgattttcgcagccagggcaatggcccgcctgcgaaaatccaatgaaaaaacaaaaaaaatggcctcgtcgccgccgccctcccctggcctccctccggccggatctgggaggggaggagaggggagccgctgacgtcgccgtccacgcgcgcgcctcgtcgcagccgccctcccccggcctccctctggccggatctgggaggagaggggaggggagctgccaacgtcgtcgtccacgccgccgccgccctcccccggcctccctccggccggatctgggaggggaggggaggggagccgtcgccgctgcaacaggagccgccgacgtcgccgccgcaacgggagccgccgacgtcgccgccgcaacgggagccgccgacgtcgccgtccacgccgccaccgtgtctgcgccaccggtggagggatggaggggaggggaggggagggggagagagctgagaagccggtggagggagagagagagagagttgagaagattagtgttgagggaaatgagtggtggggagggggttggagtagataagtatcaaagtttttttttggtaggtaccatttttgcaggcggaccacataaggttcgcctgcgaaaataggtggtccgtttgcgaaaatgattttcgcaggtgccgcttaagtggtccgtctgcgaaaatctattttcgcaggtggatagcgaacttcaccccgatttatatttttataggcgattatttggttccaagggtcatgttcgcctgtgaaaaaaaagacccccatatcaggaaaaatgttttttctaagtgtgttggcttcgatttgatctaaagaggcatgcattggagtgttatttaggccggtgagtgatatttgtttcttttgttacggtcattgatctccggggtttcttcggacttcttttttgttcgatttagaaaaatcgaatgaatgctataacaaattatatattgggatagaactatagattgtgggaggactgtttcgagggggagagggctacatagatggaacggtcgcgtggccaacagtgaacagttaatgagacaacgggttagtggtagcaccatctaagggcaagtacaaaggtagagaccggtatggtctctacgttaattagaggctattacgttacaataattaagacaatactgtctctaacattaatgcactaaaatactttcttactagtgatctttcctttattagactcaatgcaacgaaaaatttcctaataaatactaagagtcgactctatgctgttgtcatgcgtagcaaccatctttctttttccttctccctctctcttccacgtcaccaaatatgcttgcatgataataaagagagaccgctaataaagaccattgtacatgccctaagcctgcatggaagagtatagagagtaagtttgtcttctttcgaacatttccctagctaacttctatcttccgtttttacacgtacgtttcctaaattatatttgatccatttccaaagttttttaagctaatatttaattaattatacgctaatttattgttccgttttacgtgctgaagtgagggttccaaatccgtagtagcgaatgcagcttaattaaatgggggtgtgcgattggagtgagcccttttgaattggaggaaaaatataggaattttggaggattttaatcatataggaaaattttctatgaagccctttgaaacaaaggattaagtcatatctaattctttgaaattcttatggaatggacaatcctatagaggttttagaggaaatttagcaagagcttcaacctcttggtaactttcctttgagtctatctctctcatccaattcctgtgtttttcctgcggttcaatcaaacagtcatttctgtgtttttcctgcgttttgcaattctttgttttacacttacattcctatcaaaatcctatgtttttttcaatcccgcgattcaaaggggccctaagtaagaagtggaagaattacctctccctccattttatattataagattctctttaatttatctatcataagtttaatttatccacgtttgtccaagtttttatgaaaatgtagcagcatttcaacataaaatgaatatattaaaaaatatatttagtgaaatcaattcggtgttctacgtattgcaatttttttatataaagttagttaaattcaaacaagcttgactttaaactgaaaattttttcaatgtctaagtatctggacaacataatttttttctcataatatacaggcaaaccttctagaagcgtggtagtcttcacaagttcacattggggaaaaaacgaaatatggatatatatatggtatcttttgaaatattaaactaacaaccgttattatctcgcagagtacggctaaatatggagtaccgggcgtgatggaaaacggaaaaaacatactgtattttgtcttaaagacacgacaggagtataggaccatagtttcactgaatgcttatcggttttgtaatattgatgtcaatttttgatgtgacatttatctattcatcttattaaaaatataaaatattatttacttattgttaacttattttatcatcaaagaaactataaccttaacctatatttttcatatttatactgaagttttaataagacgagtaagacgaatatttaaacaattatatgaaaaattaacggtgtcgtatataagaaaaactgcggtagtatcatttataaatgtaaatccatttctttttcccttgattgcacgctagatccggttcagacagaattgattgggcaggtggcgagaggccgtactacgccacattgtcctccccctggaaaaaaaaggcaaaaggacaagaggaccaacagaaaagggtgagagagagagagcagggcactgcacggtgcacagccacagcctgcactgcagtagtgcagtttgcagcaaaggcagcaaagggcatgtttagatccatttgaaatggcaaatggtaaatggtaaaagttttattattgtaaaagtattagttggtgtttagatgtattttaaatttttgccattctagcactaaagtgagagagagaaagagatagggagtggtcccaaagcatttttttggcacaatttgctactatggactagcaaatgccaaatgtcaaattgccaagttttaatactagtgtttagatccaaaatgacaaaatgtacttcaaaatggcaaaatttttgctattttggaggatctaaacagggctaaaggctagggtagtaccaggtactggagcactgtagtgtacttcctgtagtagcccaaaggcaaaatttgctacaggacacgcaaaaaacgtgtaattagctgggagacaccgcgaaaacgtgacacggctgatggacactacaaaatttgtgtaattggctataggacactggtcgcattattttattatttccgagtcaaaacaagtgatatatttttctgaatgtctagattgccctttctctttccttccttttctcctacgccgggaacctgcgtgatgggacgaggtcggcgaggtcaccgggaacccgcgcgatgggacgaggtcggcgcaggcgcgagcttgatggcggcagcggggcggcagacggagaggcccgcctcggcgatgcgcagcgcaacggcgaggccggcggggccgctgacgacgacggcgaggtcgacgggcctagagcaggcacccggggggaggggtcgccgaccgctgccgcgcgggtggggggaggcgtcggcgagctcggcgcgagtgggcgggcatgagctcggcggcagcggggcggcagggcgagaaggcgctcggtgttctcggcgaaggcgctgagtgtccgcggcgaagacgacgactacggcgagggcgagagcagcggcgcatcgccgccaactccctctccggtagcagctcacggcgcccacctccatctcgccggacaagaggaagaccggccagctagcagctagcagcagccaagcatgcgccggcgagctcgctccaccagcaagaagatggctagctagctccttcaattcagacttgagagcttgagcaggcagcaatggcgagctccttcagacttcaggcttgagagcttgagcaggcagccaggaggcagctgcagccggtcaggggctcgatctggtctctgatttgcaagtcggagcatgcacaggcgtcctcttgtgccgacctcgccaacctcaccccactgcgcgcgatcccggcgaaggagaaaaccaaggaaagagaaggggcaatctgggcatttagaaaaatatctcacctcttttgatccgaaaataataaaataatacgacaagtgtcctatagctaattacacaatttttgtagtgtccgttagccgtatcacgttttcgcggtgtcttccagctaattacacgttttttgcgtgtcctgtagcaaattttgcctagcccaaatgccacagttttgggcctaattggaatataatcaagctgagctgccatgggccacggccactgcacgctgaacagctcagcgctttaacgtgccaggccatctgtttacagggttgttttcttaattaagtgccacatttttttctaaacaaaggcaagagatacacatgacccaagaaaaagttctcactttaaacaccataatattacaaacactaaaaacacctcaaaatcattccccaaagctacattaaacacctaaaagaaaaccaaaaaatgccacattttacccaaacatagtcaattggtttttagtcacagactacgctcatcacatttgaccctgtttagatgggactaaaacttttaagtccctatcacatcggatgtttagacactaattataaatattaaacgtagactattaataaaaactcatacataatcttagactaattcgcgagataaatctattgagcctaattaatccatgattagcctatgtgatgctacagtaaacattctctaattatggattaattaggcttaaaaaatttgtcttgcaaattagctttcatttatgtaattagttttgtaagtagtctatatttaatactttaaattagtgtctaaatatagagactaaaattaagtccctgtatccaaacaccaccttatattttttcttcttacctagccacagactccactcgccatatttaatttttccccttaccttgcctaaggtgtgaacaatagatcttggccacaccttagcaaagggttgactaggtggtgttgcattttttttaaaacaacagatgctcatataaatgtgcacgcaatcactctatccctttgagcacctttgaagattgtataagtatatcttgagattcacgaagtcacctatccctataaaaacccgggtggatagattgcaccacgaagaaactaaccaattaagttatactcacttcacgccaatatgtgttatatctttctcttgagcaaatactgttacctttttttgtttgataattcatgtgtttccatggccaaatttagggctccttggaacgcatgaatcttataagattttgacaggaaatattttagctcctcctaagtttttccaaaaaatcatatgcttcaagggaagcctcattgatcctcagtagagtcttaaaaatcaacacaacgctatatatcggggtatttaactttttgccactttgaaatgtggcaattaaagatttaccactcgcaatctatgacatgtgtgcctagtggcaaatccttaattatcacttgtaagagcggcaaatagttaattattccctatatatataaagtttgtttggtttagtagcccaccaaaataactctagagtattataaatgaatttgttcgaattgatattaattggaagccaaaatttatataatagcaaagaaagttctagaattgtttcaaactgagcatgtgcattacccatcatttggcatcaaaccaaaccatcgtatttactgctcaaactaccaaaacaattggtatgacacgttttagcattgatccaaaatgacccattgttgcctagcagtttcatccataacctccataactaactggctgccaatcaaatttgatcaaaatttatcaaacaattgaatttacttcatccatcccataaccacacaagggattaaaccttttctttttccaaaattaaggaagtagcaaagtcgtgatacaaaagtgatagttataggaatataactacaaaagttagtagatagggaataaatagtagaaaagttagaaattgaggaataaaatatcttatattttaggataaaatagaagagtaaaatattttatctcgtagaacagagagagtatgagcttaattaattttatcaagtggtttccaggtggtcgatttataaggccgataatgttcctcgctgactatactcttcatatagccccaagctagttgcatgaatcatataatactataaagttgatatttattgactcttaaaagtttaacatgcaagtgtaccacataaacccactagcaattattatctacaatattttaaatatcatgtaaacataatatatcatttacaattttattgtatttctagaactcaatatgcaagtaatatcaaatcattatatctacatcattttcacattatttaaacatatacatatctcgcaacaaagtatactaattcgaatactttgactactaatacatactgatggcatccgtggattacaccgttggtttgtcaaggaaaatacttctaatcttctatacaacattttcactcttttactattaatcttgaagtccataaatgttgcttcgagagaaaaaaataaccctgatgtccaaattaaaacaaatcagctcaccttatatctccagactcgatcacaaaactctgatggacgacgcgac

SEQ ID NO: 62539 - DNA, 617 bp, Oryza sativa
ttgtttttcttgtaaagataatcaaaaatcttatcgcacttggccacatcaaaactatatttaacctcactttgccaatctttgcgaggagtcggcattaggttggagcaaacaaaaggcttgtttttgttagtccatgaccattcagcaacatatatatcatgatcaccctcctcctcactatcgctagcctcagggtaatcaatcacattaacattaggctttttgtcatatgttctaacaagttttttattatccttgacccggctttcttgagccaaagccatttgcataagttgactaacatcaagaaattgttggccatctagtctttctctaagaggagcaattaaaccattaaaagcaagaccagccaaatctctatcagttatattcaagctataacatcggtttctaacatccctaaatctcttaatataatcaatgacaggctcattatacttttgcttaaccgatgttaaaaaaaaaaacctaagctcagtttctccagtatagaaataatcatgaaatttttcttctaattgagcccaagtatgaatagaatttgccggtaaagaagtaaaccatgtaaaagcattaccggacaagataaagaa

SEQ ID NO: 62540 - DNA, 1138 bp, Oryza sativa
cccggtaccaatgatccccgtactattcaaataccgtagtcgcgatctcaaacgtcgacggtattccaaggtatcatatttatttaatttcgaagggaagatttataagagagaactatgctaataatttatgtataccacttttatggtcagagtctaagtaggggttaatacattcataagggtagagtgacacgaaacaaataactcatatcttctcattaattaatcctaaactatgtggaagaagaaatagagaagcaatcaattcctttacttctagtatatactcaaccttagtttacatctgctagtatataattgtgcggccaaaaccccctaatagtgtcctcccggtgtttcaaaagaccacctggggttgccgagtttcttacaacaacctgtcgtggccgtccaaccgaggctaaatacggagtagtaccctccaaggaaagtgtcttaggaatatataataacgtggagggatacccgtactgagctgtcaccatcagcggcccactctgtcccgcagcatatatgaccagataatgatacttaataatctagataccaagcctacattattaaatactactctatattcccaggaatgacatagagcaaccaaataatcggatattaaacccacaccattgcacctctctggtatgctagctacacaactataatgatacagatataaagtaaagccgatactcagacaaattaaagtaccgagagtatataaagaataatatttcattaattctggaagtcttacaaaagaaaaaagaaaagctactagagccatacctgaattcctccgaagactccgagaactccgagagctattctattctactccacttagcactagaatactaaactaaagtatagagagatcttgagcttgcttaagtgtgtctttggagtgaatgaggtctcctccttttataggcaggtaaatgacggatacactatgcgaattgtccaactaccctgcaaccgtcattgaggagcgatcaggagcgtccacgtggaaggccaggatgagaggagcttgccagggtttggccgaacccctggttcagtcgacctggcccggcccagcaggcctccaaacttctctggggcactg

SEQ ID NO: 62541 - DNA, 6688 bp, Oryza sativa
tgcggagaggatgaaacgagggagccacctgctaaaatgggccgactcggcccagcccatgattcggtcgaacccgccgtcgcgccgtttgatccagggttttgatggacggctgagatttgctccctatgatggttggagggtattaccgaccattccaaccgtcggaaccgccattctcaactataaaaggccttcatgtcgtcactttctacacacacctcaagcaaaaagcttcatacatctctcaggtttagtatagtttctagagtacagtggaatagaaatagaatagaatcttcagtcctcggagtcttcagaagaattcgggtatggctctagtagcttttccttcttttgtaagacttgtactttatttagaatattcttcttaatactactctggtattgtattactttccgagtatatgaataccaactttactatatatccgagttatatttattatgatgctagcttatctgggaaatgcaatggtgtgggtataatgagcgtgtatacgatgactctatgtcatgacgatgatattagagtagtatttggtaatttaagcgtggtgtttagattaccggatatcattatttggcgttatatgctgcggaagcgatgtgggccgctaatggtgacagctcagtatgggtatttctccgcgcgtgtatatagtccaaagttaatttcctgtggagggtactcctccgtatttagcccccgttggatggtcatgacggattgtcgcaaggaactcgacaatcagggggtggcttctcgaagcaccagagggcattggaaagagggtaattatataactaggatgtatgtatattatatatgtatactagaagtataggaatatgatctttctactttctttccacttagcttagataattatgaatgagagtataaatgcttctgcttagtgtcgctctactcttttgattatattaacccctgcctagactttggttattgcaagtaacatataaattattagtatggctctctctcttataatcttcccacgggattaaaaaaaatacgataaacttgaaatactctcgggtaaaatgctacaatggtatatccgtgcgcttgcgaatgaactctgtaaccataatataccagaaatatttctgcgctattgctgtgaattatatttctagtaatatcattaagaaataccaacacaagcatagctagttctcctttatgttagttatatcaacggtcgaaattggtttataacgaccatcaacaaagcccccaagcttgaacctttgctcgtcccgagtgaaggactcacaaaaaataaacttggttgttgatcaggagttgctactatgttatatatctagaatgtacaggtgcaaagtttgagtactctctcgtattaagcaagtaggcacggtggcttatccatacacccaattataacacatgcttctctttgccttgggcggttggaagacacaacagatcatagagtaacattatctcttcctttgtctaattcttattccggaggttttcaaatggttttgcaaataaaaatcaagtttctcaaatgattctctcgatcactcaatgtgtataaatattattcctcaccaaaattatgcatttgtgactcctacactaaagccgaatatgtgtagtttggaaggatcaagaatgagcatacttacaatcacatttatcactaagtcaaaaatctagactaaaacagataacaaatcatccttaagatcaatcacatttatcttcgtgtgcggttggatagctcgcacgtgaagatggtgatcttcacaggcacatggggttagatgggtcggccaaccatacgtgaaaaccctcgtcggccgtctagaaaaaccctttctcattgaagtcttagggtctttttggttgattccttgaggaaaaattgcatggcctgagacaaccctgggattaacttgcaagttgtttggttgccacctgagacccatccaccctcgcctggcctgatactgataccatccggctcgagattagcatgcgtcgcctgagcttcaggcgcggggcggccatcataatctccatcgttgacaggctgcaagaagctaaccactgccatgctgacgccataacaagctgttgcgtaaagctgtgaagctgcctccgccaccatcgtgcgaagccaccgccgccgcagcgtgttgccgccttgtccgacccagcaagcgcgaagccgttccgaggattccgactcgatcgtcggatcccgtcgtttttgggatctatttccaatcctgatggacggatttgggatctatttccttctgttctttgcttttctgtccttgatggcttgatgcatgcgaacaatttgtctccagaaagctggacagatgaattttagttgtgcggcgaagcaattgtgctaatatttgtatctggacattaacatatgagttcgcagtaattatgtgaggactaattgcagttttttctcccaggccatagtagccaacgaatcaagtaaagtcgtaggatacctgtatagaccaaaaggcacacggggcctgacggcccagcccatggcatggggtttcggcccggcccaaacacaacacggtctgactggtgttgggcccatgctagcctgacatgtccttcgggccgtgtctgggcctctgcctcggcacgatggaccggcccggcacggcctggtccaacaattagggaggcaaaatagatgagggagacaaaatagacttgttacaaccatataaggcacaaccaaaagagatgaagaatgcaagatagacttattccatccatcttctcaaagagatgagggagaaaaaatatactttatctaagaaggagcaaacgagcttttgtgtcttctggccagcttggcccagcccggcgtataggttgggccatgctagtccgactgatctcgggcctaagcccaatcgtgctgggccaagtggcccatttggccatctatagctgcctgactagataaaattcatctactgcatatgtgcttagcatgcatgcaaatttctatttctcagatatggtgctcaggggcaccaaccaaatacacttgaactctttctgaattataatacaataagtaattaatcgcttcattccatattgatcatcgtatatagtttttatcaagacccaaaaaattttaactaccatatattttatttaatgtgagtatgtggtggaaaagaaccaagaaacatgtaaaatttaactccccgcatacacaataatcgagcctttgactaccttaaatgtgtacatgcatgcatgcgtaatcaatttgatgcacatatacaataaaccctacaattataatcatgcacattaaaggagggtgtgatcaattttttttttggctatatgatgatgaatattccctccgtttttaaatatttgacgccgttgacttttttaaatatgtttgactttttttcgtcttattcaaaaaaaattaaataattattaattcttttcctatcatttgattcattgttaaatatactcatatagttttacatatttcataaaagtttttgaataaaacgaaaggtcaaacatgtacttaaaaaatcaacgttgtcaaatactcctatttagaaacggagggagtatataatagatagagtataaaattatctctacatgtcacttaattattggatgtcttatatgtccatctataaattgattgatcctttaacttttgttacttaccattgatattttctattatttcgatatgcatcactaattagttaaaagccataatcgtagtcgaaagttgacggtgactgggtgacagcattaatcaaaatgctaagatctgccccaggtttcgcaacagcttttgcacacaggatttcatagcttttttgcatcaccccatcctctcgttcattcaataatctactgacacgatacaactagtgtaagattaaacacacatttgtaactatatactagtgcatacagccatagttactagtgctagtaccagttggttcgtgcaaaccggccagcggcgccggcgcccgcgccacccgcgggcgcgtttcggcgccgtacgcgacagcgacacgccctgcaggtaaccggcttataccaggccggcgcgcgccgccaaagctgttaagcggtaaaaattaagaaatatcttcttctaagctactcaagctagctaaactaaagcaaaggcaggcaaagactaattaatcacgacgagttagtaattaaccagcaatcttacatggactagaggcaaattaatttaaataagagtaaagacagcgtcacataccctttggtagtttggttacctcggaggactgtgacagctagggatgatcgatcgatcgacacatatgatactgacagcgaacgccggcgacgacaccgtctattgctagctatagctggtggtaataatatcaccatcttggttaactagtccaattattattactccctctgtctcataataagtgtagttttatactattcacattcaacgtttgaccgttcgttttatttaaaatatttttatgattagtatttttattgctattagatgataaaatataaatagtactttatatgtgactaaatattttcaatttttttataaatttttcaaataagacggacggtcaaacgttgggcgcagatatccacggctacacttattttgggacggaggtagtattaatctataatagtaactcaaaaccgacttgttaattaagaggagagtttcaatattgtgcgccacccaacacggtcgtggaaacggaagagtgttgagagaatcatgaaagcttgtattattctccataatatgatagttgaaaatgagagaggggggttaaaattcctattgatctgaatgtggaccctggagcatcggttgctcttcctcctgaagtaactactgggcacaatccatgctttgatcaggtgctgtgtaggaaaactgcaatacatgctcgtgcaccacattcccaactaaaaaaagatctagttgaacatatttggcaaaagtttagcaatacccgtcgtacttagttgtggtaggacattaagcatcttgttttcacattttcaattacaattgcaagcatcttaattcacttatcattttatttatttatttcagggacaatggaaaactttggtggtagctttttggtgctttctgctatggttttgggaggtatgtacatgtctacttgcactgtacagtccaaagaacaacataatcaaataagtcctttaatagtccttttgtttctacttaaaatagtagtactacttccttccagttgttttgccatccagattatatgctacaattgttctataatcatcagcctcctattttccatggaaataatgttgctttaatgacaggtagtgaagatgctcaatttggcaggctagcagcttgttttggctgcttgagaaagataatctagttataaagtaatttttagtaattcgctggtgtcatgtaagaacaattgtgttgttaccatctattggcagtatggatcgttgtaatggcctaatttcttttatcgaatgttgatgtatggatcattgcaacagactaagttattttgtcggtctatgaattagttatttgtcaatctgtgaatattctttcgatcaagtaacaatctgaatcactattgtactgtttagttcgaatgaattagttcgaatgaattaggaatattacaccattgttgttgataaatccgtctgctttgtgataaatcacatggtttatttttttattgattgaacatagtcttccgtctatggttgacatataagtggctactcaagtgatgtttacagttgatcctacataacttgaaagatacaattagagaattaaatgcagcttgctttgctagagacggcttagagcatgtactatcttattgtaaatgtcgtctgttaaaccatctatagatgatgtggaggatactaatagtaagatgtttactctattattacccttgccctaattagtagtagaacttaattaaccgtctttgtcagcgatcgattcgcacgtcgcgtcgcgggggcatgtggcccgcatgcggtgtgcggatagatgtgagtcgacgcccacgtcacccccgccccgcctgatgacccgcacgcagcgcaggctagctagagcttatccgtagtgcctgcctgcatcagtggcgacggcgagagagacagagatccaactgcgtgacttgtctcgtctcgtctcaccgccgctggagcgccaaaccgcggctctttgctctacgcatatgcgcccttttgtacggatatagatttcatcctggttgtttacatatcgtttaaatagttattaaaaaatcttaaaaaattgacaacatagattgatatgaaatatattactccacaaacatgcaagaccaaatttaacttctataagttgcaacaaaaataaaaaattaaactgtaaatagctatagtacatttgcatctatatttgttaattttattacaaattgtacaagtaaaattttagcttgcatgtttgtagagtgatatatttcatggtaacctatctttttatttttt

SEQ ID NO: 62542 - DNA, 13422 bp, Oryza sativa
ccccccccccccccggccgcgctgtggaatgaaagcatactgctcgactacctggtgaaatagctcttcaaatctacaagcaaaattacagacatgtgaatcaatgacaaattgtgcattatacttttacaaattgcaatgttttcacttatcatttgtcaaatactcaagaaatgttacacttttatgatgccaaagccttttctttcccctatctatccatttgtgctgaatcgtttcacttcaaaaaaatttgtgttgaatcgggctagttactttgctgccttgcccttgctaactcgttggtgttgctgcctgctcggcttagagctgggctgttgcgcgcaggcgcgcaaccgtgtaggccaggtggcactgcggcactaggagcatgcgagcaccgccgcgccggtctgcagtctgcagaggctcgccgcctagcctggacgccgcgcccacaccgtccacggctacactcaattcgacgcgattggggttttggaatggggaactttcgaccaatggccggcgttgtgggcggcgctgccggggtcgccgggggcggggagcagcggtggtggtgggcacgagtgcggcttcaagaacctgttcatcggggactccggcgtcggcaagagccgccgaccccgctccatcggccggagagagattagggagagagaggatagagagtatccacatgggcccaccattttttacttatttgtgtgtgaaactaacatgtgggtcccacgtattttatttttttccgatctaattgctacataagcaccacgtcaacgatacgttggacaaagacctggtcaaaaggagctatgtaggcgccatctcagccaaaaacgggtacaataccaccgagggactttatttaaacggtttcgttaggttgggggacccatcgtaccggttttgtgaataggggatgaaaatcggatttggcgacaaatagagggacccaaagtgaacttattcctcctttttattttcggaaggaataggtccattttgactcccttaactatagcttaaatctgattcatatccctaaaccgtaataccggatatcttgaccttaactgttaaaaccggtgcaatttgactcccttgatgattctagagagcagtttcgctgatgtgatgcttagacttgtctaacctgctaagtcattatgtagggcccacacatcagtgtcacagtctatcttttccattactttccctctcctttcagcacccaagatggcttcgtccacggtagaggtggccaaacgggcggcccggcccggcacggcacgggcacgggtccggcacggcccgtttcggcacggcctgttaggcacggctcatgaaacgggccgtgccgtcccgacccacgtgccgagccgccggcccaagcacggcccgtggatggccgggccgtgcccgtgccggcacggcatgcgtgtggcccgccgtgtcagttgtcacgcccggaaattcactagtaatttccgaactaatttgtgcataaaatcctcgtccaggaatcagccgaggtacacaaactgacaatttaatatacaaatccatcttaataataacgttacatacttacaaagaaaagaaaacaacagcggaattaacggtctagcgatggcttcagctccactcccacaggcagctcaactggggtataagccaaacgtcttctccttctggatcctttatcttcaactgaggtttgatgattattgcaagaatgagcatatgacatactcaacaagccacacagcaaatatgcaagtgcacaaggattccaaaggatggcataatataggctcatttgcaaaagcagcatttagcaaaacatttaagagaagtaaaacagtgaagtgattaatcatcaattttaatcaacactgaacagcacacccatgctgcacaggcccaaccatcctgaacaaccatacccggctgtacagatctaactccaaaccaggagctaagcaaattattaccagttatagcatccataattattgtgagaggtgtgagactaatcacgaaaaacattgctcaactcgcccataaccgcgggcacggctattcgaatagttttactctgatcagaggtgtaccactgtacccacaagacacgattccacacatgttgccatgccccgaaataccaccacggcattgcaaagggggaaatcgtgacaataccctttgcacaacacaactcaaaacagtgcaccgttcctggatcataatcacccccttataaacaaggcatggactccccagcgacccccacggacttctcgccgcttctcagtctggtgccccgtaatgaatcatgctatacaaaaggtaaagccgttgcccatgctggcttgtggttggcacggtaaatgtttcacaacagtagctcgcgaaccggtccttaattgtcatgagcacaaccatcaaaaccatatgctcacaacccaccttaaccagattttaagtatcaattaattaacatcacacgattaaccatcgtgagctaccattaaatataaccataattaataagaataatataatataatttatatttaatcccctttaattagctaatgtttctaagcatggctaagcaaacatacatataacatttagctgaaccaaaccaatatataaggttcatgctaatcaaattataacccataggaaaataagatcatcttcggccattaattaacggggaaaggttcaccacccgatgacattcaaaaataatgcatagttgaaataaaataatagctttaaacgggttcaacatgctcaaaggattgtgtttaggatctgtgtgacttgccttgcaataatcgatcttcaattaatcttcttgatcacttccgacgcactcacgaaccttcgcaacgacggaaacgacaagctaacacgcaaaacgaagaaaaaaaactaataaaaaccaaataaacaatacatataaagtaaacaaacatgtagatcatgattttagatgaattatgagacttgaacagccttattctgacttcaaatgaatttattatgaattttacaagattaaatctaattaaagcccatttaaaaagaattaaataaatttaattcaatttatggacaattttaatatgtagatctttattttagaaaaatttagcaactggaaccacctgaaacggatctacagttatttagttatgattttccgaagatttaatctattagaaaaaaaggaaaaaaggaaggatgatgatgtcatgctgacatcatccaaggcagccacaggtcggccgacgacctcgccggcgctatggaccttggccgggcgattggagggcacctacgcgtagaggacgacgaggcgaacccaacggtactcaccaaaacgacaaacgacgcacgacgacggccggcgacgaagaggacggcggcggcggctcggcttgacggcgacggcggagctccggtggccggcggcgaaggggaaggtgcggccgaggttctcctcaccacggcgcacctaacggcagcggcggcaagcggcggcgacggctagggcgacggcgcggcgcgactggagatcgccggcgacggctagcggctagggcaacgtggcggcagcgctacgggcgacgagggagctcgggacttggggcaaacggaagaggacgactaggggatgctatttatagcattggattgaagagatcgaactccaaacgagaggaatcgatccgagaaaatcaaaactcggtttttgagataaactcgaaaacgaatttgattcggataaaatacacaacgatttgctccaaatattgagggaaaagatagaggagaacgagaggataaaatcccctcaaaaacctggaggaatcggggtcggattgaggcgaatttgagaggggaaagaaggcggctaggactcggctcgggcacggcttcggccggaggttgaagaaaggcctgacatgtgggccccacatgtcagtgtcccacgagagagagagcggcggcgacagctgggccgacttgggccggcttgcccgcgggagagagagagtattaggccgaaatcggcccaataacctaaaggaggggtttttgaactttttcaattaaaataatttatgaaatgttgtttcatttattaaaaatactttccttgctcaaacaattcccagaaaaatctagaaaatagaggaacaagcaaagtatttaataaaattttatctaacccaattttatattgagatttagcaaattaaaattagatcttctcttttaagcttttaaaattgtttctaataattccttttaaacaacaatttataatttaaggatttttaaacaagaaaaactcttaacaattataattagatcatttaatgattaatttaatattcaaataattgctgaacttctctttgtatgattaaaattaataattgagctccgaaaaatccgagaaaattccagagagtataattaaccatggagaatttaataaaaattaaatccatccatgctttatatttaggaaattttatttcctacatttaacttcacttgtaaattattgaacatttaatataaattctattaataatttattaaataatttataaatcctgaaacggaattcaggctgtgacatcagtacgggcccgtgaatgaaaaatgggccgtggacggggcacggttggcccaggaaccgaaatggcgcggagggatgcgatgcggacttgcggaggtggctggcgggctgggccatcagctaggaggggtgctcaacggacttgcggaggcggctagcgggctgggccgtcagttgggagggatgagatacggacttgcggaaggatgagatgcggacttactacagtagccgtgccgtgccgtgccggcccgcgggctcggccggcggcccaagcacggcacggctactcgtgccgtgccggcacggcccgttactgtagcaggccgtgccgggccgtgccggctacaggttccgccgtgcctcgggccgcccgttttggcccggcccgtttggccacctctagtccacggtgacatctctatctctactactgcaattctgcatttctactagtaatatataaagtactagtttcatcaacaatcctgcaatctgatccactttatcgtgtgggacccaaagtgaacttattcctcctttttattttcggaaggaacaggtccattttgactcccttaactaaacaccgaaaaaaatagcacgtcgccaccgctccgccctccccacgccaccgctcgccctccccaagccgtgtctccgccgcccgcccgcctcaccagccacgtcgccgcgccgcccgcctcacccgccgcactcccctctcccctctcccctctcgtcgtcccactcaactcaccgcagtcccctctcccctctccctcgcgtcgcctgcctcccctcaccgctgcctcaggatctcctccgcgccgcctcctcgctcctgtaacgccgctgcgcgtgacctctcgccgaagatcgcgtactcctgccgctgccggcgctgcgaacatcctccgtaagctccatcacccctgtcatcctcgctggtcgccatgcccaattcaatcgcgtatccaatacaatccctaatttcacatcgcaccatgtcccatcgtcgttcccatcgccattccgctcctccgatgcagccgtcgacctccgcgccccggtcgccctcacttgcaacacccgcccctgctgttgttgccgctgtcactgtagacgtctttgctccctggtggcgtcgtcgagccctgacgccacccgcaacagacgacgccactggcaacacagctgccgtggccggcaacgtagctgctgctggaaccgctcgcttccttgagacgctcatcgagagagccgactgccggtgcggcacttcgacattatgctctaccacaacgctacagagtaccgatcaggttcagcacattattaggtttcctcgcgtttaacttcacacgtgcttctgttccttctggtgtttgttcccacaaaatgcatgtggcatggatgatgctggatggaatgctcaattgattattcgatacagtatcatttgttgcaatttttagatcttctaattaactagcgcaacatcaacagattctggttcctctttctttattttctgcttcccatttatatttatgtttgttaaaagaaattcagcactaaagtattaaatgttcacccaagttatgtcagggtgattacccaaattaacttaccatttgtctgtgatatcaggcttgttaacgacattgtctttgtgcaggaatgcccgtttattgaaaagctatggtatgttagctacattttaaacgaacaggatatgattatctgagctttgtccagctccagtatctgaagatgggatgttcagtttgtaatcatagaactcacgcgcaacaatcttgcagtggaatccaatgattcacaggttagaatgagagagggatggaattggaattgtcaaagatttctcatacacctatgtcgaagccctttcctctttccttctttctatttaacaagggaatgatcttgtcacagaatactgcaacggtttgatcagcgataagcaggtgataaatgttggtgattgacttatgcccaggttacccaccttgattttgtgcctaccttgaaacatgaagcctcgctatgattgttcaccattccagcttaccagctatattgaaatatcaatctattctgtaagttgcctttaccaattaattattactctttgttgataatgttcagtgccactgagcttgttcttgctttcaaatatggtgctgctctcatgaatattgataaggtcttccatctcttcatggtagttttgtatgtttgtgcaggtcttccagattacacatagttcattatgcttgggacataataatacagtagttgatataaatgtgcagaaaaaactgaaagaaatttcggactgcttaatattttgatgtgagtggatcactggtgcatattggagtgactgaacaatgattctcattggtaatgtttttctcctaccttctacttcattcggtttctcatattcctttcttacgaattatatacctccgtatttaaacgacgttttatatattttttctgtaaatattaaatgataattgctcattttcattttttttcgtggtagtacactatgagaattttccgaaatactatgtcctgctacatggttgctgaatacattcaagggcattgcactgtcttttgatgaagctccaaatcaaattcacatcttaatgcaatcaattatcaggtaatcatgtagttccttggcaagatcacattggtaggtaagttaaggtttgcaactgtggttgatgtcagcaggtcttgctatttttcttttaatttagtttcagtcctctaatgtttttatcttgcacctgtcacttgctaaaattttattcagtttatatccctttagaattttcaaacttaatgtgcctttcagttttttaggcagaaatactaagttgtatttatataacaaaatttgatggaaaccatcattatggtgatttcgcatagtgcactatgaacatgtcagcatgtgatttcaggaaagtcagttgatgtgttttcctcagagaaatattcctgttctcaagtctttcataccaacatgtagtggtcattctctcatttgagagaatccattatataccactgactttgtcacacgtctacgatttgccactgactttatcatgttctacaatatgccatcgacttttggatctataatcaaacagtacattttcatcgttacctgaagatcatctgttacagctattatcccccaacaataaagaacatgcggttgtttgcgatgctatgttaggtgcaattttttagtgtctttaattaaaaaagaatgagtttacgtgtgtactgtgttcatcacataaatggtttctcaaattaatatctgcacttggcctctttgcataccaaactttatatttctctataagtactccagtagtctacaaacttttgttatcttggattaacttattttgtttcgatatgcaagtcatataattaatcttcttgtagcagtgaaatggtccaaccccttcctcttttgatatgggttttcagctgctacttttcttctttttgcaggaattttatttgcaaattaagcactcaattcacttccctcaaattgattcacaaacttacacccgcgcttttaaatctgtgcagttcattcatctatgcaaacataaattatttaatgttataatttactactgttattctctgtcccatgttaaaccaaaaaccatgtctaccattgaagcaattactgtaacaagttcattttgccagctgaatctacccagccacttttgctgtagctccaaccaaaataaggtggctttatggtctctgtgtgccatacaacttttatatattaatttaaatttagttttacatggtctgaacttggccttgcattgcttaagaacttggttgacaacagtctgaaattggcgttgcattatatgccaacctgtgtagtgtaatgtattgtttctattcagaacataaacatgcatattttccctgtgaaccattgattatgtactgagttaattcctgacagccttttgaaacgtggagtgttttttttaggttttgttgttgtttgattgccaaatgtttataatttcagtacaaatttcctgggagcaaaaaattgccaatcacatctcatgttatgtgctcaaaagaaacaaaacaatagatgtctgaacgtgcctctcattttctttatttggagtcttattttctgccgtgctgatgacaaattctttatatatacctctcattttctgtatttggagtcttatcttgtccttgcaatatgtgtgaaaaatagatgtctgaacatctgccagattagtgtttgaacatttcttatattattttctgagcatttgacatattagtttatgacttgttcttatgatgtacgagtatctgaatttagaatctgaacttgggcaagcatctaaatgttgttcaatgttttagtttgctgtgagctaattaatgttatgaatttcttatagctcaagtattggaagtttacaaattcaccggtcgatgtaaggtttttctgggtttagtgtaaacaatatactcatattaccattcaaggttatctgaacgtgaatatgtaatgtatctgaattcagtgtgcggacatactcttgccatgtttcttaagtcagtgtatgaatatgctcttgcaagcactatttttccctgtatttttattgttaaaatatatattataaaaacgtgctatgcacgtgcactattactagttagagaagacgaccacaatccgtggcgacgacgttgtcgccgccggcgccgatgcggcatggacagagcagcgacattgaaatcttctctcctggagggaggaagtgcggcgacggtggcgcgaagtggtgctgcgatcgcaagtacgagcttgtcagctacgagcctacgacgcgctcccggccttcctcaagcacaacgagttcatcatcgactactaccgcagcgagtggcccatcaagcaggcgctcctcagcgccttagtcgtccacaacgagaccatcttccagacgtaattaagcactcgatcgatcaaaagcacgtatattagctaaagacgatactctaccagtagagaaactatcttttatcggtcgaccaaattccataatagttcttgttgcaataaaaaccaggactaaaaaacatctttagtcccgattcaaaaggttagagctacttttaatctttaatcctagttcaaaaaaggtaggcggtgtcagacccctcctttacctttaatcccggttggactaaagagctatttctagttccggttgttaaacaaccaggaaaaaaaagatccgcatgcgcggagaggatgaggcgtgcgcgcaacatcgaggaggaggaggaggcgcacgggataagttaataagttctatctcctcctccctcacctttatctcctctcctcactcaccccatctcttcctcttcctcctctggatccgcccccctcccctctcctccccacttctcaggaagcggaggcggcctcgcgcagtggcggcggcctcgtgtggaggaccgcgcccggtggcggcttgcgcggaaggccacgcggcggcaggcggtggaggctggcgcggctgcacggattttttttttcttttttctttctttgtgttgaatgattcgatctgtgttgtctgtgttgaatgtatgattcgatctgtgttgagaatgaactatgttgttatgaatgttgttgtgaatgatttgggaggaactatgttgttgtgaatgatttgggatgacctatgttgctgtgaatgatttgggataatggacgtgaggtatacaaaatagcaaaaaaaaaagagaaaaaaaactttactaccaaccgggactaaagatctttagtcccgggtatttgaaccgggacaacgatctttagtccggatttgtactactagttggaaaaccgggactagggtaccaatcgggagtacaaatcatttcttcaccagtaacagtacaggttgtgtgttttgattgacaagtgtgcttttctttttgctgtatcttggcaggcgatcggcttcttcatgttcatcgcgctcaccgtgtgcaccgccacgatggttccatggaatcctccatgtctgctagcttggtgacgtccaagacgatggccaacaactccgccaacccaatggtatttgatgatgatgattgatgagctacggcagcaccggggcggtcgcggcggtgcaggctctaagcaacgtgcccgtcgaatcagagctcgcggcggcggcgtgccaccaggtcgcgcattggccggagcggtagatgcaggggaagttcgacctcaccggccaaagccaccagctaatccacgttattgtcatcgccggagtggtctacttcagctggagggacagggcactgggcagacgagcacacggtgacggttccgacgagaggatggttggggggggggggactgttagtgatatgtcctagaggtaatcatagagatgattgtatcacatactatgtttacatatttatccgacattgttccttgaaatagataactccttattggttaatgaatatgtgattctttcatgagactctttatcttgtttgttactatttctaaaggatccctgatcaaatatcataagtggaacaaatatgtttatatgatcagcacatgtattaattgatgatcatgtctcatggatcatggtatagagatatcaaattaataatgtggacacatgttggtgaacatgttgttggatagacccaacatgagacattgcaagagccatatgtgttgtgtcatcagtgatctcatttagtgttggtgttgaatccttagacctgatattatcatggttctcaacatgtgtagtagtttacttagggaccgctaaacgctactccgtaaatgggtagctataaaagtagttttcgggtatgctataaaacatgtagtgggatatgaataatcaagatgggatttgcccctcctatggagagatatcaataggttcgagtgaatgattgagctattagaggatggtacatatctagccttgagcttaatcgatatcgtgaggcaaatggcttcatacaagtatacactagaggttcagccgatatgatctttatgtatgcccggtgggtcaatacgttctactaggggccgctgttgacgcgtggaccgaaaaggagttttcgggttacagccgagtatatatgaacctacagggtcgcacgcttaatgggccggaataaggggattggatagagatccaatatgagcttaattcggatagggatccaaataggagtcctacgggccttggaggcccgagtgatggatcctatatattcgcgaggggtgtgaccagcgaaggcattgcatcacgtgagaaaccctagccgtcacttccctccccgagcaaaaccctagccgcgcgcgggtgctagcacatctgcgcgtggcgttccgtccctgtacgtgtgtataccggtagaggcgccactggtttgcggtgctgatcggcgtgggagtacaacgaggagaacgcacgaggaggagaaggtcgagccggtgcgatcgactacttcctctacatcgacgcgcgctacttcgcgagagttccttcgacttctcagcgtcttcttccgctgcgcagcgcgtcgagtggtaacgatctatgatctaatacttgcatggttcctggtttacgcgatagaaaattttgatttatgctatcgtagcctacgcgtatcacaacagggacggtcgacggcttccgcgggctagtgcacgccaccctgccctgacgtgccgcccgtgtcgcctccgctgcgtgttgtgtaggcacgacgctgacgggattggaggcgacgcacgtccttcgccggatccgcaagtgcctggctactctcggttccaagctgcgccctccggctactgccacctgtcgcttgcccctgcatcaacacccatcccccagccccctctcggacgccgatggcaacctccgccgcccagtaccatcgtccttctgccgcctcgccgccgctagaggaaatatagaggagaggagcagaggaaacaaccacttacatacgggccccacagattgtttggttctaaggggattgaagaggattggagagaatagagagggaataattccacacacaataggtgtggaataaatcccctccaatccctccctcacggggattaactgaacaaggtatggggagtcaaattacaccggctttaatagctgagggatgaagatatatggtactgtggtaaagggatatgaaggtatagttgagggagtaaaagtggacttatatcccttttcggaatcgctataaatcttttgtttttttgggctgttgatctatcccgagatttgtgcgtagatagattgggaaaaaattaactgagatggcatgggctggggtatctatcgatcccgcgtcctctgcttctccactgaaccctcatcattattgggctaactagttttatagttagtacaccatgtagctatataagttagtgtaattataccgtaactacaatgtaactatattctaatttttatataacttagatataaagttgtatatatttttaatacttatatataagtatatatagg

SEQ ID NO: 62543 - DNA, 1698 bp, Oryza sativa
gaacaaattaataattcagtacggtgctgtatgaatttttatttaataatggatacttcatactgcatgcaagataacagagttctccacatagtacatatatagtcctcatcgatttgtgattccagcattgtcttaatatgcacgtacggtatatggccgaggcgccccatttccagtcgcagttctggaccaaataacaaataacaacaggtatgaactagttaattcactctaacttgatagtatatattaatgatcgcaaacgaagaacacatctgatttaacatgcatatccatcgacaaacagccattttatatatcacatgcgaaataatataattaagcggcccagcttgctgaattaattccaagcggaaaaaaatcgatcgacaaaccgatcgatcgattggtacgtgaaaatgcatgcctagctacatgcatgcatggatgagagtgagagagagagagagagagcgctgatcgagcaaagtagcgtcttggcaagcagtacaccagcacaccaccgatcgatctcttgatcacctgcaaaatgttcagaatagtagctagttagtgtcagagtaacggttcaactgaacaattgaacatgtatgaatgcgtgcatccactggtgcatgcagcagtctagctagtgagcataataatgtagtatgtatactactaccactagacatatacaggatgcagctgcatgctaatctgccgcattatcgagtccaccactacatggacaattggacatgggttaattagctttcaccatatattgatgaagtaattgaactagcacaccggtgctgtcagctgatggtcgatcgagattaagtaagggttaatttggttggcggcagcggtcgatgtcgtggggtcgtgcatgcagttatcacatccatccattgatcctaagtgcgccccaagtcacgtatcagcgccgcctgcggtctccctcctagtacacagatactcctcctctgtaaacaaaaaaaaataaaaaaaaatcgacttcttgcagggcggtcggttacttgacggcgttggctggctggctggctggctgccaccacctactcctagactcgtgttgtagtgtgtgtatatatacgtgccactgccccgtcgagcgagctcggaaagctgaaagctagctgagactgagtgccagtatcaagcagaaggaagctaatttaagagaagatcagagtgaaccatcgtcatcaatggcgccggccgctcatcgggatggcgcggcggaggcggtggggcagagggtgttccacttcggcaagggccggagcgacggcaacaagaccatgaaagacctggtgcgtgcatatatgtactacttcattcatcatgtactggtaatttgtatatgaacatatatatgtaaattgcatggataaaattggatgtgcagctgggagggaagggggcgaacttggcggagatggcgagcatcgggctgtcggtgccgccggggttcacggtgtcgacggaggcgtgccagcagtaccaggcgcagaaagcgatgccggcggggctgtgggacgagatcctggcggcgctcacctgggtggagggcaacatgggcgccgtcctcggcgacccgcgccgcccgctcctcctctccgtccgctccggcgccgccgtctccatgcccggcatgatggacac

SEQ ID NO: 62544 - DNA, 3348 bp, Oryza sativa
aatatttgtagaagttgagaactctgtttttagagggaaacaaatataaaaagagtacgcccagtatttgtgggccaaaactaggtgatagccggcccagcccatcctggcccattaatttattgccttgtccagttctcctcccttctccagttgttcttgttcccttctccttttgctcggaaaatttccttctcattttctcttcatgtccgatttttttcgcggcctctcgattgccacaactccggcgagcgagccggccgcctggcgcgacctccttggctgtgtcaccggaggggcaatgtgtcgctctggaggaggaggggcggtcggggcagcagcaccttgtccatgggggtggcatccccggacatggcgaaccgcgtgcgctgaaccggcgtacggcggcggcgcgacgcatttggggccacgcccgaggtccttctgttctttcttagccagatctttctactgctgtaattctacatttctattttgggggtttgatttaattttcatgttggaaaactatgaaaaactggcataaataaataatctagtttagtttagttttcgataatgaaacattctgtacaatttgtgagttacttcgtatgctcgctaatatgaatattgataaaatttgtttcgcaattttattttgtaccaaattcaatattttgatactaaaaggttatcttattaggttatggacataccgcattcactatttgaggagaaaattgaagccatgaaagcagctttaggtttgaggaatgacaccgagttgactgccagggatttgaaagaacttgttgctcaatataagaatgtttatgtggaggccaaaggtgaagaatttccctcaggtacgtatattcatatatatacacaatcaaagttaaattttatcatccgttttatttggtgatgcttgtatcttgaaagcagatgtatctgattttctttttcttctaaataaatgtagatccaaagaagcagctgcatttatctgtgttggctgttttcaactcatgggacagcgcaagggcaaagaagtacagaagcattaaccagatcactgggttaaagggtactgctgtgaatgttcagtgcatggtctttggcaacatgggtgacacttcaggcactggtgttctctttactaggaaccctagtactggagagagaaaactttatggtgaattccttgtcaatgctcaggtacaaatatacagggtaactggtccgaccccttctctgttttgcttattccttgacccctatttctagcaaacattcagtttccaaaaaaaaaaaattctggcaaacactgaagtaacaagatgggttaatcagctatcacatgatcttttcatatttatgttgttacttttagtctgattcgtcatggttactgtaaaatagggagcacatattttagattttatcctttagaatcaaaggttgcaaaaggcaaaaatgtttcgactgaatcatcttatgtatttgctgggttgatagataaatggattatgagcaattaacacaaattatttctcttgtagggtgaggatgtggttgctggaatcagaactccacaagatcttgataccatgaaggattgcatgccagagccttatgcagaactagttgagaattgcaaaatcttggaaagccactacaaagaaatgatggtacagtacatgagaatacatagttcctcttcttggccatcgtatcctagtatcttttgtatgattagagcagaatcaaaataccatgtttttaaaagttatctataatgatggatagatttgattacaaatagtttttaaaataaaaatttaattacagggagttgcctgttgtcagaactgttttcaaaattacaatgaacttattggcaatgtaactaggaagactacagaattacaacgaacttatcagaactgttttctgtgctttccatgaaacaagattggttttcatgtgactgatattatagacaagcatttttataatgagttcactgtttctcttgtaactgatttttgcttgtgctcaaattaacttattttttcatgtcatgcaggatattgagttcactgttcaagaaaatagactttggatgctgcaatgcagaacagggaagcgcacaggcaaaggtgctgtgaagattgctgtagacatggtcaatgagggactgattgaccggcgttcagcaattaagatggtggaaccacggcacttggaccagcttcttcatccccaggtacaattaactatgcaacacttgtcttatctgttgcattgcaaactttgtacactgctattttcttgagggcactctgttgccaagctttatttcagatcccatcaacaagatcgaataggactttgcaaaaagtggtggtttatattttggatgatagatcataacctattattgaatgaatgtgtaacttgttagtctatcggtatatcatgttttcatgtccctaactagaaacttgacatagcacgtgctgttgtttttttgtttcacaaacatgaagcatgtagcgagtgtatgtttatatgttttcctctaaaccaatatgagcctgaaggttgttgcatagtacttttgttacgcttcggtacgatttgtaacgacaatcaaactgatggctatctaatctgtactctttgctctgcccttgttaaactagtttgagagcccgtcgtcatatggagacaaagttattgctacaggcttgcctgcatcaccaggagctgctgtaggccagattgtcttcacagctgacgatgctgaagcatggcatgcacaaggaaaatctgtcattctggtactcacctttgatattgaatttatctccagtctaactctctatagctcaatttggaagctataagatcaacatattctcctgtcctgatcataatataacattctcctgtgtaaaaattaaggtgaggacgggcatcgggctgtcggtgccgccggggttcacggtgtcgacggaggcgtgccagcagtggacccatgtggaccacacgtcatcctcactaacctcttctctctatcctctctctccctcttctctctctccagccgacggagcggggtgggcggcggccggagcgggcgatggcggggcggagccgaggagcgaagcggcgcgccggccggcgggggagaagtcgcggcgcggcggtggccggaggggcgtggggcgccgaccgttgggagcagaggagccgcccgtggcccgcggccgtctgcgggtgcgtgccggcgtccaccttgatgttggcgttgccgttggcggggctgcagga

SEQ ID NO: 62545 - DNA, 5663 bp, Oryza sativa
tgatgatttggaagaaattgatataggtccaggtgatcgactgaggccgacatttattagtacgaatttagaaccaagttgatagagctgttgaaagaattcagagattgcttcgcttgggagtattatgaaatgcctggactcagctgatcgattgttgaacatcgtctacccatcaaaccaggggttaggccacaccaacaaccaccgagaagatgtaaagccgatacgcttgaacctgtcaaggctgagatcaaacgattgtatgatgctagttttattcgtccttgccgatatgatgaatgggtttctagtatagttcctgttatcaagaaaaacggcaaggtcagggtgtgcattgatttccgaaacttgaataaagctaccccgaaggacgagtacccaatgccggtagccgatcagctggttgatgctgcgtcagggcacaaggttttttagttttatggatggaaatgcaggatacaatcagatctttatggctgaagaagatatccataagatagcttttaggtgtcctggtgcaatcggcttgtttgaatgggttgtgatgactttcggcttaaagagtgctggggctacatatcaaagagacatgaattatatatatcatgatctaatcgactggttggttgaagtctacattggtgatgtggttgttaaatctaaagagatagaggaccacatagccgatttgagaaagatttttgagagaaccaggaaatatggcctaaagatgaacccgacaaagtgtgctttcggtgtatcggctggccagtttttgggatttcttgttcacgagaggggaatcgaggtaactcaaaggagtgttaatgcaatcaagaagattcagcctccggagagcaagacagaattgcaagagattatcggcaagataaattttgttagaaggtttatttctaatttgtctggaagattagagccttttacaccattgttgagattgaaagccgatcaacagtttacttggggggcagagcaacagaaagcgttggactgtcacaccctaaaaatcctaaatatataaatttttgtttaattggaattattagaaatgattttaaaagccttgaaaagaagatctagttttaattaataaattccaatataaaatcgggccagataaaatttcattaaatactttgcttaactctataattcctagatttttctaggatttatttgagctaaggaagtatttttaataaatggaattgcatttaatgaataatttaaattgaaaaaggtttttaaaagtctcttttgcctttgggccgaaagtcggcccaaaaccttctctctctctccccggcccaagccggcctagtccgcagccgagccgtccgctggcgcgcgcgcgtccgcccgctgacaggtggggcccacctgtcaggcctgtcgtctacctccggccagccgccgcccgaaccctagccgagccgtgccgccgtctctttccaaattcggccgcgcctttccttctccggtgaaatcaattgaggggaaatgtttcccgagatctcctctaccttttctcttttggaatcgtcggctaatttcgtttggaaatccgtggattcgagttcgattcggatcgatccctctcctccgaaccctaaactttccttcgcgtcgccggtcgccgtgggccttcgccgccacctccttgcccctttaaaaggacccccaagcccgccgctacccgccgccacccttgctttcgcctctcgccgtcggtagcgccctagcaccgtgtagcctcgcgccgccgtcgtcgccgccgctccagccgtgcgtcgccgtcgctcgggaaggccgccgtagtggtcaccgtcgcgtcgccgtcctcgtccgcccctccatcgtttctgtagaccgccggagcaccgccgtcgtcgtcaagccgatcttctccgccgccttttcctcgacgccgtcgccgtccgttgatcttccgccgccgttttggtcaccggtgagttcgccgcgtcgctccctacgtgctggtgccctccgttcgtgccgtcgcgccgtcgttcgccgacgagcttgcgcgcccgagccgccgacggtggtgacgtcaccgctgacgttatcgtcgtcgtctctcgtggtccggccgtggaccggtcgatctcggccgtccgttttggatggaaagatctcggccgttcgtttctgtgagccgccgccgtgcacccggtccaccgcaaaccctagccgctgacgcaataaacccctttttccttttcaaaaataattcattattgtgtcataattcaattaaaacccatataattgatttaatccgatttaatctttgaaaattcataaataattcatcttagctcggatttagttggttcaagtctctaaatttttctaaaattgagatctacatgttaaaaatatccacatgtactattcatgcttgtttatgtgctgttttggtgtttttgctcttttctgtttagattccgacgtttccggagagtccgttttcgcaggagaagaatttgaggagttccaaggccagcaaggcaagtcacacagatcctaaatacaatcctttgagcatgttggtcctatatttaaattctctatttatttcaactgtgcatttattttcgaatgtcactgggtggtgtgaatctattcctttgttatggcctgtttgcattgattactttaatccttgataccttgggttattataactttactagttgagctttatatattggttcagctagatattagatatgattgcttagccatgcttagaaacattagcacactattgggataacttatgactcactattatttaatgatggcttaatgatagttcacgatggtcaatcgtgattggttaattaattacttgtcaactaaaacttgataatggtgggttagtgagcacatggttttgaagagtcagtgctcatgacaattaaggtccggttcacgagttttggttgtgaaacattaaccgtgccaaccacaagccagcgtgggcaacggctttaccttttgtatagcatggttcattgcggagcaccagactgagaagtggcggagataagcccacgagggtcgctggggagtccatgccttgttcataagggggtgattatgatccaggaaaggtgcgctgtggtggattgtgttgtgcgagaggtactgtcacagctcctttccgaggtaccgtggtggtattgaggcacatggtgacatgttgtggggctgtgtcttgtgggtacagtggtacacctctggccagagtaaaactattcgaatagccgtgcctgcggttaagggcgggtctaacaatgtctttcgtgattagtctcacacttctcatcataataaaagatgctataactggtaataatttgattagctcctggtttggaatggtatattcctggtttggagatagaactgtgcagccgggatggttgttcagaatggttgggcctatgcaacagggtatgttgtatagcgttggattaatattgtttaattattacttaactgttttattaaattctgaaatgtttattaaatgttgtttatgcaaatgaaaccctactatgccatcctttgttatcctatgcacttgcatatttgttgcgtggcttgctgagtatgtcatatactcaccttgcaatcattcatcagaggaggagttctacagtgatgctgatggtgtggaggattaggtgtagccctggtcaagctgcctgtggagtggagtcgtctgcgccgtttatcttatttttttccgctgcttagatttttattgaatgagaggaactatctacctctgtaatgacattttattcgcttattaattagagtaataattgtactctattatcaatttgttattgtgtgcctcggctgattcctggacgagggttcacacacatgtaagcgtttggaattttggatagaaattccgggcgtgacaccattgttgagattagaaatttgtctggaagattagagccttttacaccattgttgagattgaaagccgatcaacagtttacttggggggcagagcaacagaaagcgttggacgatattaaggaatatcgtagctctcctccagttttgattcctccatagaaggggataccttttcagctatatctgtcagccggtaagaagtcaatcggttcgatcttgattcaggagcttgaagggaaagagagagttgtgttttatctaagtcattggctcttggatgcagaaactagatattcccccgtggagaagttatgcttgtgcttatatttttcatgtacaaggttaaggcattatctattgtccaatgaatgcactgtcatatgcaaggccgatgttgttaaatacatgttatcggctccaattttgaaaggaagggttggaaagtggatattttccttaactgagtttgatcttcagtatggatcgccgaaggcgattaaaggacaagctatagccgattttactgtagaacatcgtgatgattcaatcggctcggttgagattatgccatggactttattatttgatggatcagtatacactcatggttgtggcatcggcttggttataatttcccctcggggggcatgttttgagtttgcttatactattaaaccttatgcaaccaacaatcagctgagtatgaggcagttcttaaagggttgcagttattcaaggaagttgaagccgatgctattgaaattatgggggattctttgctagtgatcagtcaattgacacgagaatatgagtgcaagaatgatacattaatggtttataatgagaagtactgagagttgatgaaggagtttcggctagtaactctgaggcatgtatctcgagaacaaaatattgaagctaatgatttggcccaaggggcatcggggtataagccgatgatcaaagatatcagggttaaggttgctgcattaacagccgatgattggaggtatgatgtacatcaatatttacaaaatacatctcagtcggcttctcggaaattgagatataaagcgttgaagtatactttattggatgatgagctctattatcggacgattgatggaatgttgcttaagtgtttgagtgccgatcaggctaaagttgcgatcggcgaagttcatgaagggatttgtggtactcatcaatcggctcataaaatgaagtggttgcttcggcgtgcagggtatttttggccgacaatgctggaagattgtttcaggtattacaaaggatgtcaagattctcagaaatttggagcaattcagcgagcaccagcgtcggctatgaatcctttcattaaaccatggccattcagaggttggggaattgatatgatcgacatgattaatccaccatcgagtaaaggacataagtttatattggtggcgactgattatttcaccaaatgggtagaggcgattcatttgaataaggttgattctggggatgcgatacggtttgttcaagagcatataatctaccgatttggtattcctcaaaccattacaactgatcagggttcaattttcgtgcccgatgagtttgttcaatttgctgatagtatgggaatcaaactgttaaat

SEQ ID NO: 62546 - DNA, 1260 bp, Oryza sativa
aaagaggagaggtatgactttaatatcaccaaggctgacaaaatttttgacttgctactccgagaaaagcagattcaacttcctaccggtcatacaattccatcggctgaagaaattgggcaagaaaaggtattgcaagtggcataattctgtgtctcatactactaatgattgcaaggtcttcaggtagcagatccaagcagctattgaaggaggcaaaatcatgtttgatgattctaagaggccgatgaaagttgatggcaatccttttcctatcaatatggtgcatacaactagccgaatagccgatgggggtcgtgcaagaggttttcaggcaaattcggctaagattatcaacaaatatcagaggaagtatgataaacagcaggtgaagtattatgaagaagatgatgatggctttgatccttgttggggttgcgagttctttagattttgttggaatgaaggtatgaggctgccatctattaaggactgtcctgggtacagtgatactgcggagagctcaagccgatcatatagtaggggcaatcggctaaggcagacaagggttcctgttcatcaaagattgggtccagtaaaccaagatcgtagccgggaggacaacgaaacaagaaaactcaatggtgtccttctagtatctttacaaagaatcagaagagaagggttcaaagattgaggaacagggagcgctttcaggaggtcgagtaggaaatcaatcattggctaaagaagacaaagccgaagcaggagtgacgtgttaagaatcaagttcttgtagacgatgaagccacagccgatgaagcaagaagattggctaaaggaaaaagtgttgtaactgcttcagtcaatatggttttcacgttgcctgccgagtttgggatcaatcaagccgatgacgatgaagttgaagaagaatcagccaaattaattttatcgccagagcaggcagttttcgagaagccagaggatacggagaatcggcatcttaagccattctatataaatggttatgttaatgggaagccgatgtccaaaatgatggtcgatggtgcagtaaacttgatgccttacactatgttcaggaagctgggtaggaacgccgaagatctcatcaagacaaacatggtgctcaaggactttggcggcaatccatcggaaaccgaaggagttttgaatgtggagctgacagtcggcaacaaaaccatccctacaacgttctttatcatcgatgggaagggt

SEQ ID NO: 62547 - DNA, 1291 bp, Oryza sativa
actctgtattaatagaaatatcttttctgagtaactaagatttacattgtgagaatatttcttagttaggtcctatagcatattggatgattattcactattgctcacttataaatagtgattactttggtgagttactattggtatttcttaacgtcacagataaaatccgaagcgcacggaagataccgatgtagcacttcacccaagagtattacaaggtattgatttccatagggaacatgtgtgttcagctcctcttcaggttcatccaaggacacgaagcaaatataggcaaaagggtagagaggatttcctattgagaaacaatgtctacggaaagctcagtttaaccctaacgcgatacttcaggcactagtcagcccgctctcccagatgtccttctaatgcgtacccggacaaggaagacttcagtgtaattgagggctgtcaccacctttacacccaccttaaacctcctgagcaatcaccggaaattaattacccagacaccaatatcagggttatagataccacatacccaatagtaatcgactaagctcgtcagggcccaccacataccatgtcttatacggaaacaaacctcgtatatagaaggagttccggataaggaaggactaatagagttatacatggaaacgacaaggactagtcagatcgtatccatatttatctccctagttctacttggacaagggggcacctatagctataaatacaagcccccctaggaggagaggggacgagccacaaagccacaaagccacaagccaatacaaactaatacaccgccaaaaatcgacatcagagattagcatagacataccccatccagtacctacggaggccggcaagagggatttagtgccatctctgatctcgttgagtacggattcaaggaggaagactaccctgtcgtcgactacgagttgattatttagccgccaagtcgacgacagctagataggttatcccaaatattgtacttgtgtgatcctgatgaataaagagcaacaccggcttcggccaacaggatgtagggctattacctgttagataaggggcccgaacttgtataaaaatctctatctccatctcttttacctcaatctcgcatataccctagtatcaaaaatccccatactatgcaaaataccgtagtcgtgatctcagacgtcgacagtggcacgccagagtaggggaattttggtgactttaaagtttttgaagagatgggttaaaaagatggattctccaacaacaagctact

SEQ ID NO: 62548 - DNA, 605 bp, Oryza sativa
cgttgggaaagtactttgcttttcatatgagcaataatttttctttctggaaacgaagtgaccaagtgaaatttctcgcttgagtaaggtcaaagtaaatcctcgatggtagcttttataacataaatagaaaaaagtagaaaccattaatatattatagttggcatatttgaaaaatacatctgtgtaatacccaatattcatattttctatgcataataccatctttccctaagatatctgggttcggatgcctatgttgtacagtgccttacctttttcttaagaaaacacttcatatgtaattgttatttatgtgatcgcttgtgttgaagggggacattccttctgattgtgcaacatttggtgaatcggatgtgcttgtgcaagctttgcatgagaaggtacatttccattgctttccttttcttttgattctcctgtgcccactcatgaattgtgatatgagttaacttttgtcaattttttttatagatctgatagtgctctttggattgaataaccttacgttatgtggatatctattacgtacagatggaagcacttatgctcttctcacaagaacaagaaagatacctattgga

SEQ ID NO: 62549 - DNA, 2158 bp, Oryza sativa
caaaattacatctattagattcatattataaaatattggctggtgattaaactttttaatcacattaaaaataaataatattcaatagaacaattgttggttaaactctttatcttaaaaagtatatcttatattttgaatcagagagactgaaaaaggacggggcgatggatgatggatccatatgagtttgacaattatgcataaataaatgcgttaaatattagaatactgagaagtctagaaaatactgatgaatgatttttttaaaaaaaaatcataccgcttagaaccttgaatttttttttgttttctgaaaggaccataattaaaaaaaaatccagtgctaaacggttggctcacgaggcccttcacaagataataaataaagggtgtagctatatttatggcgccatatttttcaccaaaaaatagtcggcatgtatttacattgtaacttcctaaattacatatgtaattttaatgtatttataatgtataaatctcgaaattacatatgtaaattccaaaattacatatgtaaatattaaaattacatatataaatagagtgtaattttacatgtagatagcaaaggtcgatcggataaatcacagcaagcagcacaggtgcatgtgtatgtagtacgaactagtgcttgcacgcacgatggcaaattaaacagtcctgcacgaatctaaacgaaactttgagggctaacaaactgactgtaattagaaactttgagggctaacaaactgactgtaattagagggatgcaacattacatggactcatggagaggtagcgcacgataatccgtatttcatcaactttagtagttctattattacaggacagctgtgattactccaatcaattgacgtatatacaccaaacgttaatccctttcaggactaaattattgattgcactacaacactctttgcaaatttagttcctacgagttcggacatttgtttccaaatttagttcctacgagttcggacatttggaaacaatttaatggacatgctttttctgtattctaattctacagtatccacatgaaaaagtatgactgtaaactcactccgtgccgcttccagatactcagcttgccatcaatgggcgtgcagtacatctttctcacctaacaaatacacaaactatatagttctcccttttggcatcaaattatatccttagaatctaaacaaaatgtagcgaagtaaacggtgttcacacctatttgttattcaatataaagctatccttgaggatatcagcagctaatattagtagctccaccatttccatgcccgcagagctgagggggtcttgtttctctgacttcgatgatttaggtgattcagatggatcatagagagcatcactagtaatagcatctgatgaatcccctaaccagcttacggggagagctacaccaagagctgtcttcataaggtttgcttcggttatgagactgttcaacgcttcatacgtactctctaaagagtgagccgatttgacatcctcaaaggcctgaaaaaaaaaagattattacagtctgcaggtaaagtttttgcaccacattattgcttaagctagcagtctagcacggcagcagaaatagtgtctcataagccgaatgaaatgcaagttcagaaataatatctactaactaatgtttatttgttgatcataggaaatcttgcaactgcaaaaatcctcaacattcaagaattaaaaggattgcatttcagaatttcagatcgaatggaaccttgctttcccatcaagcttttttgattctttttgtcccattgaatatgcaaatattgtttggaacaaattacccaaagttcatccaagtatcatgcattgcccacatatctttccaacattttgcatctttctagtaagctgcatctatcagggaaaagagtttaccttcataagcacaatatgcagtcatgcactgacgaagtgaggtgttccatagtggcaacactttccaaaagagcagcattttcagctttaaccctgtaagcagcaccaaacaaagcagacagcacaagtcaacggctgaagagtggcatacaaaaaataaacatttctgtcaatgtttctcttgagtgatttccttactttgagt

SEQ ID NO: 62550 - DNA, 777 bp, Oryza sativa
tcctaagtagcatatgggattattgttcactataaacaactaaaatatagtaattgctttggtgagttataaacactaaagtagatattgattgcttagaagtggtgtttaggtaattgtatacagtaattgctgtgtatcccacactagtttgaggtaggtgtagaggtggtgacagccctcaagatcacttaagtcctctctctctccgggtacgtagtagagcgacatctgggaacagcgggttgccagtgcctgaagtattgcattaggattaaagttaagctttccttagacactgtttctcgctagaaaatcctctctatcctagcctttcatctgcttggtgttcttggatgaactggaggaagatctgaccacacacgttcccttggattcgatacccttggaatactccgtaagggaagtgctacagcggtatatccgtgcgcttgcggaattttatctgtgatcgtaagaaataccaacaatatgctataagttggatatgtgagtcatgctggccacatgagatgcacatgtaataaccaactctagcgctcctataggtgattaagagatgcctactcctggttatcgactagacagttgtagtgacatctcgccacctatcaatttaaatttacttgtggaccgttgaactccatctatcgttgtcgaaaactccatgtctctacggtcttacaccgggatcgaccaagtgagtacgacaaatattgataaagggtgaggcggaaaacaaaacaagcttttgcg

SEQ ID NO: 62551 - DNA, 10552 bp, Oryza sativa
ttggattccttccatatatgtaattcttccttatgttctccccatgtactcctatatatatcggcccccctgaggctcaatacaatgtgtccaatattccagtatcctctctccctatactatctaacactgccgcgcctgtgccgtctgtgcccgcgctgccaccctgtagccgctccgctccacaccgcccctagccgacatcgccggcgtcatccactccggccccgccctccgtgcgcgtgcgtccaagggatggaggtagagccctgcctcatccctccttctccctccttcctttcccgttttggcaaggagtgccccccctttctttcttcttttccctccctttcctcccctcaccggcgtcatcctctgtcgccgatttggccgcgtgcgccgagcgccagccgagccatttgactgcccaaggtcggttctcccctcccaaaccgacatcgccatcccaatctctcttgttttcactctccaccgctgtcgcacaccattgtcgtctcgctgtcgccgtccgtcgctgagcgtgccggaggagctggcgcgttcttggacgcgtgacgtgaactccgcgctcccgcttcatccccttcctcggccaatacgatcacgtttcgcgccgtgtactctcttcacggcaccctgtcccgtcgaggtatcccctcggttccccctcctcgctctccctcctccccgtagcacacccgatagctagtaggcgccaccccaagccccgccgccgctcggcatggtctcgccgccattgccgcccgtcgcttgccctcctcggctctgcttcgtccaatccgacgctaggaacgagtcccggtggtcgtgtgtctgctctagcttcaagaaatcgaaccctcgtcgtcacgtcgtgctttccctcttttgccgccgccgacgaacaccgccgcaatccgccgccgtcggaagggcgacacggcggagcgccagtgccggcacgtcgacgcgaagctcgggtggctcgaccacccgagcctatctaggacgagcacgagcatgtccaacgggagagacgaccagtccatctgcttccgcttctttttcgccggcctggctggtgttccacacgcgagagttcgtgcgtgcgtgcgtgcgtgtccgcgatggcctgcacggcgtaatataggtcggcttccgcttgtagtttttgttagtttgctatccaatctccaaatagatgcatactggagtactagtacaattaattttgatgtcgtgtaggaattcatgtttccttttcctgatctacaggccggtgcagattataattggtaggagttactgattgtaggtcttaggtgtgcatacttcttcgcttctttatctcttgtagacttgtactactattaaatcgcttctttatctcggatgatttggaacagaaatcacgagacaacacttgtaggatttctaaaacactgcacaaattcgtataccgaaagatcgatcggccagtcgtccgtcgaaatcatggaggaggcagtcaacgcatctgccgctctggatcccaagcttgctcctctgctgctgttcggccacggcgacgccacgttcctgtacagcgtgccgaagagagcgctgctgccaatgccaacgccaacgagggtgggcgacggcggcgtcgacgacatgatgagaggccaccgctggtggaccacggcgcagggctggttgctcatggcgcgccccggctcgccgtgcactttcttatgggaccctttcaccggccgccgtgtcaggctgccccccgaccacgacggcaccgtcctcaccgccgaaggcagccatcgccggaggtgcctcctgtcatgctgtggtcccatggacccgaccagctgcaccgatctcgtcatcgacctcgccgacccggagctctggtattgccgtcccggcgacaaccactgggtgaagctccatcagcaaccgtaccagtaccgcaaccctgcccaccgtgacgccatcatcagttttttacgcaagtttacggcgatcgacggcaagttctacaccgaactacacaccggcaatgtcggcgtcctcgagttctcgccggaggttgccgaggggaactaattcccctcggcccaccggcacccgttgtcaagcgttatcaaatccatgcaggctcttaagtcgtgtagttatacaaagtcacaaacctgtattatcgacgaaaatctcgttccttgtagattgagatgcatggcctctctgtttactttaaacatcattcaagcggacaacaggtggatgttaatttgcctaaaaccgacatttttcatcttcactaatagctgatccattttgctgtgctacttatttactgttctctgcaatgactgtttggagatgctgctccacaaaattcagtggtgaatagatgtgtcttgtgtatttatcatacatctgttcactttaagccaatattcgagccttttgccctgttacatcaaattgcattattcacttaaataaataggtatgaataaggttactcaaaaaaatgctttcgcagcaacaaatctgacaaaactgcaaaagttcacccttaagaagagggatatatatatatagcattggttctgcacttctgcatgctaaagtactccacatgatacagcaggctggctttccatccataaggttacaaatgggcaggattgccgtttctgtttgagataaaccaaaggagttgcaagttagaataaagcatttatagtcacatcatgcatacagtttcagtactacctccgtcccaaaataagtgcagtcgtggaaattcgtgtctaacgtttgaccgtccgtcttatttgaaaactttatgatttttttaaaaaaaattagtcagacataaagtactatttatgttctatcatttaatagcaataaaaatagtaatcataaaaaaatttcaaataaaacgaatggtcaaacgttggagatgaatagtgcaaaactgcacttattttgggacggagggagtacaagatacaacacacagcgaactggcaatagattgcttttttgtaaatcttaccactccaatgcagcttgagcttgattagttccaggtgttgacagacggccctgtgactggttgctcatctagggcacggcgcaactcctcaaagaagttcatctgtactaccaatgaccacagaaaaggaatcagagtacagaaactaagacgtaggagaacagtatgacaaaatcgcaggttcaatatacctgatgaggaagtttcatgtgaccatgaccccatgatgatccactagatccagagtacatcaccggcttatctggcaaaacatcaacagcatttaataggttactttggtttagtgcttcccgttggtacaactgacatgaaaattcacttgagtgcacagggtacttgatggtgttcatagtaacatattaacatcacgaattgctatacaatactataattgctagcaccataattgtgcggcgtcactactgttgccaacactttatattcacctccatatttctatcataacttatgaaacggtaatctaaattaaacataggtctaggatagtatgccaggtcttgtagaaattgatcctaaaatatctaaagattcctctaccatgattcatgacatagtaaatctcccatcatgcggcctgaatttgcttaaggactcaccaggggaatcatatgactgatcattgtacaagttcattgctgcagcccaacctacaggggaaaagcagcaaaggtttattatcacataagaagaatggttgtaaataaagttggttcaaaattagtacagcaactgtaggaatacatctttgttatatatgcctagaccatccttgattaaaagttgcctaacttccggtaaattaccggtggcatatgcacaattgcacataaagagaacagttgatggtatgattaatgaacaaaaaagataggataagcagtaggtacacagtttgaatattcttccatgttactaacatgcagagaaccccaaaataaatcacaacaggtgctccacgtatttttctttacaacttacagtatctgaatattggattatcagcctgtgtaaacttattaaagcaatgggcggttctgtaatatactgcatgtgcttttactacttactccctccgtcccaaaatataagcatttttagaccacgacatagtattcgagatgctactttgaccacaatatctataaaaataaaatggtttaaataaaaagagttgcatataataatagtttgattaatgataaatttagtaacatcaatttcacattattgattttttttatttttttgctattaatagttaaagttaaaaatggttgacttagcactatgctaaaaatgcttatattttgggacaaaatgagtaatatcttattactgtagacataatgtatcactaccacaataacatgcaacaattcccagaaagtcaaaaagataagaacttatatcatagaacttctacaagcatttaaaagggcagcttggtctctgagaaacatacggtcattgagaagctgggcagcctcactggcacaacatccctccaagggtattaatcttgtttgactgtaatcattctgaggattgctgaaaaaagtctcatgagggataattggtggaaggttctttaatgaaggagcatggctcttctctccatcattattgtacaaataactagccttctcagccctatctgtttggtataacaaaagtgttacagtgtcagccaaaaaaaatcacctcataaattaaattgttatgcttaaacatacagataaatcattaaaaaaacacatggataaggaaaagatagcccataaaaaaattattggaaatatgaataatcaaataaagacatgtcaaggttagaagattctggacagctattggacataataagtaaactctgagtaaaaaacacatttgacttgtaaatgactgattgtggggattatgattgcaggtagcttgcattagatgcatgaagttgcatgttgtacagagtattggcatcattaatacaatggagtagaggggctcatacaaggatgtttgcttgcaaggatttccttatagatatagagtagttatcaacatggtcggtgtaaggcacatatttttcagcccatttgtggaaaagaaacatggcagtttcactgcatagaaatctactagaggaataatgaattaagtttgataccataacaaccaacaactggataagaccttatcaactaatttggagaccttatatagcagtcaagccaaaataataataaaggaaaatataataaatccccaaaacatcatgaaatccaactgattcaataataattgcgtcgattgttagcacggttcctgaagcatattcagtaaagatagccatcagaaagcatatctatgcatgatatgtagcaagattattaaaactaaataataactaacattagactgcagacaacagaatatttcaagaaataactgatggtttcaaacaaaataaatatttagctcataaatacaaagatggaacaaagaagccatatcaagttatcaactaatcaaatcaacaaggtgatagactgattgaacaatatgtcttaagcaaatctacttcttcattgtgaactccacttataattgtgaaattgtgattacgcgatcacctatcaaagggcaattttcaatatctggcagtacagtaactaaagtatgatagtctttatgcagtcattatatgccctgtgttgaagtcatgcgttaaacttatacaagctgaccgactggcagagttttgctaggcaaggttagcttaatccgctaacccaaattcgaaacatgggcaatccttcacttgctaaaacaggtagttaggtcagcattaaacatgccctgaaataagccattagccatgtagcttgaacaaagatttttctaaaataaataaaagttagttgctaaggttgttcattctcaaaaagctaaaaagagagaccagcgagccaataagccttataggtcggcttccgcttggagattgtataccgccccggcgccccggttggtttttgttggtttgctatccaatctccatatatgcaaagtatttagattttgctttagaattgggtagtggtttgaattttgatatcgtgtaggaattcatgtttccttttcctgatcaacgggtggtgcagatgattggtaggagtactaattgtaggtcgtagatgtgcatacctctttcctatgccaatagttatttataaggatttatgaatttgatcggccagtcgtccgtcgaaatcatggaggaggcaggcgatgcatctgcagcactggatcccaagtttgctcctctgctgctgttcggcggccacggcgacgccacgttcctgtacagcgtgccgacgagggcgctgctgccaatgccaacgccaacgagggtgggcgacggcggcgtcgacgacatgatgagatgccaccgctggtggaccacggcgcagggctggttgctcatggcgcgccgcggctcgccgtgcacttttttatgggaccctttcaccggccgccgtgtcgggctgcctcccgaccacgacggcaccgtcctcgccgccgaaggcagccatcgccggaggtgcctcctgtcatgctgcggtcccatggacccgaccagctgcaccgtgctcgtcatcgacctcgcctacccggagctctggtattgccgccccggcgacaaccactgggtgaagctccatcagcaaccgtaccagtaccgcaaccctgcccaccgtgacgccatcatcaggtttttacgcaagtttacggcgatcgacggcaagttctacactgaactacacaccggcaatgtcggcgtcctcgagttcttgccggaggtggcgttcaccaagatcgctgtacacgacgacgataggagaccggcggtgtacaagaaacgtactacttgcttcgtggaatcaaacggggagctgcactccgttgtcttctctcacccgatcggatgtgaccggattgtcgcgcgtgtaggcgtttacaggttgagcattaatgcggcggcaacgcaggagcaaagatcagcagcatgggtgaaggtggattcgctaggtggcagagcgttcttcgttaagataggcagttttggagcgtcacttgatgcggagggaacaggcttgagagggaactgcgtctactactcggtgttcaatgggaaagtgttgtgtgtatacgacatggaacgaggaactacggctgtaatcgatcccggcacacatcttccgtatcaccagtcaccccaagtattgatgccaacatttcctagatatcatggcggagcaactcgaagtgttgaaagcatctatcaggttgggccaacaattcaggaaaatgcttatgaggtaaaagacactaaggtaagtaaggtgaagagggatgttcgatttttcgagggtggttgtacttgtttgccgattcctattcaaaataagttaataaatcagaagaagagtaagaggtctatggctgaaagatttccttgtcaaggggaaggtgcaagcagtcccgaaacgaagaactcataccgcggttgtggctttcctttggagccgctcaaatgtcttctgcgtatgaagaaataggagtgcactacatagaggatccaacttaccttttatgccaactcgatgagtgtttttttagttaactcattcattcaaaatatgcactaatgttagctcggctatgtcacgtctattaatttcattaagttttggtctctactatgtgattgggagctctttttctctgaaattttatgaaaccatcttcttttttcttttaggtgtttaacagctccccaatctgctttcttcctgagaaagcctcgttgtgtagtgcccgttccgtcgtagcgcctagctaacatcgtcagatcccaatcccccaatccatcgtcaagttcgaattccaacttcaagtcccctccaaatcaaatctctcgacagaagtctatttcgcctccctaaagttttgtgggccgagctccctccctcggcacatcttctccctcagcccatcccctcctctcgcacatgccgtgcgagtgcgctgagccgagccgagagagagccctctctctcattttcttgctctctctttgttctctctctccccgatttcccgccaacgacacccaagttgccgcgccgcctgttgccgcgcgtgcactgtggtggccgaccggccggtcgccgccgccgtcagccctgcctgttagagtatatggtagttagagtcatattaggatagaattggtttgtttggattccttccatatctgtaatccttccttatcttctccccatgtactcctgtatatattggctccctgagactcaatacaatatgtccaatattcacagtatcctctctccctatattatctaacatggtatcagagcagacgatctagtcgcctctctctcacgcttccgctcgtcgccctcgggagggtttcaatctcctggggcggccaccgtttttttttcttcgcgtcgtcaagtcgatgtcccgagagagatcgatctctcggacgcttgcgtcgtcatcaagcggcagtagcagagtctccggtcatcatcagtctgcacttcgtcctccacatccggtccgccgcgtccaccgcccctacctcggatggccaccgtcggcttatcgacctccgccgggctccgcggccgacggacgaccttgtctccgcctcgaccgctgtcttcatcaagctccgccggggggatggaccgacgtcttcaccgcctctccgcctgccttctgcctcgtcgccggcaagacgctgctggtccggcgtctctggcacgggcgcgcggcccgacacctcgccgccaggatctgcaccattgtcgccgcttgcggcctcgacgcctccggactcagctccctcgtcgttgccgccggtcagcccctacgcgtccgcgtctatcttgcctctcgctccctgtattgtttggttgtccgtcactttgctgtgatcttacacgtgattagcaagggagaggagagagagagaagatggttgcagagagcttgttggctggctggctggctgtggagggaaccgattgtgcatgtgtcgctgctgctggtacagttgaggcagagaggttgctggacgtggacttggtctacggaccatttgagcacgtagggctggttgtactgtgctgcttgctgctgcatgtatctttttttttcccgatcagagatcgggtttgcgtcgtccaccgcctcgtcgatatctacgcgtctctgacatcggcatcgacttcgtcgtcctgccccgcgcatcttcggcttgatcacccgttcaagcgtccgactacaacgacttctgtaaccgatcgtcatcgagcatgcgtctacgccatcaagctctgggttgccgctgtgtcgcctccttgggccgcagtgccgctgcctatggtccacacctccattggctattgcaacgctgagaggcgcccttctcagcgtggcctcaccgccggtggacttctcgccgctgcatcgacatggagctgcagctgtgctgtcctctcggaccatagctttgccactttcgtcgtcttcatcgccgttcgcgcatcgacaacctcgtcgtccgcactggtcatagtcagccgctcggggtctccttcctctacttcaagcatcgccgccgcatctccaagctgccactgtcgccactctaggccggtggtgcagctacctctacatggctaccgatgtcgccgtccaggccgttggtcccgctatttcgccttctactttgtccagcatgactcatcgccagcgtcgccgtatcttcctcgactacacttcgctcttctccggcaactgcgtgctgctccggcaattctccctctacgccgttctcgcgctgcgactgtcccagaggccttctctgctagtctcctccgacattggcgtatgattcatggtggtctcctgtctcgcccgcgcggtattggcaacaccggcgcgcgcgtttgtcccgagttgtcccggggtctggcaagccctgtgtaacgtctcgtcctttacggttcgactacattggctcttcggcgtcatcttcctcaacgaccgccgcgattgtatcaccgtcttcgtctccagcgcgtcctcacgcaccattggtccacgatgccctcccgtccatccacgaccactctacgacgccccctgcgccttacggctcgactacctcgacatcatcgacttcccgacttcggctacatcgaccacggctactctacgcacggcttcatcaaccacggctctctcggctccttcgctttggttacatcgactatggcacaaagggctatcatctgtgttgagtactctttccggttttttttccagtccaag

SEQ ID NO: 62552 - DNA, 1261 bp, Oryza sativa
tcagctgataatgctagtataagcaactccgagaagcaggaacagaaaaaatcagtaccagaagatggtcgcatgaagaatagtaaaaatgatcatgcgacaacaacatcgccatcttctccatggtcagaaaatatggatcctattgcatcaacttccaaaactggtaaaggaaaaactcaaggagctgaggccacagaacgagaaggagatggcgctgtctctgttgctaattcaaagaaagaatcgagacccgtctttgaagacaacattgttctgggtttagctcttgagggatccaagaggacattaccaattgatgacggaatgaaccctcatctatcactttctgaaactgagcaagacacagttgaggctgcttcatcaccgaaggataagaaaggtcaagaaaaaggtgaccagaggaatcttgataggtgatctgagtttaaaccgattatttatgctatatttgtcaccaagcctaccttttttttgtgcttgtgcaaatgcaatctgtcaaacctgtctatgtcaaaggtattgatcgtcgctgatactattcaggagacgaacctcctcaaatgtacttctcagccatttgctatattaggcctgtaaaatcacaaggcctctcctctccgttcaacatattattgtacatatcctgcagcctctgtaacaatcctagataaagctgacctgacctgtgttgcctcttgcatgtgcatttgtgatgcgaccacgttatcatggttcctgactggaatcagttttaggtctgttttgaatgatgatggcagtgtcaaatggtccttgcagttgggggtgatctgcagaccgttgcttgatgtccgtatgggccagtgggtgaagggttaaatatataatcttcccctccaaggctgtctgagttgttgggttgcagctagtgggcaattatttgtgaccacagtagttgtcgccatgaagccatctcatctcagccgcccagattggcctgcatcgtgcatcatcgatgtaatcttgtgtcaacttagtgtcacccgaccagagtccagatattggtgcttggttggagttgaacacggccggccggcagacatggccgctggtacgtagtcaagtgtggagaagattcataattgcaggccagaaagaggagaaaaggtgatgattcggaaaggtgacatgtcaatgcacacaccctgcacctactacatgcatctacatatacatatagccaagatcaccgggttct

SEQ ID NO: 62553 - DNA, 2642 bp, Oryza sativa
ggttttggaaattctacaatttctactaaagtagttcgcatgcatctacggtgaagtactgaagtggtagtttttctttgctttggataagtgagcgtccaaacccttcacacgttgttttggccgttttttttacaaattgaccattttcaaaaacttattcgaaactaacccctgccaaaaacttcaactaaaaataggccgtttgctcagcgccaagcgcattggcgctgaggttgggcatgtcagcgccaacgggcgtggcgctgacctcgtgccaccgtggcggccgggctgatcccccagctgacgtggcagctacctcagcgccaaccgcttcgacgctgagatggccaatctcagcgccaaagggcctggcgccgagttttggtacttagaggccggccgaggccgcccccagccagcctttcctctattcttccccaccccgcgtgctagggttcgtcgcactctcttctcccctcaccaaatctcccccaaatccactcaaatcgaaggggattttgtcaggattgagttggagatcgattgagaaggtaaactcctctagaaaccctaatttcccccatgttttattggatatttcgcattgttttggttccaaccgtggtttgataattattggctcggattggatgttaattggataatgtgggtggggatgtagtgcggaagacacatattaatcttgctccatttggttcatgttgatttgtagaattgagaacatatattttggaaagatgtgtggtgatggttagggctttgttggattgatgtgtggtgattgaaatggatgcaaggggttgatgtgtggtgaggtctaggcactatgcaggagaagggaattttttttatgaataatgtgtagtattttagttgaaacaattaggtattgataggtttggaagttttgggattgctatggtatttagagactattttcaaattaattaatgtttatgtatgggttaaatattgtagatggatagattggttcggcttcattatggtggttgtgtggtagatgaaagtaccggtggaagcaaatttgagggaatgattgttagacagttagtgtttcatgcgaagccaacatttgaggagttaatgtctcgcattaagcatgaattggattggagtgatgagtcggttggtatgcaagggagatacgatgtgggcggcggtgtcatgtcgcataagtttatgttagacttgaatggaaagatcgaatggcaaacatatatagatatagtattggggtcacatttcaaagctcttgaggtgtttgcatggaagaaagaaggtaggaaagggaagaaagaacttgtagacttgaacgaaagtccactcatagaatcacccattagttctcacgaactgtcggagaggtgtagtaggaaggaagaattaattgaggaagacgtggaggtgggcgagggagtaaatgatatggcggatgtggaggtcagggaggaagtacatggggaggagaatgtcccggtaagggaggaagtacatgcagaggagaatgtgccgttaagggaggaagttaatgtggaggagaatgtgccggtaagagaggaaggagatattgaggatggtcgggaggtaggagatgatgtggagttgactgaggaagaagcgaatgctaagaatgtaagtatgggcctaagggagttggttaggctggaattctatacccgagaggagtgtgaggaggctatgatacgcagtggattgaactcaggctggttggagtatgatacagatgatgaattggatgagtccgcttccgactccgatgatgatcgtccagtgcgtaagatgtcggagcatgaaaggactgtgtttgagaaattggtgggtagaaactcggaaataacacaattctaggatcttaccagatctgggctagcaattgctgatggggatccacaatatgacggtgccttcgaaccaatgtgtgatgaaccaaggaaggggttggagtttcgatcgatggatgatctgaaaatatggctgcagagttattctatccgtgtccaccggccgtaccatgtgaaggaatctaatgcgtcagtaaagtatactgtggcttgtctcgatcgccattgcaaatggcagattaatgcaaggaagagtggaggagataggtggcgggtgactagggtgggcgaagaccacacatgctgtagtgcggaagtaaccggcaagcatttgcaacttacttcgaggtttattggaaataggttacaggcatttgtgcgagctgaaccaactttgtctccagcagcgattgtcgaggcagttgagcaaatatggtactatcggcctacgtatggcaaagcatggcgtgctaagcaagttgctatgaaggtcatttggggagattgggacgaggcgtatgttcgcttgcctacactgatgcatgccatcaaagaaaagaaccctaccatgcatttccgtgttgaggctcaccccgagaagtcaaggatggtggagggagtacaaaggtgagtatttggatgtgcatattggatatttggccagtccatagaagcattcaagcacttgaggccggtgctagcaattgatggcactttcttaaccggtaaata

SEQ ID NO: 62554 - DNA, 1321 bp, Oryza sativa
atcactctaatatgctatgaagttgtgataatttttaggaactcctattcaccccccctctaggcgacatcaaggtcctttcaattgccacataggatcaaaacaggattgtattggcacagggggtttatttgtctagcttgagaagttgaggggagaaatgtctggtttgttgttcaagtgggtaattcggaccatcgcaatagtttagggggtaattaatttggactattttatagcataaagaggataatatatatataaaggtttagtttatccatagttttttttttagtaaacttcactttgggccccctttattacccaaagtttcaccatggacttttgacaagcctaattttccacataacaacacatacaattaccaatggttgctttggactaggtcacatggacttcatccctgcttaaagcccaagccaccaagcagcagctggtggagcatcaataagatcaatcggtatggcacagcaattgagtattgcatcgtgcgagataaaaaaatcagtgcaataatttgtttatgcaattggcaggtattggaagtgcgggttcaaaaataataatttcgtattttggtattcgatggcaagggcttcggtggtggaagcccttagatccattctcataatttgtggccgcaaattgcacaattttgtagcacaaaagccagcatggcagtccaagttgtctaaccccggcctgcaaagaatggtaaacatatgtgatgttaagggaaaaggttagcttatttttaagagaaaaggttgctcctggttcctagaattaaaaatagtatgcctagaatttccaatgaaatgattatcataatatcataaacttgttgcaacctattctaatataaaattgatggtcaaaattagattcaccaagggaaggttcgcacgtggcaacctgtggtggcagggacagccaaccatcatagaacctcggtggatcgttgtgacagccggtgagtatggaggcagtcggacaggctgcaagcggaagggccagcatgggcatcctcattcgttgcaatagaagggagtaaccgctttgggctatgccagcatcgaggctcaacaagttgatgcgggtgatggccgatgcttctttggtgtgccctgcctgcagagtggtttaatttcctacaatctgttgatggtggccttcttctcttcccatggagatgatggtctctctagcaggtacttctcacaacgaggcaaggacgtccagatctacctgtagaccaatgtcagtttggcttcgattcaaggtatcgcttacatcaact

SEQ ID NO: 62555 - DNA, 706 bp, Oryza sativa
gctgcaaaagagcactccagaacacctccagtgcacatccatcgcccacacgatcttgacgcgcgcgcgcgcgcacaaaacacacaaaaataaacgtcaatttgcaatcgtcaagagtagagagagtcgctagaaacatcaactgatggcaacatccacacggcgtcgaggaaaagaaaccatttctaattgctgcaagatgccaaaagatgccagcccgagaggcagagatcactagagacacatcaatagtagcaccagtagtgtaacaaattgggaatacactgtgggagtaggacagggacaatgacacaggaaggcagaagaggacgcatgatgaacacatcaacaagagagtgaaattcaggacgaaatgtcgacaagatattggaatctttggccacgcacgcaccaattcttgggtgacgcggccggaatcgaacggcacacccgacccaacccaacccagcgaactaaacggagtcaatcatctgatgacctaaaaaaaagggaaacaaattctgccaaattttattggtttttctttcccgtttgcttcctctcttcttctgcttgtctctcttttcatcacttagaggcgtgtgcacgtctcgtacaccggcgcgccggtcacctgcgcgactgcgccgggtagggcgcgacgcgcgtcctccgtgtgccgtccgacggcacgcggccaccgacg

SEQ ID NO: 62556 - DNA, 1549 bp, Oryza sativa
gccaccgccgtgctgccacgcctcctccgcgcaacgccgccgccgcgccgcgcgacatgctgccgctgcgccgcgcgccaggccgccgccgcgccacgccgatgccgcgccgccgccgacaccgcgccgccgcgcgccacgccgccgccgcgcccgcaacgccgccgccacgccgccgcttcgctgccgccacaccgccgtccgctgccgccatgttaacgaacgaattatcgtgaacgaacgaaatgtacgtgaacgtgaaagaacgaacgaacgtacgtgaacgtgaacgtgaacgtgaacgaacgaacgtacgttaacaaacaaaacgtacgtgaacgagtacgtgaacgaacgtttctcgtgaacgaacgaacgtacgtgaacgtgaacgaacgtgaacctaacgtgaacgtgagcgaacgtgaacttaacgtacgttaacgtgaacgaacgaacgtaggtgaacgaacgtgcgtgaacgaaaagtgaacttaacaagaacgcgaacatgaacttaacgtacgttaacgtgaacgcaagtgaacgaacgaacgtaggtgaacgaaacgtgaacttagcgagaacgcgaacatgaacgatcgtgaacgaaacgtgaacttaacgagaacgcgaacatgaaatacaatatatgttactttgcgtttatcctaatacatctttttgtatgttgcagaaaagacgttgtcgtcgtcgtccctcaagctggagtggtagctagccctcgaaggaattcacgcaggcaagtgatgtaaatatatgattgttagatttttaatgcaattaagactattagatttaatatacgacacttagacttagcatatatgattacctagggatctaatatacgacacttagacttagcatagttgactaccagagttgtaatacaagattatttgagttttaatataagattattagagttttaatataatattattagatttgtaattagacttagcatataagattgtgtagggttctaatatatgacagttagacttagcatatatgactatttgagttttaatataagattattagagctctaatacatgattattttagttttaatataagattattagatttgtaattagacttagtatataattattgtctagggtcctaatatacgacacttagacttagcatatttgactattagagttttagtacaatattatttgagttttaatataagattattagagttttaatacaagattattacagttttaatataagattattagagttttaatacaagcttattagagttttaatataagattattagatttgtaataagacttagcatataagattgtctagggttctaatatatgacagttagacttagcatatttgactatttgagttttaatataagattattagagttctaatacaagattatttgagttttaatataagattattagatttgtaattagacttagtatataattattgtctagggttctaatatatatacgacagttggacttagcatatatga

SEQ ID NO: 62557 - DNA, 1309 bp, Oryza sativa
ctctctctctctctctctctctctacttgcatgtggaagatagaggacgtcagttgggccccactgtcatataggatgaaaggtggattttattgctgaaagttcaagtgccattaatttggttttggtgattaatgacaaatccaattacatgagactaacattgttataagcatttctttgtctactagtctcatatggatatgaaagtggaatatgtgagaggtgatttccggactttatatgagtaaagagagaaacgttcattgatggtgttcctaaatcacaaggatgaaatgcatagagatcaaactatatatgtatcactctttctctccatgtacatattgatgtgttcatatataatatttttcatgtgaataacaatatacatgtgagactaatgttttgtttgagccatatcttgtttagtctctttacattgataacatggagatgatgaaggtatatttttattttaatgcctacttgataaattccttctattcttgtataggataagcatcaatcatttgaagaatatatggtaaaacggtatcggcattggcgtccctcaagacaatgaaagaaagatgaaaaaaatacattcctaatggtataattatcttcttatttacatttgagtttaggaatgccgtactattaagagggatgcaacgtcgaggtgtttgtgtatgtctcggtgctcaaagtgacctatcatagtgctaccttgagagaaacccaagctttaacctatcttttgagtagttttagaccttgtttttggttgagttgggtagtcctttgagtgagctttccatagagtccaagttcattaaaaatagactcccgagcgaaaagttatagttgttttactctgtgcttttcggaaactccaaaaaattttcggatttatccgaaaattttcggacattccggaagtggctgcgaatctgagatttgcttctgtaagttatcggacttgtccgaaaatgcttttcggaaactccgaaaattacagtcttggcctccaacggctagtttttgaggggctcgggtatataaacttctccacccctcctttgagtggctgctgctcttgggaagtattagacacatccaaagccaaatagccatccccatttcccatcctttgtggtgcctctttgtgagggggatttgagaagggaaaagagttgggttaagagagtgaggagttgagagctagtgagcttcactccatcctttgtggtgcctctttgtgagagggatttgagaaggggaaagagttgggttgagtgattga

SEQ ID NO: 62558 - DNA, 1930 bp, Oryza sativa
ctaattccttgactctggagtatgttaaatcctaagtctggccttagttgcttgtacctaaagtatttaaccctggatttatatcttggaggcattgtctagagtttatatcttgaaggcatcctaagacaacgatctctgtgaaggcaactaaggccaaagcaatatcctaagacaactaaggcctaagcaacatcccaagacaacgatgccttcaagatgtacatcctaaggcaactaaggccaaaggaacatcctaagacaacacatgaatgaacatcttgaaggcattgtctagagtttatagaattttaatgaaaatctatagtctaatcttagttgattcgagcatgatgtgtcattcactttttattaggcgttgttttagggggcgtttatggttatttcaagaatgttgcatttatggttgtatatcgcagcggcatgattttcgtatagttgggtcgttctttttttttcttatgtaataacgatatatttatgcatcttagctattaagagaccgtggatgattttagagtgattatctaatatcaataaagcttttttatctttaaaaaaatttttactaaaatcttgttctaaatattaatgttgtaccactggtaagtcgatcgaatcatttttctacgctcacgagaagtctcggtgctgacgcaggccacggtactcaatatgaaaggccactggtgcctggtggagtggaaaatgtggaattgcttatcctctctcacactaattaacaagatcatatcgaggattagttcgtgtcaaaagggagtctaaaaggatgatgctgacatagaatcactaacaaaaagctgctcctggttcgaatatatattgggggctttggttgggcccaaccacggcatgtccaacatatgcaaaagttcaccttttgatagcaacaggttatgtagccatgtaggtacacacagcaacagcagcagctagcaagttggcttcaaatttcggtctgcaaatgaatctagctacgtactaaccgatggtgatgcaacttaatttgattactttatgtactcattactgtcctaattagttgtacagatataaaattacatgcttgccttttattaaattacttggccctggatttttttttctagaaaggtatttaatttgtaaccatgtgatttcttcttgttcgaccattttacattgtacatcatctgtgttagaaaaaaaaccaacttcagcttatatctaaactcatagctagaagatggttttttctaagacgaagggtatattattttatctattccttaattacgtaccactaattaagttttatcacctgtttctaccgtataccattgcagaagttttttgttttcaaaatgttcaaaatcattcttggagacatggagggacagaactaattgatgaccccaatttatgttcctaaaaactatgaaaaaaaaatcttcctagccacctgctggcagagcatacaaactcatatgtaagtctcagaatttctgccaaattaaaaaaaaaagatcgtacaagaaatggttcctctttgatatgatgcacaattgatttttttttcttttttggatgttgtttgctcttgggaaagccattcctctttcgtaatgctcaagtgcagggggcctgggggattccatctcccactaggtagcaaaagcaatacatgcaatggttggctggtcgcattggtgcccaggtgggctagctaagcttgcatatatgcatgctggaccagcacaagagagatctagtgggagctcctttttaggtcagagccatacatatatatgcattttgcatccatccatctattcgttgtgcttgttacacatgcatatatatggtcctcttccatcctcctttttcacccaccaacgtagtcctacat

SEQ ID NO: 62559 - DNA, 2280 bp, Oryza sativa
ccagtctgatgcgtactattcaaatgtactataagataccactacaaaacacttacgatcatataccattttacagtcagcaagaaaatcaaattctgcagatttatgtatggtgacaagcatgatcatcagtgcaaactttctgagcattcaggaaacttcacaagtaacagtttactgatgggacaagcatgatcatcagtgcagatttatgtacaatactatggtgacaagcatgataggacaagcaaaactacctagtcaatgccactgatgtgctcttgaccaaagggatttcctgcaaagaaacaggcaatgcaaaagatctaacacccaaggctctatatctagaaggcacatatagcataggcctatagttcctctccaatatgttatgaccccagcaattgtgtccctgcaaagaaatgaagagaatttctctaaggtttactataatagagcaaaaacaacattaaaataaatggagtcaaatactacctccgtccaaaatataaagatttttagagttggacacggatagtaagaaagtatgtagaattaaatgggagatgtttgtgattggttgagaaatggaggtaggtggaaaaatagaatggtgaatggttgtgattggttgggaaaaggatattggtgaagaagttgttatattttgggatggagggagtactatatactattggataacaaagaacaaatgacaaatacaaactgtagtgaatgatgcaaaagaaaaaaaaaaggaaacacagtacaactattaactgttatattattcgtgtaccaaatataggttcttctctatgactctatgtagtaataaaagaaatgctttgtgtccctatgcgcacaacactactcagcaatatctctatgtagtaataaaagaaatgctttgtgtccctatgcgcacaatactactcagcaatatgtgcataatacagattccccatttctcagtctatcgacagatggtaaacacttacaagttatgagatattcattatttcacttaattctcataccacaacatattgataaaagcatcttctcccactctcatgtgaatgcagcttgttagaccatttcaagaaaatgaattacactttattaactcaaacaaaaattaatgtatctacaaaatggtgagaacaagcacggcatttaattccttttatcacttcaattgcttagaattgacaggaaagactaacagtaacttgacaatcgttgtgtaaatattattagaatttcaaactaagtttcaaacagcaagatatctggatagtctaaagctgtcaaatacatctgtgaaagagaaatagatagcaaaataattctctgccatacatatgtacacactcctattctaaaataattatttgcttctgctacatgacaactactaacttttttctcaaaaaaaaatctactaacttgcacaatttcaagtaggaacaaatattaggtgcagaaaaaggtaaaacatatgtagacttacagtaaaacataacaaaagaaacatcactacacctctataaacagtgactgaaaaataatattatcttaacagtactgaaaggaagaaaccatacattagggaccgaagataatgaagttgatgtgagagaacttcggatatctgggttctaggaaaaataaacattcaggagtcaggacacagaaaataaaaacagattaataattaaagattaggagtgaacaatctgcaccctgaatttgttggtctggcagaaacggttggtagcagtcactccttggaatagctgggatgtcactccaacagccatctcaggcaggactcaaatgacacgtaaaataatcacatccactgaattaacttctatcagtgctgcctgagttataagtgcaacttcacttctctgacaaaaaaaacaatatgtaagaagtgtggtttgcaacgggcttaagattaatttgaaatattttttagaacatcaagtttcctgtttcttaattaagtatgaaggagtccatattactccccagtccccacccccacccccgagaaatgttctgccatcgtggtcattgatgtggctgctaacatttgcattcactcagaatttgttacataaaatattcttcctcatatgttcagggtactagtattgccaaaatattaagttttagcatgacaacatggtgcccgaatcaaataaatcaaggtaatgaagatacttttatgcatgaccagacactggaggctccacataccct

SEQ ID NO: 62560 - DNA, 13341 bp, Oryza sativa
ctgcgtccgggcgcggcgtggcgaggcgacacacgcgacgccgcgagagcgatgggggaagcgacggaaccacgcacgtgtagccttatcgcccttgcctttttgcctatgcgccgtgcctgattgaccagctgcttttctttattattatattatttcttcttttatattattttaaagtatatgcgatgattgactcataatattttttttcgtgcccctcacctccttctcttttttttttctttataattgtataaaacatgaaaaaaaaaggaaattactatagaacgtgtatcgaatttttttagccattggattagctccaaatttgtgcacgcgagatgagagaaaatttttggccattaaattcactccgaaatttatgcacgcaagatgaaagaaaatagtagagaatcgctacagagataaccttttatacaaagaattttaaattgtgagaagcagcttgtacttctgatttattttccgactacaactatctataattatagtctatagattcttgtaatctatataacaatctcaactatttcaaagagcttcggacagctaaatatcctacgtgaggcaataactatacgcgtgagaaactctctaaatatggcctacttatagaacgatgggtcggtagctaggattaagccaccggctttcatggaccacaagctgcttagcgagctgtgccaaattaccaaccatagtccagcaactaggaattgagccctcttgaaaagaataactagggctgtgtttgagaagaggagattggaaagatacgcaaaacgaggtgagccattagcacatgattaattgactattaagtattttaaacttaaaaaatggattaatatgattttttaaagcatcttttctatagaattttttttacaaaaaacgcaccgtttagtatttcgggaagcgtgcgcgcggaaaacgaagcaaaactcactaacaatcacttagatcacctaggaaagaacacagcctaaagcatccattctttttctcaactccaaactcgtacttttaaaactattaaatggtgtgtgttttgtaaaaataaagtttctatataaaagtataattattaatacttaattaatcgtgtgctaacgaggtttctcgttttacatgcgttaaaatctgtcttcaaaagtgaagatggaacgcaacctaaaaattgaactgattgaatcccctccattacaatagttcagttttatatacaagtcccttgcatttctatattactaaacagactaaaattcggaaatatacaatttcttaggaattacacaatttttaagggattgtctatgagacgaatggctgaaaaaatttgtgttctcggcccgtttgtctgactctctatgatccaaacacgcatctcccatccacctgcgcaaggaataagttcaccggaggtccctcaacttaacagcgagattttttgaggtcccttaacaacaaaatcagaaatgtctacccctaaattcacttaaaccgttcaccggaggtcactcggcagtatttttgtccggttttgctgacgtggcatcctagtcagcaaaaaaaatttaaaaaaaaaacttggggctcacatgtcagctgcatatcttttttcttctcttttcttctccttctctcctcttctcttttcttttctctctcctcttctccttcaggctgcgggcggagcaaccgcgcgccgtggccgccgtcgtcgtcagctctccaccgtcgtcgtcgccgtgagcgaggcaaagcggcgcggccgttcggcggcggagcggaggcagcggagcgcggcggtggagcggaggctgcgggcggagcagccgcgtgccgtggccgccgttgtcgtcagctctccaccgtcgtcggcgccgtgagcgaggctacgcggcgcggccgtccggcggcggagcggaggcagcggagcgcggcggcggagcggaggctgcgggcgaagcagccgcgcgccgtggccgccgtcgtcgtcggctctccaccgtcgtcatcgccgtgagcgaggctgtccggcggcggagcggaggcagcggagcgcggcggcggagcggaggctgcgggccgagcagccgcgagccgtggccgccgtcgtcgccgtgggcgaggcctagagttacatgcatatatgcattcattcatgaatatatacatatatattcgatcgatcttgtcactttcaacccgtgcaggagcctgcaaatcaatcacaagctgcttttgctttggtctttttctctctactgcatgcatgtatccctcacttgagagcccatagctagcatgcatgcgttcacaggcttttggcctttcttctcttgcgcgcggagggacgctattgccaccgacaagctcgcgagtgaagctcggccggctctctctcctctccggcaaaaagggcgccaaggccgccctgctcaacgacgatgattacgagccccccgcgccgccgctcccacccggggacggcgacgacgacgaggagcccatcaacctcgtcttcaagggcggagatgactagatgaggccggcgggagagggggtggcgtgctgcatcggcgaagaggtcgccgccgaccgcctgccgccgctccgcagccacacctgccccccgccgctcgccgaccaggccccccgctccgtcgtaatcgcccgccgccctccgcccaccgctgctccgcctaccgcgctcgtggaggtcaaccaacacgacgacgctaccggcggtgaagagctggagcatgacgagcgccgccgctccgctgccgctctcgcccgctgccctgcccgccgctcccgccgtcccagccgcctctctccccctctcccgccaccgctggcacgctcgctccacgccgcccgccgccacgcccgcctcctctccccccgcttcttccccgcgggccgttgtgcccgcaccgccgcctgtcgccacaccctcatctgcccagccggctcactgaagaagagatgagaaaagagaatgtgcagctgacatgtgggtcccagatactttttaaatttttttttgctaactaggatgccacgtcagcaaaaccgggcaaaaatactgccgagggacctccagtgggttgaaggagtttaggggtacacatttctggttttgtggttaagggaccgcaaaaaatctcgttgttaagttgagggacttttggtgaacttattcccctgcggcaatactctcgcgtgcatggtgcactttccagccattgtaacccattttgttgtgtcaggttggtggcaaaaaagcccatagccacacgaaggggcccatgatgttttctacagggcacacgaaaaaacaaggaataagttcaccggaggtctcgagattttttaaattaccttaaccgcaaaaccagaaatcttcacccctcgactttacaactttacaaaaccgtctaatttaggtcccaaggcagtatacatggctggttttaatggcgtggcatcctagtcagcaaaaataattaaataaatatgtgggggcccatatgtcagtgagagaaaatgatgtgggccccacatctcttttttttctttttctcttctcttctcaacttctcagttctcacgcgcaggcgggaagatggcggccgacggcggagcgggcgcggttgccggcgcagcgggcgctgcggcgcgcggggaagaagcgggggagggggagaggaggcggccggcgccagagaaggggagagaggcggccggcgcgaccgcccgcgacggcgggagcggcggccggcgcgcgcctctccccatccggagccacggcgggttagcaagcgaacggcgtactcgctatcgccagccacgccgcctccacggcgccgcgcacctcctcggcgcgacaccggcagaggatgcggaggagagcggccggggtggacgcgttcgccgatgggagcgccgggagagggctcgacgacgagcaggcggatgggcaggccgtcgatgctccaccgccgcttcgcctgcctccggaacgcgccgcggaacccgccacagaacgcgcgtctgtccagccgacgcatcgactccggcgtccgctccttcggcggcaccgtccccagctgccccgtctgcctccggtcgccgtcgtcgtcgttatgaaacacccattaattagtttgcacgctgcatgcagctagctagccaaccggattcatgggattgtccaccatgccctgcccgtgttagaaattaatcttgttgtttcttaatttcagcatgtttatctatatgcatatgtgtgtgttgcatggcctggagagctagctatatgtacgtgggtgctgcatggtttagtgagtagtggttggcagtgagtagtgagccaataaagagccaggagatgagagcacatgtatgtagcttagttagttagccatgcataattgtgggctagtgattagccgagtcttgcacaagattaggagtaggaagtggtcagtttgcatgcatgcaggttagttggttggttcatgcaactaacgtcggcgaagactcagtacttgtgaagttgcggccaagtaaacaggatgtgggcgtcgtgtgtggcttgagaagcggaacaaccagcttcgtgtgtgtatgtgctgtgttataaatagctgctcattgtaatcatttagtaaagtgaaaaaccagtgaaaagggcacaagttgttgtggtgcctctaagctcctgtgtgtttgcttctgtgtttgtgtttcttcctcgctgcctcgttcaaaaagtgtagcctgtattcgcgtgagttgctttgattcccaacagcccgaccatgggctggtccaacacgggaggatgccgtgcttctccagctgcccacgcagtccgacgccgctcaacatcagcagctgcaggccactcagcatcagcagctgcaggctccccagcgtcccggtgtggtcgcgtgcgccgatgggagcgccgggagagggctcggcggcgagcgggagaatgggcagggaagggtcgagctacggcctgcgggtggctgcggccgccgcccgccgcaggctccgctctccgccgctccgcgtgcctgctcgcccgtcttcgccgctagtagccgcgctcacccgtcgctgcctcccgcctgctccgctctccaacgctccacctgcctgcttgtccgccgtcggcactcgcagccacgctcacccgccgctgcccgtcctgcctgcttcgcagccgccgactccgctctccaccgccgccactccggccgctttgccgccgcggcgactgctgcagctctcccctccgcggcaagaaaatggaaaagagaagaggatgatgctgacaactgggcccttactatttccttctcacttactcgtgggtcctacattatttttttattctttttgctaactaggatgccacctcagcgaaaccggacatctatactgcctagggacttttttttttggacgttttacttaattaaggggtacaaatttctggttttgtggttaagggatctcaaaaaaaatctcgctgggatctcgggtgaacttattcaaaaaaaaaaagacaatttcattttacccctactttaatttttaatattgacttactttttagggtatcgttggcccttgctttttcaaaacgaagctgacgtttactcctattgttgacagaagttagtgcaccctggatagttgagtttaagaagtagaaaaaaaaagaaataatggattttaaatttattgatttacctttctaccttgggtggtcacaataccttggaatttttttccttcccttatcatcttcatttcgggttccccttatccttaattccttatactctcagcagctcggcaagcagcagagaagcgacgacggaggctcgacacgaagtgtaggcaactgcgacggtggctcctcatgtggaggaagtgacggcggttgctcggtgctgcggtggaggcaatggctggaggtggctccgcgcggtgatgggcggaaggcagctcgccgcgggttggagacgacggtgacgagcaggccaagaggcgacgatggaggcctgacccggcttggctgcgagcaggcgactgggaggagttgcttgaggtttttttttttttttgacatggggggttgctcgaatttgtgattaggatctgcttgactttgtgatgcttgtagcttgctatttgtcttctagttttgtaaaaaaaaaaagagtctcaaaattatgcctaaattctttcgattttttttcaatttttgtctaaattttatcaaatttgtggcaaaagtatgtcaaattttgaaacattttttatatttggtcaaaattttcatatttgtacaagttagtgaaaattgtaggatacaggtacaataaggagcaaatacacaattgatgaaggcaaatgtgtaataacaccattcgcctgtctatccaaagtacagataaaatttagcttcgtttaaaaaaagtagggataatttcatttttaccctacttttaaggtttaatattgattttaaccctactttttagggttctcatttttacccttgctttttcaaaatgaagtagacgtttacccttatttttacagaagttagtgtatctcggattattaagctaataaagaagtagagaaaaaaaaagaagtgatgattttttaatttattaattgacctttctacccctttcattttgccataggccatagccatacaacatccacatcctttttgcgccgcgccccagacaagcaggcagcggctccgcacgaggaggcaactacggtggctccgcttgaggaggaggcgacggtagctcggcatgggaaagaggtgacggtaggggctcggcttaggcagcagctccgcgtgaggaggagacaacggcagcgcctagtggggatcaggcagacgaggcggcgaacaggcaagaccgcagacaggcggctgccagctgcaacaggcctaatgatgccgacagcagaccagctaggcgacaagaagtaggtggctaagacagcgagcaggccaagccacagttgcgagcagtaagggtacatatttagaccgaaccgaaaagaccgagactgagaccgagaaattcggctatctgttcggtcctagccctcaaaagaccttgggctcgattaaccgaattaaccgaaaagaccaaaattttggcccagtaggcctaggaaggccaataagcccactagaacaaaccctagaagtgatacaaccttaccactgccacactcccatcgcgcttggcctccgcctgaccgcctctaccgcgccacctccagcctccaccgcctccgcctccgcctctgcctccgcctccacctccaccgcgccgcctccagcctccaccgcgtcgccgccgcctccgctctccactgcgcggcgacgcctctgtcaaattttttcattccaaacttactcctgaaaaatttcgatcagaccgagaccgagaccgaatttgtcgatcctaagattttttttagatgaaatttggtcctgagttttcaaagaccgaactgaccgaaaaaccgaaaaccgagaccgaatttttcggtctgaccgaacgcccacccctagtgagcaggcgagaacacggggagcaggcggtggaagaaaattttgtaggatagcggtccttcactcgtccgtaggacttcgccccttgtccaacacgtgttaggctggctagtcacaatcttaaagcaaaccttcatcttagtccccacgccgtgaagcgtgaagcggcggcgccgtaagcgtccagcattcttcctgactttactcgaggcgtgaagcggcagcgccgccggttgtgcccctggctgcagccacgtgagacgaagctacgtcgacagcagcgacgcggcgtgaggtgatgggtgttcttagagcaggtacagtagcaggctattagccagctataaacatattttaataagataaaagatgagagagaagagctgcgggctacagatctatagccagctgcagcacagactctaagacgcagtgtgtgtatgacaggtgggaccatatattaatagtatagtaagcaactattgtgtaaattgactattatattggctataggtgaattggagcttgtagtgggctatactattgaacttgctcttatccggtggaaggcgaagcagcatcactgatttgcggccatggattagatgtattgtcttggtcaaaaactgatctataaacattgagaagctacggcctacgaatgcactgtaagcttggagttcaggtttgcatattctccttaaaagaatagaagtgtggaatgaacatcatcgtcgtcgttctgagatttgtcagatcgtattaccactgcctaccatcgctggtttggaatcaagcttttgccatagatattgatgcatcgtctcacgggtttgctacaagacgagcagaagggcggcagcacccgtccatctcccgcacaccgcgccgtatcgatcgtctccgcactatattgatggccgcgcggcgcctgttcatctcccgcatgggacgaactaacgacgtcgggccacaggatttaccggtttagggggaaatgagggaggtttgctttgagattataattggacacgtgtcatgtggaggggcgaagtcctttggatatgcgaaggactgctgtcttaagaaattttcttccgcaggcggcggcgagctttgccaggctgtagtgaccagacgacgacacagtaggcggcaggccgcaagcaggccaagcgacgcctgcttgccttgctttactgcgactgcgagcaggccatttgctcgactttgtgatgctttgctacatgatgctagctctgtaaaacatgagtcaaaattgtgcccaaattttatcaaaatctgtccaaattcgtcatatttgcatattaaaatttcaagctacatgggggtataaatgtcttttcgctaaaaatttaacaccgtcaacttgcacatccaaagtagggtaaaacttggtttcgtttgaaaaatcatggacaaaaacgaaaacctaaaaaacaagagtaaaatcaatattaaacattaaaatagggtaaaaacgaaattggccaaaaaaaaagggataaaaatgaagaccctatactgtcagggtatgaaaaaaattacccaaaaaagaaaaggccaggatgttttgtcgttgaaaagaaaaggctatgaaaataaacaaagtgatttaatcaaagtcgtaaaaaagttcttagccccaaataatcaaagtgaccccagcatattcttatctaaaagttgtctgtcagtatcaccttttcacctatgcatatgtaatcatgctataaccaatcatgtaaaccatcacaatactccctctatcctatatattttaatcatcacctaagcaaaaaaaagaagcgtacagaccaaagacaataaaacattcatcattctgcattaatactcattggttaaggtgttacgtcgcttcgtgctccgtgaattacatcaagttttaaatattgcatgtagttggaccaatagaaattaatcttgggtagttgcgtacagtgcattcaatgatgctcatttactcttggcacaaataaacaaagatgcacttgttagaggatgatcattttggaaagactttaaaaaccttatgtgatgattaaaatgggatagagggagtataacacaaataagtagagcacacaattatcagtatgatgggacaaacctgagcaattgacacttgagcagggctccatgttctcaagcttagcagtgattcaggcctcacaacaacccaccaccaccttgttcagtatcctagtagagtcttgagttggtatttttttaacaacattactagaaatatgaactcccagcaatgacgccagaaacaaccctagtatatatatagttacagaagggatccgcaagcgcacggatatatcattgtaatatttcacccggaagtatttgtcagggttatggataccacatacctaatagtagttgactaagcacggcagagcccaccacataccatgtcttatacggaatcatacctcgtatataggagttccggataaggaaggatgattagagttctatatagaaacgacaatgactactcggattgtatccatattggtctccctaattctacttgaacaaggtgacatctatgggtataaatacaagccccctaggaggagaggggacacgccacaaagcaaacaacaacaacagatcaacacaaatcgatacaagccagcacacgccaagacaagccaccggatatcgacatcagagataagcctagactgtcacgtccagaaattcccgaatagaattccaagcagaatgtgcattaaaatccccgtccaggaccggccggggtacacaaacgacaatgttgacattcagatccacgtcttacaaacatcataaacgtcttacataaatgcagcgaaaaacgaaagacaacaagagctaagccttgactagaactgcagcgggaacaccactccacaagcatcctcgacggcacggacgaagcctatcctcggagaaacctccatctgacacatactcgtactctggggttgggaaaaatagagcaagactgagtactacccactgtactcagcaagtcataccggaataggggtatgatgcagggaattatcaaaggagagctagggtggttcatttgcataaagcgagcattcataaatagaagtttaaagaagaaaacagtcataataattaatcaatattaatcatccactgtccaacgctataccacgttgcgacaggccccaccatccacctatactatccaatttcaaaagactaaactagggtgagactaatcacggtgaatctggttgaccgcccataaccgcgggcacgactattcgaatagttttactctgatcagaggtgtacaactgtacccacaagacacagccccacgacacgttttcgtgcgccgacatgccaccacgacataccggaaagaggccatgacaggacccttcgcataaccccctctaaccaagcacaccacacctcaggtttcacccccactcctcgcaaggcagcgggcagtcccctctcgtgcctaggtgaatccggaagcgacagaggccgtcgcagggcccgccccgctccatcacgcccacccttgcctggatgcgtcagctagaggaaagctacactacaagccccgccgttgcccacgctggcttgtggtaagtacgataagttcttccagggcatcacgctaaccggtccttaactgccatgggtgtgaccagcaaaaccatgcacccacagcccaccatatgatttattttaattaaccaacaccaaagcggtggcactaatccaacaataccattagaaccaacagtctaaacattaataggattttccccactgtgtactagttgaactaagcatggctaagcaactcctagtccaacgtctattcatgttacaacccaagctaacaaaggagcaaggtaccaaaatagcatggctgtaacaataggtaaacatctcataataacattataaaacgatgcagtatttgaagaaaaacaatagagcatttgcaatataggatcaacatgttcaagtgacaagcatgacttgccttgctctgctgctggaggaacctcggcgactatttcgaagtacaccggagcgtcggaagaaccggaatctaagcgacatacaaagcaaacaatgcaaacaggctataagactactgaaacagagaacaaaaccatttttaatggattctacacatttttcttgatttactgagacttgaatgggcttaaacagagctcggatgaattagttatgaattttagaagattcactgtgtttattactataacaaaaagtccttaaataatttattgcgcaacaactcccagggctgacgtcatcaaggggggtggcgccgatgggcgggtcccactggtcagtgtctcgggagagaggggaaggggcggcggcacgtgggccccactcggcagcggctcaaggggagggaacggttggcaagcgggccccacagccccggctccacgggccagtgtacaggccaggcccggcatcaagccggccgaccggccatggcaaagcggcggcgcgcgcatgcgaccgccggagacggcaaacggcggcgcggacggcgggcgacggggaaaaaagggaaggaaaggaaggggaggggagacctcaccggaggggcggcaacggccggcggcggaaaacgagggaggcggcgaagaccggcgatgccgaggtgcggacgagcgacggcgacacctagggaaaaagagaggaggaattaggacggagggaaaccctcacggcgaccatccacgccggccggagtcggaggggagagagaactcaccggcgacacgagggagatggggtttcggtgggattccggcgacgcaaagcggcggccgggaaaggtcttgcggcggcgaagctaggggtggcggtggcttagcgcggcgacggctctagcggcggtggcacacggccggagtgcggcggcgggcggcggcgcaagcggcggcggtgcgagctcggtagggggcacgggatggagcggtgagagcggaaaacgagagaggagggcacggggagcattttataggcggagggggaggcggacgtggccgggaggcgccccgatttcgccggcgacgtgggggaggagagagagaaggtgggggcgattcaaaatcgaatcccgcccctactcgtgcgcgagcgcggccggaagacgcggggagagggggcggcgacgtggcgtgggcacgggcgacgcggcgtgggcgcggggaaagcggaggagtgggtgcggcggcggcggtttcggcggggtggtgaccggcgcgggcggcgggaggttaggggaggacccgacaggtgggccccacctgtcggtgaccccgggagaggagggaggcggggcggcctgactgggcctcggcctacggccggcccaacgggagaaaggggagaaaaaggaggaatgggccggcggcccattcaaaggaaaagaaaaaagaaaaagaaaaaaaagaaaagaaaagaaagaaaaaggaaaaagaaggaaaaaggatttttcctggattaaaattgcatgtgctcaattttaattggttaaaattatttcgagagctctgaaaattccactaaaaatcttg

SEQ ID NO: 62561 - DNA, 6245 bp, Oryza sativa
  unsure (1)..(6245): unsure at all n locations
atgcataaataatatgtggaactaacaaacatgctatgtagacaagatcatggttaaacgagatttttgaccgggatgatacaataaagtaagtttaataaagcaagtttagggatctcgacacacgttttacaagttcgtagacacaggtgaaacctcgtttaaagtttaagggccgctgatgcaatttactctaaaattaatgtgattgattgtaggagagtttttaattggtacaaagaaatagatagatatatacctgcaatgtatatgaagtcctaaatattatattgtgcaacttgtgggatgcatgtatgcagaactccattctcacatctcactgcatcacctaatcctaattatcctacagatatgaggcattcccttcaccatgtctcttcttattcttcgaaacatatataatcctatagtgtcctataatgtttctgaactagtgtgatggcgtacttcctgtacttaaaataagttaattgcaggtttgaagcgaatgatcttaatatatatgcctaattgtgttagttgtatattcttctaaacactacagaagtttaagcagtaagattagtgaacaaattctctcgatcggagcaatatttaagctagctttcggtatatcctttccaatttattcaaagatcctcgacatataccagaacaaatacgtacacatgttccaaatttccagtgaatgaaacaaaagttaaacaggcaatgattcactatctgctttcacaggtatatgtgtatttgttagtgtatggaagcaattgattaagaatacatggtgccatttgtcatgcaacaagttaatcgatcgattattaattttatggcagctgcaaggaaacaaatcacacttatacgctaatttgtgtttgccttcttttatgtactttcatgtatagaaagttaactcattaaattatgaactccattgtgtgtcgatcagtattgatcaagaatataaaaccatcttctagcaaacctgttttgtagtactgtttttctccgtttcttgttttatcttttgacttagatgtgtcgctttacttctgcagacggccggcacgtacacgagcgaattaataatttctgctttacatatacacgcggtatatatatcgatatatacgttgttaattactacctctgttttttattatataatggcattaaccctttttacatacgtttgactattcatctttttctttaaattttttgtgtaaatataaaagatttaggtttaagtcatgcttaaagaatatttgatgataaatcaagttacaataaaataaataataattacataaattttgaaaaaaaaaataatggtcaaacgtatataaaaaatcaatggcatcatatatattattaaaaaccgaaaggaataattcgaaagcagtaataatatagaataggacgatcgacgtgcaaaagtcgtccatttcgatcgatacctttgcagatcgattttgtcttgactcactaagcgtcatctgatgagccaaacatatcagatgaagcgacatatctctacagcaaacgagctatctgctaggagttgcacgcatcagtccaaaccaacgacatgcaagcaagctagctacacatatcgaaccatgcatcaagtacgtcagattcagtgttaaccggtaaaacaaataaactattagtagctcctatacaagtcatggaatattcagatctacaaataaatcacctgaggatcgatatatctactagctagctaaaattaaattgaacacacctgaattcacaaagttaataatcagaggaagcatctaataattaataaacatgtaatgcaagaacaataaatgccaattaattcctccaaattaattttctagtaataactggtgattgattaacttaatccatctgatgtgttttgctacctcctctccctactacacacgtacgttgctggctgaaaaaccctaagtacgtacacgcgcgcgctgcttcctcttcccattcaacccgcacgtgcgatatgcatgatccatattgtgtattgcatgcacgatgcatcgcaggctcgatgatttgcagcaatggcggatttggacttgttggatcgatcgatctcatggcttccacgcgctcgcccacacgacaggctgctccttccacgcaaggaacgctccggcagcagcggcgccggcggcgtcgtccgtggcaccgccggcgtcccgcatcgaccagccctccttgtaccgccggagaagcgaccgcacgtcgtcggcgacgtcctcgctgaatgccgccggcgagaaccccgccgaccgcatgcgccgcgcccacgacgcggcggtctcccggcgctcggcggactgggaggccgggcatgacacgaggtcgacgatggcacggccgaccgccctctccagtgacagcctctcgttgcttgtcttggggaagctctcctccagcgagtccatgtacgccgagaagaagcggaggccctcgccgaacaccttgacgaacgcggcgtcggtgtcggcctccgacgacgcgtccgcctccggcgccgccaggtcggcctcctcctccacgacggtgaccacgcgcggctccaggcgccggagcgacgccacgaacgcgtcgcgcccccgcgcgaccccgcgcagcgcgtttacgcagttgacggcgagcgcggcggtggcgccgccctcgcggaggtccagcgcggcgaggtcgaggtcggccaggtcccccgagtggtgcacggcgcggaagctgaacgggacgcccatcagccgcgcgaacttctcgaggcgctgcccgatctcccgcatcacgcgctgcgcggccgccgacggcgccgccgtgggcacgacggtggtgatggacaggtgcggcgtgtcgtccgaggaccgggtggccagcgcctccaggagggtcggccactgcgtgcagaacgtgttgctcaggtcgaggatgtgcagccgcgtcggcggcgtcgacgatgaagacgacgaggaggaggaggcggcggcgcccgccgccgcggcctccaggaacgactcgagtatggcgccgttggcggcgacgtgcccgaacggcgtccacgggctgagctcctggaacttgagcgccgtgcggcgcgtggagtcgaacgacgcgttccggtccgacgcggtggcgagcgtccgcagcgtgcgcgggccggaggtggtgagccgcgcgaagaggccctgcaggaagtaggaggccagcttctggtcgacgtcgccgtacggcgaggccagctcgttgagcatccacatgagctgctgcacgcgctggctgtcgcgccccgccaccgcgcgcgcgcactccatcagcagctgcgccgcccacctccccgacgacgacggcgctgccccggcgccggcgccagcaccggacgacgacggaacggccggagagccgccgaagtcgaggctgatatcaacctgcgggaacgagaagtccgccgcctcaaacagcccgtgcccgcccgcggacgacgtcgtcgccgacggaggaggaggcaccggcgccgacgacggcgcgcccgttcccgagtggaactggcgggaggaagacgaggaggagaagtcttcatccatgtaaaactggtggccgttgccgcattcttctaggtacgccgccggctgctgctcctccgcgtagtagtaccctccgccgccgcctccaccaccctggtaatagtagttggtgttgctattattgttgtagtgggagtgggagtggtggtagtaggtgtggttgtgggtgtggtgggaggagggggagctggtgctccctcgcgaggaggggtacgacttgtgcggctggtccggcggcgacggtgaggccgcgtgctggtggtggtgatggtggtggaggctaaccaacctgaagagggtatccatctagacctaagacacctgcagtagtagtagccaacatatggccggggtgcaaactgcagtgcagtgtagtagctactcactggctaccaccatacagcacagcagctactacaacaatctttctcacctcactacactgtcctgcaacaactgatcatcgatggatgcaaaggggatctaaactagctagttgtgttgtgtttaccatgcaatgcaaatgagtgaaatggtggtgacatggggttataaacatgcaaagggaagcaaaccaacaatctacttggcttgctacttgtgatgtgaaatggtaggagcacagcttggtcaattctgaggagcctgctgggccggcccccatctattattctttttatcccactggctctctcaccctctatctgtctctctgcttttttttttgtgggaccgaggagggagggaagagtgctgttgttattgggggattttctagcaaccgcttttactgggtgcgagagagaaagaggggactcttctcttctttgcaggtagcgatctcctcttatcgtggctttggctccttcagctttggtaaagggataaagtggtgacagtaggattatgcacgacagacacacagacagacatatactagccggcactaatacgtatacggacgactagaagcatttgaaaattcttccttgtcgctatctgcctctccttatgcccttggtatatattatttttacaattgagacacgacctctttcggttgatctccatattacctaaagagccacggtaagcgctaacagtactttctacattttttcatatctatccggtgcctataagtgaagagcaagtttagtatggccagctatgggctctaaatcatctatagttaattctaatagtcaagtcatataatggttagctataaacatatactacacaattaatacctagtcccatctatcatacacatgtcactggtggagaaaccatccttcgtcggtcggccgaattccacaatagtcccggttgcaataaaaaccagggctaaagatgatctttagtcccggttaaaaagggtaacggccatatttgatctttagtcccggttggtaagatcatctttagtcctggttcaaatgctgtcagggcttgtcaggcccccctgggatctttagtcccggttggttacgctgagactaaagatcccggggatctatagccccggttcataaccacctaacccgggacataaaaagtccccaacccgcgtataatataatgtacttacttccctccctcccagactgccccgagccaagccttccaaagatttgcattccaaaaaagcagcgggagnngtccatgcccaaaagtttnctagatgagattgtattttggtgatctatataccaaatccggaggtgcctaaaaggttagcaacttcatcctcccaatgttttttttgtcatattacatttggagctatgttttgcacacttttttgtctccaaaatttagttgtaagttgatgagagagaaaatttgtgtgggggaagaaagaatatatagaaatttagtttatttgctaaagaaggtttttataaaatagttgagaaggaaaaatatagtgaaagttaatcttaaataatagaaaacaaactaaaatgaaaattaaaagaagtacaacacattaatattagtttaaaactttagaaatagtaaataagaattatttggtgtaatattttataatttttgtatgaataatgatatgtcattattgtatgactgttgaaagagtttgtaattattttaaaactgtcattattgtacgaataattatttgtgtacgattttttttcatctcatgtagatggatcggcaatggatgtacgctaaccggcggtccaaagagtttattgacggcgtgcattattttttgagagtggccaaagctaacaggcataagggttttatttgttatccatgcaataagtgtaagaatcataaggagtattctgcatccaggactattcatttccacttgtttgagtcgggcttcatgccaagctataactgttggacatcccacggagagcaaggggttgaaatggaagaagatgaagtggaagacgacaatattccggactttgctcagtacgctggatttgaaggaaatcaaacgggcgaggaggaaagggatgctgatggtaacgacattgcggatgatcttggttagatgttgcaggatgctaaggaggactgcgaaagtgaaaagggggcctataaattggacaa

SEQ ID NO: 62562 - DNA, 1105 bp, Oryza sativa
cactagttggataacgcaagtactcgtctccaaaattctcaacaatagtggtactatcagcaatttgcagatattcatcttgagtgtcggctgcgactccattggttatcattctaagtgtggtggcaatctttaccaatggtaatatacccatagtacttgcagcatttctttttagcacaaaataatcatcatgggctaccacatcattaactatgcgcaagaaaagatgacaactcaatctaaacctgtgcaacaaaatgcgaattaataaagttgcctacaaaacagaatcaaccaaaatatgtaaattaattgcaaaccttcgccggaataagactgggccgtatgtaggattcggcgagaagtagtcgtgctgcaaccgttcatagctggctcgatgattacgtcgaacaacttgacgacaaggaacagaaccacctcaccgacaacgtcgagcattcgactgctcatattcatcttgcgcgactattgctgcagcagcgatgatggtctcatcgtcggatgatgatgattcatccaacaaaacacgtctcaaaagagagctcattgagtgatggaagaatcatgcacaataatttgcatggtgcaaaaagatagcaagcaatgtagtggtatatatagagatgatgcatgtctgtgctagccgttgcaatttgctagccgttgcacattttcaattagctagctagctgttggcaatgtagccgttgcaaatgtagtcattcaatgcacaaaaaaaatgcttcactcattttaaatatatcaattaaaaagatttctgttaaaatttaattgaaatattatcacgataaataacatctttaaaattaagtagttcaaaatatatctcttaaaatataaatgtaaggttagttgaaagatattactaaaatataggatgatgggatatggatgatctgttggagttggaagggatatggatgaggaatctttttttggatgatactccatatggacgtttcgaggccaatatagatgagctgctggggatgctctaacaaaccatgctgaagctgacaaatcctagcccccagccgtgaagttggaaaagtcaatttcc

SEQ ID NO: 62563 - DNA, 4478 bp, Oryza sativa
tgtattatgtctgtaagaattttattctacactagcatcttaacctttactcaaggacgagtaaagagctaagtgtggggggtttgttggcagctgttaaatgccaattctatgctgcaaacacctacataatacatagttaataatacatccaacatagtggtaggacttaattctaacaaattccatgagtgttggtgtatatttggatgcaggtaataaactgccgaagttgggatgaaaatcagacttaagtgaaggaagaattctatccataccagagtgggccttaaacttcatctaaacgtcagaaaatgggcccaactagggtttggccgaaccccaatcttagtcattcaggctgaggtttggcatgggcgttccagacgctctactgatggcggttgcggggcatttcagacattttgcgttttccgaccatcatgacctacctatttaaggaccctctctccctcacttcacacacacactccaagcttgagctgaattataagaggctctattgtactttattgtatactagaattagggagaaagtagagtagaagaagtcggaggaatttcggagttgtcggtagtcctctcttatttcttatactttgttaattactatgctttaatagaattatcattctgagtaattaagatttactcggtgataattaattcctggttagttcctaattaacgtgcaggataattgatcactatagtccagcaaaatatagtggttgctttagtgtttagctagcgctaaagtagatattaattgcgtagacgtggttgtcgacgtttgagatcatgactacggtattttgcatagtatggggatcgttggtaccagggtatatgcgagattgaggtaaaagagatggagatagggatttttatacatgtttgggccccttatctaacaggtaatagccctacatcctgttggctgaagccggtgttgctctttattcatctggatcacacaagtacaatatttgggataacctatctagctgtcattgacttggcggctagataaccaactcatagtcgacgacaggtagtcttcctcctcgaatccgcactcggcgagatcaaagatagcactatatccctcttgccggcctccgtaggcgccgaatggggtatgtctaggctaatctctgatgtcgatatttggtggcgcattagtttgtattggtttgtggctttgtgggtttgtggctcgtctcctctcctcctagggggttgtatttatacctataggtgcccccttgtccaagtagaactagggagataaatatggatatgatctaagtagtcctcgtcgtttccatgtataactctattagtccttccttatctggaactccttctatatacaaggtttgtttccgtataagacatggtatgtggtgggccctaccaagcttagtcgattactattgggtatgtggtattcataaccctgacagtatccccccgacttcaatgtaaatgaacgagttaaggttctcgatcgaagactttggaacaactattgttgtgctcgcttgaccattctcggtgtgatcagaaataacgctagattcttcttatcggtctttgtaggcaccatattgggtttgtctaggtcaatcttcgatgttgaccgagaaggtacggagcatgtgactaagtctcccgtcttgccgtaatcgagaatttggattgaagtcaagaaatctcgtctcggcgggtacactatcgcttcattccatattccttgtcaagccccatcaaccgttctcgagtaatcgagtaggcgtagagtctgcgacaaagccgtgaaatctgacttgattgttctgatgtctgattttccctgaaatcaatactcagaacatttgtcgtactcgcttagtcgatgccggtgtagaaccgtagagacatggagtcttcgataatgttgaatagaactcccccgagcgagcgctcaagggtaacatgatataatatgtatggaaaaattgaaaataaattgaatctgcgtgtgacaataaaagagtactctcgctagagttgccctcagcaaacgaagtttggtactcttcctagcccacagctgtttttatggaaaagccattttccacaaagacagcttgaatcttataagagcatccctagcagatcatggaaccgatcctccatcccagttttggcgtgtaggggtgaaaaaacgcgctccagcggatgtgctaacccacacgccaaaattggcggatgcgccatagtaggagagagaagaggtaaaaatagcgtatgtctctcttcacgccatttcgcccaaacgactctagatcgagatcccaccaccatcgggacttcggcaagaacctcccctccggcgcgagctccccccctccagcgcgagctcagcaccggcgcgccttcccctccatcgtcgtcgtcccgatccggcgtacgtgagttccccgtgcccattttttgattttttttcagcgatttatggagcgagcttacaagatctggggcgccgtcgctgtgctcccgccgccttccacctccggcgtgcgcgtggccgccgccctgcgcctgccagccgctaccctgcgcctgccagccgccgccgctccgcgcccgtgagccgacgccacccctcgcttgccgccgttgccctgcgcccgcaatccgccaccggcacccctcaccagagccgctagtgccagccttgagcagccagccgctggcgcccctgaccagccgctgctgcccctgaccagccagccgccgccgccccttgccaaccggcgtcccagatccgccagcgccacccagcgccgccccttgccagccgctgccgccctgcggccgtgagccaccggcgcgcctcccttgccgccgctggtcgcccctgagcagcccgccgttgccgcccctcaccatctcccccatccctctgcctgccctgtttggtagagaagaggttttgagagcaaagaagagcagaaactatagtatgttaagtgaagataagagctcttttcagtatagacaccacacttgagcagagaaatatagtatgttgatttttgtgaatttatgttcattgagcatatatatataataggaattaagtacaaactagatttatgttgctatattgcttgcttttatcttcattttatttatgttgctacgatttttcttgctaggtgaatccatggacagctatgttaatttgttgggctcaaacattgatgtagaaacttgggatcctagtcaaaattttccccaaactggacagcaaccacaatatagtcctatggttggtgaacagccaagtgctgaagttgggggtcctctagacccaacaataagagatccaaaatttcagcattgcggaaggtaaaatgttggtgtagcttggctgaatacaactttagatgcaatcacaggagctgagcaacaccgtgactcctactaggcaaggattcatcaatacttccatgaaaacaaagatttcctctctaatcgtaaccaaaattcacttaacaaccgttggggtacaattcaataatacgttaataagttttgtgggtactatgagcagattcttaatagacctcaaaatggaatgactgttcaagattatgtatgcatctaattcagctcgcatcttgccaattaatgcaaatcactcaggctactactttgtacaagtcagaagagaagaagacattttctttaatgtactgttgggagattttgcatcatcatccaaagtggaatgataggttgtcccagaaaaaacagaaagcgaatgtcgatcctttggtgataccatctgcaaggacaaactccagggaatttcattgcagccctgacattagtatctctgatcctttggtgagaccacctgggaggaaggtggaaaaggcaaaacgcgctcgaggtgatacttcttcatgctcaagtgagagtagtcttgtagttattgcattaactaacatgtggtcggagaaaaaggagatgagtgcacaatctagggaggaaagaaatgaccggttgggtgaagttatttcactagagaaagagaggttgaaaatagaaaaatgaaagttagatttagaaacccatgaaagagaagagagaattatgaacatggatcttcgtgctatggatgggccaagaaaagcttattacttgcgtttgcaagaggagatcataaaggctcatatggattgagttcatgatgtatggatatgtgatacgtattgctatttcctaatgagttgtgaacttttatgttgtgtgccgtgtaggcatgtgtcaattatgtactgatgcttgtaagaactgtatgagttgtgaacttttaagttgtaggtatgtgacatttatgttgtatggaagaatggtatgattaattgtgagcacatacatgttgcatacatcattag

SEQ ID NO: 62564 - DNA, 9910 bp, Oryza sativa
tctcagcctgcacacgagccaatccgcagcaagttggcagataaataaattctcattagacagaataaattgatccacaaacaacgtgtgaacattcttaatttcagactccagccaattatacatagcatacaacacttgagatgcaatggagaaggacccagacaatatatcaggcaaggcacaaataataattcaaccaaacaaattaaaaatatgaaatatgtttcagttaagatactacaagaatgtaaaacaaagacttaaataatctaaggtcacttacatgagtgagaaaggaaaatcctcaatttcaatctaaacggagggtgtacaaatttacaaaatcaaaatgggtatggcatcataatcttacctcctcgacatgctgggcatcaccaagcatgcagaccttcatcttggggcgggggatatggggcagcttgacggagccgctgaaacgcttgtccttttgcgggtcatagttcttgagaccaatctgaagctcaacggtctcggtgaacttcctgcccttctccttggattccccaacaacctgggagatggcttccttgagaacctcgctctgcaacttactgcaattgatcacgcaagctcagcacgtgaattttgttcaggaaacaaagaacgagcatttcttataccgatcagtaacctatattcagacataatctagctagcgccactgatctctagcgagaagcagaaaactctagatcatgcaaggtgtacagctacgtgatcccagtctatctcgagatccatcgctttaatgagacataaactaaacaaatcgtccgaattccatatcatcttcttacatcttaataagagctttgatctaacaaagcaagcgcgcagaatcacagaaggccatagcgacagaaactaagcaatagaagagattcgttaaccgtaagaagggaagtagagattgggcggcgggaatcacctcatgatgatcggcggcggcggcggcggagggtcagggagcgaaacggcgcgagaggagagaaggcggcgagtgaggatgcgtgctcccgacctagggtttttgtggctgcatgctctgtgccgtttcgaccgtccgatcggatcggacggtggagattgacgccggtgggcttcctttcgtcgtgggccgaaacataaagggcccattccacatatggcggtcgcgcatctcaatctcaaaaaaaaaaaaaaaaggaaaaaaacctccactacgcaaatcgtcgtcgtcttcctccgccgaattccccaccccaccggcggcgcgaccgggcggagatgtaccacccgacgagaggcggcgtccgcggcggacgggatcgtaagctctctccttctcctacctttcccaaatccactcgccgtgagatctcaatcgctggctgcgggccctaattctgccgcgtaatttttttacttccgtgaaacactcgctagggtttcgatgctgttgctagggactcgctgtggctgtaaggttctagttgttgatttgtcgatgctccttcctcgcgtttgattgcatctcgtccggtcttacttgttggttccaactcgtccgtgttgcactggattcgattagctagttcgtctcttgtgtctatgtggttagtgcgtaggatcttaccttccaactcatctgtttgcttgtatgatcttgcatcaggaggaattctgtgtctgccatattgttattgaatcatgttcctttgaaaggttataagatggaaactgcacatggcgcggtcacgcacgtatgcctgcccgcattcagcacccttcggcacgcgtgttcacctttatctcttctctatccaattgataccaagttcctcattggtatccgacattgttttttagtttaaaaacaatggtcataagatgaatggatgaccccattgcaagggatcctcgtgtgacagactgacagtcggatcatcaagggacaacaactactggggttacaacgtactgctgccaaaattaccttaatgaatggtggcatggcaataccagtcatcaggatgaaacatgacactataaaattagtattagcacttctatatgctggatgtatgagctttccaaaatttacgcgagtttttcgacttttgtgggcatatactatggatatgcatttgtttggtgcaatgtacggcccttattaatgtgctcccagctctaggatatcatgtatatagctttaggatatcatggaatattcaggtttactctctgtatttcgatgtgttttatgctttataatggtaaggttcatcctcatgctgcatgagcaaaaagctgctagatacctacaagatacaatgaggtgagaaaatgatccaaattacattgattacaattgctgcatctgaaagagaaaatcatcactttttttttggggggggggggggttcatttataggcttgtactatataactactttgtatatgataaactcactagattatcatcacttatgggcatcatcggtgccctaattgtataaccttatgcttactattcaactttacaagcgctataaataatgagtgcagcccgttagctcctccaattgcacctgtggttcttcattttgtactatgaacataaagctaccttttctcaaacagaaaagcgtgcactggactactcctacacctgccaacatgaataggcctacattttgatcgtttgtttttgctataagctcttctacatgttgttctgttccactgccattgtgtcatctccatcttgcactttgcattgtagcttacgagcttttttgttatatgggttgaacatacaattattagaaaagctcagtaaatctaaatacttttctccttttgttccttgcagaattcaaatgggatgatgttaaggttgacaagcaccgagagaattacctcggtcatagcattaaggctcctgttggaagatggcagaaaggtaaatataacaataccccttgtttacatccacctttgttggctggctagtccttataaaacaatggttttttactgctcgacatgaagtggtttttcttcttcttcttcttcttcttttttatgtcacatggtctaattaaattgttaaaaatatcttatctcttactgtagtttcctacttgaccttgatttagctgtactgttagtctactagattagtgaataccagttgtcccatgtccagaaatcaagagtggctaatcacatctccctcaagttgttcaggttaacactatcattttgtgtataccgggacattacctttgatataattgaactggaatattatgtatttttagtgcgacaagtgcgtaactgttgaaacataagcaggcatttgtcagggttagcacgaactaaacaaaagcgctggcattctatttattgaccttctagctgatacaaataaagtgctatggcatccttttttattttatggattccagatacaaattaaaattagtcattcatgtttttcgaccttctagttatttatcaactggaagaaatgttggtcttgtgagcagtgaatttgtgaaccgtaggtgcattcagtgagttcaatattggcatgtgttgttttgttaccagctcaagtgagtttgtaattgtaccttagaaacctcgttttggcttgataatagtaggctaatagcaatagatctccttttttagctgggcttggccaaatgttttgataagccttcaactaaagtggattggaatgtcaatgcttgttttacttttttaagtcctgttattttaatgtataaccctgtggattctaagttattgatacgagagactgattatctcggccagggaaggacctgttctggtatacaaaagataagaaatctgactcagaagatgctctcaaggaagaaatcaggagagtgaaggaagaggaggagcagtccatgcgggaggcacttggcttagttcctaagcgtagtagtcgacctaagggcaaccgattagataagcatgagtacgcagagcttattaagcgaggatcaactgcagaagacttgggtgctggacatgctgaagcagcacaagtgcagggtctaggtttatacaagtaagttcatgctgcaatagtttcaaacccactttaaatcatccttattatatagtggtcatataatcgaacttatctgaaaagttttttctagtgatatttgatgaattactaataatataatcataatgcacattatctcaggggtcctcgcagagaggaagaatcgagctcctttaaccttgatcctccagaaatggtgcccgctgagcaggctgacaaccctccaccggaaaccaaaccggaacgtgaagattccgatgatgatcgtaggagcaaaagggggcgtgaggagaggggaggggagaaagagcggaagcgagaaaggcactcggaaggaaaggagaggaggcgtgacaagcaagagaagaggagtcggcatgagtcggacgacaggtcgaagcgccaccgcaaagacaagcacaagaggaggcatgactctgattccgactagttactgcggctctttcaacctgtctcactgtatcctgccatcatatttcatgccttgctacgtttgcttgatgatgatgtagttgtaaaaacagcttgtatactcttcttgaatacattgtctgtttttaacttgcacatgagaaatatgttgaacctgtaacatcagcggtgcattttggcaatcttctttctgcctatccttgtcttgtgcatttccatcttcacgggatgttaagtgttacggtgtgtagttcacatcaaaattagaagtttaattaaaattaaaacgatgtgacggaaaggttactccctctgttccaaaaaataacaatcttatactggatgagacacatcctaggacaacgattgtccagattcgattcgttgtattagtatgtgtcccatatagtataaggctgctatattttgggacggagggtgtgctctgcttattagttatttcttcaacgatccagtgaaaaccattcttaaatttaacaaacgtttaacacgttaagcggctaattatccaaccagaatttcccaggaggaacacgcagattagcaaaggaaaaataaataaaactagctgagtcaactctctctgtcgtcatcttcttcgtgtgtgcagtgtgcgagtaactcgactcgacgaagggcaaatacgtaactttctcggcaggagaggagttgggttgattcgcagcaaaggcacggcacggcacgcacgcactcgaattcaccttcaccttcagcgcgagccgcgagcgagagaggaaaagggaagcgacgatctctgcccttctagaaggttcgcctcgtcggtccccttccccccctctcctctcaagcttcagagccctctctctcccttacacgaggcgagatctgctccccttctcccgattcaaccaaccaccacctcatctccgattccccctcttcttcttcttcttcttcctcttcttcttggtggggttagtttctgaatcgtctctactgctaacctccgactctgatgccgcttcctcttcccttctctcctaattcacattctattcggatttcctttttgagggtactctagtctcactagtggagtgattgattggttgattggtgttgttgttgttgggaacacaaattagggtttgggatttcttgactggacgacctcgtgcgatttcgggaggcaggagccatgaacggcaataagcagtccctgatatacagcttcgtggccaagggctccgtcgtgctggccgagcacaccgccttctccggcaacttcagcaccatcgccgtccagtgcctccagaagcttccccccaacacctccaagtccacctactcctgcgatggccacaccttcaacttcctcgtcgaccgcggcttcggtaacacccctcttcttcttattcttatctttctgtgggaactgaactacagtagttagtaattgtgatatctgttgagctcacttgggttattttgggggctgcagtgtttctcgtcgttgcggatgaggccgttggaaggagcgtgccgtttgtgttcctagatagggttaaggaagacttcatgcagcggtatggctccagtatcgacgaggagggtcaacacccgctcgccgatgatgcagatgatgatgacttcctcttggaggaccgatttagcatcgcctacaatcttgaccgggaattcgggtatgaagtcaccatatgctgtgttacctacatatgatgtttctttcttttactagtatcaaatgtgtctttaacatgtgtttttgtgtttgggtatagaccgaggctgaaggatcacatgctgtattgtattaatcatccagaggaaattagcaagctctccaaagtgaaagcacacctcacggaggtcaaagggattatgatggacaacattgagaaggtatgtgctcaaaacagtgctttctttgctgaaagaatatagtatattgtgtacggaaacaattgttgtgtaagtaaggtttcccaaaaactctggattatattgttctagacacctaacagttcccctgttctattcatgtatggccatatttctgtgtgatttatttctttgatgaagtaaacgtggatatcatgtcagggtatgatgtaaacatgtttcaccttttctgctcaatgaaaaatcgcgtaaacttgtttcacctttcctgctcaatgaaaaattgcaaatggaaacattttcaatagttcatgggccacatcccatgctgcttggaagttcctgcagaatattattactgtgtgcagtctatgttgctatgcatagaagtgctctggtgtctgttggtgtgattaatttacgaattgaacaagtaatgatgggatcttgagttttaaaataaagatcagtttttcccccctttttgtgagttagtacatactgttgtcattgtggtgatgaatcgtctgcttattgttttgcccacgtatttgaactttttttttgttacaaagtcttcactatgacagtatggttattggcattctagtttcaatatcttgggatataggagtatcattttagttatgctgactttccaatatagaaacccatgtctagtactcctacccagtatgtaattagtcagtctggcattttacaggaagccagagaatgcaaacaatatttgtggcctcatgtcattttagtatttaactgaatacagaaaaaataaactcctttcttgatgtttcatactactgactcttactgtcctggattttgtatagatattggaacgtggagagaagattgagcttttggtcggcaagactgaaaccttacaatcacaggtatggaaaatctgtgtgaaatttttgtttctgtaagaatgtttaagtaaccatgactaagtggtgtgttttcaaataatcttcaggctgacagcttccacaggcatggaagagagctcaggcgtaagatgtggcttcagaacctgaggtttaagttgatggtgggtggtgctgttgcggcgttgattctcttcctctggctgattatttgcgggggcttcaagtgctagaacattgaaagcctttttctttgttttgcattcgatgtgtttaccgtgtcgtgtgcatatataacgaccagcaaatcctgctttcgatatgcttcgtgcagagttaaatctccttatggacctttattccttgtagcctgttctcatgtttcatagtattacaataggggggctctggaaatggaatacttgtgtaaacaaaccttgtgaaaggagacaacttagctatctgtattatgtacattctgaaatgctaatagcttatttcaatctcattttcattggtcattctcagctggtgtcctaaatgttgattgcgtaccgcgcgtctgcgccagatcatttaactcgctattcatattctgcaattaatcgattctttgaactgtaagggtctatctcaagattaggatggcgcaccgaatttctgattgcatgaaagatatagtttatcttcacaatttgcaaagggagaaaggctatatatgttgatatgcactctgcttctatcaatccctcccgtgctatgtttagcggtgaagcaggtgtggatatacctcaactgacagcatatgatcagtcgaactgaatttcatacggaatgagttagactgactacgcctaatcactttcattgctgccctttttttttctccctcttctagcgttgcgaggtaaatgtattagttagagaattcgagttcctgttatataaatttataaaacttacggaacagaaacaacgcaaagggtgtttggtctagtggtatgattctcgcttcgggtgcgagaggtcgcgagttcgattctcgcaacaccccgttttttttttcccaattttgcttcaacggatgaccaattgcctgtgccatttacctgagtctaattagcagctatttttgacttttatttttcccaccttgtttgtgcatgcaaccgcgtatagaaatattttcacaagataggtatgtcttgtttgaaccaaatatgggttccggcactttgtatcgccaattctgagatatcaccattttttggtggaaataatagtagccaaaattgtctaagtacgagtctatacaacatggtacagattggaggttaaagcaaaaccagtttacttgtgtgaacatagttgtgctctggttagggtccatgtgataaaaatcatagggtacgtacgtttgatggttaaagaaggtacccgtggttagtggtgggtgattttaatgagactctttgacagtttgagcacttctctctgaaacaacgaagtgagccgcagatgcaagcctttagggatgtggtccagagatgtgaactccatgatctggggttctcgggggtgccatacacttacgataacaggagagaaagccgcggcaatgttaaagtgtgcctagaccgcgcccttgcagatgatgggtggaggggactgttctctacagcacaggtgtttcatctgtcctctcctagatcagaccattgccccatccttgtcaaattttattctgaagatcttcgcaggaattttgcgaagtgtgtccattatgaaatttattgggaaagagaccatgcaatctctgaagttatagcagaatcttggggcgtttccggagctaagcaggatctgagcgacattaatcaagctctgtttaggatgatgtctaaccttcgcccatggagtaagaaaaagttcaggaatgtcagccgggagattgagaaaactagaaagaaactatctgaacttcttctaagtaataccgacagcagggaaataagacgggtgtctgatcaaatgaacgaacttctgtaccgtgaggagatgatatggctgcaacgatctcgaattgcttggctgaaagaaggtgatagaaatacacgtttctttcacagcaaagcagtgtggagagcaaagaagaataagattacaaagctacgggatagtgacggtactgttcacaatacgacaaaagagttggaaagcatggcaactgagtatttccaaaggctgttcactgccgaccccagcattgatcattcgagagtcactagcctgataaagccgaaagtcacggatgcgatgaatgaggaactatgcaaaaccgtcagtgaagaggaaattgcaaatgccctgttccaaattggtccattaaaagcacccgggccagatggattccctggtcggttctatcagaggaattgggctatactaaaggacgacattgtgcgagcagtacaagaatttt

SEQ ID NO: 62565 - DNA, 778 bp, Oryza sativa
cgcagtagtcgcagacagccacacctgtgaacacgcaggcagtagtagcgagcagagaaatcgatggatagtcaggagtaaggaagggatgaagcgcgccaccgaggaaggaaggaagcaaactgaccttgatttggttccagtatatggcgtcccagctgccggagccgtccatctccgccgacgacgtcggcggcgacggtggcgcccacggcttcgcggcgtcgcgggcgacagagagggagggagcgctccgtctcgtccggctcgtgtttggtttcggttgggtttgcttgtcgtgagagggaggcgacgcgaacaacacacgcgatcgcttttgttgtatgtagcatgtgcagcgcatgatggtactacaagttagcgtgaccgaatgaaatgatctcttgctacaagttttcctcctcctcgtgatgtgctatgcttccgtgtctttgacttgggttatatgtatgatcgaagaaccgttaatcacgcacatggctattattcatatatctgtcatttaagatagcgatacaaaatgtattagattcagcttatactatctactataagtttgggatattgtactaatacgagtagaggaggaaactcttcgagcgcactattgtacgctagtatgatctctttatatcttgttggctcaattgcctgagacattactgagattaccatacttttaaaagattgatcagtcccagtcgttaaatattgaccctgcttacagtttcttagtcacatactcatttgcagataa

SEQ ID NO: 62566 - DNA, 12265 bp, Oryza sativa
attgattacgatgcttttggtgatgttgttgtttttgatagcacatatagggtaaataaatacaatttacctttcataccgtttgtcggtgttaaccatcatgggtccaccatcatttttgcttgtgctattgttgcggatgagaagattgcaacatatgaatgggtacttaagcgctttttggattgcatgtgtcagaaacatcctaaagggttgattacagatagtgataattccatgagaagagcaattgcaactgtcatgcccaactcggaacataggttgtgcacttggcatattgaacaaaatatggcaaggcatctccgtccgaaaatgatttcagactttagagttctagttcatgcaacttattctgctgaggagtttgaggaaaaatgggtggagttcaagctgaaacgcaaagtggcagaagataaccaatggctcgggaggatgtacaacttaagaagaaatgggcggctgcatatactaaaggtatgtatttccttggtatgaaaagcaatcaacgtagtgaaagcctcaactctaaacttcatagacacttggatcgtaaaatgagcttagttcttttggttgagcactatgagcactgcttgtcgcgtatgagacatagggaggcagagcttgattcgaaagcttcacagtcagttccattcacagccaacgatgctagtctaattgaaaaggatgctgcccgtatattcacaccatcagtttttaagaagttgaaaatggatattattaaatcgaaagattgtgaggtgatagactgtatagatgaggaaaatattattaagtacatcatttgcatgaaaggaaaaattgacaagataacaatcttgacttgttcatatgttgaatcatcattgaagaatatgagctgtacatgcaagaaaatggagtgtgaaagccttccatgtcagcatatgttcacaattatggactatttgaaccttcaagccattccagatgtgtgtgtagtgcctaggtggacagttaaagccaaaattgcatttccttcagataggtatggtgaggtttatacctggtctgatcagatggaaagatatcgtagaatgcgtgcaattggatctgaggttttattgaagtgctcgatgtcagaggaatatactttgaaggtgatggagatgtttgaaaaactggacttagagacaaatgcaattgagggggatgaatttgatgtaacattgtgcggtcacgttgtagctcaaagtttacgctctgacattgctagtgtacagaaggttcatgatcctatggaggtagtacctaaaggtgcaccaactaaaaggttgagaggttttttggagaagggtaaccggcgttgtggttattgccgtgttcgtggacacacggttcgttcttgtgccatttacctaaggtaaggttctaatatattttgggtaatgcttttttttgtgttgtttttttgtaattggtgacaactgacaaggactagttttgttgttatttcagaaaagttgcagtagatgtatgaagtgcaaagtggaagcaatcaagctccatgtcttatccagtgggctattttgtgctatttgaattctgtaaatcatgagtcgtggcaggactcgtttgttgtgtttgaaaactgtattggagctgtgcttggtctattatgtttgctattttgtactcgtctgttgtgtctgaaaactgtactggagctgtacttgttttgttcaattattcatgactttggtttgctaatcgatcacgaactgtcctcctatctcactgtattggagctgctatagttaatccattattcaagtgtgctatacatgctcaatctgggaacgtgtgtgcttttcagtggtgaaaatcatatgtgcgggaggagatggcatatatacattttgagatatcatgatcgagtaccaaagtttaacaagggccaagggccaagagatagcatgcgaaatataatttcattcatagttgtggtccaaatacttcatttagcacaaaaggcaacttgcaacaagcagcactcatacatgcaattcacgaatagcacgtgtgctcacatatagcagacactacacaactgacggacagcagacatgctcacatatagcagacagtagactatagtaaggttgcagttgataatctccttcagagcaaatcaagacagtaactagaagggtcagtagacacttgtacgtcggacctgatatatgtcatagaccacacttgtgcatagcccagattaacccggcacggggtttgtcgtagagtgcacgtgtgctacgacacttgtacatcacacttgtgcacatgggtggacctaccatgattcccgggtatgtgcgaacggtgtgacatcgcgtgttgtgacatcgcgtgcaagtgttgtgacatcgcgtgcaacgtgttgtgacatcgcgtgaaacatttgcgtacaagtatgtgcgaacggtgcccttcgtcaggtccatcacagctcataagcagtgcagaaatgtgctttggaacttgttgtggtctgactcatgacaggcaatagtaatggggactttaaatttgttagacaacggtagtgcatgcagtcctgacttaattcctcgctacacttaccgatgagaactgtacagtcgcctattcaaaagcatgtagttatcgaacagacaagtcattaaattaatcaagttagccataatacaactgctaatacatgcttactaaaaatacagactgagatagagtcagataattttgtttcgtgctctagtatctccgtggcgccaaccatggcggatcaagacggcaacgcacgtgatgaaggcccacctcaggtgccacagcaagctcatgtgtcgtttgcccttaaggtatgtctaaaatcattcaaatcatgcttttgtcatatccattcaaatcgttttcctatccactgatttcatgctcctgtcctctaaatcttttacctggaaaataacagatgagctccatgactattgcttgttctattccaaaatttgtttcactcgttcaaaatttcgattcgtgtcaaaaagaagctattgaaagaatcggttttggtggtttattgcaaatgcctgatattacacttcaaaggataacgtgtgggcacatcgctgaccagttcgatgtaactacagaatgcgttgagattgaaggtatccagattccaataacaacatttgatgttcagtgcataatgggtttaccagctggagaattgttgattacccctaggccagtttccgatgatgaagactacaagtactactcggtgtacaaggacccaaaaaaaaagaatatcagtctagctatcttgcgggaagaactcttaaaagcaaaagtagccgacgaacatttcttgagaagatttgtcttgtttgaaataggatacattctatgtccgacaactaaaccatttgtcagctcaaattaccttgctttggtgaaggacatcaaccaaataaaacacatcaattgggctgctctcactagagattttctgatccgttctctcaaggagcttaagggcggaaggactaatctggaaggaaatctaccactcctacaggtaacgtaactactccatacttttagttcaacacagatcaatattattttttacagcttactagacacgtgttaacatttctgttcctactgctactactttccaattctggttatgggaacatgtgcaggtccaagattctaagtacaagatgacatatggtgataggacacctcctctcatgtcgtattggaatgagatgaaggtcaattcatggcttaagtacgacagcaaacatggcatatctggactagtaaggttcttatgtagtactaacacgaccagaacttctccttacatgttgttcaaatacaggttgtccaagagatcactcttcccttgcaaaaatgcgatccaatagttcaacatgacaatgaagagcatgccgaacaagcagcggacaataaagataacaacattccagttacagaccacggcccccacttgggaagacagaatcaatcaagaaattcacacactttccagatcagatacagaccatggccaaacatatgaatccccacaataccaaaattatgctacaagtcctgaaagcagccagcaacccaaggtattatttgtttcatttcaaacaaagtagcttgaaattgcagtttcttacttcgctctctacagaattcagccaatatggatattgtactgggccagctactgcaacttcaacaaagcatccagttccttgacaataaaatgacaaacaagttgatatcaattgaaggcatatgcaatcaaaatagaaaagatatccaggtaatacttttaagggtcacatctcacatttttgtgatagagcaatgcttatatctaacttataataggagattaaaaaaaggttgagatcagcattccatgtaacaagcgcaaagcacccaaaggtcgagatcatccatgagcagttcaacattacaaatcaagaggaagtaaggactgcacaagctgacgacacaaagaatacccaaacagagagcgtgaaaactacgcgaagtgacaaggtgaaacacacacaatctgacagcatgatggaatcaaaggtgaaaactgaagacatcaaagagacaagccaaactcctctagttatcctaagcgacgatgacaacagcaatggaaacacagaggtcctctaattcttgcacttacagtcatatttaataatctaatattgtattgtataattgttaatgttataccatccttgcaagctgaacccaaatacaaagatcctaatattttaggaaaaagggtcatcaaaccagcacacaaagcataagatgacttcgtgtactacaagaagaaattcacagttactgcatcgtccacaaaacaaccaaagatagacgatgttgatgccataacgattaattatatttccaattgcaaagacaacatattactttcagctatcaatggagtcaaactttattcccagtttcttagagcacttgttgtccctcaagaagcacctccaacatccaagtggttaaatggcagtgtaagcattcttcacaatactaccaatgtttttatttaaatttcaatcctgagtattattcatcttccatcatagatcatagacgcatacattgagctcatcaaagacgagcaagccgacacaccaagaggaaatgggatggcattactagaatctgaagcacattgccagcaatggaaatctgatggtgcaaaaaaaggaactttcagcaaaacataccgtcaaagaagagccacagttgcatccaaatacctcaaccatgatatggtataactaaatcctaatgtatccatccatactaccagtaaatcaaaacatttatttttcattcattccatgcagatcttcctaccgctaaatagaaataaggaccactggtatgttgttgtactcaatgctggaaaacaaaaaatacagatactagactcaatacgtatggataggaacacatatgaggctaacaaagacctcaacgatacggtatgttacattctaccgtatcatctgcgtgtttatacaatgcattcactttgtacattcatatatacaatcagcgattgtgttttgaaaacacagattaaaggtattgacaagttcatcgcatatgcaaccgaggacaaaagcattaccacaagatgaaaaaatacaaatgtgaccgattggcctttgtgcccaatgcaagttccacaacaaagggacggttggtcctgtggtttacatatgttgaggttcatagaacactggactggaaaagagctatcacctcaattccatggaatggtatgtttcctcaatcaaaacataaatatacaacctacttcattgctctaaatatttctaattcatctttcaggacacatgcactacatttagagcgaagctggcatccaccctaataaactctttcatgaatgaggtcatcaacatacaagaagacatcagacgcatacaaactgagcaaatgcaacaaaagaaggacgagtgactagactcttttgcaaatttcgttccatgcagttagaaaattgttttgtatctttctgaacttcttgtcgctcatacatttgttaccaaggcagtgggcaaaaaaaattcagaaaaattgcaatgtaatgtcacatttccacccaacatttctatctttctgaacttcatgtgcctcaaacatttcttcccaaagcagctagcacaacaatacatgcaattttatgccacaaaactatagttcccaacgcatttccacccaacgtaactgtagcgacgaacttaccgctgcggcgccgttgcagtctgttccgaccaccatatcgccccttgaccacgacggcaaacctctctcgtggctggcgacaacgagcggaccagggctgtaccgacgagaagcgaaccggcgtcaatcagccctggacttcacagtaagaactccgcgggagcgccgcccttcactcctcttgcctttgccctggagtccgcggaagcgccgcccttcactcctcttgcctccgccctggagtccgtggaagcaccgccctggagtccgcggaagcgccaccctggagtccgcggagatcggatggggaatcagatcaggaagcgccgctggcaccattcacttctggcgacggatggggaatcatatcgggaagtgccgctggggaatcagatcgagaaagaatttgcatccctagggttcctccagcttcaaagcgaaagatgctctaatgatatgcgaagttacgcatatgcccttccacccttaaacccactcgcgatacagctcaaattcatccacagtacctcgcggtacccctgttttcagtccgttcgatccgctccaacggacggcccagatttcgtaccgcgaggtaccgtacctacctgctagactgtagaaaacctcttttataaaaggccaaaagggtcaatatgccaaaggttcggtacggtttggaaaaggaacagcaacacagcattccgccgcgccgccgaaatcgccatggctcctcccgcctcccgcccgccgacgccgacgccgacgccgacggcgaatgcggcggcctcctcgtcgcggatagagtcgccgtcgctcagggcggccctcgccatggctctcatccactacaaccgcctcccctctcgagcagcagcagccgctgccccctctccccaggctctcctcaactggaagcgcaaggtaggtcgcattccccattccacaaccccgccgtcgaaccctaactctcattctctcctctgatcccgtgcgtgcaggccaaggaccggaagcgcgagatcctccgcctccgcgaggagctcaagctcctccaaggtacgtatccgccgcgccgcgttcgtttactcgatttccagtccccaattcgtgtatgggtgtgatcagacggggcgcgcggggaggagatggagccgccggtcgcgtcgtgccgatgccacttcttcgacgggtgcggggaccttccaccgccgacggacggcgatgctggggagcactgggtcgacgacgtgctgcggaggagattcgtcagattgggtacggtttttggcttcgatacactggttttttttttgaatttttgttgcttctagtagaattttttttttttgaaacctaaggcggaactttgttccacttttatatttagaagaagagaattgacccagtttataaggaaaaccgggcccgaaaaccacacaattgcacggttaattataggagcttctagtagaattttacatgtataagctctattgcaacagtgcggtggaaggataagcgcaggagactggacagatcactgcccacgagtagtttgatgggtgggtatcgctgcaaacatatgttcttctcactcactactcggatttcagattactgtagaatagtttttaactgctcaaatcttagtttcaattgttcgattgtgcagaatataacactgaggatgaggtacaacagcttagcttgtcgattgatttcctggtggagttatcagatggcttgtttgccaaagtaaaattctgttgtcttattatatctaagaatgtaagatatcccattttttgtgtttctaaaattagatttgtttgtgcagagagaagctggctcctcatttactacattttctcaccaggcagtagacttcattctgggtaagtgagagttgcacagttatgccacgactgaacatttaataaattatatctgttaattgtgccccacatatgcttcaagcggtatgagttctcgtcactgataataacgttcaacatatttgatttttctgtggttatttacatggcaagttgatactggaacctgaatgcatcgtcttgtagttagcaaaggaattatgaatttacttccagccttacctttcagttttcacatattttgttgattgtttaatggtagccgtataagatggctctagaaactattttcagtttttctattgcacttgccacacattttattttgtggggttaagagcacacttgccacacaaatcgtcaatatgttgcatatgaagttatctatttttgttttctgtttattccatgttagattgatgcagccatgtgtgataatcaatggtttcagcttcactgaagaacattctctcgtcagaaagggaaaaggagataatcgaggagataatcaatggtttggttgcacgtttgatgaaaaggatgtgcaccactcctgaaaatgctggtacttcaagttcagatgatctttaattgatccatttcagaccattcctagagcattttggatatatgtttttctttcagaaattacatccatagtgatgaatcatgaaatggtgccattagttgcacattagcagtgttttagctagtagcaccattactattccttaacaatggacttgactttcttttcgcttggtttgttttttgggaacatttatctatgttatgacatcttatagttttgcttatttttatcacttgagtgttaactgaatttattttcagaatgtgctctgctattgtcaccaattctatatttatttgtgctcctttcattttgttcgtatattgcaggatcagttgactgttcagatgcccaattctccctgcagcacttattccgtaagttaggaaatgaggagtttgttggtcagaggataatccttgcaatttctcaaaagatctcaaatgtatcagaaaaattacttctggcagatccatttgatgatggtttccctgaaatgcatagcaatatgtttattatgtaagttgattttcaactccttcagatagattataacagaggaatttctgcacaatttgtcataagataatgtccgactctgagcaatatggtctgcatacagtttttttctcctcttttctgataatttactgtactgtcagttgagatgcagtcatgttttcagaacatatttgtcataattttttgcccaacacaatctatactctgagattgccagttgggcagttacaacaacttgaagatattagacatgacatatctcatcagaagaagaatttatgatctccagttccatcatacttggggcatgctttgtgttgttgcatacttagcaaatatttaatttgattttctttactccctgtttcctataaggattatttcttttgtgccttactttgtttttatgttgcaggatacaattaatcgagttcctaatatctgacagcttcaacaattggctatgccgtgatcattttgacagaagttagtcctctgttgccctgatggcgctgttttatatttgttaattgttattcaatgtgaattgtgctgcatccaacatgataacatgaaaacaataaactatatccacatatatgttttttcttcattcaattcttctggttgcagttaaatatctttggtttctacattgttctttggaattgcactttatcatctcatactaattatttgagtcgagtcacagcttataaattgtataattctatccctgaatctgaatagctaaatattgaaagatacatgctgataatggtgcaaacataactcatcattgcatctactatctctttttggcatttcatcacatgagcttgatcaaatctaaatacaacatttattcagaactttttgaagaatgggtcagatctattctcaaggcacgaaaggacttggaagtcctagatgggagaaacggactgtatgtggtatacattgagcgagtgattggaagattggcaagggaggtagctcctgctgctcatcaggggaagctggacctagaagtcctctccaaactcctttactgagaacatgctgcctctgactcgccaatgtattcacccacatgtcatttggatggcaattctcatgaattattagaggcttgtactctacaaacttggaaactacatatcacattttgtatatcaatttcagattttcaggatgactagctaagggaagatgatgtagcaagaaggtgttttgttctcctttgaatggctgggaaaccaactaccgaagcatgctcaaaagtatgtttcattaaccccatgtgttaatgagtagttatcacaaaccagtctgctataatttgaaattgtatttcttcaccaagacccttacatgcctacattatggtctataacacagaccttagaatctattaggggatccaatattgtgataggcattgtttggtatgtttagctaattgttttactctttactccaatttacttatgtcatatttatatatgcatgttttatgtctgctctaaaaaaggaagggagtttttcttaaatacttaagaggcaataatgcatcagccccttttgtcatgtgtgtgtgccgtgcaaagggcagttttgtctattatgctttcatgtactgtcgttttcttcatttctagatggtgatgtttaaattacggtgtgaactctcaataacaagaaaataactaagcgtgttctggggtggtgactttactcaacaagtcagttgctttacaaatttgatctcgtaagtgcccccttgggctatatgatgacgttctggaattaggattgcaaataaactgcctaaaactttgtgtagctgagataatatagtacacagcctctctgtatgtattctatacgtgatattctcaaatgtttacacaatgtaagtttatgaaacaatttttaattgagaaacgttaagaaatcaagtattctctgctatttcagagacatatgttaggtccttattctgaagggttatctagattagaaattgttaacagggtgttggctttaattatatctcagcaacatggtgcagacaacatgcaccatggaagattagggatgagtttaaagtcttaatagccaaagaatattagtgttctttcactctcgttttggcaaagaatgagcttgcactcttcaccctaagaaaagagatagcccttcctagctctagttaccaaatcagtgtttgagtagttacatcaccttttagtcagcagctagcttagctccgttctcaactggtataacaacaactctcatgagccatgaggggagatagtagttaaccaatcccaggatcttccgagtttttatcttggttaagctcaactgatctcttcatcccattgacaagacctgtatgcttgatcaatgcaaggtccttttcaggtaggccaataccatccagcatctggcatctgctccaatcaacaagtgacgtgcaccgccgtttcagagcctaaatccggccttcttcctcaacggtgaaatatctgaaatctgaatcccagatctgatgtattatatccttcttaccattttaacatgaacgattaaaacgacaggtgcacgttactggaaaggttaactcgttgtcatgtcaggctaatagaggatgggtgaaagcataaccagtttcaagaatcaatatcagctttcatttcaagtactccctggagttacagaggtggtttctatgagccctaaagtaagaccatcttcagaatttatggacttccgtggcaatcggtgagttctgataaaacgtcaattgaaatcgtaccatgtatagtagcagggctgcaggaat

SEQ ID NO: 62567 - DNA, 3646 bp, Oryza sativa
tggttatattcagtaaagcctctgcagcgaactatgtgaaggacctcgaccaccttctcttcccatgtcagcttccactcctgtttcttcttatcaaccgtatccctcatctcgcacttgtcctccccattcttgtcactttctgccatagcttgcttgtgttgtgtgctctccgacctggcagccagcaacttgtaaaaaaaaaacatggaaggtttggggttctcatgtgtccaatccaacaaacaaaacaaaaaaaaacatggaaaatttgtgattcttatgtgcccaatccaacaaacaaaacaaagatatgatggattgatcaattgcgaagtatgtgttgttttaacttttacatgaatgaatgatagattgtttaactgcggagtgtgggttggcactcccaatctcagtaatctttctctcaagtctatgacttcatctatgaggcggcgacaatagggcttgttgttgtacatcggccatgatttaattttggattatcgtaatggccggccggtgatcgggcacatgtacaggcgccgtgatgaggccggtgagattaagggttggtttgtatacatggatgggccataaacaacgatatcggagtgtaccgtagatgtggtcgccgtgccctaaatcctaatcgccgccgcggaaagaggaatcgccccaacttaattagctggtggtatacatatttaacgacagtttctacagaaaaaaaaaatatactccattaatcttaataaataaaaaagcacttacagtgttgatatgtccggggcagccggcggtcgatccccttgcgcggctcttcttctccgtcgccggctcaatacgagagctctcacggccagcttgcgactgcccctcgagagtgagagtgaggtcgccgtgaggtgacgattgcaggtcgtcgccggcgaccagatcgccgccgggcgccggttaattcgtcggaatgccgccgcttccgacgacgtcgtctgtacgatagggacgagaacgtagaggactgatttacaaaatactcaatcagcccgaaaataagttgggagcttgttctgccaaattttctaaatttaccgtgggctgttcaagttgatgtcatttctaaccataccattatttagcaaagttgttaaagatgtgactatattttttttcaaactttgataaacacgtaacaaatcttgccaaaatgttagtaatattgtcaacttaccaaaattttgacaataccaaatttagtaaggtttattttgaacacaatctgaatagcctcctaaaattttacacagtaatatttatcgggtcctaatcgagaatccattccgctgcgacaggtgcaaggtgttagggttagtgtttggtgacggatgataggaggggaggggcctcacccatagtgaaagaagaagaaaaagggatgtcatgtgctccgaatacaccctaaatgaggaaggcaccaacctatgaagactgagaagtcattctatgaactgtgaagggccaaagggcagggtgtggctaggacttctttcctctccaatctcttctcccatgcatttctttgattgatggtgaatcaaccttaccggtgattaggaatataacattttaatatcagaggctttgttcgatctgtgtgatgtgttgatcgcattctcatcaccttgattggtaaaactcctatagttgagttagtgattctctcaatttcgtgctcgatcggtttatactagacaccatggctccaacaaaggagggcatacaagttcgagaagtgctagctatgataaatttcatggaggagcgactaatggcggtgatggaacagttagacacgaaggttaatgagatggaaataattggcaaacaagtgtatatgattgcatcaaagcttgaacaacaagggagcggttggacaagttgcataccaaggtggatctatcgatgacatccctatgacaggtgtagcaaaagcatacgcaaataacgccttaaggtgcttaaggcagcaatcactccactatcaacaccacaagtattatagtgtgctctaagttattcgtatgtagatagaatgatatagatagttatgcaaatatcaatgttttgtttttgaaaaaaaaatgaaggttgatatttgttatcaatccaatggttataaaacattaatattattcaagtgactttcattgttcacatttcaatattttatttgctacatagtttaaaactcgataaggcaaattcacgtcaccttgggcactatctcagcgccaatgatgatggagttgagacactataggcttgtttggtatagctccaactcctaaatttagctcccgaagttaggtctggagtgcagttgtgcacaactctagtttattttatgatagagttccacccagctccactcccagttttggtggagctaaaactgtttggctgagctccagctccaggaggggtggagctggagctgtgccaaacagaccctatatcttagtgtcatcaggttagcgctgagatcatagtttatgttataaagagtaaatttcactttggtcaacctttatttaccaaattttcacattggactagagttagacttatattttcacttaacaccatatatagttaccatcatttgcactttggaccgggtttcacaaattacacatagtataatgattgtagatctgatttcatttattttttgtgttagaaaacttagaattcaacaatctgtactaacactacagttgggtatcgtaaaacatgtaatatcttttctagaaaaatagttcttaaactcaatatttctccaattttgtctctagtataagggttgtgaatgttcatatgtagtagtaatgaagtcccattaatctgataggatatcttataacatgttacaatcaatgttcttgcgctaagcatatttgcatggcaaaaaattccatatcattgtttcttgtaaaatgctaagcaccaagacaacaactcatgtgatggtaactataaccaggtccaaagtgcaaacaatggtaactatacatggtgttaagtgaaaacatgagcctagctcttgcccaatgtgaaattttggtcaataaagatggtccaaagtgaaatttactttttataaattagtttctgtgataggttattttttaaatgggtttttataaagagcgttgctctggtccagcagaaagtggcgcggggtactggtaccgtgaggtaccaaagcgaactccatcggtgggcagaatcggaagtggtgaaagttttgatgcgcgctggtggggccgtgggggtgaaaatgcggacttctcgccacagaaagcgcatcgctgtgccgcgagtgtcctcgccacaaagtcctctccttcgtggcgccgccggcgccttctccttcttcgctgcgtcgccggcgtcctctccttgttcgctctgccgtggctcgtctgccccttcggccttcgctgcgccacgccaccctagtgcgacctttctccgcggcactgttgtctccccctttgccgcgccaccgttgcctttccccatctccgcgcagagcgtccgtcgtctcccccttcggtgccccttcgctgcgccgccccac

SEQ ID NO: 62568 - DNA, 562 bp, Oryza sativa
tccatgacaactaccgggtctggtgtacaagtgtcgtagcacacgtgcactcttcgacacgtgcactctacgacaaacatcgtgtcgggttgatttgggctatgcacaagtgtggtctatgacatatatcaggtccgacgtacaagtgtctactgaaccttctagtctactgtcttgatttgctctgaaggagattatcaactgcaaccttactatagtctactgtctgctatatgtgagcatgtctgctgtccgtcagttgtgtagtgtctgctatatgtgagcacacgtgctattcgtgaattgcatgtatgagtgctgcttgttgcaagttgccttttgtgctaaatgaagtatttggaccacaactatgaatgaaattatatttcgcatgctatctcttggcccttggcccttgttaaactttggtactcgatcatgatatctcaaaatgtatatatgccatctcctcccgcacatatgattttcaccactgaaaagcacacacgttcccagattgagcatgtatagcacactttgaataatggattaactatagcag

SEQ ID NO: 62569 - DNA, 5833 bp, Oryza sativa
agacataaagctttatttacttgagctccagttcataaacttacactcagaggcagctgatgtaatttcaattcaagttaaccatgccttagctggtacttgaaccccaagaaatataaactaatggtatatgcaccaaaatatgtactcaagacatgaaaatctttcctttcttgtttgggtgggaggggtcaccagtactggactactggttataactatcaattatacgtgataataacgcgtacatgtcatgataagctgatatgatggtgacaagccccatttgtccatttgcctcataggacggcagcaccatgtggtccatgagatatctgaggccccatgaagccatagagcttgcaacaagcacagatagcccttgcattcttgtgatcggaggatgtttgcctctgtttgtgtcacctacaaagaaggagaaaaaggaggctctggagtgaactccacttgcctacaaaagacttttgcttctgaattctggtattagttggggagtggtgtttagcacttgcacgtcaggatgtgaacatgcattgagagggggtagatgctgctgctgtgagcattgatgaagctttgctaattggcgacaaagaaccaattatcgactggacttttgtccaaagtggtttgctttagttagtagcgaatgcatgcattgccctgccattgtgtttcgtcagctacatgctaggaatattcaacgagacagagggggatggttagccagctttgaaatgaggactagaggaataggctctcaaatcaggtctcctgatctggtttggtgtgcttcgcgtccaaatgcaagaagctctttggcttatacaatattattatatatctattgtcgaattggtagcatgcttaattccatgctgtgtgattattggcacaaaagtatctgacagacagatggaatccaccaagtgaaaaaaaatcacaataattagtaattagctaactgcaccaaagaaactatagctagctactgaatgtctgcatgccctgacgcacgggcggatggacccatgaactgaaagctacaagattaactaaacaagatcgtgtagacctcgacaggtaagtgattggtaatcacatggagtgtcctaataagttgcagatgcccaaaggacaaggacaggagaatgtagagtactccaatagttttttggaatcaatggtgtgccttggaaaagtatataggacaaacagtgagatatagtctgatagatcactcgagttcatgacatgaatccttgagcatgcagaactacagaagtgtgatcaacttgtttttgcatgttcaaatataatgccatgcataacagtagtgtctgacatgtttgctttctgtcatcttgttttcctattatatacgttcgatatgagccctgttactgtcgtgtggctagaattaattctgttagatgcatgattcgcgcgtggctagaaatgacatttgtgtatacatcatcgtttctttatcataatttcttgccatcgtgccatggcaaattaactgcttgttaccaaaccatgcattacacagctcgacagcgagatgctttgcctcactgttagcttgatcgggatcgattcacctcacaggtacgttgattaattttgcttaaaataagcatatgctgggttatcagtgtgaactttttttctctgtttttttctgggatttgaaagcacgacgtatgaaattactaaattagactatatagtgcatgatagttgaatgatatcaaatgctgtttaggttagaattgttttcttctcttatcaccaagcgcataatttgaaaatgcaatccgaattttttacagttagcgttaataattaattgtacgtacataggagtacccattaaggtgtgattgaggtgcgtctctatacacacactactaaaatcatatacagtatatcacacaaacaaaattaattaaaccagctgtgagagcgagcacacatttcacaaatcgattgaattggaagttgaaacacaagatatgcattgcatacacacaaattgcctgtcgatttggctagcttttttgtgtcaaacggacacaagtaacattaaagcactagcaagctggtgatagtgtggactagtggtagtagtggcagtaaccatgcacacgcatgacaagcgtgtggacgcgacaccggctagcagtatagcttacaacttgagagaaaggtcgatgtcctcggcgtcgccgccggctgccgcggcgtgcacgcggtacccgtagcggcgcccgccgtcggcgatccagctgacgacggccgcggcggcgccgccctgcggcgggtagggccagccgagctcaggatgcggcggcggcggcgccgccgccgtcgtgacgccggcggagagctcgcggctgcgcttggcgaggctgcgctcgagcttgtgcgcgttctggtggccgcccagcgcctgcgagctgtagaacctgcgccggcagtaggtgcacgagaaggcgcggtcgtcgccggcggcggcgagaggcggcgccgggttcctggtggccgcggtgtgctgcctgccggccgccgtggagtggaccagccgcaggtcgaggttgacgtcgccggcggcggcggtggtcgtcgtcgtcgtcgtcgacctcgcgctgatgatctccttctccatcaattagtttctagcttggtatggatgtgcaaaatgtaattgtcggggtgggtaagaaagatagtgtggtgcgagctcgatcgaggcggccgtatataaaaggaggaaagtccaattaagcctggaggactagctaggcgatcgactagctaagcttagcttgtatggggattattgtcatgtcggccctctagtgcttacggccacacggcgctgttgttttggttgggcactagcaattaatcattaatgtcaataatggaaatatattccatgattattcatttttgaataataatcgatgttacatttgagctacatattatatgtacacggctgcgggaactcacctcccacgcacgcaaaacagagtgatgtattttcttatgattaattaggtatgtactaattttttttaaaaaatggattaatatgatttttttaagcaaccttcgtagaattttttttgcaaaaatataccgtttaacaattttttgtaaaaaaaatactatttaacagtttgaaaagcgtgcgtgtgaagacgaaggaggtgagttgggaactgagatcacttaattcgacactcgaaaacagtaacagtattaccaatctttctgccaatgatatttttttttaataatagattaagagacttaacctctacaccaacaaaatgtacacagctaatccatggggactttaatcaacagatatctcccaactggtactactagctagctagctagacacaaaaccaggatattatccaagatgatacccaacgtttccctagctagtccaagacaagttggtaagatatcgtaagcaaattttgaagttcttataaaaattgttacgtgtaaataactatgtccatcttgactctgcaattaaaggcatgctctccaagactaagcatgcattacatggtatcacatggataatgggtaataattaaggagattttttttccttttgctaccgattagagcacactacatcctcacttttgccatagcaaaaaacctcctcttaatctatgcgcgccattattctatacaagtaatgttttatttttgctgttgccgcactttgaccgatgtctaatataatgtctttcaccagtccataacaccttgtatgttgcttgtacggaacaataatggaagagtacgtcattactctgattgtgataaaagcggcaatatgtagctaacccattgtagagacaaaattgtctgaattaagctaacaaatggactacatattggcaatcaatcgatggaagctctttgccatcatactagctagctactactccttcacacacacacacacacacacacaaatctagaattgaatttggcataatctagctcctaagctcttgtacatccagattcgttgtattagattgtatcaaatctaattctagatcggtttttcgtgggacagagggagtgggtgttatattcactcagtaactaattaaacgtgacatttgcatatctccgtgagtatctggctagtacattgtaagtacctacgtgtcgtaatttgctctgcgttgatggcatgcatgacgtatgcactccagtcgtctcttgcacgggacgtgccagattattacttttcatattttactaatgtacggtatatttatatttataatatgctcagatatccatatatctgtactactatataatctttgagattctttaattacatacgtacctatgtacggaacgagtacggcatatctgcttgtatatatgtgtacagcaagatctattccatttgacctttatatacggtatatatacatgtatggtacatttagttatgtatgtagtactcctatgtgcagtcacgtccactgttctatatatggttgatacatgtaataagtcgtttgcttatatacatttgcagtaaggcccatgctgatcagcttgcatgcatgatcgacccattgtttgcatgcattgcccttgattagctaggacaataaagtagctctaggtagctagctagcttcatccatgcttacttacaactacctccatcacattataagtgcaaccatgagtttttatgcctaactttgttcttttgtcttatttgaaatttttttataattagtatttttattgttatgagatgataaaacatgagtagcactttacacgtgacttatgttttaaatttttttattttttttaaataaggcggacgatcaaagttgtgcacggaaaatcatggctgcacttaaaatgggactgaggaagtattaattagaaaaaatgttctatactccagttttgagcatgtgaaacgatggtcatggagagcagtactccctccatcctacaataaatttatatttataagatattaagataactttagtaagaaggaaaaatgacttaggtgttgagaaacaatattgataaatggtacttctcaatttacaaagtgagcaaggatatatagggtgatagaaactaattacccctgacccgtttcaaaatatagcaatctaatactagattggatactgacatattgtatatcctaacactacgaatttgaagaatgaagaatgaattacctatccagattcgtagtatcgtagggttctagctactagcgctactagctagtatctagctgcaagggctacgtcatgcagattcatgcatgcatggctgaaacttgaaagccaaatgaaaacaaaactagctagagactaggcaaagatcccctctaagatgctgatcttactacacggctattatccagatgtattattatgctcgaccggatggaagctgtgggtgtgcatgcctctgacagtgacataggttcagtcttcagatcagcaagtacattaacatgacttggactgcagcatgcaactatgcatttttaacaaatcaggctctaggctcctctatagcttggcccattcctgactgcccgggcctttgcctgaaacccaagtacccaacaagtataataatttctggatcccatcgattatattttgggataaatttaaataataaaatctcttatattatatgatggaaggaatatgtttgctcggagtacattgcatttagatgctgtatt

SEQ ID NO: 62570 - DNA, 567 bp, Oryza sativa
ggcttaatgcatcgattagtataataataaacaaaaaagatacgtatagaggcggatgaggtcctagtatgggaagaagatttacatacttccaagagttccctcgggatgtgatccaaattacattggttaaaacaaaagaaagaaacggcaagacaacaatcttcctctttggtctccagctccgacacctactcccccgctcgaaggaggcaactttaacggttgcctccacaacagctacgcgcacaatggcttcactcggggacctcatcctgcacaacttccaagaaaaaggttcatgtcgcgggcgtgctacgatgccaggatatactcgaccaccttgaggacgccacctcatgtacatgagcaggcagcccgacaagccgttcttatggcggtcagctccatgatgcggtggctgattgagccaatgtccatggtagaacaacgcatgtgccctaggtaggcttagtgaagtgccaaagcatgacgcgtcgttttgcatcaagtactgaatcgacatgttcttcacaaaccacccaataatcaaagaccacgtctaat

SEQ ID NO: 62571 - DNA, 609 bp, Oryza sativa
aggtggatgggcgtggtggcggcactcgggttcggccgggggagagaggaacaggcgcggctggaggaatactatgacgcgtcgccttcttgggccggctggtccgcgcaggggcgagcggcgtgggccgacagggtggacgcagaccacgtgcggtataagagggggaaggggagctgggccactgtggctgcgggccgaggaggctaagggcggctgcggcccaacggggagaaggagacccacgagggatgggagaagagggaaaaagtacaccagagttcatcattcaaatttctgaaggaacaatctttttgcagacttcagttgcgacagagacaagatatttgcagacaaggcaggaatggagtaaaaacaccttgcaaattcgatgattttttactgtacacatattacaggactgatgttacattatctctattcgctcatggcggataatctgtatttaattacccttccatatctcaggttcatctctctacatacaagatggcatacatgcactgacaacgaagaactaatatgcatgtacagacttcttgctttcacatatataatcctttcttcgataagctgaactccggacga

SEQ ID NO: 62572 - DNA, 692 bp, Oryza sativa
ctcaaatgtccacgaccttaaattacaaaatcggatatctcgacccccaaactcctaaaaccggtgcatttgactccctggaccgttttgggaggcggttttgctgatgtggcgccgtgcggtgcctacgtggcaatattgaccgagttttcggtccacgtagcgttgacgtagcacctacgtggcggtagaattaaaaaatatgcatgggacccattagtcattcacacaaaaagaaacatgggcccactaacatatgggacctatatcctcaagaactcatgtcgacgatactgtggggacgagggctactagttcctaccgcacgatcggaactgtggcatgctaaataggcgcggctcttacccccagatgggccaagtttgacaagtactccctccttcaaaaaaaaaaaaagacaaaccctgggtttgcgtgtccaactttgactgtccgtcttatatgaaatttttttataattcgtatttttattgttgttagatgataaaacatgattaacactttgtgcgtgacttgtctttttaatttttttcataatttttttaaataagacggacgtcaaatattgggcacgaaaattagggtttgtctttttttgggacggatggagtagtactgctgactttgttagtttgtgctttaatattagcaaaaaagtgtggtctgtggtg

SEQ ID NO: 62573 - DNA, 1258 bp, Oryza sativa
acaaacctatagtttccccatggcaatactgtcaaccagtccaaataattccttgttacattaaactcgctagaactggcttccaacagctgaagctttgtgagttcttcttcaatgacttgcaaaacatgagcaggacatttctccttctttgcttcaatccgctccctaaattttgctgcaacacataaatgaaggacaattttgaatcgtccactagaaatgtcaagttctctgggcaataaaaaaaacaaagccaataagaacagctgaatcacaaaccagacaatgctgttttgtcatcagtctccaaacctagctcctgaaagcatcagatatgcagagtaattatgaacctatataaaaccagatcaacctagaaggcaacaatgattatatttcccattttgcatggaatatatacagttcaagtcttcaagagcacacggctgaatatcagatgtcaacgttagtaattctgtagttctagaataggcaagggattattgcccattccgctaatctatgaaaagcaatggtgtcatcagcaatcggagtgccaaattctacaaaagtaattattcaacaatagaaatgtaacaaaagtaactttatacaagaaacactatatgatggagtaccttcttgattgctttaagttgctcattcaataaataacgccgctgatccccacttattttttcttcaattgcttttgcaatggattgctggaaaagaagtgtattggtcaccacaaatgctcaaccaagcaatggtaaccaaggctggagatagaagaatgaattacctgcaacttactaatctccatctccttcttgactaactcaagagttaactttagacgtttatatacctgttccaaaaagtgcaatagttggactgaaatagaccaagaaaatggtataaagaatgtggaatcttcaagaacttctagaagagtgctggtaagagaagctgtgctgatatgttccataatggattttcaaaacgtattcatatacccaatgttctattgattattggtgcatttggaaagagaatttgctagatcagggaataagttgtgcttctttgcagatttgcagtatatgcaaaataaatttcaaaatcagtatcatatctgctgaattttttaacaaaaaaaattatgttcaataagtcagagagaaaattctttggagtatagagtaaaattatagcacaaatgagacaaccagcgcacatggtgatgcacaat

SEQ ID NO: 62574 - DNA, 654 bp, Oryza sativa
aaactgccgacagaagatataaaaagggtcactgtgtatgcacagcacaacaccaccatcggcatcgatgcaaagcttcgagtatacttatatcacgggcaggggcaggcaggttcctctctatccaccgtcggatccatgctaagcctcatccaccggcccaggtgctcccctcgctgggggcttggccgtccgatggcatccaacggcgcagatgtcgtcgtcggctgccgcccaaacgcagcagccacacccacatccactaaggctcggttggtctattccttctctccaatctggttgcaaaatgcagcaacttctttaaggcatttcctttaattttattcttacaaacgagttcacttacataccataccaacaaggaacgacaacacctccaagactatcagaacggaaaagaaataacgaaactctggctcgccagaaaacaaaatggatgaatggccagacctcgttcattataagaattagtttacaatagttttttctttgtgatacttccccagccatcttgctgcaacattcttgccaaaatttttacttaacatttactgctacacggcgcgtacaaaaaaaaagggtgatcaatcaagttatttttgatgttgcaaagaatagtctagctgcaaaact

SEQ ID NO: 62575 - DNA, 26111 bp, Oryza sativa
  unsure (1)..(26111): unsure at all n locations
aattaaggatacatatagagagagatgtggtagggatacacatgtagaccactatttgcaatgttaggtcccagaaataatggtaagttcatcatcgtgcatcgactgattgccccgtttgatatgaacaagagtatatcaactagtatactaatacgccattatattatatgtgtgcatatatatataggagtagtaaccagtgaaccactagtagcaataaaaatgatgatgtggcccttatttttaagattttttttagtagaagtagagatttggggcctgttcattttgatgttattttcaaccttactaaattttgtaaagttgctaaaaaaagtggctatatttagtttgctgtcaaattttggtaaactatataagaaatcctgccaaaattttagtaactatgccaaaattttggtatgttttttttagcatcaaagtgaacaggtcgttggcttgccaggataatgaatgaacatatgaagtcgatatctatagtagcgagacaaaagaaatgaaaagggggatctacctcgatcgatcgattgaccgatcgtagatcgcctagctagtcgcaaggaacttgcagttgcagtagcctccaccgcccaaggagcccgattcgccgtccaaaaacgcggggaagccatgccgggccgccatgtgaccctcgagacttccgtacggcccatttcggtttgggccaaaacgggattgacttacgtgcggcccattccggttccgtcacaggatctcgattacgtgaggcccaataacgagaatatgaattattgggccatgaagaatataatagtaatagtaggcctgcgtgatggaaaggaaaggcgggcgataggatgctggatggttcagcaacaaactgaaatttttactagcatcaggcattagttacattgtttttcctctcattctcaactgtatcgttatcatgttgtaccatcccgttcatgtggaagcttgactgttggagggttctgagcaaccatggcgaattgttggtgcattttactgagactctactaacaaatggagaggctaatttgcttaagaaaggaaaataaaaagaagaagggaaacgagtagttgaaagggaggcaagcagcatcgagatccagaccatcagcgcagcagagttgtttagatggcctcttgccggcatcggaaccaagcaagacaaatcacttgtcttgttggaccattagcagggtaaaaatatgtctaactgtagcaaaacttcagtttgtggttggaccatccaagacaagaagaaaaatgtcatgcacaactgagcttttagcctgatggatggtaaggattttctacagctagatgccatggtacctatcaattacatgcgactcaaaatagttatagaaaaatttaaaaaaaacttagtaacatcaattgtgttgatataaggctacacacaaacatgcataactaaatttgatctacaactagagaaacaaaaataataaagtcggatagtgaatagtacccatacaacgcagataaaatttgttatttttgtttcttcatatttcgatcgaatttagatttgcatgtttgtatagtgttttacattattgtagtctatcttactaaattttataaaatttttatatagctatttaaattacatgcatatgccacggtaccaccctgatggactggctggctgcaaggtgtgcccaatgtaggctattactagtagaattcagtgattcaccgattgatgatggatgccaccaacaaacaacgctccgcgggctcccttgcattcactctgatagtagtaccagttgtaacttcaccttgaaggtttgttcgagggagttttaattttcaataacaaccggtgaaaatctgaaaaagctagaaaaaacagcttccagcttaatatattttatagattttttttagaaatttattttatagattctacaattacaactttcagacactgatgtgagcttttaattctgaaaaaaacatgtaattggcagaaactctcctaaatagatcctcagtctctcgtgttgagcaatgatacatacgcaccgtacacataattactcgatcaactacatgtattcatcttaaaaaaatagtacccaacaactcaactgattttttttaaaaaaatttaatttaaaatcaaactctttcaaaacttatttttaagatctaaatcttttaaccatgccaccgaactgacgtagcaaaatgacattgtcgcacaggtctagctagcgtgacaactttatttgatcacgccacgctgactggtgtgacatgataaaactatcacacatgttgtgtgtgacatgtcagtgttgttttgtcgcgtcaagtgggttggtgtgaccaaaaggttcagattctataaataaatttgaagtgtttgtctttaaaactaaaaatttaaaaacttcaaaaaataataaaaaaagaaatacaactcaattatatattgagtatctagcctgcataatgtagaaacgtaaatcataacaatatataataacactataaattatttgatatctcatatctggattatgaaaatacaagtggtttgcatgctttacatgcacgtactagctagtactacaacacaaaacacaagtccatctcttacgaattaactcgatcatcgtctcggatttgtccaccgcattattcctcgtatcattcgtatacattcattcattcagactataaacacaaattataactagtactatctaggaatatataatacatgctagttttttaatgacactgactagctagcttgccggctggttcaaaccttgcaaacggtacgcgccattatttgaactcaccgcatgctcgtactactgtccacctccgatgccacctccagcgcctccgccaaatcctccgccgccaccggcgccgcctccgcctgcaccatggccgccgccgacgcctccaccgaaaccacctcccttgcctccgccgaaaccgcctcctgctccagcgccaccgccgccaccgaatcctccgcccgcaccgccgccaactcctccgcctttgcctcctccgaagccaccaccgaagcctccacccttgcctcctccgaagccaccgcctgcacctgcgccgccgccaccgccgccaccaccaccgaagcctccacctttgcctcctccgaaaccaccgcctgctccagcgccaccaccagcaccgccaccgattccgccccctccacctgcaccaccgccagcgccaaggccaccccctgcaccggcacctcctcccgctccaccacccacaccggcgcctccacctgcaccacctccgagaccgccgcctccgccatggccgccaccagcaccacctccgagaccaccgcctccacctgcaccacctcctgctccgcctccgagaccaccgcctccaccggcacctcctcccgctccaccaccaacaccggcgccgccaccagcaccacctccgagaccgccgcctccacctgaaccacctccaagaccaccgcctgcacctcctcctgctccacctccgagaccaccgcctccaccagcaccgcctcccgctcccgctccaccaccaacaccggcaccggcgccgcctcctgctccaccgccaagaccgcctccggcaccgcctccccctcctccaccaagaccaccaccaccacctaggcctccaccttttccgccaccaaaccctcctccaacgccaccgccatgtccgatccctccaccaacaccaacaccaccacctaagccgccacctttcccaccaccaaacccgcctccaatgccgcctccatggccaagaccaccaccagcgccccctccaaatccaccacctcccccaaccccaacaccaccacccttaccacctccaaacccgatcccaacaccgccgccatggccaacgccaccacctccaccaaagccgccaccgccgcctaagccgtccttgtccaagcggcgcgcctcggcggccactactccgagagctaacaacgacacaagggccaatgccgcggctcgcctacccattcccattaccatatatatttccgacgtccagtagtcgtcactcgctcactctcactcaagtgggtgatgatctgaagctcaagcgtgtagaaggtgggtttatatagggaagaaggggaaggctgctcctatcatatgaagcgtacgaagaagaaggaaggctagtgcgcaatgcatgtgcagtgtaggtcgagtagagtaaatgcagttagttggggagcctatgcctgcctatctacactccagagaggagaggagatcgagctgtgggctatggcggtggcggtggcggcttagcttggatgaggaggccggccgacacagtgagtactagtagtgcgtgacagctgctgcatgaggagaggagctggataacgcggtaggaataggatcggagaaaggaaggttacattacaccatcgatttgacgtgcggctagcgagcgaggccatggatggccggcgagatgcgcgcggcgcggcgggattgggttggtggtgtttgtgaaccggtggcatttatgcccacgcgctctcgatcagctggagtagactgcactgtgcagccggattttctctctgcacatctttaaccaaccaactgcatgcgcgcccgcggttgcatatgcatgtagtattatgtatggtccatgcagtcaagtgatcgagtcagcactacacatggactgggatgacgtacgtatgtactagtacgtaggagcgaaactaattactaaaatgaaaagctatgcgtgcagcgtatttcatacgcatatatgaatgcacaacgaatgtgcaattgtactgtattcatgtcatgtgttcttccagctgggaccgactttcatttcatttcattacggcttttgtacccctactccacatcaaaaatattagtaatatcactatatgcaaatatagtctccagctgagctgtactgaactattgctagtcatcaaactagtaatactagtatttattggactagctcgatctgccaataaattttggagccaactctgcagcttgggttgacaaggattccactccactgttcaccattgatactcctgtatgataacagccagtgtgttttcatgttaaaattggaacgatgcgacgaaaaagttgaaagtttgtgtgtgtagtaaagttttgatgtgatggaatagttgaaagtttgaagaaaaagtttggaactaaactcggccacggccagatatgagtcgttcgcttcatttctaggctctggcctgtgccaaactttgatttgcagggcaaattacaaactgtggatttcgatgaaaaccattctgcaaggcgcatgcagctagactctctttcatgtcatataactgcatgtttaaccttctccacagtttttatcactgataagagtgatctatacaagtatttaaaatgttactacatgaattccgttctctatttctaaccaaatctagtaggaactcacttgaaaggcggcagttcattccatcttccgcttgcaccgacggccggaacgcaattatctcgtcaattaatggaaggatgaatcgaatcaatcgatgataacaacaatgctgcgacaaattaaggcatacacgataaaaaggctgcctgcatgtcacataattgtgcgaaagcaaagcgtcaggcacaggatcacagcatttaatctcagcacatggtgatgccctgttgcagcacaccctccttgcaggccagcatgtcatattagggcagatcttatcgacatatgccactgaaacccgatgatgttcacagtttcacacaggacataaatcagaattacaggttgcagcagaaacaagacgatgacattcctccaaggttttttagaatctagaattacattgccaattccactctcatctcttcagcaaacaacaagctaattctaaagggcgttttacatccgcacaaatgctaccgggcacttgtcctaatccccacgatgcacagcgtggggatagctttctaaagggtcgatcaccgatgggtacatcataagagcaaatcgctagaggtctcaactaaactcttccgtatctgatcatcggcttttcttcctggtgttagcaggagaattattctgctctgaaatcatctttaacagattgacaagtgaccgcaatctgtcccacacactaaggccgtagagagtttcaacgagcaactcttggaattcaaatccattctcggagacaggatactgaataaagatcattagctgagtatcagaacaagtagtaaagccatacaatttttttcagactacttatctgggaattaacatacctgaataggttttgggatcatggttttaacatatggccaccatctatcttctacaactgccttgacaaggcagcaagcccgcaaaccttccacaccagcaaatcttccaaatccactatctttgacaccaccgaatggcaaagactgcaccaagaaagagaagcatacttatataggcaggataacaccgagcaatgaagaaaaacatgctttcagtaatacaataaatgaaatgccaaacattactacaagataagcatgtgagctgcaagagatctttccatggttagagattatcatactggtgttttctgttgactatttcaaagaatataacacaaactagaaacttctaattacctacctgacacatataacttgaagcaaaatcattgattgccgcaacaccacagtgtagctgggatgctattttgatggcacgcttctggttgccagaaaagacagcacaaccaagaccgtacttggagtcattggcaagtttgacaacttcattcataggaattagaatattcaatgaattagggcaagaaaagtaagggatacacaaagaatagtcacatagataaaaaatcacaagaacaagagagaaaggaaaaagtattgcgagcaaaaatcaaaacgtaaaaagtgaagaaccgattattaatggattaattcccaaaaaaaaaataagaaaaacagatggaaaagagaacagtgtaactatataacaaggagactatancctacttgctttgcgataatattatcatatgtgatgattaacattcaccaggacagttggaggaaagaattgatctactgcatcttcacccagatggccaaagctccctctgccagcaatctcagcacctttgtcaacagcatcattaacaagattctgaagtttctcagagtgctctatcatacagatagcacccatatcgtatctgccagataatggaggaccctaggaaaagacaaaagagcaatggagcaaaccaaaagataagcgctgaggcaagattaccagcatgaattaaaaatacgttggaaactaatatctgaaaacttaaataaggttgttaggacaccttaagaaactaatagcttaatatacatatttcagatagctctaaactgaaaagattcagaagatttagccgtgtgaatacagtatgaagttatacagaatgttagaaatgcaaaactacactgccaggttagctgttaatctgcaattttgcacttgcaagatgaagcacagtaacagtatccaggaataatttgaacatacatgaatatgatttgccacaggtctgtaatcttggtcaaaatcaaaagaaaggcaatacaaattgcatgtcagtaccgacttaagagtacaattttgtgtacttacgacagatatagatttgattatcttcaccacttgggaaacaaatgttgaatagatatccttgtgaacataaaatctttcagcaccagcacagttttgtccgctagattgcagggcagctctcacagcaacttgaacaaccttcaagtaattaagtgccatggtttagttgcagtgctcgttcagaaaatatggttctcaaaagaaatggcacattgttgaagaaaacatgctcttcatgacaaagaaacactaaattacacttacactgggtaagtctacatcttcacatacaataaatgcatctttaccaccaagttcaagagttacaggtattaatgtatccgatgctctgttcatgatctgtggcaagcattaaacagaacattagaacagaggacagtaaacgtggacaagaacttcaaacaagtacataaacttcaaacaacaagtaggactacatttttataatgctccctgaatttgctttagttaaaagttatatgctagaagacaggttgattccatatacaaaatagaagcacatcagttctgaaacagaatctgtagctataaaatgcataactgaacatgattaattgatttagtgtcccaaagtgagcaaaacaacacttctcagcacatctacagcagtataaaaattggccgcagcatgagattaagaaaccactagttcagaggaaagctataccatccttccaacaccaggtgatccaacaaatattattttgtcgactgaagatacaagagcttgacctgtttccgcaaaactataaacaagccaaaaaaaaaagagaccaagtaagccatggtaagcaattatcctgaatgctaaagaaatgcagagtagtattcatacccagttattatatgcaccagattatctggtgcaccaacagctgcaagagctgcttgtatgatacgaaaataaaagcagcctgaccaacttgcatgctctgaaacctataaaagggcatcttgctgatcaaatatataaatagagttgaatagtatttagcttagataaaaaatgaattccggtgattaaaatgaaaagtagttcttatttgcagcaaaagacaatattcatatggcagagtagtgttgcagatgtttcgcttagcatagcaaaaaaatgttaatgatataattagtacagtatggttatgtgaatatgctatctcttagatgagaactgttaatctgaatatctctatcagtgttcaaagctgaggacgtttgaccattcaaattctaaatgtcatatgtatatgaacaaagggagtacaaaaaagcaacatctgatggcttacctttataactgctgcattaccagagaatattgcagccagcattggattgaatacattgtggaaggggtaattccaagacacaatcgcaccaataactccaagtggatagaactcaacttttgctttcttgtgaagcattgatctccacaggacctgagcagaactaaaattaaaagcaagtaggggaatgcttgtatttaattaggataaggtaataattgaagaaagcacgagtttgttgggagaaaacaagctcgggtctgtgaggatatggggacttggatccaaaccaaaattctaaaattccttgagtaccatccatcatccaaacacgctaaggtatcacctcaggtgtaaagaaaggaagacttcagcaatggtgccacagtacctaattgctaacttcctatgttacagaatattaatgtgtggctgcatgcataaatgaaaaggcttatctttcctgtgaaagaactaacataagttgtgagtcaatgtctgtagaattcccaactattttgaggttttaaacttttaataggtagttcattttgtattcaagaccagagttcatttgctgtgtatttccaatgctcacacctgttgagctaccagacggtcccatataatcacatcctattgcacatcgtaaagacaaagtggtgaaaacaaaagtaagctaacatagaaaagttaatataatcattgacacaatatacaaggccctaagttactctgtctttcaaataggaatgtttctaagagtctaacctgtattcaggttttaaccacttctcaccctcatccaaaagccaggtaatcttctcacaggtggtcattatctcacctaatgaagcatcaaccatagtctttccagtgtcccgggatgatatcctgcacagcacaaaatgtagttaccctcagatattccatgttctggaaaatgttatcaggtgcaaaggtgcaataaaagaagaaattgatcaggccttcatgaacagatgcaagataatgaaaatagaaagcacaaccaacagcgtctagactaatttaaagataagatgccattttgaattatgtccttactcgcatatcagatcctgatgttcaagtatatattttagaaggattcgaagaaactggcgtctttgcttgaagctgctttttgcccatatcttttgtgctttcctggcttgcgcaacatgctccttaacctgattagtcaaagaattaaaggcaaccaaaacaaagtaggatgtcacgctaatgaagttacaagaaactgcagtaacaaaaagatacaaaatttatttgttccttgatcactacttcagaaaatcaaaatcgattatgaacgacgaactagatctcagttaataatccaaaagataatgacccagacaactaaaccctacattatatgttgtatttaaaggacctaacaaaagcaagccagcaatatacctcatcaggcgtcaatgcagggaagtatcccaagtatttcatagttgctggctcatagcattggaccttgtcagtctgagctcctttccccttccttggtggtatctgcaacagaacataaactgaatgtgttgtaagcctgtaatatcaaagcaaccatgtggctctgctagctctcataaatcacatgccactgtgagccttattcagctggagtgaatcaatgcaactttttttttaaaaaaaaaaagaaaaggtgcctagtgcttatctgaaacctctatcagcacaaatcagagttgactcgtagcatcaattcgaagaattcaaatagcactctgttcaagaatgcagttcatttacatgttatcatcttactgcatctggccattttgagcatgggaatttaccaaattgaagttggagtatgtaacaacgttttaacacttgatgaccgcacacactgttgcctgttgctttctcaaaaatttaataaccacgcccctggaatttgcttgaacataatctcaattttcacagaaatagcaagattgtggtacagcattggaacaagtcgctagacttaaaaatctaaaactggaaattccaggcagacagtctttaaacatttgtccactaacagtaagatagccatagtacaccagacagtaccaactcttcagacctatgagcacctgaactgaaccgaaatagtgaaacgcaatacctgaaagctagacgcaatgtgcgatcctatgtcattggaaatctatgtggaagaagccgaaacaagcaatggcagcagaatgggccggtttgcgcatcaaagccaaataagtggagaccgagggtgaatagacaaaagaagcagagtgcagatgcatatgaagtagtgaatcatcccagggcagtatagaagtggaaggaaaggggaaaggggattagtaagtagttaaacttacgtagatgtagctatcctccttgttctggttggcgtcttcgagcactgcatacaatagaacccgatccgatccgataccattagagtaaatcccacataaaccccatgagccatgagctatgagcagagcaatctcagagggaaataaaaaataaaaacagtaaaacctaagtaccgtcggaagcgtcgacatcgatggaggggacggtgggcgggatgagaaagaggaggatgcggcagagcgcgtaggcggcggcgagcaccaggagcggccaccacaacgccatggccggagactggggcgccaaccctaggtcgccgcgcgcgcgtggctcggactcggagcagcagcagcagcaagggagcgagttgaggttgaggaacaacaaatcaaaatcaaaatcgaaatggaaaaaaaaatccaagggggatcgatcggatcggggggcgtgctgtggctttattcgtggagtgcagcgcgagcgtggcgagatgcttctctctcagttcagttgcaactcacatttcgactcctctcgtctcgtctcgtgtcctccgccgtatattatactggactactgcccccacattcacagaaaattcatttaatcgtatatctagttatctactccctcatccgctttaaatttagggttaatcgaattcgtgctaatataatttatatcatttatgtgattttggaaacgttagatcatattattggtagaaattgagggtttgtcccatcacactttttttaaagttttttttctacttctgagaccttttttttggctatgtgccatggacaaaggccgaagatgtgatacatttccattatctaaaaaaaataatttatatcattttaagaaacatcattttaacttatataattgaaacgatggcattataaatttgtgccgctatttaacccttcgacatattttctaacaaaaaaaaataaccatcttggcaatctcttcctccatccccctctctactattctagtggcggtggacatccaaatcatggagcccctccaacacaaccatccattagcactgcggaccgacgagaggactaaggaggaggcgatgccccgaggtcgactttgccacggcacttggatacccccatggcggtggagagggacgggacacggacgggcttgacggctgtagccataggagagagggacaggcctggcgcacggcccttctaccgccacgacgaagaaggcacactgaagtggccccaaccaccaaatccacatacacgtgggtatggtgagaagtagatgtttgtgtagtagagacaacaagtggagctgcatccaccacaaatggctttcctctgaaaacgagccaaaggccacagctcggctgttggtcgctgctgattgtcaccatcttaggcagttggggtcgctggctgaggctactatacgtggtctaagacgccacacaatggtatacgcgagggaggaacagaggttggaagggaagacgaaccggtaaacaatggcggcgatttgctgaggtaggtttgcagcctgccaatgcttagaaaccagatcaagagatgcaagaggaaaatgagtggagaggacgaaggtacaagataaggggcaatttggtaaaaaaaataatgtcagtgcatcatctccggtatcaacagatttataatggcatcatttgagttagtgaattgtaataggattttccaaattaaaacaggaaaaattatgatggtatgaatacaattaatcctttaaagtacatgctattgtaactttgttttaattcaaaaatttttatctttaactattgatttctaaaaatccgtgttgttgaacaatatatttctcatggtagatctattaaaacgtaaatcatataaatatgaatttataatgtttgacttgagacaaaaactaaaataatagtaatttgagactgtggaaattaactcctcgtgttcatgtatagttttgcatgtattataccaatcagcacagtcacgcgcggcagtgctttcaaacaaaatgaactgaaaaaacattcataagaccataacaagataagcagagatgtggtttttggtttcacatgatacagcaaaagaagagaaaaatgggaaatcagcgattattaattatctgatcgtcatacaacagaaccatcccagcttagactgtctccaacaagtgacctataagggcacccaaacccaaaatgggtctctgatagtactatttcagcctccaacagagtacctatacagaagacctattttacgtgctataagacacataacctaaatttgagtatcctctcttctgaagacctatttgcagtaagggttctcttttaggtcttattgttggagaagaccaaaaataggtattgaactctttgactgtagcgctatgcaaacgtgaaatgggtattgtattttgggtttcattgttagagaaagccttatctgatcggaaacttcaccgaaactgaaactctgaaagtggtagatagcatgcacgtgcatttgtacatgctgtgcagatcaatgcgtctctctttatgagaactaattataatcagttattatcaatatactataataatgttgtgtcagataacagatttggattgacccaaaccgagttcatcctatccgtgacaccgtgatagctaggataatacttgcgtgcctcaaaatcatagaaagcgctccggttggcgtctccggcgtcgttgcatcctccaaactttggcaaatatatcctgttacaggcaatgtcccgcggcgccggcatcatgatcgcgttccagttatcaacgaacaagacggcaccatccaacctctccaatttggtccatgccatctcacacctgttgagcctgaacacgctgatcgccccatcgctgtgcggcctgaaaacccatgaactccagcagatggcagtacatgtcacctggaatcggatcatcaccaaaattattgccatccacaagtacaggcgcctccggcttgtcaagaactctccatgtcgtgttgttggggttgaagacggcgaggccaccacgggtccccaagcagtagaactcgccgtcgtagaacaccgggttgcagtacgccgtccggaacggggtgtgatcgtcgattcgctgcatcgtccactgctcgtctcccgcgcgccacagcgtgacgtagacgctgcggtttcgccccgtcggattccggtctttctcgacggagaacgcgatgcagtcaggagacgtcggcgccgcagacaagcatatgccgtcgaactggttgtcgacggggaacgtcgcctccgggaactcgaacatttctccggtgaacgggttcgtcgcgtacatgtacttgtcgcctctcgtcgcaagcacccatccgtcgtgtctcgaggagaagagcagcatctggaagtgatcctgggactgaaccaggcctgcacggttgttcttcatggttgtactcctgctcgacgattgggtcgaacagcttgtagacgccggtagaagtggagcagatgctcatgagcatcgggtacgtcgagtatctctgcgcgtaatggatgggcttcacgatggagctccatcccttgcagacttgtcgcagacggaagtagtcgatgagtgatatctttgacacgatctcctctaccatgtcagtaggaagaccacaccagcatggtgatgcttgttcggaggcgatgtcgacgacagagataccatcgccattttcctgatcgattttgctgcttgaatgtacaatggcgcctgaataatgttgagttgtgtcgtcgacgatggagctaattggtgcaggaaggagccagtagattgaatcgttggaggtgagatcgggcagcagggtgaaggtggtagtccgatcatccaggcggatagtgtagaggcgaacaccatggcggcatcgttggtggaggaggtagacgcagtcggggcgtatccctgccttggtggcgtcggacatgacgacgcagttgtcagcgacaaagatggccctgtcgccgatggtgtccaccttgcgccacacgtagtcgccgccgtcgtcggtggcgtggacgaggcgatgcaggtcaatgtcgaggagctccgagtcgcgggcgccgtagccgtagtggcgcagcaggaacacctcgccttgtgattctaccaacattgcgttggccatggagtggatgcagctgggctctggaatgcctctccgctcgatgtggggagggtaggaggagacgtcgagcatggcgatggagctcatatcggtgggcacgtacattttaccttggcaactgacgatgtcgcccatgagtaggagttcgtcgtcgtcgtcgtcatcggtgtcgagctgccaccagtcgtcctcgccgggccgggtgtaggcgagataggtgtccatgaaggtggagaagacaatggtgcagtcgggcgagagcggggacgaggagatggcacacctgcgaagaggctccaatggcgtgtccagtgggggcagagaaataatggtcatgtcgtcaagaggagagacgaagaagcagtggttggaggaggcggcgtccaacatcaatagccattggccttgcaagcaagccaagcattgtttacccttgagctccagcatttggtgccgccatgccgatgggttgttggtattgctgttgtgttgagaaaaagggtccatgagcgtgggtggctcgttgtcattgccctcggcaaacttgaagacgaggaggagtggttttgacgacgattccatctcaagttcaacagcaggcagcatgacaatggattatttgccgtcttaatttgcttgctgtatcaatcgatctggagtcatcgatcgttgctaagtcaaaactgaataataatataatctatacgtataaaatacatatctctatctctatttttactattataaaaattaaagatgtttttgccagtattttgatacgtcatttgtgtatgagtcgttttttcaattcgtttgcttttggaaatacatatccgtatttgaggcggatttaagttcgttcacttttggtaatacagaaaaaatcatataagaaatctatttaaaaaagctcacatgctaacttgagacgatcgaagtcctaactacgggcctgttcactttgatgccattttcaatattaccaaattttagtaaagttaccaaaaaagtggctacatttagtttgttagcaaattttggtaactatataagaaatcctgctaaaattttggcaagtaaccataaggttttttttggcattgcgaaaatttgattttggtaggatttcttatatagttaccaaaatttggcaggaaactaaatgtagctactttgttggcaactttaccaaaatttggtaaggttgaaaatggtatcaaagtgaacaggcccttactaaaaaatatatatatctaagcaaactgctataatgaatttcatcttaaccaaaccatataaattaaaataaactttatccgttgcaacacacggataatttttctatttatatataaataacgaagaatggattaaccgatacatactttacatataacagcgcaagcgatgcgtggcgatcgagtcgtcaaatcgaagctcctcccctcggcctgatcgatttgattcgagtcgcctgccgcggtgacggtatatatacaaatagaggtagatcgacttagtccgagtcggagcgatttgggaaaggcaagtgctatttgggcccaaaaatagttccagcccagcacattacattattcctggcaggaaaaagttcatttgtggtccctaatcttgtagacttgtactgagtttcaaaaactgaaatagcatatataaggcatctctaatctatctattatattattaaaggaatagaaaaatgagcctctacgttcactctcatggcctagaaattctcacattaatcggagaaaaagaaaaggcagagtccatatagaaatacaatttagaaatagctgaaattcggaattaaaaaataaggaatattagaagagaaaactagagtccatatagaaatacaatttagaaatagtttgaaattcggaattaaaaaataaggaatattagaagaggagactagagtccatatagaaatacaattaggaaataactgaaattcggaattaaaaataaggaatattagaagaggagactagaattcatatagaaatacaattagaaaataactaaaattcggaattaaaaataaggagtattagaagtagagtatagagtccatatagaaatacaattagaaaataactgaaattcggaattaaaaataaggagtattagaagtagagtatagagtccatatagaaatacaattaggaaataatagaaattcggaattaaaaataaggaatattagaagtagagtatagagtccatatagaaatacaattaagaaaaaaaaagaaattcggaattaaaaaataaggaacattagaagtagagtatagagtctatataggaatttaaaactaacaaaaaaattggaataaacataataaaattaaaagtagagtttagagtccgtataaaagtacaattaaaaataactaaaatttgaaattaagaaaaagatgtgaagaagagtttaaagtcaatataggaatacaatttagaagtaactgaaattaaaaattaaaaattaaagaatattaaaagatgaatttagagtccacatagaaatacaattagaaataataaaaattcagaaataaaaataaataatattggaagaagagcatagagtctatatagaaatacaatttacagaaaattcggaatttaaaaaagaaatattaaaagacgagtctagagtccatataggaattaataatatgaatattgcaaatatgcatgttagttattaattatttttaatatcaaattttagttatttgtaaatttaatatcaaaatttaacatttatataaaatataatataaatattacacattaataatataaatattacacattagtagttttataaagttattgcaaaatttaaaattatgttgtcgttttaatatatttgaataatataatgagaaaacatatatgctattatatgagagaaaatataatgatgctaaccgtacaatctgcgcgggccaccatgctagttttacaaaacgggtcacattaggtctaaagatggtattgcttatgtcatttccaactcaataactaaaatgatgacagcagcatattaaataagttaccatctagaatgaaaagtgatctgtcaaataaataataaaagagaaagaaaacaggtcttgcatgagacatgatttttacacatcaaagttattatatgagataagtaggggtgagtcagcatggccccacatgtcatacatagaagaaaaaaacagagccgcctggagcacccggccggcaggcgaccaggtacgaagagcccaccaccggcgaccactcttcctcgctgtggcagtgaccaagcgccctctcaccgccggccgccggcacctcgacggacgaggaagaagagggggccttggagcagcagcgagttgaggcagaaggaggagcacgtcgtcatcggcgtcgatccaactccaagacaccgtgcgaacaggagggagggtttgatcgatggcggcaggccggcagcggaagcaggacacgcgcgcgtgccgcacctagcttccaccagcttccatccgctagctagctacttatcagaatcactacccaatggccgtaggggcaactggcaaaggaggagaagatcaggtgctgcttcttttctttcttcttcttcttcttcttcatcgacaatctttttcagatgaacgccatctttttgtccaggaacatgttgttgattcaacaacagctcgatcagtctgaaattaagatcgcgtgcaggaacatgaatcgaggagcagggcgtgcagcggcggtggagactagagccgtggggcgtggcaatggcagcattgagccaatgacggagatgaggacgagagcctcgaccgaccagaccagaccataccaaaccagacagacgagcgcaagataaataaagatccggaaaagaataatacggggaaaaaaagagaggaagatactccaccacattagcagtgcgaatgcaatcaaattcatctcaactgtatattccaaactaaagcacttctacatactaaaaccagatgcagataagtgccatcacatcagcaatatatttggtctctgcacaggaccacaaaagttgcctttcttaagttcaggcatcaaaacatctaatcaatacgaagacatgctttcttaaacgaagcctgatgagtactactagtgttccttactactactactagtatatggagtactataagatgacacttcagttctgctgcttgatctccttcagactggacaagccctgcaaaaacatcgagagatccaaaggctcagtaccgtaaacacacagacagtacgtacatacatatgaaaataaattaacttacttatcatattgccctaattgtgcttcttcttgagcttggtattggtccgctcgtgtttgtccttcgccttcttcgcgcccttggcgatttccgtcttcgtcttttggcattcgtggtctcggttgagagcgattttaccaccgcaatccttgcacgtgccaagtgggtatccgccatcctcacgcttcttggaagccatgacacgaacactggatgttcaaaacattcaacatatataatcaaacctaatgttatttgaaacaaacaaacattccttaggaatagaacccgacactacaataaaaacgttcaacacctacgatcttgtacgagaattaaatccaaggcaattttgagattttactgacagcaaaatacatgcggccgcatcttaagtcaaaaccgaaaccagcgaaggaggggagggatgtttcacaagaaaattgatcaaatacattaacgtcaaataaagacacactaacagggattttcttttcacgaaaaaaagaacttaacatgaaaaaaaaagggacggagatcaccatggttcctccaaacttgtttggagcaacatcaaaagaaaacgtggaaaaaattagacgatggatgaggagatatgagaaataggaagcagcagagttcgatcccaactcccaagaagagggacgaaaacagaggttgaaacgtgagtgaagggacgaaacagagatcaccattgctgtggttgctcgtccccttcctcctaaaaaaacaccatggaaaaagaaaaaaacaaagcgaagcttagaaacagtttagaacggaaagaggggacagaaatcaccatggttctcgatgctcttgcctccatagtcctctaataaagaacaagacccaaaatcaaatcaaagcgtaagcagcatgtgtacgagatcaagaagacagacgcactcactctaccactcgatcgagaagaagagaaagatgatgaagaagaaaaacaagaaggagcatacacattagtttcagaaaatgttaaacgaataagaggaagaggaaggaagtggggagctcgtcgcccctccgttcaacagcaactcaaaagaaaagaaaagaaaagagaaggagaggactaggagggaggaagggacagagatcatcatagctatcgttgttcgtcgccctcctccttctcaccaaaagcaacatatattcaccatggaaaaagaagtaatcaagtaaagagaagaagaacaagtagaattcagcagcaaactcaacaacagaaatgagaagggggagccgggagcgagggaagggacagatatcaccatggctattggtgttcgtcgccctcctcaccaaaagcaacactctccaagacgaagaagaagagattacacaagctttacccgctcgagaagaaagagaatagagacatggaaacagcttagaacgggaagaggggggcagagatcaccatggttctcgatgctcatgcctctctactcctcccaataaacaacaaaatccaaaatcagagcggcatgtatacgagatgaagaacagactcactcacactgtcgatcaagaacaagaagaacacgaacacaacagcaagaagaagaacaacaagaacaagaagaagaataagaagaagaacaacaacaacaagaagaagaaggggaggaggaggaggagcgagtaaggcagagagatcaccacgagtatcggtgtttgtcgccttcctcctcagtcctcaccagtaaatttgaagaagagaagaagaaatcaaccgaaacccgaaagaaaaagaaaaagaaatgagttaggaatggacaaagatcaccattagtatcggtgttcgtcgcttttctcctcaatagaacagcaagaagagggagaagaagatcgaagaggaggaggaggagatcaacaacaactcaaaaagaagaaaaagaaaaaaggtaggagggaggaagggacggagaccaccatggcatttggtgttcgtcgccttcctcatcctaaccagatggagaagaagaggaagctttaccagtgggagtcctgggagagaagagaagcagaggaggaggaggagggagggatggagttggcgagcacggagacggagggagaggtggtggaagttgtgtgctgcaacagtgtacatatatagccaggatcgacgaggcttgtgctctcatcaagcggatccaaaccgtccgtgactgctcatccaagtatccgacggcgcaggaaccaactgccctgtgccgtctgatggtgtccacgtgtgcggccgcgatgtgccttgagcagaggaggaggaaggggggtacctccgccgctgccgccgccgccgccgccgtcgtcggcggtgctcgatgccgcccatctgtccgcgagcgcagcggaggaagacggccggcgtaggggttgaggaagccagcggcgccgctgcctccggtggctccaaagcctccactcctcagccatctgctccggccgcctgccgcagctcgatcgcagccggcagccaccctcacacacacagcacaacctcccctcccgctccgccgctggtcgtcgccggcttgctgccaaagcttccaccctctgtccctctctcggtctcgggttgcactctccactctccccctccccgcagacacaatcccttctttgttggatggccatatggtcacacgggccgatcctatattctccggcctgttcgacaaaaatggcccatcaatgacctaacccacgcgaacgacgagccctccctcttattgaaagacgcatcaagcgcagcaaaccatatatatatttataaaaaggaaatattaacataaaggcattcgttctttttcatttttctttaaattttgactaaatttataataaaaatatattagtattttcaacacaaaacaaacatatattattaaaatatattcaatgttgaatttaattaaactaatttgatattttaaatgttgttaaacttttctataaacttggtcaaacttaataaagtttaactagacaaacgacttataatatgaaacggacggatggagtagatatttccttgtgatacttgccgaaccatctttgctgcaacattcttgccaaaaattttctcaaaatttattgttacatggggcgtacaaaaaattaagtcataatttaagtttcgctaagtgttgcaaataatgatgtaactgcaatcatccctggcgattctgtctgcccacgcctttgaaaaatcttaacacttcgctagcttgtttctgtctcagtatcacaatggaaagctacatcaaatatttcattgcacattgggagcaagctcatcgaaatcccttttattcgctgctgggaatattattgtctttactgcacttctcctggcagcaattgttttccctttgacctgtttcaggaggatatagagtgcatgagggtgacaatccagtgtttatatgcatggaatagcacacaaagatcaatgatcatatcgatagcatctcaagattgaccttttctggagattagcatgaatgataattttctcagcatattataaaatcgatcatgaacgttatgtggtttgttgatcaatcactaattaaaagagaaatcaaagatgaaaggcataggaggatcaatcctctggttgtaataatgaaatcacttgctattcccttaaataagagagatttcgatattccttgtttcaaaattcagacatggaaggcatagtggaaaaaaaatcagatatagaaggcatgggtcgtgtgtgtaaatgtctgtagcattcccgactattttgaggttttaaacttttaataggtagttcattttgtattcaagaccagagttcatttgcagtatatttccaatgctcacacctgttgagctaccaaacagtcccatataatcacatcccattgcaaatcgtaaagacaaagtggtgaaaacaaaagtaagctaacatagaaaagttaatataatcattgacacagtatacaaggccctaatttactctgtctttcaaattggaatgtttctaagagtctaacctgtattcaggttttaaccacttctcaccctcatccaaaagccaggtgacttctcacaggtggtcattatctcacctagtgaagcatcaaccatagtctttccagtgtcccggggtgatatcctgcacagcacaaaatgtagttaccctcagatattccatgtgctggaaaatgttatcaggtggaataaaagaagaaattgatcaggccttcatgaacagattgaagataatgaaaatagaaagcacaaccaacagcatctagactaatttaaagataagatgccattttgaattatgcccttactcgcatatcagatcctgatgttcaagtatatattttagaaggattcgaagaaactggcatctttgcttggagctgctttttgcccatatcttttgtgctttcctggcttgcgcaacatgctccttaacctgattagtcaaagaattaaagaaaaccaaaacaaggtaggatctcacactaatgaagtctgtagtaacaaaaaatacaagatttatttgttcattgatcactacttcagaaaatcaaaatcaattatgaatgacgaaccagatctcagttaataatccaaaagataatgacccagacaactaaacctacactacatgttgtaattaaaggacctaacaaaagcaagccagcaatatacctcatcaggcgtcaatgcagggaagtatcccaagtatttcatagtagcgggctcatagcattggaccttgtcagtctgagctcttttccctttccttggtggtatctgcaacggagcataaactgaatgtgttgtaagcctgtaatatcaaagcaaccatgtggctctgctagctctcagaagtcataacatgccactgtgagccttattcagctggagttaatcaatacaacttagaaaaaaaaagtgcctagtgcttatctgaaacctctatcagcacaaatcagagttgactcatagcatcaattcgaagaattaaaatagcactctgttcaagcatgcagttcatttacatgttatcatcttactgcatctggccattttgagcataggaatttaccaaattgaagttggagtatgtaacaacggtaacacttgatgaccgtacgcactgttgcctgttgctttctcaaaatttaataaccacagccctggaatttgctagaacataatctcaattttcacggaaatagcaacattgtagtacagcattggaacaagtcgctagacttaaaaatctaaaactggaaattccaggcagacagtctttaaacatttgtccactaacagtaagatagccatagtacaccagacagtaccaactagtattcttcttcagacctatgggcacatgaactgaacccaaataatgaaacgcaatatttgaaaactagatgcaatgtgcgatccgattagagtaaatcccacataaaccccatgagccatgagctatgagcagagcaatctcagaggaaaataaaaaaataaaaacagtaaaacctaagtaccgtcggaagcgtcgacatcgatggaggggacggtgggcgggatgaggaagaggaggatgcggcagagcgcgtaggcggcggcgagcaccaggagcggccaccacaacgccatggccagagactgcagcgccaaccctaggtcgcagcacaaccaagaccatacttggagtcattcgcaagtttgacaacttcttcatcggaactgaacttcatgattggcagaattggtccaaatgcctataaacaagcaaagagcattgataacactaatagcattagttcaaaaagacgtcaggcattctttcaggcttacctcttcttgcataattttcattgtgtgattaacattcaccaggacagttg

SEQ ID NO: 62576 - DNA, 11215 bp, Oryza sativa
  unsure (1)..(11215): unsure at all n locations
cagctccgcgtcctcctcatcctctccccgctgctgctcatcgtgcccgagcaggtatggccncagagacgaccacgcgccgccgccgaccgccgtggcgccggcggaggcctcatgtacctcctcgcgcagctgatgggcatgggcgacggcggcggctcgccgtacggccgttggcacggcggcggcggcggcgcgtcgtcgtcgccgtggggcgtggcgctggtgctggtgctggtgctgttcttggtgtcgtaccagtcgtcgttccagagctggtggttcccgctgctcagccgccgatgagaattgcaaaagctcgtgcatgtaaaaccatggtgaaaatatagcagaggcttcttggttaatcagagctaagctcggtgacgatcgagctatatataattgagcacaagggcggagctagagcgagatggagggatgccacttgtttaatttactctgttttatattaagtttaagctaatacgggtatttaaatttgtattgagagatgtgcacacatgatgaaaataggttaggtataactatattttttcttgaccgggttcctgggtacccccctcaatactctagctcgagcagatggcatttgggtgccgtgtaattatgcttgtccgatctccaatcatagtaactaaatccaatttacctgtgactttcgagcgaatttccggtattgatatatatactcttacatatttacctgaaggggtttctcctatttttggagaggtatcaaaactaattgtataagttagaatagaattgggaatccatctttatgactttattatgttctagatatttttcttccttttttgagaggtatatgcattttgtaccttatagtgcatagtgttaggagatgtatacctccaggatctatgcactatgagttatgtatactttctacgcctcccgaaaatcagaaaagtgttggccaactataagcttgtcttttattaagtttgattgttcttttttaacctctcaatcagttaggaggtatatacctctataaggatgggagaaaacattttcactaaattatgatggcaggtgaagaaacgaccggttttgatagtgaaagtattagttcaacttgttttcgactcattttcttctttgatttcaacatgttttgcaaactgcataaaaatgtaactatatatgttaacaatagttgatgcaaagctactacttctatgataatggtatttgtagtataatttttttgctgttattgttaagcatatacagtaacaagacaagatatggttatgtttgttaatgacatactatttgttgtttgatgctaatttatatatgtcaaactccatataatagtataaaagatgtcttgttactttataaatatgtggatagggttgggattgggattgagaatgaaatagtcccaattatccatctcttccatatccctataacaattccacctttttattacctagctacatccagacacacgataaggatctgcgaaagtatatatgaatatggtgagtgaactgaaagatataagtaaatgtgtaccacgatgaataaggtgagtgaattgaaagatataagtgagtgtgtaccgcgatgaataaggtgagtgaattgaaagatataagtgagtgtgtactgcgaggaacagtcaaaagcgttgtggtataagctatctgttcttctttttctaccagcttaatttagtttttaggtgaattaactagtacatacagctcaatatgatattataatcatgatgttttgagttcaaatatcatggttgacacaatatttcaagcttttagatgaacaatggtaaggtacataaaaaaggacccaagaatgttctaggtcaaaagttctttgttctgcgttatctagaatcttcttttgttggcaacagcacacaattcttgcctcatctttttcacttctgtttatacttataaatcaaaatttaaattttcaacttaaatctagagttaattttgaggttttttcatcgtagtttatttttcagcattcgcttttagatcgttaagaacacttacataaaaagttcatttacaatttttttttcgtttgcaaatataccatttgacttattttaagccgtacatcccaagcgatacaaagaagctcctgtctccatcttttctggtgctctttttcttttctctgctgaaatctagtaaaagctctggtattccggttgcgactagatatgatatgatatatgattacctcagccaaagcagaaaatgcaattttgattctcaaacacactctttcattacctggctttaagcagcattaccgtgcgatgatgttctagattttggagccttggaatattaatacgtacgatcaggtctaactgagcttgataccacaattatacagagtagttaaaattttgccttggagcttttggcatttctttattatgagatagttgcaagttgattaatcaaattagcatcgaagattacacaagcatgcgagggatagatatagatatagctagactaaataaaggaaggaagaatcttctaacttttgtcaacaatggtgccgtctcctctctttcggctctccttgataggtgaccaaagtgactttctgcgctaatcatacgtgtggggctctctccacacgtgccaccctgatcccagatattctgtgtgatcatgaggatataatcacttctctggacgataagactgtttttttatacgtgatgctgttactattcatcatattgaatatatatatatatatatatatatatatatatatatatatatatatatatatatatatatatatataagttatatttaaagtaacttcaataataaaacgaatcacgaaaataaataaattaattcattggatcttctccaatagacggctcacattcactcatatgtatatctaaataaaaaaaatagggattgtatctcgtttaaatgtggtgatatctaatcgatattatgtgatacttgtgatacttacgataccggttaggtattaggatataatatttcagatgtaccatttcgttcgaatggaataccgcacatagcattcctcgtaattaaagcaagtccagaggtagttcttaaaaagaatggtccaaaggggataaacatcaattaaaattcccttgggtagtactcgaccatgatcattctatacacacagaaattcataaatttaaaatggtccatcatcatgtggggatcgtcgtaccgcaaaatcattttaattcgatctctccactctccagattcgtagcgatcggcgattcattccgacggtgtacttaacgcctgcacgtgctctcgcgtgcatatcaccggaggattcgttgccgccgtgcgctacgacgttgagatcgatccgcttcatcgtcgtggtcgtcacgtcgtctcacggcgcgcgtcgttaaatttgtctcgcctcgttttggaccgaatctgcatgttggttacggcgccactgggctgggctcggtgttgcgcgcgcggcggaactgggcttttctcgtcctcgtttcggcccgaaactgcaaaatgtacagactgatatgccgccctccggcccaagcactaaggcctgagcattaaggttttcgtttttcaaacggtcaaacgatatattttatgaaaaaaaaactttctacgtagaaagatacaaatttatttttaagtttgtagcgagtaaaattcgattaagcatgcactagtggttttcttgttttccgtgtcctaactttatcttcatcttcattagaaatgaacaccactttaaaatataaaaccgttagaatttactgaaaaggccgtacggtccctgaaatcacgtctggttcctcgaggtaagtttgtacgctaacaatttgaagtatatttttatgtctcgactcaaatttatatttcgatttaaaatcgggtgtttttatgtttctacgttaaaaattaaagcttgaaaacaagtagtaaacaacatcttacgatggcccagacgcatgtggattaaatcgccaaaagtcaaccaagtttggcgaagttttaattgttcgtggatgacttgcatcatcattgtatgcgggcacatgatgattttcctgttggttcaagcttccgcaatctcactggtcactactgtccccagctgccatccctgatccctgtgtccgctaaccagaccgcacagcgaccgtccgtccctttcattcccccgcatgcgtgatcccccattctttccgagaaaaaaacccgcgtgatcgcgtgatcgcgtgatccgatccgatctccaattctccatcatgggctacgactctgacgccgcgcgttgcctctccgatctcggtgagtccgccccttctctattctcccctccatgctccattttttttttattttttagacctttttaatttttagttttgcaacgggtaaaggtaattttaatcatgtatactggtgggaaaaaaatataaaataataataataataataatgaaataaaattacagtgacctttggtaaaaagataaaaatatataatcaattttccattaattccattagctaaaaataatataatacgaagtaggaaagttattctcaaattttagcaattttcaaaaagcttaaatagagcaaactaattatataaatgaaaacaaatttaattacctaaataaaacaattagacctgtaattgaaaatctgttgccggtttagttaaaataagcctgtgggtgtgtgtggtatatatctctcactcgtatgtcgtggtctttttttttacatagaaaaaatgcccgtgcgttgcgacgggtaattaaaattataacaaatataaaaatattatatgattaaggtttagtttcacatgatatgagctctttaagaaaatatatttataatgaaataaaaaagttcagctgaagtgacctaaagtgaacttgttccatacggagcatacacatggtccatgaggcggccaaatagtgtggacggcctagaaatagaatcggggaggaacaacttaagcgacctaaagtgaacttatttcgtgtgggcggtctgggaatggcgttcggcctgacgcgggagaagccagagccgtccaatctgatagacggtcatcccgacctatataaaagttcaacagcccaaaccctaaccctaaaatcatttccccttccccctctctctcaaaacaatgtggcggcggcccgacataccgatatccctgcgacggcggtggcggttcagcagcgacggcgacatcctcccctttcggcgtcggcgttttcttagtgttcttgaatctgatcttgtattcttgtagtagtgttttctttagaatttaggtctaaacttgatgcggtctctcatttttttttcattcttttcttttttttttattatttttcatcggagagggattaaagcgggatcaatcgcacgtgcaatggaattttttttatggacgaaaactataacccataagccatacaaatttttttaattaggtatatatagatattgaatcagattttccttttttttttcatttttttcgtccttttttcgttactacagatgtcagaaacgtctttaatttttttttaccgcgtcagatataatcagattcgattttttttgtcgatttctttttcacgctttttttcacgggtggacgacggaaacactttttaatttttaagtagtagagattgagatagagatacagatagagatagagatagagaaacggaaaactttttttgaaactttttttttggaaccggacagaaaaaattttacgtttgttttttaccgcatagatggaatcggattcaatttgtttttttaccacgccgtgtcacatataataggattcgattttctttggaatcggacaaatacttttttctttttggcccctttctttaccgcgtcgacagagtcggattcgtttaaattttttttccttttttcgcccttttttaccgtgtagaccgagtcagattcgtttctttttttttcctttttatcgcccctacttttggatcggacttacttttttcttttttttccggttttttttccttctttcgccctttttgatcggacatgtttgtttttttttcacacggttttttttcgcccgcagatttttctgtttgtttcgtccgtttttttatcggacatagttttttttcgcccgatttttttctcccatggttttttttgacggacgatggaagcacctcttatttttttaactactagtagagattaataaatattatcggaaactgaatttttttagccacgccaacactaccatgtcagctgcacgtggcgtgatagagttatttggccgcgccagacaggctggcgtgaccaaaagatttagatttagaaatactttttagagtgttctattaataaggctaaaaaataaaaactctcaaaattaaaagaaataaaaaaattttctccatgctctctctataggtatacatgcatgtatatactccctccgtttcagaatataagtttttttttgttggatatgatatttcttagtactataaatttggactctttgtctagattcgtaaaactaagacgtgtcatatccaataaaaagacttaaattctgggcagagagggtatgttatatacatggtatatgtgcatacaaagttatatacactatatataatttatgtatacgcatacaatgtgaatgtataaaaaatatatatacatgtattaaaaaaccaaaaaattagaaagaactgaaaaaaatggggaaaaaactagactgctctctccgcacatgccatgtggttgcgccgcacggagagagggcgtgcgatagcagtgaaatagctttttcgcgatctatttcgattatgggcctgttaagtttccaaacaaatatttttcatcatatcacattgaatgtttggacacatacgtagagtattaaatatagaaaaaaactaattacacaaattacatgtaaaaatagagacaaatcttttaagcctaattgctcaatgctttgacaatgtagtgttatagtaaacatttgctaatgacggattaattaggcttaataaattaatctcgttgtttttagacggaatctataatttattttattataagtatatgtataatacttcaaatatatatccgtatatccgatatgacacaaagaaaatttcattcgcgacctaaacaggccctatgtcacggtaccaaactatcacgccggttatgagctgcagttaattgattcgctggttgcttgctcacgcgccaacgtacaaacaaaacctgcgttttcgccgtgcactcaaaacggaaccgagcgatggagcgagcaggggttgttaatactctctcgttagcagcaggggaagttgccgagttgggcgttgctgctgaatcggcaaaggaaaatggtcagttatggcaactgactgactgtgacttgttcaaaaaaaaaaaaaaaactgactgactgtgaccgtctccgaccgagtgctgcctcatggctgtcagcttcaggtttgctcatcccatactgaacagagtgtatgttcgtactaatttcgttgtcaaacaccatcattcgtaatgacatggtggcccttgttattattgatgtggaaaaacttgacaatgtttgcagtttgttttgtcctgcgtgcaacatttgcagtttagtggtagtaccgcatcaactttggataagcaccgagaaaataaggggaccggaagtgtactcgttgcatgttacaattactccatccgtactataacgtagcaatcgaagatggataagcaccgaaaaaataaggggaccagaagtgtacttgtttaggatggacattatttattttaaattgttatattctgagatgaatgtgatatgttactaagaaaaacctgccgagtataatgatggagctctcgttttttttctctacacagaaatacgaacgctcgtttacgtaagcgatgacttatgaagcagccatggtgactccacatggataaagattagcaaaatcatttttgactagcatctgacttccgattcatgggtacacgaaaatttctgctaagttggattcgttttttctctctctctcgattttttgtggtcgcggagagttgtaatagtagcacgagtacgcgtgcgtaacgtaattacgtaaacgtgcctagaaaagacgacgagcaggaaattttccagcacggttccgttgtttggtattttacattacagaccttttataagatctatttcacaaatatgtcctataaacctaactgctaatgtggatcctggatcgatgccaagtgccattgaggttacatgttcttatgttggaaatgttggcaatatgcgtggcagccggggcacatcacgctgatgtacccaggagctaggtcaacaccgtacttcttggtggtgatgtctagctgacaagtcaagctcggaaatcacgtgaatggcagaaatacctatgaacccatatgtcagctctctcatatctcttctctctctatccactcatttcacactagttggtcagtgccatattgcatcaccgcctcgagccatggctagcgctgttgccaccatcgcagcccctgccgaagaggatgccgctgtgtgggagcgcgccattgcagcgaccgtcaagaacgccccaagaccctaaccctcgatggtatagtcaagtccaccatgggccgcctcccccccggaatgctagttcgcgcgcgcgttaccggcgcgcacttccggcccacaaggcccaccgcatacgcgcacgtctctttttttctttttctttttttcgcagtttttttctaccgctgtttcttctcttttttttcttttttccacagtttgctactgcatggataggagaaaaaatcataattagtttactagtgattagtttcctatttttactagtgattagtttactagtaatatttttaaatcttaacttaaaagttttcaaatttggacttgaaagtttttaaatctcgagttgaaagttttcaaatctcgagttgaaaattttcaaatctcaaattgaaagttttcaaaattttcaaatctgaatttgcgaatctcgagttgaaagctttcaaatctcaaattgaaaattttcaaatctcaagttggaagttttcaaattttcgaatctagagttgaaagttttcgaatctgagttgaaagttttttttaaaatttgactttaaaatttaaatcttaaatcgaaagtttttaaatctagcttaaaaattttcaatctattaataaaaaaatctccaacaaaaattttttaaaatctttcctaatactataactaatagaggaacttaaggggagtgcgcgctagcggcgcgtacacgccagctagccgcccccgcctccccctcggcgttgttccttggtcgctacctgttccttgaggagctcttcgtcgtcggggtatgcctttcctcattcgtaagcctcctgcacctctcggtgctccgccgtctctccctcccagacaatcgcctcacaaggcccaccttcctcgcagatgtcgtcgagccctacgacgccacactccgccaccttgatctcgggaagcgctcctacacggcggagatgcgatgcagcgccaaccaatcagtgtggaaggaggggacagagagaagagagatggaataactgacatgcaggtatagggatatttatgacatttcacgcgatttctctcttctctttaaccaaaaattattattttaataggtgtggtgtccagcagcaaatatctaacttctaagagtttattctccaaaagtcactccgtgcggtgtcttacaactaaaacagtgaagtcacgatattctttagcaaaatttgcatatcctcaattaattttttgagggtttatttacaaaataagtttatattaagatgcccaaatgtaagaaatccagctccatttcggccagactctcaagctggatttttcatattttgatccttttaaaaaacttatttcgcaaatagacccctgaaaaaatttatctcagaaatgatcctttttggggcgccagagtggctggcgccgtcatccaacgggacggcgccagcctctctggcgccgtcctcctgccaccgtggcgcacgcgaaccgacgtggcaggaggagggcgccagccatgctggcgccgtcccagggaggagggcgccagcatggcaaaaaaaatttaaactcgaactaccacttagctaagtccgaaaatatctagcataccacttagtttactttgcaccttcactaaaattagaccataactcctttagtaaaactttttgatcagcatgttaaacataatacactctaccactatatgaaattacttaatctaattaaaaatataaccacatgaaatgacatatgtaagttaaatagtacatagagatgcaattttttttatttttatttcatttttttgatatttttttcatacttaggagaacataggaaccaaccgtgtaaaaaataaactcaaacggacaaaatatgtgacatgtagaattttccaaaactctaccgaaacggacaaaatatgccatctattaaaataggcgtaactttctcatacggactcggaatcaggcaaataatatatgcacggacatctacagaaaaagttacatccgattctccctagctttgccgggttcggcgatattaaaacctccaaattccgcttgcaagattgtgttttcgaggagagaagtttttcggtggagctttggaaaattccacatgccacatatttcgtccgtttgagtttattttttacgtggttggtttctgtgagttcctaagtgtgaaaaaaatatcaaaaaaataaaataaaaataaaaaagttgcacatctctctcctctgcactagttcggagagaggagaggagaggaaaaattctacatgtcacatattacgtctatttgagtttaatttttctatggttggttcttgtgtatctctaagcgtgaaaaaaatatcaaacaaataaaacaaaaataaaaaatttcgggggggggggg

SEQ ID NO: 62577 - DNA, 12629 bp, Oryza sativa
ctccccctagccacctcagcatcgccccgccacgtcggcggtgggacggcgccaaagaggctggcgccatcctgttgaacgacggcgccagccactctggcgcccccaaaaggaccatttttgggataagtttttctagggatctacttgcaaaataagttttttaaaaggacaaaaatgtgaaaaatccaggactctcaagagtccaagagaaggccggcacgccgggctccgacccggccaaaaattcccaaatccaacctgtacgcgcctctctctattctgatccacaccaccccaccacgccgccaccacctacccaccaaataattccaactccaactacttctccttccttctcctcctcctgggcctccgctgccagcgatcaagccagcacgatccccccgcgcgcgcccccagtcaaccccggcggccgccgaggcaaatgccggctgcgggatcccggcggtgaaggagcggacgccgacatgggtgggcttcgtgtcgacctctccggcgcggagatccgcgtggaccccgcgtgcggcgccgccgccgacgatggcgggagcccgcccgtgttcctcccccgccagcccgccgcgcccccgctcctcgcgctcgacatcggaggtacgcgcgttttcctcgctctctcacgcgcgaagtagacgatcgtggtggatgaactcgctccggggtggtgtttttttttttttccgcagggactctgataaagctggtgtacacggcgagctgcggtggcggaggcgcggagctgcggttcgccaagttcgagaggcggaggatgcaggagtgcttcgacttcgtcagggcgcagggtctcgtccaccgcaatggtagtgcgtttttttgcgctgaattttggttgattctctagcgttctagctccatagtttttgagactgcaaaaactatggatggtaactgcctaactggcgtgggacttcaatacttgatgaggaattgttagttgctctcaatttaggactgtagcctgtaggagctcatcacatttgggaatttctgtggctattcatgctggcatctttgtctgttcgtgatcaacaaagcaagctcactgtggctgttggacatggccggtgacatttgcaagcgtttcactccatcatgccggcgtgaagaaggctatatatatgacgcgatttttactgcaaccaaaattacaatttctgttgttggagcttcctgtgttcgtgggaagaaaaatgttggaactatctgttgtgagcttaattatatttttttaattacaggatcaactatgggttcaagcaaagaaaatatagcattgaaggtatgatttttcttgtgctatgtattagtggtccggaaaatcaagatatcaatgcaagtggagaccattccagcaatctgctgtttcctctacatttatttgcatgttcatatgaatgttttacctattatcatacccaaagaaaaatcaagagctttgaatggcttcattattgctcactagtgatagcggatgtatgatgggctttgtatggcattcaatagtttactatcatatgattggatgttgctgctacaatccattgaaatcatatttattcggtggaattcaaaaaatacaaacatagaaattagttgcttacattttgtatatcatattagttgcatttaattgacacaactaattctcgaatttaattcatggagttgcattgccaaccgatgcagagttacagaaacaatgttgcagtatccccaagcagcggagtataactttttatcattattatttgaatattattttatttagcaaatcagggctttctcctccttggtatggtatcactacatcattatagatgttggcaagtatgcttttcgagcatttaatgcacagctttgtgtgaagacgtgaaacattgttgaatatatgatttagcagccttagttattgatctaacatatatgatattatcatcatctttttctttgttgacctgaatagaatttaatgtgatcaacactgtctgcaggcctcaggtggtggagcatataaatatactgaagattttcgtgagaaattaggagtttgtcttgacaaggttgatgaaatggatagtgttgtttctggagcaaactttttgttacaggtcagtcatatgcatctatattcattgtggccgttaaataaatcactgcacatcttgaccactctgtagattttcaatttgtattttggatgggaccaccaaattcttgagaaaattgcaggcaacttatcgtctgtatcgtctggatatttatttcttatttggagattgttttggttaaactgatactttcttgcagagtgttcctggagcagccttcacacacatgaatggaaagaaaagttctgttgatatttccccaaataacttgtttccttaccttcttgtcaacattggctctggagttagcatattaaaggttgcacttcttcctcatgatacctgtatggaaatgccttacaatgcagctcatataaacatgttttatcaagtttaatgtaggtcactggaaataggaaatttgaaagggtaactgggacacatattggtggcggaacaatgtttggtttagcaaaacttttaacaggctgtaagaggtaatccctatacttttatgtcatatattgtcttggctactgtttcctcactgatatggtataattctctagttatgacgagttcttacaattaagccagaaaggggacaattttgttcttgatctaattgtgaaggatatatgtggggaacttgtttgccagaaggtttgcctttacccttttcttgttttatttgattgaccaagacctcttgtcttgcaaatttaattttcactttgtccttgtttcttttgttttagttttggtaggccagtcgtgcttttgcatgcgggctaactctaccatacttgattgtatttatttatatgcaacagatttattcttttagcatcattaacaaagcagtatgacttctaggattattataattattaatgacatgcacctatttatttatcttcagctatcttttaagttttgaagtgttgatcctttcatttcatcattgaatatttgttcttacatcttatgggtcccttcttatatgctccagcaaggactttcaacttcaactcttgcttctagttttgggaaagttatcacttctaagaagaagttaacagattacagacctgaagatctagcatccacattgttgagcgcttttacctataacattgcacaagtgagtttttgttcgatctttacctataacattgcacaagtgagtttttgttcgatctttcttctagctattaagtcactacagattatgttggaagtggataacgtaagacagaggagcttagttaaattctcttggttccttcctcagctgtgtgcatctatggtacaaccacactagttaacagcactttcttgaaagaaattacctgggaatatgcagttataatttggaataagaaaagcacagtaaccaacggtttcttctgaacctaggtagggataaaagaaacatgtttaaacttaagaatgtttcagcagaaagcagtctaggcaaatgacctcaaacatgctggtaaaactttatcagaaagaactcttgttttacctttcaacttatgcggttctgttgttactatgttttcagttactggttgtggtaaaataatcatggtatttgtcattcagatttctttccttgttgcatcaatcttgcatctcagaagagtgttctttggtggatcttatatacgtggacataagagcacgatgcaaaatatttcttatgcaattgacttctggtaaatacttaaaacttcctaaaattttaagtgtatcaatgtggatgtcatttttcttcaaaaagttatataaaactgtatattcataattgcaatattccatttgttgggactttaatatgcgaggtctgttattcaggtcgcagagtaaaatgcaagctgtcttcttgcaacatgaagggtatttaggagctcttggtgccttaatgagttatggtgattctggagataaaaacatgaaccttgaggaaatgaaagaggaggtgagttagtgagttactaagaaaatactgttgactgtttatcattgtcctactactccaaaaagaaagaaaacaaatttggctctcattctttatgtttttttatctaagaaaaagtttatgtgctactagatacaaattacacaaaatctagagtaattcacaagtggaggtgttatctgcatcagtctatttgcaacacatgtccttttgtaaactgtttgatattttccaataggtgtttatgtcattaggattatttctaattccaagctcaaacgtgggagtttcttgtgctctattttatgttgctgtaggagaacatccatgaatcagcaacacctattgatgagacatcaacagatgaacataatgatggaaacatatttccttatctccttgttaatattggatcaggtgtcagcatgatagaggtttgccaatacacagcttctcattgcatttagtattttatttacaggacagttgttaatagagcattgttttgtgaggcaggtaactggaaatgggaagtttgagcggattataggatctcacctaggtgggggcactatccttggtctggcgaggcttttgactggttgttcaaggtaatattcagtattcattatgatttgtttattttatattaatattgggattttatttcatactgattaattgctttttttttgttattagttatgatgaattcttggagttgagccagagaggcaataatttagctgttgatttgactgttggtgacattatggggagcatggttacccaaaggtacatatacccatactctgacaaaaggatttttttttttggtgaaacgcctgtgggatgttaatcattactatgccgaccgacttactaagagtacaatacatatattagctatttgccaccctgagatctttggtggaagaagccatagcttggttagcaaatgcaagcatatgtcacttatgtccaccattttatttgcatatgcatatgtcatcgactctggtgcttggttacattactctaatgatcgaaaatcacaatgaccacttgttatcctatggatgttaaatggggcttccttgcgtcactactgcagctagctttggaaaagtgagttcaagtagactttcggaatacaaagtagaggatcttgcggcagctctattgaattctttcacctacaacattgggcaggtatttccagatatctgagttactaggtgtcattcaccaataatgtgctgacctcattttgtttctcttttagatagcctactttgtagctaatctttctggtctgaagagaattttcttccgaggtgcttatatctgtggccatgagaagactatggacaagatttcccattccctcaagtattggtaagaaattcctgttaagtttgctatccaggaacactttaatgctcagttcaatgcgattgacttgttactagttcattacaatttttcttgctctcaggtccaaaggccaagttcaaacaacatttctgtgccatgaggggttcttgggaacactaggtgcattttggagctatgagaacatgggtattgacggcttggcagcacatgaagtcataagggaggtcttgcttggcgctccttacactgggcagcttccatctctgcctctgactcaccaacaggacaatgtaaatatttgacactgacacgtttagctgcgtagtttaattaccctatgttatttttccttcaagagtgcaaaaccttaatactctctctctctctctctctctctctctctctctctctctctctgctgtttttagggagaagatacgaccattgaaggagaagtagaacggcttcgacatgacaatgctgtgctgaaggctgagcttgaacggttacaaagggagaacacagagctcaaagcgaagctggtaaaatctggcaaaccaaataccttttatcattaaacataggatgcagtagtgaagcatgattccatggcaacaagagaaggtgtttgagggcaaaagttcaatggccttgttatggagatcggagaggcagaggctgttcaaccaacccaccacctggttcaagtcttatcaactactccggtacggccccaatttgttaaaagactgaggtgtgtgatccacatggaaacagatgcaactaacagcctaatactgaggtgtagaaagttgttgtaaacttgttacactttagcaataacttttattccaacatgatttttacagaggaagtgtgcacacaggtagttacccagttaacattgctcatacatattgagctgatgttgtatatttatttatttttctttacttatttttgttggtgtaaccttttctctgttgttctgtatcttgtaaatatggaagcagccgtgataataaacatatatggtgtctttgtatattttgcgaagatgtctatattgtcatcaagaatagtacaatacagaaatgttcatgatacttgtcgagcagttgtcttccctattataaaccaaatcttaactattgaaaggtgaaactcaaaatgaaataaggatgagccacatcattcgataaatattagccgttggattcactacaagataaaagaggataaatgaatcttaatcgttggattagctggatagtaaaaataataatttaagaagtttccggggatgaaactactagaaggaaagaaagaaaggaggggaaaagctaaaagaataaacatatgaaggtataatgttatacatataatttacgatctgtaaccagtggcggatctagaaaaaaaattaagcctggacaaacctcataaagtaacaagtaaacacaaatactatagtattttataatgaatagaagcaaaattgggttgctggctaataactaaatatgataattagtgctaatctaatggcgcatgtgcagctagactaatggctaagcattttatttagctataatgtatggatgcatgtggcagggcctgttcactttgatgaaaaaaaaaaccttaccaaaatttggcaatgccaaaatttgccaaattttggcatagttgctaaaattttggtagaatttcttatataattaccaaaaattgacagcaaactaaatatagccacttttttttgacaattttactaaaatttggtaaggttgaaaatggcatcaaagtgaacaagcccgtagagcctgggcgcctgcccatgctggccgggcctcggctccaccactgtttgcatctattgtaaaaactattttacaaataaaccctcatcataactaaagattcatgggtcaagattgagctatttcgacttttcgagtatatacaaaatgtatgttcatttgattaattttgtttctaacaattatttttaatatatttgagaaaaattactataaagacatgcacagttatggtcaccgaatataagttaaatgattttcacacgaatttaaacgaaatcaaactcattccttaaaaacctacaaatatttgtgcatagcctataaaaagcatgtgccaataaaaagtaaggggtcatgcaaccacgaagaactgtaggacaataacttataaaatttgtaacaaatattaagttatttagtgtattatcataatattagtcagcctaacctatgtctaaactcagcctaacctatgtctaaactatgttttttatgagcaacgataaacctataaaaaaattaccactcccacgtaccacataataaaatgtctagagtcgtgcgaatgggcaatataggctagttcaaagtgaaacaagactgaaaacttggaaggactttgtatctatcctccatcacctgtacataaaacatgaatttcgtttttttagaaagaccaaaattctaattccatgatggcttcatttactgcgtattattctctgtataaagtggttcttttttctttaacaatttcacgatttactgcaaagtattctctgtataaagtagttcttttgtccgtaacgaacaaaattctttttttcccttaacaatttcaaaaaaaatattggcataaaggagtttatttttacttaacgattgtacgacaaaattattttattcttaacaatctcacaaaaaaaaaatattgccataaaggtggtacactgtaactgtgaaaacaaaaatttaaaaaaatgaaacataaccattgtcataaaggaggtaaaacaaaaattaaaaaaatgaaacataaccattgtcaaaaaggaggtacactggaactcccaacaaaaacaaacaaaaattcacgacgcctgagagattcgaactctcgcggggaaaccccatgtacttagcaggcacacgccttaaccactcggccaaagcgtcgtctgtgctaaaggtacaaagcgcttttatatgtcataaagcaattgcttttcacaaagcgagactctgaagacatgaagatatctgaatctgatcggatatccatctctcctgctatctgcactagaagaaatgagacgctagcaaaggacttgggatttgagaagcaagcatgacactgacgttataagccactgagcacttgcttggcttgcaagagctaacttgccttggaatactgcgtccagattaacctcctggccgccacgtgaactcacgctgtcctgccgttgggtttttgttcattctaaagctccagcagtccagcctccagcgcacaagaaaaaagctcaaaaaatggatcacctcatttcctttgccaattccagcttccttctgagaaaggtctaacgattagacgcaagagaacacttgcccgcacggaaaacggagcagcgattagcaggtgattaattaagtatttgcttttttttaaaaaaatagattaatttaatttttttaagcaactttcatatagaaattttttgcagaaacacgtacgcgtggaaaacgagagagatgagttgagaagatggtctggctctgctctatcaatgcatggcgaatagcatatcacctgacgttaacttcctgaaccaagcaaagtagtacaatagtacatgtcttcacacaatcaaacacattgacacatgtagtccctctgtggactagctttagtttagagcactcgcaataataaagtaagatgctctctataaaacatgtacatctcagcaatagactagattaatagtaaaccacctcaatagtatatctacatcggtatctatagctctctaatgcattgcctcgtttttctctatagactatctccaagttagcagatagctttgctctctctctttatttaatatcttccaagtagaaaaatatgctgacatggatctcttgtagagagcctatagataaccattacgggtgcccttagaaaaaccgaaatcttgaaccgccccactccatgtagtaaggggttgtttggtttacaactaaatttgctacatctaatcttaaggcaagccacactttttgatagacagcgtttggtttctgccacaattttactttacctaactcctagctacttggcatacatgtcatatactctatggtactcttttttttttttgcctaactttgcctaagcttagtttgtcattttgtttgccataaaagtttggcaagattaaacttagccaccttagcaaaaaaaaaatatgtgacaaatttagttgccagccaaacaagccctaaggctctattctttccttattaggggcaattgtaaatttaccatagctttaaatcgttattgcaagattgtcattagaaaattgcaaaaacaccactagaattgtcatttgagtggcatccttgtaaaattgaaaaaacttgtggaaaatttgcaaatgcccctttttattgagatgagaattttatctcgatttttattagcacatattttaaacagctaaacggtatattttgtgttaaaatttcttatatataattgttttaaaataatagataaattctttttttcaactttgaaacgattaaaacctaattaatcatcctctaatggttttttcattttacacgctcgtacttaatcttcattttcattaaactcaaacgaattattctaactaatcttaaaaattaaatatcctagttataagctgtcccctccatagttagtactataagttatgagttatatgagttatgagttataggattgagattctctacagtcgaatgcacggtgcttttgtcactgacatatggactcagggattattgggtccacatgagttataggattgagattctctacagtcgaatgcacggtgcttttgtcactgacatatggactcagggattattgggtccacatgttaacaaagtcacgtgattttaactgcagaggatcctgaattcctgatcctgagttttgagcagttgagcactcatgttcagacagagaatttaaccgaattcagacagagaatgaatgatgattgatgggtcatggcacaaggacgctaaaccgaagttcaggtgtgggaacgaaacgtgcaggcttgttgcacctcatttcccttccttcacaaacctcagcacaaaaccgatcgaagccaaaggcaccgcgtatatctgctggactctggaatccagcacacttcaccggttgcgtgcaagcctcactccaatccaaatatccaatgacaccaacaccatcaatcctcaaatgctcattctctatataaaaaccaaacccaagaactcctccaaatcgactagctagcagtgcctctctagtctctatacaagaagaataagaaaatctcattctctcttggattgcaagctacagtgtctgctcggtgcagtcacagagctagtagcaatggtcgacatggcggaggcggcggcgtccatgtcgccggagctcgccgcggcgctggcgaaggtggccgtgttcgcggtcgtgcaggcgctggtgtacctcatcctgcgcaagtcgtcgggcgtcttctccccggacaggacggcggcggcggggtcgaggtccctcagcttccggccgatgcggagcatgagcgtccgccgcttcctggcggcgctctccgacgtccccgtcggcgtcacggaggacggtggctcgccggcgccggcgccggcgccgccgcatcgcgggcctgcagaccttgccgagtagttcattgttcagtggtttcagctaattaatgacagtagtatactcgtaatgcatttgttcatggctattgtgaagaaggaatcatttaacattagatatacttagtaagttagtatgtgctgtttgtgaattattatgatatagtttggctttgtacacattaataaatcttttattttactgtccatccaacagttacacgtatggtatactcgtgttttacagatcaatcaattaaactggatcattcagagactgattaaaatacgtagtagtactacctgactatatcaactgagcatattcagtacaaagttttcaagtctacatgtataaagcatctgaacccgaatacccccgtatgcaaatctggaaacagaaaatcacacaatagtgaagcattttgttcaatttggacgctactatccactaatattgtcttcttttatgcgccatcgtaaaaagataaatcgcatgtaaatagtaatgtaaaatgtttgaatgtacactgtttggaccatgaatttgtcttctttttctccacatgcaaatcaaattttgagttgattttttatggtactatatatgttacagtattctcggaatcttttcatattttattgtgattttttatgcacttttaaaacaggtagcacggtagctcatgagattatctcgtatgtgtgaggcccaaactaagtaaactttaattttctctactttccttgctatagttgttgggaataagttcactttggatccctcacgttgagagcgagtttgaaaaacagttgaaccgtaatactaaatataataagtccctaatattataaaactgaattaaatgaggtccgacattatagcacccagttttgtctgacatgacgctttgactatagtcagcgactcaggcactcagcgttgacgacttagcctaacttggtgtggggctatgctgagtctttacttctctccttccctcttccctctccctcccttgtttgtacatctccctgtgatggagcaagggcggttgcccaaagtagtgtagcggtgaggagagtggtgttgaggtgggggagagcgaaaccgctgatgccgttcacgaggaggcggaacatatgttgtggttgtgaagaaagtgcatgaggatggcgcaagtgagctcactggaggcgacgtcgaagtcgtgggaagctgatgtgggtgcggtggtagatgtagaggtcatgcggagcaatatcccaagggcagcacgactcgctagg

SEQ ID NO: 62578 - DNA, 4177 bp, Oryza sativa
attggcctcctggtggcagcgaacacccttctccttgccagctcctctcctgtcgatcgcgatccttctcctgccttctagccaacttctctcccatcggccatagcccttcccccgccacttgccgcacaccacccttcttctcgccagttcctctcccatcggccgtggtccttctccctgccgcccacagtgcatcacccttcttctcgctggttgatctccccaccgcttgctgtgcgccatcccttctgcctaccaattcctctcccgtcggccgccgcctcatccttctccccatcggccattgccctggagaggataggggagggagagagagagagagagaaatgaggaagaaaatgctgaccactaacatgtagggtccgcgtgggtcttgctgttgactcagccatgttgaccatagtcaactcgtcacgttagttataactaggcacaatactgtcctagaaggctagaacctcggataatccagttttgtatgttgagagacacgacgtgatccaaactcgacgtcaatattgggaccacctatacatttggcgacaaattttctcctaaaaatttgacagatgtaattgtaatacaatcgtagtgtaattacactgtaacttatatgtaattacactgtaacttgcatgtaactacagtgtaacttgtacgtaagtttcatgtaattttgaatcattatatctattacaagatttgttttgctgaggaagaaaaaaaatcacggcacacacatatgtataaggatttgttcccacaacctccattttaccgaaataacatattacagagagatttttgaaagttacatacaagttacactatagttacagtgtaattacatgcaagttacagtgtaattacactacgattgtactgtaattacatctgtcaaatttttgggagaaaatttgtcgacaaatatatagcaaaatcgtcaatattagggaacataagtgaacttattcctggtaggtagctcctaatgggccgtgaagcccctattcaagcccgatctggcttaacggatacacacacacaccccttacgtaaacctgcaacagcaaaggattggaaccggaaaagaaagatgccatttgcgtacatgtatacgcataacgaacacatgccacacacacacacactggcacactccatacccctcccgtaacgatcgaaaagcagttggagatggcgagagtaattgcgcaattgcgcaatgcgtatatatggtcccccggcgccggcatcacccgaacgtgccgtccatccatatataccaccaccgctgccaaaaggtcaacaccccactaaagtaaacaccactgccaccaggacgcgagagtgacacggacacttccacagacacggccgtctcccggtctcgtctctcgcccacgtttctcgtccatcccgacaacgagagccgatcgatcgatcgcgcgcgcgcagcggaaaccggcagtatcgctcgaacgacgtacggctcgcacaccgcgccctgcaccgacgcgccgcgagacgcgagaagccaaacccggtggagtccagcgcgcgggcggcaccggtggcgagcgggcaaatgcgctgcagatgccgcgttcgggcttggggtcccccgtgccgtgtgcctcaccatttttttcggtgatctgagcccgagggaggggtggggtccgtacgtccgggtactagctcgcctattggcctcaaaagctgtaagttggcgagctctgtttactcacctgtggccccctcggctgatggcacatagtgggcacgctacggcgactgcgaaaattcggtgatctctcggtaggctcctcgcaactggcatctggaattaactccaagtactacttattactacctctgtccaatagttgtatttttaggatttgaatttgtttcaaaataattatcacaataacatactaatggtttcattaatcacttctcattcaaatttctttctattttactgtcatttacccttccactcttacatacatatcatttaataagggtatcataatcttttttcttaaatcttaatatatgctaaacaacctgagtaatagtacttatttagtggacaagtatttattcagattaatagttagaaatagcttttttgcgaaacgagaggcaatcaatcattagtttggaaaaaataattaatccctccgttttaggttataagatgtttttgactttggttaaagtcaaactactttaaatttgattaagtttattgaaaaatataataatatatacattaccaaattaggtttattaaattaataattaaatatatttttatagtaaatttatcttgggtcaaaaataatactattttttctataaacttaaatttgtgtctgcattgtgcgttccaagtaactagcttgtcttttgtctcgcaagattcttccatcttttgctcatcgtcggtgggagatcgatcgaccgatcgatcaccagcatttctcgctttaaagccatggatatggatcgatcacagatcaggccatggtgcagtgcagcacagctccatgatcgatcacatgagcccattatatagagctcccacacatatgcctccttttatgcctacgctcatgtcgtcgcatggcattaagcaattagttggggagctttgctcgttttgctttaaccttttttacaatgctagtagtaccatacttgcaaagccaccattaaagcgccacgcccttgccttgcttcaaacgtactccatggatctgcatctttagtgtagtagtgataatagtacaaaaaactcttttcccttgggatgctaaattcatcatgattatgtccttttctttcgtcggatgaatcatgcttaaccttgtgaaatttataggatcgaatcacaagaactaagccaaccagagaggggggtgaatggttggtatacccaaaaaccgaaaacttttagcagaaataaaagttacccttaatttcgatgaagatcggtcttatcggagtagattagccggtctgaccgaagcgtagccaccggtctgaccggtgttgatcttccggttggactgccctggaatccttgccgcgcctgatgtcgccgccggtctgaccgcctcgctcccgccggtctgaccgccgatgagttaccggttagactgccgaaacccggtaaacacaaatcgaagaactcttaaagtagatgacaactttattgattctctctatgtttacaaagtgcaccaacagcactccttacaaaaatttctactaaactcgaaaccctaactcaaaactcaactcaattgctctcaaaagcgataccgggaagcctcacgctccccctctatttatacatgaggtaggcagcctaaagccacgaaccaaactcatattaagagtcctaaacaccttaggaaaccctcgaatacaagaaagaaactttacatagccaatcgtaccaaatttggactccttccaaattcgactccgtatcccatacgcacacaatacctccatcgtatgccatatggaatctccatcaaccacgtgcatcaactctagcctaagtatcccgcatgatctctgaccaccacggacgtcgtcttatccccaagccgactcccggtccatcaccgcaaatactctcccgaggcatcgagtcacctacacatgaaataaacaaaaaaaccatattccgagaccaagctatctccaacttgactgattagtaacaaacaacagtattacacacgtatagcatccatctagaagccataatcatgaaataatcacggatatccaaacaaacaacccaaaaccgaaaccgacacagcgtcggccggtcagaccgcgggctggccggtccgaccgctcgatcaccgccggtctgaccggcacacactgcccggtctgatcggtcacataaaataacgaacctgcgattcacctgtaaatccaatcatctccaaaaccacttcgtgaacaaaaccaataatctctaatacccaattattcatcacagaataataataaaaaacacctttgattttataatctcccccttgatgaacacattggcaaaccaataaaaaatgttttggtgtttggaaaaataaaaacaaaagtgataaaaagc

SEQ ID NO: 62579 - DNA, 13551 bp, Oryza sativa
agtattaggtatttaggttgaggaaaacccaaattaatctaagcaataaatcaaatcgaagatttagggcctatttggcacagctccacctccacctccacccctcctggagttggagctcagccaaacagtttcagctccaccaaaactgggagtggagttgggtggagttatctcacaaaatgtactagagttgtagagctgggtttaggcagctccacaactccactctagcctcaactcctagagcaatatttaggagttggagctgtaccaaacagacccttactcctacataatttcaagttctattatcgatgtgtgacaggaaatgtgcgaaaagtgtatttatttctcccaagtatatttgtctgttttccagcaaataacctttcaaaatatttatccattgaggagactaagacgtaccacctctgtagaattttatagggtgtattttaattgataaaactcttaaggtcacactttgacagtatattcctgatatctataaaactaacattttgtgaaagtatttgaaatataatatacttgtactactacttccatcacaaaatgagttcatttttcacccactttatcaaatcccatgtaattgtttttcactttatctactttcaatgcatttgtcccctacttttacaaattccaatgcaatgattgcttaaaaatgaacttattttgggacaaacgggagggggcaaaaaatatcttattttgggatagaggaagtataattttatacagtaaatatacttataatttgaataatcattagtcaaagttcacaaagtgacttctttttcaaatcaaaacacgtggagtgtgtagttattttagacttttttattttttgccctaactagttattttagacttttttattttttgccctaactagattctttgaaagacataattaggttatattatggcggtgtcgtcatgtttccttgttaactttttcttaattttttttttacttcatagatataggcacatggtgggatataaacatataaggtgaaacagatgaagtagtttattaatgaaaatgttttgagagctgcttatttgtgcatgatttatgtgatggatgagcattgctctctccatttaaaaatatagggcatataagctttgacacggtcttcaacatagaactttgactattagttcttttgcaaatattaccaacgactatgaaatgaatatcatacaaaggtattttcaaatatgaatttaatgatatcacatacgtaacacacaaatacacagcataaagacactcctcagatgcgcagtctattgtatcacataggaattttgaatttttcaattagtgtagctggagcctggaggatatcatattcccatggccctaacttactctgttcactgatgctttcgtgaacatgaaaaacaggtatgaatcaccttactggaagaaccttgcagcaaatcgcatccaagtcgcatggaggtatcggaaaaggcgactgaagagagctgagatgcaaaggttgcaatagaaatcaagtcggcaattttcggttgtacaatcacgatctacggggtatgcatagtcggacgtcatatagcgccatgtgcacaatcggcgtatgcatagtttgatacttggatgtgcatagcggactttagccattccactatttcttgtgtgggggaagtaggctgttagttttggtcttgtcggttttgtgcaggttcactaatttgtgtttcctcccgtataaaatgagatgtagaagacagccgatgtacataaaaaggaaaagaagttccctaaaaactgtagatgaaaaagaaaagtcaattgactaggaaagaggcttttcagatagttctctgttatgaaattgttactggtggtttaatcctttcctccccgaattttgtaaaacgtattgaagattgcaagtttgcaattggaaaggacgacccaactctaaacaatactttgctatgctatctatctacggtgcaagcgggcaggcccgcaatggttcgtgagtctacccacttgcacccttgtatctatctatctttttaagttggcaattttgccggcttatccttggaccacgtggcacccttaaaatttaagatagatctaggaattactgatggtaagaaaaaagagagacatttacaatgcaccagaaaaagtgaaaaagttaagaagggaggaatgaagaactttctcaaatgtgaactaaaatagtgatatctataaccttctaaaaactgatgaaaagaatcatagatcaggattcagggaaataatcgcagaaatctctacatctagactctccaaaagtaaaggggtagacaaatccgagctctaacaaaaggaaaaaaaaaaggcaagaacattgaggcgatgatcttttcccggcgcttctgcacagagaacgagatcctaatcctcggataaagctccacaaacgttggtgcatagcggacgtggtgcgtctatccccgccacacaccgcagcatagcgaaatggacgtggttgctatcgccctgagcaaagcggctgaagtaccactgacaagtaggtcccataatattttttactgttttatatgactaatatgtgggcctcatatattattttatttttttttagaactgctactgacatgtgggtcccattaagtttgtaatgccacgtaaatgccatgtagatgtaactgttatgtaggacaaatagacgctatgccagtaaaaacagccatcaatgattcaatactattccctattagattagagctatatttgagggacccacattagacattttcgaaaaatcatgtgaacgagggaactaataggctattcccaatcagattcgagctatttgacggactcacattagacatttctcaaagatcatgtggacggggaaactaataggtgatgatctggcccaaacagcccaattctcccctagcctacaacacacagcccatcgctcgccccaccgcagcacggcctactccacccaagaaagaggtagcctagcctgcccgcccatcacctcgcggagaggtagtagtacactagtagtctagtactacacgggccgccacgtttgggtgcggtgtcgtgatacacgctacacggccgcgttggagattccgcgacggcggaatgcccccactaccccgccgtcaccggtggtgtggtgcagttttgtcttttgcgtcactgcgcacccacctcggttttctcgcaccgtctacgtagcgtgcgttcggtgcagccatacacggaatatattttttttggggggagggggggcacaaaattactctggatttgttaaccatctcaccggattttacgaccagaagggagaaggcccccctccaaagatccgtactgttttttttcttttaccccatctgaattgcaccaaccacggcaacaattatttatgcaggcttgggtgggtggtggtggatacccattctcttttctctctcaggtgcaatcgtacgtgcaagtgacaatctttttctgcatggccgatggctcctgccactatttactcggaaaatcacggtgaaaatccaggtcctgctgctcgtgctaccaccgaccgacagttgaaaaggccaccgcaaaaatgcggcaagaattcacatcgccggcggccaaaatgtgcacccccaaataggaaggaattcgttgcgtcgcattaatggtgcgcgatatgattcgggcatggctcgtcggccttggaaggcggagcctccacgacggcggggttcctaaccgtcgccgacggcaggtgctcggtgcggccgagctggctggagccaccgcgtcccccgccgccgcaggtgacgctccgcatccttcccttgccgaggtggtgctcgcagagcgcgtagccgacgagcgtcggctggctgcaccgccaccctcgcccgttcacgcggctgcaccgtgacccctccatcagcaccgccggcgcgccaccacctcgccgcttcttggctccaccgccgccgccgccattgccgacgctcttctcctcctccttcacatccacgatcaccgccggtgcaaccgccgccgccggctccgacttgctgcccacctcgccgccggtgcatggcaatggcacgctgccattaagaacacaaaacgcatcatttgcacacacaaacaaacaaacaaaacatgaccaaaactgatcaaaaatgtgatcaaaatacaagtggcaatctagtgcattgcccctggaacttgttgtgccgaactcgctaggtgccaagcaagattacgcgagggtacaaccaaaccaaacaggctgtggcctgtgatgcgagcctgattgatcagcagagctagagccaaacaaaatccatccacccccaacaagaagtggcctaaatataattgaattattatgggtggatcgatgcgtccatcaatccatcatgcatgggtggtggacatgcctacagcccgttctgtctgacaggaagtgtactactaaatgtctaaaaccaatttataattgcacatttgcatcgtcacccactatgaaacagtagtagtagtagaaccaaagaaactaagaaaaacaacactaataaatgggagtagtaacctgattgaatgtgcatctactatcattctattgtagtgttgttcagtcaactcaaatttcaaacagactttgttctgtctgcattttttgcagttcttcagcactcttacctcctgtgagcatctccagctcctccatgttcttcaccaggtcccttgctgtcgctgcaatccactccattttcctgggatatcaatcgatcgagttgaggccaaaacacacaagttctttcgattcagctagatctaagccatctgatccaagagtgcaagaaccaaacaaaatctgcaagcagcacgcgtacctgctgcaacaatgccaggcgccgccttgccaccccggacgatttcttgccaagatccacattcccatggtggtgcagctggtgcagcctcctcccaacaccatcgccaccaccaccctcccggcttcttgctgccgcattctgggttgcagcggtggatgtggatggatctgagctctgcaacgaaacacactgtggcctcctcctaatcctcatcgatgagtgagaaagaaacaaagaaacaaagaaagagagaaagaaagagaatgagagagatggcaatggaggaggagaaggtcggagatttggggatggtgcaaattaaaggaggagagcttttggttttattatcttttggtgatttggttgatggtgcctttggtttttatggctcatcatgcttttgcctgcacttatttatggaggagagaaaccagtaaatagaatactagcagatggtgcagttttcagcactgccttgctgctgtctgtctggctttggctcggcttgcacatgcctcccgccgggacatcgccgcggccgtccgatcgagggaacggacggctcggatcgaccggatgcgtacgtcccccgtgatgggtggcaccggttttgtatccgcatgcgcaacgccatgtgcgctgggctagctagggagatgcattatattgccgtcgttcgcagaatttgcaatctggcacagtgtacatgttggttggtcaattagcaggatatgtgtccagtgaagatgacacgcaatcaaaatgttaggagatgaaaatgttcatgttcatgctcattatttttgcgtgtaattttttcaagctgttaaacggtatgtttttttaaaaattctatataaaagttactttaaaaaatcaattaatattttttaaaaaatagctaatacttaactaattatacgctaatcctcgctacccgaactcagcctaagacctcattcggaagtgtgcatattatgtgtgaggattttaaaggaatttcgtatgaccgtgttaaaattatggtaagcctacacgtgaaatcacgggttttgaaatgcaaatggttgttgtcgtaggaattattgggggctgttcgattcagctaggctgaggttgaatgatgcagtagactagcagaaattttgcttgctaggtctttgttgccccgtggctgcagcgtcagccgcagctagcgattctgaacacagcaattatatgtcaataggattgtaggattttgattatggttcaactgaataattggctataatctcttgagctaaaggctactaggatttatttccattacccaatgaaatgttagggagatggctacggtcatctttgaaatgtaggaattgtattttttttatggggttttcacataaactagttcagtttcagtagcattaacgtgaaatctaagacaaagctacaccaagttgatcatagaatagttcacctgatcctgccacttagaaacgcaagtggcttatgctaatgactaatatttttatgggttaacacacgatgggtatcttctttttttttttgcggggcacgatgggtatcttcttgttttttgtttgatactaaatggatcgtgcatggaacgaacgaacagtcagatcaagtgggggcagtgagaggggggcggtgattagtcagatttagaagtgggaggctgggaacaaaggctgtgtgttcagcgcaaagtttaaattttagttaaaattggacatgatgtgactgaaaaattgtgtgtgtataacaggttgatgtgatgaaaaatgactgaagtttggatccaaactttagatctaaacacagccaaacagggacgtaaagcaagcaaaatttgggtttgtgtcaggtcatggtcagggacatggtgtgtctatgcatccagcttttggccagcatggggggctcaaagaagccaatctcctgcagactctgggctatcggctgtccattgcacaggtgatggcctgatgtttccacacttgggtagtcatatcccttagctaatgcatgcttaattagcctggccgttttaatcaggttcatttcggtttagattttattcagttaatccctattaaaaaaagattgaggacgatttattttataccgtggaattattctccattaattcctttcaatcaccttgaagccgaataaggccttaggagattttttgttttaaataaaacgcagtatccaacaagttacacgtgagatctttattttaagatgtggcgtctactggaagacatgcattgacaggttaggttgttcctaattgtagcaaaacttgcatgtctttaatcattaaaagaaacagaatttggtatcaaaattcacaccataatggtgtggaaggaccttgatgtatgttttttttttttgaatgaaaagaccttgatgaatgaaaggaccttagacatatgagaaaaatatggtagtattatttttcacctaaccacaagaactgtgagctggtctattttttctgtcgtttcatacaacctctcgaatattaatcactctcccaaaacataactatttctagctgtttaacaggaaaacaaaagtagctatattatggaacacagagagtagatagttataaaataatcttttttttgtgtgtgggggattaaaaaagatacaacagtcatttataataaaaaaaatctcaattccaaatctgatctatgattggagaatatagatcaaatttaagcttacatattcatggaatgatatattatatacttctttcgtttcacaatgtaagtcattctagcatttcccatattcatattgatattaatgaatctatagatatatatgtctagattcattaacattaatataaatgtgggaaatactagaatgacttacattatgaaacggagggagtaatatgttagtttataaaaaaatgtgagtattgtaatggcatgcaaagatgaatgaacattcttaagggaggacgggttcaagttctaaacttgacacaagtactcgcatttactttacagctaattatttttttttagtgataggcgacgtaccagtcgatagcaaagcgcccgtggtgacttcgtcaatctcaaaatatactaatacaacctttcgaaaatgcttataggagtagggtgtgcttgtgtgtgttcgtagcgttgagtatgcgtgagttatgagcacctacatttgtactttgtttctaaaaaaatgattttcctggtttccccacgccacacaggctaggacatcaaatctttttggtccatgcgtcataggcacaactattcattgaccaagttttagaaattgagtgaaatgcaccgttaataccttgacttgcgaggtgggtgcaatttagtcgcacattttgtaaaatgctctaacaagtcacacatcttattttggggtgcaaattacataaaacatgtgtcgtatggagtgttcgcaatgaagatatatgctatgttaatttgttttgcaaacatggtcacacgatccataataatacaacgtgcaatactaccggtactagctaaaatccaattaaagatgaattttgttatggattgccaagtacaatatagtcgtgttcattgaaagcatgggaagtagcatatacatgaaaatataaatgttaatatgtaattttaatgcttatcctgcccacattggtaagaaatgcattatgttatgtcaatatgcactccaatttgaaaacaaacaatccgtgtgaaaatgtatttagtaacatttacaccatcgaagcaagttgagtgacttgtttaagcattttgcaagatgagtgactaaatgcacccacctcgcaagttgtgataccaccggtgcattttactcttagaaattcctttagagatgagtaaattacaaccctaacgaaattggctattcattgataagcattagagtaatgatggatttgtgggtgaatgaccgtacccccacggattttaaatcttggtgctgacaattacttacacgcagtggtggcttcatggggtgttccatgtaggccttagaccaccctacaatttagcatatttttatattcttattatattttgaggaaatgttgctatttctgtatcatattttgagcaacttttgctatatcagtatcatgttttgaacaaattatatatgtgatattgagttcgtgatgttatgatatgtagtaccgtgagcctgcgagtgttcatgtaatgaaaaagaaagtgtcactgttaaagaataaaaaggaaatggaaattaccaacaggactgagaacaaggctttgatgggcactaccaaaaggcactctcgtggactctccggcccaacaatttggtgctccccgtagcttcctgattgaatcgcagctactacttagcaagtcaacctcgatcaacctaccacgttaacagaaactgtttctcaaattactgaaggagtcagtttgtatcgattttcgaagatgggggagggattatactactcattttacgatgattttatggtgagggatgcacgatagacttattcctcctcacaccaaaaggcgctctcgtcatctcgtggactcttcggcccagcaattttgcgctcccgtagcttccgctaaacctgtcgactatactatttgctgttgcacaagctgacaggttggctcaggatatgtctgagttgatgaagcgtcgctgcctctttgggcgcaccgcgcaacagaaccaacagcatagccaccatcctcatctactccaatccgcgatatggcactcaatatatagcgtagagaaatgcagaactacacctgagctatacctgctgctgctgctgcatacacaaatacaacttagcagttccagaatgcaacgaggggaaatgagaaagtcacctgcatatttgctataaaaaaactggttgatgcaaacagggcagtaagactaacaaacagttgtaagaacatcttttacaatcttcaatcctcaaaagctgcaaagctggaccaaatcctttggatcccacatggacagcttaactatagagaaatgtcggcaaactcaagaggtcgctaagggcctaattgtctccagcaccaacagattggttgacagttgacacaccattgcaggcttatgagatactcaaagattcattttcacttggacaaaagtactggcatatgaggtcatcctatgtttcagatttgacaaaaataaaattccatcataagatgtcaatgctagggcatcaccatgtttttacaatccaataagcagtttcacctcatttccacatttaacattcgaaaatcgaaatacatcgaatggatattgtccaactcatgctatttaccacacaaatgaaaaaccatccacaaagtagtcaagtggcagtgtggtacctcgcatgttagggctgttcgttgtcacgcagcatgaggttcatgataaagtcacagatgagattatattgtatatccttaaatacaaaataaatgccaggaactgccaaaaaaggaataatttttatatcatagcatctatactattgtctattactcattagaactacacatgaactttacaatatgaagtcctagaagcctctaacacaagaatttgtgtgcgtattgagagatctcatcaactggcaactttactctctatagggatttcaaaatccctaggtctctatcgaccttacttttggtaatcgtgttgattattatcatggcgaacagttcatatacaactacaagcaccctcatccagaaaaccccatacttgcctttattgttggagcatttgatgctgtttgatcaaaagttgggcataaagcagctcgttccaggaatccggtactccaggaaggcaccagtggctgcagtcctggtatctctctggtgatcttctctcgtcctcagtcaggttccgtttgcgatagattgaaggatgtgcatcctttctatagtcagtcatccttgttatattcaagtaaacaactggagttttcatcttgtggatcacatcctctaaaatgctcatctttggtgggtaggttgacaggtactgttcatttcttattggttctgtctctttgtcacagctaccacctgaattccattgcccaccactgcatatttgagagcacaacaaaattcagtcaagacccgagattcgtcaaattttcgcaaaacaaaaaggcgatatatacctgaaatgggatgctgaatagcctctgaacaacacagtggttttcttgggatttacattcgcatcaatccacctggaccaggtgacaagagctttgtgaaaggcatccacaacattgagctcactatacacgtgattaccttcctgatagtaatccttcctgtgtcacatagaacatatctttaatgttcaacaagaagaatgaaatagagatgattgtccagcccaaatagcagtgaagataccaagataagttaccctagagaagtcttctcatgtgtccaccagtgtccagtattgaaaattagaaaatctgcatccttatactttggtgatgattgctcgactatatcaagcctaagagtttcttttttctttccattgctcactttcatctcccattcttggactaggaaaggggagcgaaaaaactccacactgcagttatagtcctaaatgacaagaatttgcattaaacaacacttccaatttctgaaatggatgcagtgtatagtaaaacagaatcaatccaagctaggaaatacataccgtgaacaggaaagagtatgagccctcagtcttaaactcatgcctaccagatgcctcaaaaaccttcctcttatccttaacggagttccttaagatgcagaccagggattcccacatgttcctattaagtgaatcaccaacgaaaaccagtcttttccccctcagcctctccaacatatcagttggattcaatctaatataacaagaatataattaggcatgttatgcactaagatggaataaaaattcaccaaaattgattgcctgctctagtaacttttcctcacctcgggatgttgcagctactaggttgccaccggagcttctggtaggctcgatctggccggccattgagataacagtcgaagggctcatcaatgtgagggcatgatccctcagggtagagagggtacgactcatcccgaacccaattcccatggaacatatcacagctggccatctccttgatccagtcaacctttttatcaggctgtttttgtgatgcctgttttgttgatgatccattccccttcaccagcacttcgctgtagttgctagtttttgagttgattgcttgggcaggatgatccttagatgaaccaacactaccctgcgaagttgtttcctcctgcttacttgttgtaccactacttccaccagaagcaactccagcactagtctggttctgattcttcgaatttgtcgatgctacagatgtctgattcttgcttggggatccacccgctttctttgcgaccattgcagtactagcagtctgattactagttgaagccacattcccactcgctttatttgtatcagctccgccatctttagcatttcccttcgccggactaacagtcacatctgatgtatggttggaatgtccacttccactcgctggcggagtatctgatctgttactcaaatcggccttcacatctgagacacttccggcagaatcagtactcgtagcaacgactacgtcttttgcatctgtctttaccgcagtgctattcacagcagcagaagaaacactacttgcaacaccatttccacttcctgcactgctattagatccaacattagattcaccctttgctgaacttccagttccagtagaattatcactggatgctttaacagcaacttcggtatcggccttcgccgtgctgttcttcttgtcagaaacggcatcgccattgctgggagcttcacctccacttcctgactgcttattggacttatctacactctcctcgccggtgttcgcggaggatgattttccggcagaactactggctgtggatggggatccacccccatctccggccgggctactctgctccaccgcgctgttcgccggggcgccgccacttgtggaattattcgccggagcgccgccgccgtcgccgccgcttccctttgcaggtggagtgccacttcctgccaaattgccgggcggaggcgcactcccaccaccgccattgttgcttgccgcaccacctccacctccacttcccgaatgcttggtagacgcagctggatcgacagggacgctgtgcgctgcgccgctccgcacccgcgcgtgctcatcgatcccatggctactcacctggccgcctccctcgccgcggcgcggcggcggcggctgctgctccggcgagggggtggaggagccggtggggaagatggacgagaagaaccccgagacctgcgcgcggtacggcgccgtggacgcgtacaccccgccgaaccacgacgcgccctccc

SEQ ID NO: 62580 - DNA, 6113 bp, Oryza sativa
gtgtgggtttagaaatttaagagagggggggaatttaactaatcagccgctaaatttgtttagattttgcatgggggttcagccagtaacttgcagttgcatctgaatctttttattcaacgagtcaaggatgttcaaaggagtatttaacactttgataaggaataaaataggagaccacagcaccaaaaatattttttcttgtttgactacttttttgctgttagttgatgggaattttattgtctggtttgaccttaaacataggcattttctgacttagatatttttgaacaataagataatcatgccaaatgtcaatcatatactccctctgtatcatattataagtcgtttaactttttttcttaatcaagcttcttagaatttgatcatatttgtagcaaaatatagtaacattttcaatacaaaataaactttatatcaaaaatatatttgatgttaaatttaatgacactaatttagtgtcgtaggtattgctatttttttctataaatttggtcaaacctatagaactttgactaagaaaaatgtcaaatgacttataatataaaatggatggagtagcttttttttaatagaagttataattctacctgcctataaactgcaaggttaaaagtatactttcttaagaaggtataattcaacacatataacctacgtgtacacgtctgagttgtgcacgatatgtacacgcgaagtttgcatgcacaaaatacgttctccaaattacatcaccttcctcgattccaaaatataatatattcatagttttagaaaaaatctaacatccaaaactttgaactagcaataattaatcaaacaatagattacaaaagaaaaataataattataatcaagttataatgttattgaccgtgaaaaaggagctaataatacatcattacattggggatggaaggggtaacaaatagggacctatggtttggtccttggaaaaaaaaatgtaatgcaaaccatttgcgtagtggaaacctaaaaactattactggattcacgaatagacatctgaaatttgtcacgttatttactcccagaaaattgttcactcctagttaaatctaactgaaagtaaaacttttactcttaataagataaacaatgtttagatccaacgaaatgaatttcatatttctgctagatattgttcatctacccagtgactttgctcataattatagccagggtttacaaaaccgcacggttatcgtgcggtaaccttttaaaattttgaaaccacggtctggcgataaccgccgaatcatgaggtgacggtaacccccaccctaaacgattcggtaaagtctaggcatagcccagccccggatgctgcggcaaaccagtggcggatccaggatttgagcaaagggtattcaaagctgaaaaaaaaatcatacagaactcaaaaaattggactgggaaaatcatacaggagtggtaatgacatgtttaaagccttaaaggtacaaacagtagcacaatagtcaagatgtctatctccaactgcacacttggggacatatcactatcataggcattgggtgcttcaagtagtagctgaataggactagaaggggcattttctgggatctgaacttcactctcaatggttaatggttttggatcagaggtggaagctactttctgagacttggttgacctttcccacaaagacttcaaatctattgtcttcttcttcttcatttttcaaatttcaagacctacagttcaaatttctgactaatttaacttctaagcaatagcaattaagcaatggccaatcgcttggggaatttgacaagaggatttattttaccagtgccagtccactgtccagctgtctagggaccaaggggacgcgccgacgcgggggtgcgtcgccgcaaccggctgccgccgtgcgccgcagcgccgctgccgtccgtgcgaacctcagctgctcagcgtcgcccgtccccgaggaggcggcggcgtcgtcgcaggccacgccgcctccgcagcagcaggcccagggaccagggtccagggagatgaggctggtggcgattctggcgacgcgccgagccggcggccggcgccgccgagcgtcgagctctcgatgccccgtcgcccgtcggtggggatgagtggaggcgcggcggattggggctgggacgacagaaggcgtggggactggctgaccgggggatagggactagggttttgttcgtttttgggccagtgggcctattcgttgggccaagatggggaggaatgtatggtctgctgcgaataaatgggcttcttttcatttgggctatacatgctgtacttccttctaatttctcatgtatatatgcataacatacctatatatagttatttttttttaaattccatgggtattcaggtgaatacccatgaatcacatgggatccgcccctgcggcaaacattggaaccggcccctgagaaagctggccagccgtcacgctatttttgccgggccggtccgcaccgacggcggacgtgctatccctcgtgttttgtggtgcctgtgccacagccgcatcaaattgcgggaggcgccactgaatcgctgacatgtggagccgcaaccgggggggattgtcacggggccacgggactcgagaccgcgtgccggcgtgccgcgaggcgcgagctgtaggccggccgacgataacctaactgatgaattgaatgtggctgtgtgtcatacgccaaacatatcgttagcacgtacgtcttcctcgcggtttgcagcagactatcaggagatcgaccacatttagcttcatttattttaacgatagtgcgaaattcataacgatatagaaaaaaaataattacaagattataacatgggaggacgtaactagaaaaaaaagagaaagaagttttataggtgcatcgaacatgatgaataacaaaagaagaagcacacatgccgacatgcgtgatgccatgatgtacatacatgatacgtatgcatggacatatataggagtaatcatattgctgacaagttaggttttttttcactatcttattggtatcaaatgtggtaacatcgagatttttcacgaatgattttttttcccgattatactaaagacacctaagctcacatataccacacttgtacacacacagatattttctcttacacatgctttaaagatggagactactgataaatctctaatctcaacaaaacctatagatagtgcaatcgctcatgcgtagaaaagcttaggcatcagattttaaatcatagtggatggaacatggacccacgactatggcaccatgctaccagcactgaattaattttgcaacaaacacaaacgtttgtgttaaaaaattaaagtggctacataaatcgtaccaaacctggttttatgaaaagcttaaaatatttttgtttatcactttcaactctaaagcacctggataaatttaggtgtggatttcgactactcggtgttatgcaacatgtactaccaagggaagaattgtcccaacgaaaaataaaagaaccttgcaaactatggaaacaaattaaaacaattttacaaggtacaaatccaatcaccaacctaagcaggccagaatccgtttgtatttgcactttgcaaactatgtttgctgctaattgtggtcttaggctgcgttcgtttgggtgatagggagtgagaatgcacatcgttttccgcgtgcacgcttcccaaactactaaatggtgtgttttttgcaaaaaaaaattctatatgaaagttgctttaaaaaaaatcatattaatccatttttgaaatttaaaatagttaatactcaattaatcatgagttaatggctcacctcgttttacgtatcttcccaatctcctcaatccccttttcctcaaacacacccttacacgccatgtcatgtgaaatgtacgcaattctcagcgagagagccagagaggtttgggttgttattagtttcacatcaaaattgaaagtttgaagaaatcgaaacgatgtgacagaaaaattaaaagtttgtgtgtgtagaaaagttcgatgtgatggaaaagttagaagtttgttaaaaaaaattggaatctacaccgggccgtgtacaagcgagtctgcgacattgctttgccaagtcctctgccgaagaaggctgaagtcggtgtaggctggactttgggagacctggtccacaagcgtacggagtaatttaatactctatccgtctatttttgatagtcatatttccaaatctgaaaattttatttttgataggcatatttcaatctaacaacctatcctcttaatgattttctcgaatttaatgcgtgactctccattcttccacacatgattggctacatggatattgagaaatgtaaatattaattaatcgcttgtttacgaggaatgattagtagcatgtttaaatagatgataagtagaattacttatccttggtctacgtgtcaagatgaaatatgactatcaaaagttgatggagggagtatttagaaagcgatattagtattaaggttaaattgtgttatatattacactttcccaatttataatctctcgtttttcgcgtacacacttagtaatctgctaaatgacgtgtttcttttaaacacaacataaaaattgctatagaaaatcatattaattattttcaagtttttaatacataattaaccatgtattaatccgttgctccattatacgtaaaatgttataaatctcaaaatgaacacactaccggcacacagcccaagttttctcggagacaaatttggctactcttcttctgttcataaatatttatcggttttgattaaacatatataaaatataattattattttaagcgaccattagctctgaaagtaggatatatatatatacttagtaaaaaaaatcgattttagacctaatgctataagttcgatgctgcataatttgattttttaaaaagaaaaatattggcaaaatattgcttgatgacctaaaattaaaattacaagtatctgtgaacatagataatattaaataattaaatagttacaccgaaataacacatattataaaggtagcttcctccattcgtgtttactcggtcacttttggaccattatccacccacaaatacttgtccccaatatatattttacccagtttaccctatcaattttctccttactgttttatccgtcacatatttggtgggtttgggatgttctggttagttttgaagggtatagcatggccattcatatatccaagcaaattattgcctaaatatgcatgctataggttaaaagcgacgagtaaatgtgaatggagagagtaattctgagacaaatccatacataaaaaaaagggaattagctagattgctgtctagaagcgcagagatgaaaagaacgtgcacggaataaagatagtattgcaaaggagaaaattgacgcaattaggtacgaactcactcagatttaaagtgggcgcacggttgaatccactgtataattgctatatacagaaactccactctttcaattcggtggagcaattcggcagatttctactactcgcatgcatgcttgccactacagtacgtaccaaaattaacacccttgctaatgtacggcctgataattaacatgacccatggatgtaaccaagagccaagactaaagttgtactcctactgttactcctactattcagtactccctccattttaaattaatctacatatagttttttaattattcctaaatgatctatatatttatatttatttattaagtatattcgttatttgtgtattggagtaaataaacattgatgcatgcatccatgcacacaagtatttataactcacatgcaatatcttgatttgctattggctagaaaatagtggggatagagcatgtatcgagtttgttgctagagtaaatatggtatgagagagttattagcttttttttttgtctttgtgtacctatgaaatatgtatatcaatttagaatgaaggaagtagtaattatga

SEQ ID NO: 62581 - DNA, 730 bp, Oryza sativa
agatcaaacgtttctcaaaaaattaacagcggcatacattaaaatacggagggagtatttaataacctactgtctagaacattctttgctaatcacatgcaccgcaactgcaccatccaaagctcagctcatgattcagctagcgcttaattaattataataggagtaattagattgtcttcttagacagatcccatgcaggcactcttatcacaaaaaccgctggtccgatccgttactgtttgtgtggcccggtacagtgttttggtgagtggttccttttcaaagattggatctttttcaggtgtctcaatcttaattatgtcttgaaataaagacccgatcttaattgtgtcttgactcttttttttttcttttgaggaattgtcttgactcttgagataactaattaaaggaacatgtcccttcacgttttgcaattactcaactaataatacagtttcagggagaaatcgctgatgaatcacatttcgtagttagttagtatttctgaaaattttgtaaaatcaaagatgtttttcccagtactgaggcttcgacttctgcttgtgtgtaggctttggtggcaaggaaggagaacgtgtgcatcgtggattccggttgttcgcggcacatgaccggtgataaaaattggttctcctcactcaagaaggcatctaagactgaatcgattatctttggtgatgcttctacaagtgccgttctcgct

SEQ ID NO: 62582 - DNA, 25766 bp, Oryza sativa
tatttgtgttgtaaaattttcagccaggaactccaccagctcggccatatgaagcacccacacctggatcagggtgggcaaatacgccaggagttagctataatgacgctccaactcccagggagagcaactacggtagtgaaacatattctgtttttatttaccatatactgatacatatcatgctataatgcatcaacgtttctgttctaatactgtttttctactgtctcttaggaaatgctccaagcccatatgtgccttccactcctgtaggtcaaccaatgacaccgaattctgcctcgtaccttcctggtacacctggtggtcaaccgatgactccaggcaatgttggaatggacataatgtcgcctataataggtgtggtgtcatttctactgttgcatccataaagctcctatgtattgtgctgctatctgcgtaacacagaagcaggcacgagtacatctaattacatgtcaaaatgtctgcaggtggtgaaggtgaaggtaactggctgttgccagatgttttggttaatgtgttgagggcaggcgatgatggtcctggtgtggtgagggaagttcttgcggtatgtatttgggctcttcacaatttctctgcaattcttgctgtctcctgagctgatgattgatgccactgggcaatctaaacttgcaggatggatcttgtcgcgtcgcccttgggtcatcaggtaatggtgagatcgtgacggttcttccaaccgagctcgaggttattcggccaaagaagagcgacaagatcaagataatgaacggcaatttccgtggatactctggaaagctcataggtatagatggttccgacggcattgtgaagcttgatgacacatacgaagtcaagatcttagatatggtgattttggccaaactggcgagttgagatggatgtatattttgtacgagtccatcgtatagccaaatgtttgtaacagataccctttgtagtcaataaaacgttttgttatttattccattatttagttgtatccagattttgacatcgaaagaaaacttgccttaagaaaaccgtctgtctgctatcccagttatctcgttactcttctcatcatcacagcaaaaatgccaaaaaagtataaccaactactcactccattgacttttttaaatatgtttgatcattcgtcttatttgaaatatttaagtaattaattcttttctatcatttgattcattgttaaatatacttatatgtatacatataatattacatattttacaaaagattttttaataagacgaacggttaaacatgtgctaaaaaatcaagtactccataatctaagaaatagcgaaggatataactacaaatgaatctgaaatgaatctgtctttttcttgatatcattacagatgaatctgaatttgtcatggcgtaatttagttgtatctcatgatctttacacaagcataaagcttcctatcgactatgccaccaactgtaaactatcaccgaactgaatcgattgatccatagtacatgccaagaactaatcgagcattattttcatcatcacgtaatcaagtgagaaaaaaaaagtaaaaattaagccgagatgtcgcggcctgtactgtgctcttgtcctcctcctcgttgtcttcttcctccgatcaggtgacgtcctgcttgcactgctggaaaacctgcagaatgttgcggtacgggctcctcgacgacgacgacgacgacgacgagggctgctgctgctgctgcggcgaggcggtggcggcgcgctggcgcttgctgctcgacggccgggactccgggctccgcgccgcctccaccgcctccgcgtcccgcagcgcttgctccgccgcgtccttccgcagcgcctccatgaacgactccttcaccaacccgtcgatctgatcaaaagcaccaccaccccccgcttgagacgagatccaatcgcacaagaaaacgcaggtgaagaatccagcgatggatggggactcaccgtgagcgggcagaactccggcatgggccacgcgacggggccggcgtcgtcgggcggctccggcagcgcctccacctcctccccgccgacatcaccctcctcctccgccgccgccgccgccgcctcaaccttgtcctgcacgcgccaacaccaccacacacacacagatcaggaacaccgaaaaactccagatggaaagagcggagatgatctggggggggcttccccgatctatctcaagtagtagtaccatgaatctcgcggcgatctccaccatctttcccccccttttgatctcctcgtctcctcctgctttcctttttggctcgaaaacgctcgatcgacgcggtttggaacttttcggccgctttcgtgcgcgacggatttgaaatcgggtgagggcgtgaaaagcggaggttccgttcgttttttatggatctcggcgaagataattcgggaaaaaggcaacggctactttttggttgtacgagtactggttccggtaggtctttggttaacctgcctgcgagcttttcgaggtagatccgatttgggggtacagacgaatttgaggcaggctccgtagccatctgaatttgaggcctcctgagaataagaaaaagttgaggaattcagcttctgttttattaaaaaaatattttctgaattatatatacaactatatattcgtataatccgaatgaaaatctgaactattttgaaggagtttgtcatagctagagattataataaaagctgcagctatcagaaactcctttaaacatacctgagttacggttggtacaattttgaagaccctcttggcattggaacaaggctaaaacaacttatattaaaatagatttatttcctttacatattttaaaatatgttttctaaaataatattctaacgcattgctaaaacatttgttttgaaactacttccccattttaaaatatagggagcaaataattttttatatgttttgtaatacaagacgtgcaagcacgtattcaattaactagcatatctcctttccttttttttaaaaaaatacgtcaccctcaagatttatatggattctatttattagggtgatcgaaacaagaagttaataattttttttgtgtttgtgcgtcttatattttggaatggagggagtatttgctaagtttatttcttaaaaaataatttattcctataattaaatcaataatccgctcaaaaatataaatcaaatagagccttatattttggatcatagaatagataatggttggtttgagaaaaaaaatcagttttggaagtatggtgatgttatttttcttgttattcattgcagatatctcaaaatgtaaggtaaagaagttgaggacatatccggtgaaaatgagctaagtatgagaaactcgtgaaaatcatacctaaaagtttcataaattcatgaaaaaaatagtagataggtgtagatatgaaatacattctcaccaaatctcaacttcaaattcaacttaatttaagaggaaaaaaaacaaatttatgatgaatagtgtcatgttactatttacctaaaatttgtcttttttgttactcctaaatgaagttgagtttgaacttgagatttggtgagaatgcatttcatatctacacatatctctagtattttttttcatgaatttataaaacttttatgtatgattttcacgagtttccaacacttagctcgttttcatcggatatgtccaaaaaagttacctgtatgtatactatgaggaattggacgagccaagtctgtgcttggaagctttaccggctgaggtaaccctgctacttgattgagctctagttccaccttcacctttgtgtactaaattgacgctgccccatgaagaccacctcaccatcaccatccctagtatcatcacattgtcgagctccaccttcacctccctcagtatcattatatcaacgagctccaccttcgcactctcctccgcaagctcccctggtcgttagaagtggaggttcgggaagatcgaggaggggtcgctggtttgaggagcgttgctcctagttcaagctacatgggagagggagctgctcatggaaggggctcgagctcggcggtggatgtgtggtagaaatggactcattgatagccccacgagagagttaagctaaactagtttgatgcttcttaggaaaaatttatgcagttgtgcagtagccagtagagatggattagtgttaattaaagaagtgttttcaaaagtagggattgactattatcaaagaagtgcgcaatagagatggaattgtgttaaagaagtgttttcaaaagtagagatagactaatgtcaaagaaatgttttcaaagagttttgaccaaaaatatatttaacttaatagttaaaaaagatgaactagtattaaagaaatgttttcaaaagtagagatggactattatcaaagaagtgcgcaatagagatggaattgtgttaaagaagtgttttcaaaagtagagatagactaatgtcaaataaatgttttcaaagagttttgaccgaaaaatatatttaacttaatagttaaaaaaatgaactagtattaaagaaatattttcaaaagtagagatagactagtgtcgaagtcaaaatgttttgaccaaaaaatatttataactttgtagttttttatttttttaaaggaataagttcactttgactcccttaaatagtgactgaatctaatttgtatccctaaactacaccagatatctcgacccccaactcttaaaaccgaagcaacttgactccctcagtggttttggaggacggttttgttgacgtggcgcctacgtggcggtattgacttggtctgtattccacgtggcgcttaggtgtcattacaattaaaaaatagtgtaggacccatttgtcattcacataaaataaaattatggggcccaccgtggggccttctctctcccttatctctctttctctcccctccctcaagttccttctcggtcctcaccgctcccttctccctcttccatctctttcccgtggcgggcggcgagggccagagcggcggcgggcaagcggagacgcaggcgtggtggtgatgatcgcgtgcgcgccggcgggcgggacgtggtggacgacctcccgccgcgggggaaggcaaggtgctcgtcaaggtgtccgccgccggcgtcaaccgcgccgacacggtgcagcaccagggccggtaccccgctccgcccagcgcgttcccttactcgctcggccccatcctcgcgctcggccccaacgtcccctcccgctgagccgtcggcgactaggtgacttggtgattgccgttgctgccgtttggattaggttaattgattgggagatttgttgttccttttcaggtttgtgcgctgctcagcggtggcaagtatgcagagaaggtggtggtgctagcggggcagctgctcttggtgccggagggggtgtctctgacggacgccgccggcttgcttgaggtggcctgcaccatttggtcgactgcttggcgaattgttctcgtaagataacttctctttttcttctatactcaaggactttatgattcattcctgagcacggtgtatcctcgatgtttgcagatccattgtggatcgagtggaattggtacattttactatacagattgcaaagcaacttggaattaaggtttttgttactgcaggtttgttcagtaggacaaaaacagtacgagtatataataggatgttgcagagattgctcaagtaatgatgttaaactatgtgttaaacaccacagccacgcccgagtctttgcttgcccgtcgccgctccgacccacgccgcccgccgcgggagagagggaggaaggagaagggagcggcgaggagggagaaggaacaggagggaggggagagaaagagagatgatggggagggagaaagccccatggtgggtcccacaatttttgtttaatgtgaatgacaaatgggtcccacacattttctaattctaatgtcatctaagtgtcacgtcaacgccacatggaacgaagaccaggtcaataccaccacgtaggtgccatgtcagcgaaaccgcccttcaaaaccaccgagggagttaaattgctccggttttaatagttgaggggtcgagatatccggtattgtggtttagggatatgaatcagattcagtcactagttaagggagtgaaaataaacttattcctttttttaaaaaaagagttggcttagtcgtcagtcgaggagaatccatgctccacccaccggtggaaccccacaaacttcgggctacgagttgggcttttaccccaaacccacccagccggtaggctgggccgtgagggccaaatctaacttccgtgttctcttcaaactttagcagcagaaatgctaatttcttcctccccttctcttctcttttatttagctgagagtagaggggaagctacttggggtcgtgagtacccccgttttggcatggactcctgactcctctgcccggctaagcaacagccgtataccaaccctttaccctcccaaagctggagttacaggcgcacgcaactgagcccggcgagctgctaggcacggaagcacgtatttgtgctgctgcgcgccaagttcgattagcggtacggtactaatggccttagcacgtaagtttttttttttttggttccgtttctcagttgcctcgcacctatggcagtcaacttgtggccttagcacgcaagtttttctttttcttgttgctgacttgcatgcacaggtcgcggtacaaacattgctttttttttctctttcgcattggttcatctctcgtacttttctgaaaattcgttcatgttcggtaatttcactttcgatcaaaacaaccctccccgcactcccctcctccacccccccccaaaaaaaaaaagaaagaaagaaaagaaaaaaaaatctgttcattatagcgacaaggactcaactagttgtagcctcccctatatgcaaatagtaaaacataagaagggtatatgtgcagtaattaatcaaaacaagaataacttaatgccgaagtgaaactaacttaattggtcaggttccttgtggcggaatcaactaacccgggtttaagtcctggacgatatgtgggctcgcatttacgactaattgtttttttcgtgataggcgaggcgaccagggttcaagtcctggacgacatgtatgctcatatttacggataattattttttcagtggtaggcgagacgcccatagtgacttcgtcaatcttttttcagtggtaggcgaggagcccaggattcaagtcctagacgacatgtgtgctcacatttacggataattgtttttttcaatagtaggcgagacgcccacagtgacttcgtcaatctcaaatctttcggagatgtttataggggtagggtgtgtgtgctacatatactttaatcaaactaaaataaaactacatatacaaaactacagatactttaatcaaactatcgcaaaactacatatatattatgttgtatcacaaaattatagatttaacgtcaaatttatgtgtgcgccttcataaggatgagtgtattcctgcgtttgtaccgtgtataaattttacaaaactacagatactttaatcaaactatcgtaaaattacatatatcaaactacagatactttagtaaaactatcgcaaaactacatatgtagtgttttgtatcacaaaactatagttttggcgtcaaatttatcacaaaaattatagttttgagatagagtatcacaaaactaaagatatggttgttatgtgggttccacggactaaagctatatttcattgccacgtaagctcatttttttttgggagggggttgtaaatctgtcggtttgaagagtcgaggggggagaaatgtttggtactgtagtctaggagatgaatcaaactcacacgatagttcatggaggtaatttaaatttttccttaccttatttacatggtgtgcttttgaattaaaagtgaggttatgggtgaaagggcctgtagcctagtggttacaagagcctcagagcaagttcaatagtatagcccaatactagctccaattcatctatagccaattcatataatagttgcttactatgctattagtatatggtcccacctgtcatacacacactgtgtcttggagtccgtgctcgctgctcttctctctcatcttttatcttattaaaatatgtttatagctagctaatagcctactattgtacctgctctcagtagtaccttaggtcctgggttctactccccatgggagcgatggattgccggcctagtcttcgaagatgctcataggggtaggctagattgcgactaatttgtgagacaaattttttaaggctaattgctccatgatttgactatgtggtgctacagtaaacatttgctaatgacggattaatcaggcttaataaatttgtctcgtggtttaatggaggattttgtaattagtttttttagtacccaaacacctcatacaacactctatacaacacccgatgtgacactctaaaactttacccatcttatatctaaacacccccatagttggcaggggagcgcgttctgcgggggcacgatcctggtgattgggatggcatcatggcagtcgccgttgaggaatcgtgtccgcgtcaactaggccaacgtgcccatgaaggataaagggaagaagataaaagaaaatgctgctcagtcgttgttcgcaacgccaaacacttgtgttttatctgcgattgctgtccaaactcgcgtgtgtgttgcaggttccgctgctgggtttcactaacagacgtgtgttaaggagtactcctatacatccatagtgtgtgtgatgtgatgtacatgagtagtgctatgcacgtgcgtttccacgagaaatattcatggtttttgtaattagattaacttataatgaacgtaaaaaggcaaaaagtagttgtgcacgtgtgttttcacgtattcgaaaaatattctttggttttacaagtaaattgcattggtggtacacaaacttgttagatgggtgcaatttagtatataaacttgtaaaatattcgtttcagtacacgaacttgtctagtttgtgcgaacgaggaccaaaataacttgacaatgttaattttatgaagcgatgttgattaggatgtggcgtgcattgagtatgcatagaacatccaatatttgtaaatttggtctctattttatttttcaccatggaaatgatgaatttcatatatttctaacatttatactattgctcgttttttaaatctttttctactatcactatattctattctatttttattaaagaggtgtatgtctaatagcaaccttctcatatatatgccctaaatcaacaatattagcaatatagtgtcattttcgccttcctccgcacgcaccagataagtttatacaccaaaacaagcattttacaagtttgtgcactagattgtacccacctgacaagttcgtgtaccggcgatgcaatgtattcattagattaacttattattattaacgcaaaaaaaacttacttagtgtgggtatgtggttggcagcaaggcaacgacgaactatttaccggttgccgtagctgactcggctcggaattggcttgctgtgttaccacgagggacattcggttcctgggctaagcttcgcgaccacttcatcatcaactttcaaggtaccttttagtatttcaccaattaacttattattaacgcaaaaggcaaaaaaaattacaattagattaacaaaaaaaacttgttttaagagttgtacttggtggttttaagaggcaaagcgggaaacacaaacaccacaacacgaccttggcaacaaacatcatatgaaacgggctcggcttgggttgccccatatgccttattaaccccacaccgtagatttcttcaggtcgagaaatattgtttgtttttacaagtaaattgtattggtggtacacaaacttgttagatgggtgcaatttagtatataaacttgtaaaatattcgtttcagtacatgaacttgtctagtttgtgcgaacgaggaccaaaataacttgacaatgttaattttatgaagtgatgttgattaggatatggcgtgcatacgtttagtgagtatgcatagaacatccaatatttataaatttggtctctactttattcttcaccatggaaatgatgaatttcatatatttctaacatttatactattgctcgttttttaaatctttttctactatcactatattatattctatttttattgaagaggtgtatgtctaatagcaaccttctcatatatatgccctaaatcaataagattagcaatgtagtgtcattttcgccttccttcgcacgcaccagacaagtttatacaccaaaacaagcattttacaagttcgtgcactagattgtacccacctgacaagttcgtgtaccggcgatgcaatgtactcattagattaacttattattattaacgcaaaaaaaaacttgttttttttacttagtgtgggtatgtggttggcagcaaggcaacgacgaactatttaccggttgccgtagctgactcggctcggaattggcttgctgggttaccacgagggacattcggttcctgggccaagctttgcgaccacttcatcatcaacttgcaaggtacctttattatttcaccaattaacttattattaacgcaaaaggcaaaaaaaaacaattagattaacacgaaaaaacttgttttaagagttgtacttggtggttttaagaggcaaagcgggaaacacaaacaccacaacacgaccttggcaacaaacatcgtatgaaacgggctcggcttgggttgccccatatgccttattaaccccacgccgtagatttcttcaggtcaattgtggccgagactgcgtgtgtgtgttgtgggcccttttgaccggcccaaacaccagcaacgtaccaactcctagccctccacaggccagagttaaaggcccacgccaccgacccagtccacttatactgactagatgcttacgtacaaaacaaaaatatgggccccacatatcatcctcaccattgtctaaaaaaacatgtcatcctcactctcctctactcttctctctccatctcccccctcattccactagaacctagagctcgacgcgttggcatagaagatggagcagcaattaatggtgggagaggaggaggttgcggctgtgcacggaggtgggagggaggcaactggcggcatagtggtgttgtgcagtgatggcggtgtagtctcggtagagctgccggatccttcctatctcctgatcgagcttgtgtaggtagatattgcctagtagggccgatagtagtacaatgtttgggacggagttagggcccttctcacctcctacgagtcgtccggcggaaaactgtttctgagtggggtaaaagaactgtttcggacgaagtcggccttggagacgaactgcatccatgactccttggcagcgcactcgcgactagactcctcgaacgacggcgacaacctcttctccatctcactataggaggcgaggaagcggccctatctctaaatccatcggaggaacggaaatggcgtcgtgcgggaggcaggagcagcggtcggcgacacaaggccatagatgcgcgccgctaacgtggtagatggaagcgtcacaggatgattatgacgtcctcgccctaggcggtgacgacgtggagatgacagtgccgcccaaaagtggatctgaatgtggaggagtctcggcacggtcgatgttggcctggtagagaccgtggtggacccgtcccctcctctagtgatggcgatgctacggtgaggccaccggtctgcgcatccactcgccacccagattgagaccgtcacccctgccctgccctgcgctctgtgctgcttcttgctcggaacatgaccgcatggttgccggcacctgacagagtgagatggggataagaaagaagattgctatttcacttatatgtgggtctcacgtgtttgtttttaatttttgcatcttgtgccacgtcactccaaaccaccttcaatattgtattaggactatatttgcacgggttttaaaatatgagggatgtgttgtatccgattttacggtttagggatttgattcaaactctacatccagatgaggggaccaacagtaaacttattcctttgcaaaatgtgcaggccacttgcggtctatctcttctctgaagggccgtaaggcccaaggcccagttcttcgttgcggaatacgcatagctgaataagctgataggagattgaagagaaagatgaagatgaaatgcagattaagtatttcacgcaaaacgaggtgataataacgtgtgattaattaagttttaattattataaatttaaaaaatagattaatatgatattttagaataattttatatagaaagttttcgcatgaaacacactctttagcagtttaaaaagcgtatcacgaaaaccagaacttcatccaatcttttagtaggaaacgaacggttactcagctctcgctccaggatgcatggcgcggttgatgggatacagtcatccagaactctctcttgagatcccgacgcggagtagacagtagagtcgctggcgctgcgcgcacagctagctagcctagcgaagaggaggggaggaggatctcgacgcgtagagcgtacgtacggccgctggggcccgcttacttgaatcctagtcgggccccacagcgatctgacgagcggtgggccccacggctacctagctactccagctagctgcatgctcggctggctgctgtccccgccgcagccgcctccaggtggcacgcattgccacgtggagagctcgagatcgtcgtcaaactcccgctcctgattcatcaggtttttttgcaccaattttttttttactctgctcgttgccattgaatcctgtgatgaatcatccaacgcctttagcttggtcaggagcggatgcaacgtgagtgcagggggacttgagtcccccctacattcacataatccatggataccttaggagcaccttcttcgattttttcactatgaataataaattaaagctctgtaaatggctgcagattaaataaactgcgtaactgagtcccctaaatttttttttgttcttggatccgcctctgagcttgagcttggtgagtgcaatgctgggctaactgccaaatgcttcgtttgtaattctgggcaaacagcatgacactcggcgaggcagatttaactcggggccgcacatatacatctttcagcaagcacgtacatacatatacacatgcttttctatcttggcagtgtggacaagggccatttttgcggtgtccgtgcccattttgccgaagcggagaaggatcagggggatgggcgcgcgcgctgctgccgatcgatcgaatcgccgctggaaacggcaagaatattgatcccctttgcctcctgctgcagcgcggacggagaagccctctcgcttaaatccgctttcccgaaacgcccaacccggtggtgccagcgtttgcctccgcccgaatggcggctagctaactgtaaccggcactaatcgggagatcgagggatctgtacggtgatccatccatcgatccatcgaaaggctggagatctagctcaactgttgatgggtcagtgtctctgatggagtaggattgctgtaggctttgtagtagggatggtgtagcgaggtcgatcgatcgagcaaggaggttacgttgttccgtactgttatcaactgcatctctgcgctgcatgcatgtagtgatggttgaattagaccattcacagcgctcctacatgatgagtggtagagtgactttagcttgctggttgccacataggagccatgctgctgcgaagagcgggggtgtgggtgagtggcctcggtaataaggtgttcgtgctttgcagcagacatggtttcttcagtaagtagacatctaagttgggcgaacacgtcacgctgccacacggtgtgtggtacttttctgccgctagatttagagggttgagctagagcggttactggagaacaacgtccgataaaataaatggagttggtggatggagatagcggacgacggtggccaaatatggagagtggaggagcggtggttgggagggacataccagctgggggacctcgtcaccgttgaccaggaagatgatgacgacgagtccgagcccgtctacccaccacctacgagctcgtggccagcatggtgagctcataacaagctccgacgaggctttggcatgattgattgtccgtggcagaaaattgacctagtgtcagcttgggttacttcggcatcgagacgagaaggactgtgtcatgcgctcgacgatgcaatgatgtttggcaatggctgactagattaaaaagtttaggggtgacaagagaaggactcgggagaagaaacacgacaaagaatagtggagagggggtggtagagaatggtagaggggaagacgtgaggagagattttatattagtttatgtattttggtatgtatagtataaaattttggacttccatatgaattaataaaatatcaggactgaaatagaaaaatatcaagacggacatgaaaagtggaagttattacttgaagccgcttgcactatggtaaaataactttttagaggtgtggtcttagtcctgtatggcatcttaaggacactcatataagttgcttctattgtgaatgcatttagctactcgattgttgcttgttatgttggggtgcagaagctcatcttgttttaaccattttttttcttatggatatttattgttgatgccttttctagccaacacggacttacctaatgatttttggtgttaatggagtcacgaatcaccttgatttagaaaactctaaaccaagatgggttttgaagattaaaccgactagcagagccgatttaaatatcaaaactagcctctaaaccgacttagatcgatatggatataactatcatctcgtgggtgaatcagaagatttatgggacaaacctacaaaggatattgcactcgagcagcgaaggaggacaatttacgacacaaatcgataaagatagacaaaacatgggtaaagtagaaaccatgcctaaaaagtaaagacaaaagaatgattcgatagattgtagggattatggtcagggtgttaaaaattgaactagccatagctcttataaacaagtttgtcttgtctccacaggatcttttctatgtcctactaagtttagagatcaataagaacttaaaaaaaaaacccagggtcaatgaaaaaaacccaagaaccgacaaattgggcttgaagtcggtatgactgactccatgcggcggtcaaacctacctcatacggtaaaccgggtcttttccaaatttgaccgtgttttcctgtttttccatcttaggtgccaaatttagatgttaccatttacatatatcacactttattcactctcatttcgtactttttcgtatcttgcatacataaatatgtatcttcatatacatcaagcatgttgttcattggcatacatcgtttttttcagctctgcaacaccaactgttagctgatcttcttttacagatttcctcacggcattaatcgagcatatgcaacattaacaactaggatatcaaatatcacatgataacaatccggcccaggtggggttggccgaggcccaataacttaagattgcccggaccccaacagttcataggcacacccactcggggaaaggcccaatctccctaaaagactagtccgataggggaagggtggctctcccttttaaagtggcttcctcctcccaagctaagcaaggtgggattattcagaggctcacacggtcgccgcccgacttttgcatctttgctagtgggtaatagtggaggatgtcctcatcatcacatcttccctctaccaaaatcgacatttcacaactttaacgagataacttcatgattacaaatttacaatagcacaagggagatattagaggactactgacaagctgcaaaagcacaagatcacaaagtatatgtttcatttttggagtaccaaaagtgcttggtgaactaccaaattataacctattattccctctggtcatgaaaaaatgccatctctcgtactttgaacactagtatcttataagatatttaaattagatgcataaaagttgtatgtaattaagatttatgcgagatacttttataatattatagttttatctagttatttagatattatgaaataaaaattagtggtcaaacttatattttgaagaccatgccaatgtccaaaatgatatgtttccataaccaaaagaaaattatgttataacttaaaagaaagaaaaagtgaagcacaacactttaataaatggaaatattaaaaggaaaggcacatcagcacatcacaacacacacatatatattaagtacatatgaaacgattcatcacaacgccacttttagaaaaaaaaattcaaccgcggtgattttatttattttaaaggtgaataatttaatgtttcaaattcattgatagctagttgttaacatttaacggctcaaaattaagatcattttatatggatctatattctaccaaaaggttgattctacaatcactgtgtataatgttgattgtctcctaactaatattgctaacgactagcatactatcatataattaattacatgtctatgctatagaaattatccatcttgaaggtatggaagtagattctattaataaattgtgctccatctacttgtcctaatatctgaatgttggtcttagtcattcttagtaaatcacatcaaatgaccaacacaatattgttagactaaataaagttaaaattgaatcaagtggtaataagtagagttaattcatcaacattatatattatcaagtatagaagatattcttttgccactagttcgctaataccgcatattcaggaattatacaccattcaaaattgcaaacaagcacaaccaatatatttcctctagaacatgatatgtcgaagacattcttaacaatcgtttcattaaaaattaataactacaaattaaatgactatagttttccatgataatgtcatccatgcataagaacatttatgaaaagcaaaaccaaatcgtgtaagacatttttaatatcccatatgtagacaaacatatacatatttttcaattgatttttaacatgtacataaattaacttgaaactagtcatcaagcataaatgcataatatgccaccatatctagaccgatcttccatttaaggcacaaataatatatacaatgacagttactcatgcaagtttgctaactttagaataaaaataagatgaagtagtggctaagctttccattatgtcagactttgctaagtttagaacaaaaataagatgatgaagtacctgatgttctagatgattgaacttctaagtttagaataaaaataagatggcatagtggctaatgtccaagatcaatgaacttttctaagtttagaaggaaaaataatatgatgtattgtctaacgctccaccctggcacgactccaatatcattccagatagtccgggctcacctccactatcattccagatagtcttcctctccgggtgttaacacccatacttggttccatatcaatacataagtagcaacaaattaatgcatattaaatgtattccaaagattacaaaattggctagtatatgccaatatctcaaacaaatcataatggaaataatatctttagagtcatttatgaacatagaggaaaaatgatctaaaagtaatagcactttttaacctaaatgggtttgcttggttgcatccaaacccaatagtagtagggagggagatgaatgacctgcaagtctgctacatggtgaaaaataatccaagaatttaaattaaaacaaaatattccaaaaactgtactcaatatattctatttaatataggtcaatagatatttttctaaaacaatttagtatctatgtaaacacataattataaaaccataaatatataaattttagcgtacaaacaaaaagtttagaataatattacctaggagtacgcttatattatttcagaaccaacttacaaaactaaaataaaacaaagctcgttagtttatatggtcattggttatgcttttgctaaattcatttgatggttatttctttaagatcgtcggttccacttttacccgcgaataaactgatcaaatcgaacaaattgatcaagtaacgctctagctaaaacgcccagagaatgcgcatgccgagcaaccgagggttatctcctctcttgatcctctactatatatttcttattaagacgctatcatgtatccacaccctagttcgaccaaccaaatcccatcgctgccaagtacgccgtctacctttgccatgtggggagaggtaccacggagtgactgctatgcgaggtgctgatcaaggcgtgcatgagttctattgttccatgaggtggcaagatatatagtgctacatgaggtccgcgactcactatcttccatgttcgatattgttggtattccttgtgagttcatacttgtcaatacattcatacttttctctatgttggtcacttgcctaattgctcggttccttgctcgatttgtttacttaatccggtgcactgcttgattcggtggattattttcccggcacacattcaaagtaagtaaacaataatagcaaaataccaaatcaaactatttcagttttcctagccgtaatttttgtggccatatttggaaaaccaaatttttaagcaaagaaactgaccaaaacaatcaaattcccaacttgaattatcattactagttctaaggaataattgaaaatgactaggagaaaaatacataatgttttagtttgcataacaaatttgtccgaaagctaccatagctacatttctaattatcggtagaattgtgttaaattttctctgtttaatataatatgttacaaggtctgtacttgcagagaaaactgaaaaacattttgattgcaacactgcaatcatttgaaatgatgtttgaaaataaatcccaagtggattatccatatttaattatcacaacgtataatcgttccacacattttcaaaggctacacatttctagcatagtaacataatttccctattttaatatttagagataactcatggcccaatacattatgatgttgcattagtctagaaaaaatataaaatatggattagtcaaacttttctgaaacattatgaagctgacataactgatatcctttgtttatttggtctttgggttttacttttgtattcaatgttgagttgtccatcagattcctacccatcataaaccattctaaccaaacaaacggtaacaattattccatacttgagtaaaaaaaacaattattccatacaatattaaagggtagacaaacaataacaattattccatacaattttaaaggctagaatttctaataaaccaacaattgtattttgccaacataattttgtctaactttagccatatttatggtacaagagccgtcaaaacatatccaccaaacttatagatgcaagacacaagatgtgtagatcgtagagaaaacataagaagattagtaacgccacaaggcccacaactttaagcatgctttcatccaactgcatatttacatgacttgcatcgtcctccaagcttgtagaaacatataaataaataggttgaatgaagggatataaagattacatatatttaaaacatcatgacttttaacatcctttctcttatacatatttacagtgctagaatcatccataaaacttatagatgcacgtaactagttatttataaacataaatgcatgaagaatcctctattggatttataaatgggtggaactagatatgctcatgttgaacaaaaacaaagaaaaagagtagtaaagtaccagcataacaacgctcactccatcttttttatataattttgagaaaccctcatggttcaattattgcatattttaagttatagtttttaaaaaccctcatggatctatacgtatgtactttacgtaacaattttgaaaaacccacataaatatattaatacatcttttatgtttcaattttataaaactcccgtggccatacgttttttacgttgtagttttgagaaatcctctttgctctatttgtacgctttttacgttatagctttgaaaaaccctcttatctctatttgtacatcttttatgttacaaattttaaaaacccctatgaatatattaatacatcttgtatgttgcagttttataaaaccttattgcatcttttacattatagttttgaaaaacccttgtagttctatctatgtgccttttgaattgcgattttgaaaaaaaaatgtaggcctatgagtatgtgtttggtatcacgatttgggaaaaccttcataaatttattttttgaaaggaaccttcatgaatttattattatatcttttgtgttatggttttgagaaactctcatggctttatgtcttttgtgttacaatttttgacaaacccctaatacctttattaattcgtatttgttacaatttttgtaaaaaaaaaactaatggctatattagtttgtcttttacttttaggttatagttgtgacagaaaccctcatggctgtattaatacgtcatgtcaattgacgtacgtaacattaatcaaactagctacaagtccaatcatcgcaatcgctccttcagcattataaactatccatcaccaaaatacttcacacgtaaaccgcctctaattgtcatcaacttaggcaaaaaaaaaaaaacaccaccaccaccactgcatcagctactagcacacaaccaaatcatcacattgtctcttctttcttatatccaccacatttttcttttcctttatttatgtgcatcacatttttcctttctccatactcaccacattttctctctctctctcttggccccatcgtttgtcttttcttttaataagccaaaacggcttattagagaataaaaataaatttataggtaaaacttttatatatgtattctcggtgacttaaaaaccaatgctgaaaaagaaactacgttgaaaatatctcaaaattaatatcaaaattaagtttgaaaatttaaaatttagctttttctttagctgaatagaccatccgatgggagcctctatctctatctctctctaaacccaatgtacggcattttcttttgacacacatgcacacacattgtacaggcaacccctcctcccagaaatagaagtacaggagcatggagaggagagggaggggtttccggcccctttgcatttgtgccttggcgggcgcaggggcggaggaggcgcggacagagagagaggggggaaaaaacccgacccgtttggccttaaatggctccagctgttcccatccaaacccaccagagatgcactgtagagagagaaagagagagtggtcgacggggcgccgtgtttaaaaacctcggcccttatttcgcaccggttactactctactgctgctgcttctgctactgcactactactacactcatactctcttctctctcctgttcttgattttctctctcctcctctacgcgaggagaggagctagctagcgcacaccagcggcagcagcaggagaaagattggcacgaacagtccagaaaactagtagtagcagaagaggatacagggagagagatcagataagcgagcgtttctgatgatggagaggagatagagggataagcgcgagcaagattggaatcagcgtggtggtggtaggggaggggatggatgatatggcgtgacggaagggggggtttggattggatgagttgaggtgcctgcaaattccttcctgttttggatcgctgtgagttgggaattcctgtataaatacggccccgagaggggacgcagagatcaagaacagtgcaaagatcaatcgatccatccatctctccccctcctcctgctgctgctgttgttgcgagagagagagagagagagagagagagagagagagagaggaagaggcagaggtagtagcagcggcggcggccatggatttcggcgacgaacccgagggctccgacagccagcgccgccgcaagcgctaccaccgccacacgcctcgccagattcagcagctcgaggcgtacgcgttttctctatttttttttctgctgttgttcttctatgtgttgttggctttcgtccgccatggcggcggcgccatggatggagggatgaaatggtgcgtgtgtttgtttcccgtgttgtgcaggatgttcaaggagtgcccccacccggacgagaaccagcgggcgcagcttagccgggagctcgggttggagccgaggcagatcaagttctggttccagaatcgccggacccagatgaaggtaaattacaaggagaattccgattggttttcttgattgatcgatcgatcgccatggattccggcgtgcgtgcttgcttccttccgttcgtttcttgcggggaggatgatgatatccatggtgtggggtttgctgtttgcaggcgcagcacgagcgggcggacaactgcttcctccgcgccgagaacgacaagatccggtgcgagaacatcgccatccgcgaggccctcaagaacgtcatctgccccacctgcggcggccctcccgtcggcgaggactacttcgacgagcagaagcttcgcatggagaacgcccgcctcaaggaagaggtaatgccccgcctccgccgccgccgccgccgccgtcgacgacgcggtttgctttgctttgttgatgtttctgatgatgtgttttgttgcggtgttcgtccggcgaacgtgcgagcagctggaccgcgtgtcgaacctgacgtcgaagtatctcggccggccgttcacgcagctgccgccggcgacgccgccgatgacggtgtcgtcgctggacctgtccgtgggcgggatgggcgggccgtcgctggacctggacctcctcagcggtggctcgtcggggatcccgttccagctgccggcgcccgtgtccgacatggagcggcccatgatggccgagatggccacgcgcgccatggacgagctgatccgcctcgcgcaggccggcgaccacatctggtccaagagccccggcggcggcgtgtccggcggcgacgcccgcgagaccctcaacgtcgacacctacgacagcatcttctccaagcccggcggctcgtaccgcgcccccagcatcaacgtcgaggggtcccgcgagtccggcctcgtgctcatgagcgccgtcgccctcgccgacgtgttcatggacacggtaatcaagctgttcgacgccacaaccattctccattttgctcatttgattgattggttcatcgccatcgcagaacaagtggatggagttcttcccaagcatcgtgtccaaagctcacaccattgatgtgctcgtgaatggcatgggagggagaagcgagtccttgattctggtaaacccacattgccattgccattgccattgcatcaatcgagcaaattcttttgtgagttttttccattttgatcttgtgatgtttgtgttgtgggtgtagatgtacgaggagctgcacatcatgacgccggccgtcccgacccgggaggtgaacttcgtccgctactgccggcagatcgagcaggggctatgggccatcgccgacgtctccgtcgacctgcagcgcgacgcccacttcggcgcgccgccgccgcgctcccgccggctcccttcggggtgcctcatcgctgacatggccaatggctactccaaggtatacgcgatggacaatgtgccgcacgcaatggtgttttggtttcggctcgctgacgacgtcgcgcacgctcgcgtacgcgcaggtgacctgggtcgaacacatggaggtggaggagaagagcccgatcaacgtgctgtaccgtgacctcgtgctgagcggcgccgcgttcggggcgcaccgctggctcgccgcgctccagcgcgcgtgcgagcgctacgcctccctcgtcgcgctcggcgtcccgcaccacatcgccggtggtatgcacccgtcgagcgctcgacatcacagtcgtcgttgcgtttttctctcgccatgacactgacattgtccgggctcgccatggttgggcacgcagtgacgccggaggggaagaggagcatgatgaagctgtcgcagcggatggtgaacagcttctgctcgagcctgggggcgtcgcagatgcaccagtggacgacgctgtcgggctccaacgaggtgagcgtccgcgtcaccatgcaccggagcacggaccccggccagcccaacggcgtcgtcctcagcgccgccacctccatctggctccccgtcccctgcgaccacgtcttcgccttcgtccgcgacgagaacacccgctcccaggtcagccatccactctctccgccattgatatcgctcactcactcactgtgcccgccattgctgctgctgcagtgggacgtcctgtcgcacggcaatcaagtccaggaagtgtcgcgcatccccaacggctcaaacccggggaactgcatctcgctgctaagagtaattagccctaattaaccctctccatgatcgcatctccaaaccttaaacctcgaaatgccatgctgcggcgagtttaatgcgattacgtcgttaatggcgtcgtctcgatctgcagggcttgaatgcgagccagaacagcatgctgatactgcaggagagctgcacggacgcgtcggggtcgctggtggtgtactcgccgatcgacatcccggcggcgaacgtcgtgatgagcggtgaggacccgtcgagcatcccgctgctgccgtcggggttcaccatcctccccgatggccgcccgggctcggcggcgggggcgtcgaccagcagcgcggggccgctcgccgccgcgcgcggcgggggcggcgggggcgctggcggcgggtccgtcgtcaccgtcgcgttccagatcctcgtcagcagcctgccgtcgtcgaagctcaacgccgagtctgtcgccaccgtcaacgggctgatcaccaccaccgtcgagcagatcaaggccgcgctcaactgctccgcccatggccaccacccctgatcgccgccgccgccgccaccgagctcgccattgcattgcacccgcttcgccatcatcggaggagagagagttggttggcgcgttgaatgctcgcattcatggactccacctgctgctgctgctgctgctgcatctgaagctgatgcaactctctctctatctatctctctctttcgcccatccattatccagctagccatgatccatccatcaaaccatgcatcgttaaaaaaaaataactcttgtttaggttttcgt

SEQ ID NO: 62583 - DNA, 1076 bp, Oryza sativa
ccactcaatatgtactgcgacaatgagccaacaatgtttatgctcacaacaataagtcgagtggtgctgccaaacacattgacattaagttttatgttgtgaaagagaaaatccaggatcagaccattagtctgagcatataagaacaaaggaaatgttagcagatctgtatacaaaaggcttaccgcccagtgtgttcagagaacacttaaccagcatgggttttataggaaagcttatgatccttggattacaaaagggcctagtgtttatttctagatgaggaggtgcattgtagtcgttgcgtttgatggttcaatagtgactatcggatgaagcgtgctctatgcatcaatctattgagaagtaaatgttaagtaagagaagtaagaaaggcggagatcaaaggggagaatgttagttgcgatctccgggggaatcgggaaaccgatttcccactccgtctacgcgccctgatcgggggcgccagccgatctattggtagtgggcccctctcacgcagcacaatataaagagggggtgccgctgggcgcgcgaacaaaacattcgctgcatacacggactccccacaaaccctagactcctaccaatctgggacgcgctgaagtgaggggaaatgccctcgttctcgctgccgctaccgccgtcgcctacaccgacatcgccgaccccggggacatctacgccgcgccgacaccgtcggcatgtccgagtctacctctaagggtgaaggtatgtgtcccacatctctctctctctctgtttactcccacaagcaatcaactataccgctatgagcttagacatcaacccctatgatgtgcacctagtgatcctacgatcctaacaatagcaacttcagctactcccttatctcaacaaatcacaactatcttccatttaatttcttttcacctacttccccatctcaacaaatgaaaaccatctcccatttaatttcacctactttcttaatcacagtgcaaaactccagaaatacttatattttgggatataggggatattcaacatggttcagacagaaaaggcccaca

SEQ ID NO: 62584 - DNA, 13386 bp, Oryza sativa
tttaccccgccggagcagtgagaacatggggggaggcaccccacccggtactcgaaacggagagagagagagagagagagagagctgtgaccttgggattggatacacgcagcggcggcggcgggggcggaggcgaggaggcggcggcggcgagcgggcggggagggtagacgtcgaagggcttgacgaagaggagcacgcggcggagcgccattggagcccctcgtctcggcttccctgccttcttgtacccgcggttcgtcgcgttggcggcggcggcggcggcggcggcgccccccggcgtggcgtctgcgccgtcgggttgtgcggtctgtttctgacgacgacgaaatacgccttcgaatcaggaacacgtaaagcagatacggctaagatttgttttatcagaaaagcccctgcggtactaatttatcacacatggtgacgatgttagaccttcacagtgcatcgcccgtggcgttctgccccgaccggccacgttggagattccatgccacggatgcatctggtgcatccaacctgaagcccgcgtagccaaagttgggcacgcgttcttcatcagttttggtaggcatatgtcagagcgaggcgagaaacggggcgcacggcgcgttgggacagggcgtgaccccgtgcttcacccccaaaacaaagctggccggatttggcgacatcaacggcgtggcgtcggctgcctagggagaaaggaagatggcggtggtggtagaagaggagacggcggcggatctggctcctaatctcgttgttatccctgttccgcgccgtcaaccgtgtcgtcgtcctccgctccaaagccgcctcagtcagtccgaagcagcagcttgacggcggcctcctgagtccactccaccgccggtcactgcccacatgcaccgccagatccacattgtccgctccacgccggcgagcttcgcgcaaccccggcgaggcccagggcgaagcggcgacggagcaccggcctcggcttgctcctcactgccgccacctcgaggcctccgtcaccgaggccaccgtgcccgccatgggagagggagagagaaaggggaaagaaggagcgccaccactgaggccaccgtgcgccgccgccgccaccgtgtcttcttgcaaaccgcgccaccggtggaaggagaggaaggggcgggggagttgaggcgcatgggagcctactagtgaaggagagggagagaaaggggaagaatgagcggtggtggaagaggtttcggggtggagatgatgagattggaattttttgtggtggggcccgcatgagaaaaagtttggtggggtccacctaaagtcacgccgcagtgtggaggagtttcgcactgttctttcataaatagctgtttgggctcccgtgaaacgtgcggcgcattggggtatgagactctctcgtacccaaaacacatgttcatttctgcacaatggaatagcggcaaggtttccgagcctctaaagtctaaacggcgtggctttcagaaaaaaactttctatacataatttatttaataataggaaaaggtacgaattactcccctaaactatctgaatttcccccttccttccttccttcccccccccaacgaaccacgaaaccggacatcgtttaccctgaactttcaataccagacaaattaccccctctcgacccaatccagagcggttttgtcctacatggcatacacgtggcaatccagtcagcattttctttttttatagtggggccggcccacttgtcatatactctctctcgggccattgggcgtaagtcgagcggcggcgggcggtcggcgcgcacggtgccgcgtgggagctagtggtgggcggtggcgacgggacatggagcgaggggtggcggccaccacggcgggatgtgagcgaggtggcagcaaagacggcgggacgtgagcgaggcggcaggacgtggagcgaggcaacggcgccggcgagacgtggaccgaggcggcgttgacgggatgtggaacaaagcggcggtggcgacggcagcaggatcctccttccccaccatcgcggcggtgcggagctcggacacgccgacactgcggcggccgctcccttccccttccctgcgcagagccatcggcccccttccccttccccatctgccccgtcagccactcgagctaccacttttcatctggcagctgcccgagcgaccttcgtctctgccgccgcccgccggcacccaagcaagctccaccgtctcccaaccccgtctcttgtgcagggcagcggggcctcgaagacagcgagggggaagaaggatcccgctacccgtgcgcccgcaggacctcgtgcgccgcttccactgctgttgccacagcctcgtcccgccctgacgagagcgacaggggaggcgaagctcgcttgggcggcaaatggcgccgcgccgccaccgtcgtcccaccgctgtttcgccgtcggtcggagccacgctcactgccgctcaccacccaccacagagagaagaaagaggatagagtgatttaatatgacatgtgggccctatattttttaatttttctggctgattggattttcacgtcaacgccacgtgtataccacgtaggattaaaaccactttattcgtttgtaccttcaaatatttatatcaccaatcgtttatacttcctccgtttcatgatataagttattctaacattttccacattcatattgatgttagtgaatttagatagatatatatatgtctagattcgttagtattattatgaatgtgggaaatgctagaatgactttacattgtgaaatggagggagtatctatttagtattgagcctgttcggctggttgggttgtgggtgtggggtagtatttcactcacaaaatcagcagcagtgtgccgctgtagcctggctaccaaacaagcccattctgtttttactcagcacaaaacaacacatccacgttcgcaagcgtgatattcaatcaagtcatcgtcttctagatgatagtaataaatctgagttgaatttgacgcaacgatactgtatagctattcattaaagcaatgctaataatacaactgacttattggctatgagaattttttagcctttttttagcccacacatataatatttagctacttacaattaatactcacaaaatttcttggttcttgtgtccaagttgaccgtaagtttacagcccgcttctcctctctctcctctcttctatcctccacctcaacatttaaccgacttacaccctcctgttatacttgctcttagagttatagccaattgttggctctaaatcatctatagtcaacttaatagccaattcatataatagttacatataaacatatactacacaatcaatatctggtcccacctgttatacacatatgtgtcttagagtccatgctgcagctggctattaatctgtagtccgctactcttatatctcatcttttatctccttaaaatatgtttatatctggcttacagtctgctattgtgcctgctcttatctagcagttacatgctaacattaatgtatgtgtgatttcctttctgtgataatgttaacgaccaaatttgttgcactagagtagcagatctctcaggccagtgcgtgtttttcgcgtcaagagataccaggtgaaaccccactcgttgctgcgggagttcagtatgataacaataaataaaaataatatgtagcatagctaaacaatataaacttacataagcactggaaacaattgatgtaatatgacttaattagagaagagagaaataacattaaccaagtgatgatgaactacataggtacataagatattataagaaaataatgaagatatatattgaaatattatatgaattttgtgggatgatgatttaacatgctttcattttaaaagctctaaaatataataaattttaaattatagataatataacgtatttgcatgatattaaatgtattgattgttagtggatgatgatgtgtcaacttgttagtggatgataatgtggcatctttgcatgttaagctttaagagttagtgggttataactttatagtactattgggatgatgatttaacatgctttcattttaaaatatctaaaatataataaattttaaattatagataatatagcatgtttgcatgatattaaatgtattgattgttagtggatgatgatgtaacatctttgtatgttagtgtgttataactttactgtaagataggatttcagaagtatgatctaccgttttgaggttatctagtaaacctatttataaaaggaaaacaatgatatttttttcattattatgagtaagcatgctatgtaatagtgctactgtggatcactttggaaagcggtaagaattgaggtgttattgaattcaatgcaactaggataattaattattcccaacataactgaaatcaacaattttgccttcctttcaattaaaactaggaaggtagcccatgtgaatacgcgggcatgcgtcgtacactaagtttgagacacttgtaacacttgtaagagcgaaatattaaccgaagaacatctatcacgatttctccgtaaattgctttagtcggcattaattgtttttataatttttaacctattagctttatattgtatcatatttaagtaatactatctataaacaattatttataatctttttcatcatttgaaaagaaggtagacttattttctttagaaaacatgtcaacgaaaagtaagtgtaaagtaaaagtaaggcatttttttaattgcatatatattatcatggtttattcgagaatgaattgggtgggacatgaacctccactaaatgtatgggtttatatagcctaatatgatagatgtagtttgacagccagtccatctatgaacatttcatgtagagtgggtcagaggttccatgcaagctaacgtgaatacaataacgacaaaatataattgcgcaatagtacttttaaaatgtgatgtaccatgaatacacgctttcttttcttatataagatagatataacggttagaaataatagttccactggtttaaaagtcataggagtattccagaaatgtagcttaaatattatggttgttttaatatctaacattattacgaagtaaatgtagctcaactagttaggttctttgtggtggaacatgcccactcgggtgcaagtcctagacttgataaattctttcaatggtaggtgacgtacccgtcaactgtgaggtgcgtggcgactttgtcaatatcaaaatatgtcagtctaatctctcagaagtactcataggggtatatgcatgtgtgtggtggaacttgaccactcgggtacaagtcttagacttgacaaattctttcaatgataggcgacgtaacagtcgacaacgaggtgcgtggcaacttcgtaaatgtcaaaatatgtctacctaatctctcagaagtactcataggggtatatgcatgtatgcattaatagggggtgagtgtgtgcgtgctgtgagtttttgcgtttgtacttaggttctaaaaaatatcaaacattatttattgtttctcttttaatttaagagataaaacaatagggagtggacgacaatattgtgtacatgggagggtgaggaggtggtgaagattttatttttctatttttctaaatgatttaagtgaaagccggtgacagggtgtttcattttttctaagaatttctatggtttttcctgtttttttataggaggtgacacatggcaacttaagattttttttaaaaaaaaatagatctaatagttaaaaataataaatacgtcaatttaattactatttattacaattttatgacatattatacggtgatttatgagcgctctagagcgtgtttaatttatttttgttacgtacaatgaatgatttagtataacataataaatgatttagtataacataatacatatgtacaattaattttccgttgttatttagttgccatgttaacttctatgtagtaaaatatagttaatgtgatcttgatttatttatttataaataaataaaactataaatatttataaaaaacatacttttttttatacccggaaggtatggaataaaagtacaaagccgccggcaagtatatctatgtaccatatactaaaagatcattaaatattgtctaataaagtcattcaaatgttaccatagaatatattctagagcacttacgtagaagatcgtttggcactcttggattggattgtttggcactcttggattggattgtttcctttaactggcataactgcatttttcgatcaatcacaaataaagatataaaattataattgttgtggtagctagagtcaaaagctgaccttaaccaaatatgtcattttggatatgtattgggagtgaaaacataaagtaaacatcgattgtgccaatatagagcccgaggggcattgtatgtatgtacatacgtacaccatcgcccaacatccacccacctccgcctcattcatcccctctcccaatgtactgtctctcatgttttcatcatatattagtcaggaaccctaatttattataatgttttaaaataaatagctattttttatcgacttatgttgttggaccattattaactatattcgaacttcttaaataaatatgttattttttattacattctgactattttcatatcatttaaataattattagaaaatatgaaaaaaaaccaatgatatatactttacctgttgaaaatatttttggtgaattttctttacatctatgtaaaatgtaggatttattactattgaaataccaaccaaacagtttcgaaaaattccaaaatgatttgagaatgttaatatcacacaaattaaaatttaaattggatctacttaaaaaacacaactaaattacatggtttgcatttttacatagttcaaattaccgttgtatatttgttaagtaaaatttgataccataaagtatatagtttgatgcgggtttttttttgaaaaattgttatggagttaattaatacatgtcgatgtcatttgccgcaatgtattttaattacgtatttttattagtaagatgaataatcaaacatatgctcaaaagtcaatagcgaaaaagtaatataaaaatatttagggggtaccctaggtaaaaaaataaaagtggggtgaatgggaatagaaaaaagagtaaatttcacaaaactacacattttatggtccaagttaacaggatgccacgtcctcatcctaggtggaacaaccatgttatctcacaggtgaatccattcattgatagtgtggttttgtgaaactacactaccaaaatatatgtacttgagtgccaattgttaaagtgtgtgtggttttctgtaatttggtccacaaaacgtgcaaggagaggagaggaagggaggttttaatctaatctaatggtgcaaaataatggatccactagtttaaatgaaaattgagggctagatgtttcccgtctattaaaacgccacgtggcggtttaggagtgtttgtaggaagtttaacggactttagtatataataatagatagatttaactaaatttatttatatttgtgaagttataaattttattttttatattgtagaaatcatattttaaagaccattgatttttatggatgtatgttttttttgtctttttctatgacaaaatttctctcggtttagcgttaaccagcgatgaaccaatttgtgagaaggattgctacacgtgctgatgtgcatgcttgtttttcctcttaaacatgcatgtctttttcttccttcttataaagttttatctcaaattacttatccgatctataatccgattacaccattgtgttcgttacaattaaatcttcacaataagatcttacatgattatattacgatgaaaaaatatttatatttgtaaattacttttattatatgcataagttacttttatcatatatataagttacttttaagatttgactaagttaattcttagacatataaaagtaaattcaataaagtctaaaagtaatttacatatattataaaagtatcttaaaacaaaacggaaacatactattgcatttttcaagttgaaaggaaacactagatggagtacaaaacagctaccactagttgtgtagtcacgtccaatgaaaaaaagtcatgcattaaagttactttctttttgttataaatcacttctataatatatgtaaattacttttaagctttattgaatttacttttatatgtcgaagaagtaatttagtaaaatctaaaagtaatttacatatattataaaagtaatttataatttttcatcaaaatataatcatgtgagatcttcttataaagatttaattgttacgaacacaacggtgtaatcggatcgtagattggataaccagtttaatagaaaattttatttaaagtataggtagatagggtctctcatagatggggagtggtagctgatttagacaaaccagctatcactagctgtgtagtcacgtcatttttctatacatgtgcatttttttcttctacgaagaataggaaagctttatcattttgtttctagtcgcgtgggtttgtacgtacggaaagacaagaagtagtgcttgcatcgtgtagcgcttgtatgttataaacatgagaaaattattttttttaataataaatctaatctaatggtgtaaaataacggatccaccaatttaagtaaaaatcaacggtgagattatatagtgccatgtggcgacttaggagcatttgtaggggtacacgtggtggcttgagagcgtttgtaggaagtttaatagactttcagtatataatagatagatgggcatagtcttcaacttattacccaatgtgaacacctccaaacttatacaaacctgtgggctttggacatcaaaagatccaactatatccaccctgttagtgatctgtgttttctaatgcacttggatccgaagagacaaattaaacaccatgtgaacaacggacatacactatcccgctttaaatttgtttaactgcaacaattttacacgcggatgtgctctcttaattggatttcaatgagaatacgaatttgctgctagtctattacttcgagcgtatttatggatacgtaaagtttgttatctgtaattggaaaaaaaaaagcgtaggctagtgaaaaaaaatcatgttttaatgtaatccctccatcagtccactactggagaatgcatttattgggttagtcaaaatccacaatagtctcggcttgagcagtaaccgggagtaaagattcaaaagcccaagggtacttttggatctttagtccattggtaccaaccaggactaatgatcatttttagtcccggttcaaaaggttattagacgcgtgtcagttcctaaccatctttaatccctgttggtcaacattttaaaaaaattaaaaatagcgcatacttaactccttatgtttttttctctccctcagctttctccctctctccttatcttctgcctcaaccttctccatctctccttatcctttttctctcctcccctcttctcctgatccactcttccttgaccggggtggcggggggcggggggcggaaggcggcggccggcagcgctctcccctctcccggaggagaggcggcaagcagttgtgtcaggggaggcagcagcagcgagcgggaggcggcggccagcggccggtgtcgccctcccctctgccggaggggagccggcaggcggctgcgtcggggtgtgggaggcggaggtgtcgggggaggcgatggtggcgtgcggcggtaggcattgacgggcgggaggcagctgagttgccatcagcgtcgcgcccttgtcctcgccgggagggaggagcgccgggcccgggccagcgacagcgcggaggaacagagcggcgagcgcgaccggcaggagctctaaagaaagagatctctttctttttttgttattctcttctccgatgaacgcgtgtagttgtgaagaagtgtaactgtgaattagttttgaagaatatggatgattttgttgttattgttgttgtgaagtggtgtagctatgaattagttttgaagaacatggatgattttgttgttgaatttgttcattcgatctgtgatgatttgggtaatatgcaaatagcaaaaaaacaatgaaagaaaaagaaaaaaaaacctttagtcccgctaaagatggtggcgccactaacctagttatttcaaccatctttagtcccgagtttagggtcccgatttacaacccgggactaaagaaggttgcaaatcggaactaaagagggtttctccaccagtggtccatcctatatagagagagtccatttctagcctcttggtgggcagattagaggtaaagttaaaattcatgagaagatagcattataaattagtttgcggtggtggatactgaaaagataaacttcttaatttgtgagtcgagagagcatgtagaaaattattaagaagtatttttatttataaagcataatgtagaaattaatttattttataaagttttactgttataaattgaccaaatccattcttaaataattaagatcatctgcttctgaaaaagacatgaaataattagataacccccctctttctctctccatttgctgagaagctgtggacccccgtttttataataggaatcaatcgtgtaaacaataccatttccctggatcaagtagtctggtacacacgaattcatagctgaaataccaagtgcacatacacgagtgtctagtacgaattattacatcataagcccgcatgcatagtcttaaatcatcggaccgagcggtccggaatacattccaaaaatagaagtaggtaaggcagtggagttaaggcagcggcacgccattgccacaggcaacgaccgtaattaagacctactgagcgccatcgtcttcatcaccctcctggtaataggcatagggatcctccgaagcttcatctccggcctcttattaagtttgtatattgcaagggtgagtaccaaccatacttagcaagccaccatagcaataatgcatatcataggggtattcaaaggatggatacggttcttttgcgcaaagcaagttttgtaattcttttcacaagcctaagacctagcacagactgatcaaattttagtaccagtgttcatattaaacaatgacggttctgtccaccatccattgtgatcccaaggatagcttcccgccattgagtcgtcatggttttctgaggacgtccaccttcctgcctctcaagaagtggctccatcagtatagaaatcatcatgcaatatcccatcccacacaagttaagaatttagagtctagccaagtgtaatacatgtcccggtgctcaataaccgcgagcacggctattcgaatagatttggtttactcacactgcaggggatgtacactttacccacactccgcgactgcccaacacatgagcctcgtcccaacacatgagacgcgtcacggcaaagcttttcgataacctcgcattggcagtacccgctccatgaactttacatcctcatgcactctaggcgtacacggtttctagcagtgagaggagttctggcgcacccgggaaggaaagactcacacatgcattaagttataactaggtttaaattctcacatggcagtcctaccgatggcgacaccactgtagacacccgcctcgcggttctaccaatggctgccccaccgtagagcccctgtctcacacatcaagaaaccactatgcatggatactgcctccgctcagctatctattccgctaggtctatacccatacgagaagtgcggttgtacgagggtcatttcatgcttaacttcatggctcggtccttaattgaccggggacggtactagccttttccggataccacccaaatcctccgtccgccccagtcaaaaacagttgtttaattttatttctcctttcacaaattatgtcatcaacatcatggcaatgtggcgctcatgtctccacatgccgcatctcaattaccttcccaaaggtaattgcccaagcatatagcatttgataaatatgagtatgcatgattctagagtggcatctctaagcatttgtcatagttgactagggactcatacgtaatcatggttacaagggaataagggtaaacaataatcaaggtatggcatattcacaaataggatgttcatcattgcatacaattttatttgtaaacaaaataatttcgcaattgggatcaacatgttcaaagaatagtgatgatttgccttgctcaaattcttgcgggtcttggccttcacttggatccgcaattccctcgggctctatagttacgtgcgaaaattgatttgaattcggttagaattcaaataaaaatccaaataaatccaaatggaagtcgaatgcgaaagttgattcttttttattaactttactattcgcgaactagggcaaacccaatttcgatttatacatcctaaactatttttgcgggcataaatattttgttaccataagtttttaatttaatctacccgagcattatatccatataataggttagaaatttctatcgcgagctaaatatcggacaaaatcctaaaattatcttataatattgtatgatttaatttagtctatgactaaacgattaaatataatacacggctaaaattcctagtaattaaatccgaattcctactgtgaatcgatgactatagagattaccaaaaataatctataataatctataagaattcatctaattgtttagttattaattacatctaaattactaccaattttaatctaatccgatcaagaaacatatttctataattaacccagaattttgatcgaaatactattacactctaggaatttccaaaaataatctatgattaaccccgaccatttttatttcctaaatcctcctaatctctcccctaatttctcttctattttcaccttttattcttttcaattttcctctctttctctttctctcttttattttctttttctttctctttttctcttttcttttctttttctttctctttctctcctttcttttctttttccttctctttctctccctcccgggttctctccttctttctttcttctttctctccctcggcttctcccttgctctctctctcggctctctctctctctcttcctaccca

SEQ ID NO: 62585 - DNA, 24579 bp, Oryza sativa
tcgttgttttttttcccactcaaatttgcccgatccgtgtgtgtgcccgatctacccgaacggggggaatgaaggcccggcatgttgttccagtggcgcgatctgaagtgtgtgtgtgtgtgtgtgtgtgtgtgtgtgtgtgtgtgtgtgttttctcgatgtggtgtgtgtatttagtggggatgggggttgtgatctgatgcggttcggtttcgctgtttggggggaatgctcatcgagagggattgggttgatggtgtcaggtagatctggatcagcttagccgattgggttgtgtgcgtgctggaaatttaggtagggatgtgagctgcttgggttgtgtgcatgctggaaatataggtagggatgtgatctgcgaagcctcgtgaatcacacctgcgtttttggccgggttggtggtggagatgggcttggatcgcatgggtgctacctatgttgaattctgcgcgcccacgtgaaactttgattcgtacggtagttaattttcctttttcgttttgcttatagttcctgttccgttcgtgtgctgaccatgctacgatttaggcaagtttttttttgggtagcaactaattttgttgctggtgatgaagccttgtcagatgctgagcgatagtgcggagtatctgagttgtagtgattggatcatcggagttactgggcaaccgcaagggtcagcattccttggtgatagaatttgtgttgtatgcttttagacaaccgtatgtgtaatctgtatttctgttctcttgaatgagagaagggaagggaaggttattttcctttcagtagagtgaccagtgaatatgatggagtgaggagggaaatgtttacttatcgcgtcacggctatcttgtcccaattgtggttctttgtgagtcacagtgctagttttgtttattagggtgcagctatgctaccagataccagcaggacacaacataccacaataagctactttgtaaaatgcatcacattgaacacctaatgccatgccatccttatttgatgtgcttaatgttctaaaagtcagccctaggcatggcgtgctaggagctatgtgccatgtcgcagctgtgattttgcatttggtggtgcaccttccttgggggctctagtgctgatattttaattgtctttatttatgtgatatgtttgctaattgctaggaaacctcttgtcaagttgatcttaggcggggttaggtgtctgtaggtgctaaccttgctgaccacctagtcaccttattgaacattgtatgcgctatgatagccagcaatgttgtgactggcttgtgtgcacctgtggtttagtgtacacctcaccgccttggctgcacagcatgactcattagttatggtgcacatgccccaaaccgatgttcgtactttcctcacaggcctagatttgtgtgtggttatttggtttctgtttgtgtgatttgcatgcatgatttcagggagttacactcgggcagggatttggatgtgggatttaatgcctatttggtttgtgggtaggcgtaggccctctttgtttaggcttataagcctacttataagtcgaaaagtctaagtcaaaacaaacaagcagctttttcatttggcttttttgaagccataagccactctaacactattaagccaaaagctaggttggagaagcttttttggcttatatgagatagatgtatgactccaccactaaacttaggacattaaatccactggcttataaatcatataagccaataagctgacttaaaagtctaggccaataagcctaagcctaaacaaagagggccgtagtgtgattgcataattccctaggtcatggtttaacttgaactttgtatcacagtgtggagatatattcgttttgatgtatagatcatgatatggtaatctgtgtgccttttctgtctgaaccatattgaatatcccctgtgtcccaaaatataagcatttctggagttctgcatggtgattaaggaagtaggtggaattaaatgggagatggttttcatttgttgagatgaggaccttgctgtcatcccagtctcagctggagaaattaaacggtagatggttgtgatttgttgagataagggagtagctgaagttgctatattttggcacggagggagttactaagtggagaaaagaggtatggacttggcttgcatataattgatttactagggtagtgttcttgttttcgtttccaggtaagtggggtcattctggcacataatgttttcagtgaattttgcctgatttcttatcatgtgtggtcacatttcttaattccgaaaaacatattataaccaattgcccttgcatatgatgaatatgatcttactggatgtgtgttcatttatgctgtgatgtttactgattccttttacatatctgaagggacatgggaatggaggttgttggaactgaggctgcaccagcagaggttaaagtaactgatggagaagtgaaccttttccaagagaatgaaagtaaagcaactgccaaggaacgtgaggaggcggttctttttggttcagataacagcacagctacagcaaatggagccgcaaatggcgctgattttgcacccccaaggatgcagaggaggactggcctgaagctaggaaaacacatagcttcttttttgtcaagatccgcttacttgatgacttttttctttttatgaacattgatcacgcggggaaggagttccagaagaagattcaagctcgttctcaaatttttgaggctataaaagccaagaaggtatggtcctagttcttacagttctagtacatataaatatggtcaatcttgtttaaattttatcctaaatcagcaagaagttatattccttacaacttgtttaaaacgactgtcatctgctattgatgctagagcctagaatatgttgccaatttgagcagactacgaaattttggtgatatgtctgattttggaacttaatctgcagaatgagcgcttcggtattatctcagagctgaagccattggctgctgagaacaagcaatacaacgaagccgtaagtgagaagttgaaggcgatagaacctcttagaaaccgtttaggaaagttccgcgatgaaaacaatgctatccgggcacagggtgcaggcatatgttcttcaattgaagagcttgagaaatcggtatggcagtacggttaacctatgataatttatttttctgttcttcagtccaatatttgattacatgtttgtgccttctccattgctttgtcctattagatcaagagattgaacgaccgcatatctcatgagagcatacccttggatgaggagaagcggttgatcaaacagattagagagcttgaaaagaccagaccgaaagtcatctccacttctgctaaccgagctcaaatccaagatacagtggtcgaaagagacgccatacaggatcaggttaaagtaagtatatacaactaaatatttgtttgtgcatttatcttcttgaaaaaaaaatagaattaataatggccaaacattgtttgcaactgttacttcagatcatcggggagggcattgatggagtaaagaaggagcgacaagcagtcaggtctaaaattaaggtcctggaggatgagctaaaggctattgacatggagatgggttcgcttcaagaagatttaactgctgccaatgccagaaaggacaaggcacatgaatcattggtccaattgagacatgcacgagatgcctatgtaagtcaatgtgtctttaatgtctttcatgcggggcatcatgttttctcttctaatactatctacctggtatgcctggactaagaaggagcaacacctaattttttaaagttacttcagttgtgttgcacacagtgttacgggacacacgggtccaaagtttttgacatatcaacttgtttctttttgccaacatgtctctgactcgactcgactggtggtgcatcttccagcagagtgtaactggtagtcaaggcagaaacgcattgctttgttggggaggggaaagaaaaggcattggggatagaataatcaataagtgtgaaaatgaagtctgtctaggttgtttttttttgtcagcggccaactttctatcctctctagagacttttttgtggataagtggatggaacagttataaatgtcctgggctcctggtatggataaacagactagataattttctgtgtgctagaaaagcctagaatgatgtaccccctttcgtcccaaaacagtcccaaaatatagctacttgtcaccacctactcccccatatcaaccaattccatctctcatttaatctctaccatccctcttctcaaccaagcacaaccacccccatttaatttcacttctctccttaatcatcgtgaaaattccagaaagtgcttatattttgggacaaggggagtagaacatatgctgcgtacaagagattttgtgaaatgcttaagtccttataacagaattaattatattaggtgaatccttgactatttagcatttgctaaatcagatacctgaaaatccatgacggatacggattcctatgtctatgtgccggtaacactggatttacagttctcagcaaatacatatatttgcatgtcttcacataacctcagttacacgtccttgagctgtaagacagattaatttttgttttccccccaagtttggtgcttttctatgtatatactgacactataattaccaatcgaatttccttcatgattcattgatacctctgcataagggtaacctgttaacatgtggtgatgaaacatgtttttagtaattaattgtctcatagttactactccctccattccaaattgatctacatatttcataggtacaccaagaccaataaaagctaataactctctcatactatatttactctagcaacaaactcgatgtatgcaccatccccactatctcctagccaatagcaaatcaagatattgcatgtgggttataaatacttgtgtgcatggatgtatgcatcaatgtccatttactccaatgcacaaataacgaatagacttaatttatgaacacaaatatgtagatcatttaggaataacctcaaaaaaactatatgtagatcaatttggaatggagggagtatatattagcatgcttaagctagctgcttttgactttgaggatgtggagttcatttgtctttctactgatacctcttatgctcccatgtttatctagaacgcatcattccatcaaaaccgccaacttctgagcaaagctagggatcttgcttctaggagtgagcttgcacaagtgcaagagctctacaagacacaggtgtgtgcgcctctggagcattgttttaataactgttcatcttttacgacttaacaaaaatgtcctaactaaacttctgttgtactctttataggttgacaaattcgtggcagaatggtgcaacagcaaggccttcagagaggactacgagaaaaggatcctctcctccctcaacagtcgacagcttagccgagatggccggatgaggaatcctgatgagaaacccatatttattgaaacagaggcagcagcaccacctgtagaacaagagcctatccaatcaaaaatgcctgcaaaacaagccaaggaagcgcctgctccccaagcagaggtttctcccaaagatgagtcccgcgtgaaagcaatagctaagccatctaaggctaaatcctctctggatgctgatgatgactatgaggccgagtctcccaaggagaagccaaagcctaaagaggttgatgtagctaagttgaaagagatcaagagacaggaggagatggagaagaatagacttgccctggaaaggaagaagaagctggccgagaagcaagcagcgaaggcagcagcccgtgcacaaaaggaggcagagaagaaactcaaggtagacaagtcgtcgtcatcatcatccctcttcctcgctgccacattgtaaccatgtttatctctctcgctttgccacattgtaaccacgtcaatgtacttattttcagagagaggagatgagggccaggaggagggctggggcagctgacaccgaggcgtccactgaatcggacaacaggtctgatggagcagcggaggcacaagcagaggacgactccgctcctgcttctgctccggtgatgagagaacagagggagagtgtccggtacagcagaaacgtcgtgaccaagagcaaggccccgctgccgaaggcgatcctgaggaggaagaaagcccagtcgtactggtcctgggctggccctgctgctgcagtggccgccgcgctcgtcgccctgcttgccgtgctaggctactaccagtactacctcccagcgagcgctagcaactgatggaaggaaagcaggcagcccccccttgagaattgcttacttgaacaattttgcaggtgagaaacagagtgcgtggtctgctgagacgtggactgaaagactggagatttgttcgttttcgttctgttagtttgatgatcggtggataagagtaaggaaaaaaaaaggatagaagttaattttggttgggacttagaatctcctatatactgcgagtgatctcatgtactcttaaactgaagcataggttgccgttctgaaataaacaatgccgcatgctttaggtttacttatctgttcctatgagccagatgaattgctgtgttgttccgttttgttccatgagcaatcgatgatcgtcatttgcatgctgcttgcggatgtgggcgagctaatgtcagtgtgtagcgtgggtttacaaatccccaaatctgtctgtatcgctctaaggccccgtttagttttccaaattttttccctaaaaccatcgtatcgaatctttagacatatgcatgaagcattaaatatagataaatgaaaaaactaattgcacagttaattagtccatgaagaaggaaatcgcgagacgaattttttgagtctaattagtctatgactagccataaatgctacagtaactcacatgtgctagtcctgcggtttccaggtgagttatattttttcattcgtgtccaaaaaacccttccgacatccggtcaaacatccgatatgacacataaaaattttcttttcatgaactaaacaggccctaaatcctgggcggggttcgcaaaattgtctcgtcacaaaaaccgcttcccagcagtttcatcgagaattgtgattgacaaaaaaaaaagttcgcataaattaacacttatgaaattataatggcatgattctaaatagttaaatagtaatgatatatttttaaaccgtaaaatttataatgacgtaaatccaactaaccctacaattgtacacccagcacttcagcacaagtctcttactttttggtgctcaaaagatttagtaaaattcaacaataacatggaataattttattttaagtttatatttcgggttgtttgtgtaaaggcaaagacccgtagattacgcatgtgcaaagattttatggaggttcaaacgctcctttagataaatagccttaagcctgttggtttgtatatattagttcaaaattcatgatatataaataaagccagctatatattgtgttgttacggagcgagttttcccattgacctaagggagtccttcaatagttgagcaaagaagttcaggtacgtgttttaatgcttcatggaagaaccaacaaggagatctagacatcacttctgattgggattaaggtaatgagccctatctgatgtcagtggggattgtttacagtaccgcagcaaacactgacgtatgggtctggacccatatgttagccaccgctactgcatcagcagtattgcagagaatttgcatcagcagtactgcatcagcagtattacagatgggggtgcacaaagccgggtcagtttacccaactaccttcctcctcttaactataacttatattcaatttatgtctctcgaaaatagatatgaacatacttttttaaaaaataatactacatattgtgaatttgtgatccttacctttacatttgagttatgacgaacaactttatcgattatataaaagaaaggatgacttcttatccaaacaaatcctatagtaatgtctttttaactttcagtgactaacatataaaccatcaaacgagtccatattaaaggataatactacgaagaattgtcatcccacatttttacactgccactatcagttaaaactgaaaaccagctcaccccaagctcaccaagaatcttcgagaaacttataaactccgccgaaaaatctcggacaaacccgcggcttcacacgcctccacgcacccaaaccccaccctagaatatcctctccttggccaccgcgccgccacatcagcctccccaatctccccgccccacgcgcgagcgccaatcgcgagccgcctttagatttcccaagataaggactcgatcccccctcacttcccgcgctatttaaactcccgcgccatctccaactcccaactcacactcgctcgctcatcgccatctctctcagctctcacagctcactgcatcaatggccgcggccaccatggcgctctcctccccggtgatggcccgcgcggcgccgtcgacctcctccgcgctcttcggcgaggcgcggatcaccatgcgcaagaccgccgcgaagcccaagccggcggcgtcgtcggggagcccgtggtacggcgccgaccgcgtcctctacctcggcccgctctccggcgagccgccgagctacctcaccggcgagttcccgggcgactacgggtgggacaccgcggggctctccgccgacccggagacgttcgccaagaaccgggagctggaggtgatccactcccggtgggcgatgctgggcgcgctcggctgcgtcttcccggagctcctcgcccggaacggcgtcaagttcggcgaggccgtgtggttcaaggcgggctcgcagatcttcagcgagggcgggctcgactacctcggcaacccgagcctgatccacgcgcagagcatcctcgccatctgggcggtgcaggtggtgctcatgggcgccgtcgaggggtaccgcatcgccggcgggccgctcggcgaggtcgtcgacccgctctaccccggcggcgccttcgacccgctcggcctcgccgatgaccccgaggcgttcgcggagctcaaggtgaaggagatcaagaacggccgcctcgccatgttctccatgttcggcttcttcgtccaggccatcgtcaccggcaagggccccctcgagaacctcgccgaccacctcgccgaccccgtcaacaacaacgcctgggcgtacgccaccaacttcgtccccggcaagtgaagtgggggaccgtagcttagcagtggttaattgtggttggatggatttgtggccagcgagttcgttgtctttgggttggggaagatgggtttagtgcgacgagatgatgatcgagttggtgttgtgtacactaagaagatgaagaagaagatgatgtttttgcaataatgattttattcgtttcccaactaatggtctaggtacttatccgtggtgttattctgattagcggatttctcatctctattagatcggaaacaaatactccctcgatcccaaaatataaccatttctggctatgtatagtgtaaatatgtagtctaaattgtttatattgtggcatggaaggattaattagtgctttaaatttacgtatacaatagattgggtcgaatctacgaagataatggatcctctgatttagtgggttaaaatccaaagcgtttggtcttaaaaaaaaaatccgaagcgcacaataaaatgagtctgctgctacaatatacaacttgttcatattatagcatttcacagtaaaccacgagtggggctgctatacaacggaatcccgttctaataggatgatatcagttaggtatcagggtcctgatacctacctctgagatatcatgtcttgaaacctaaccggtatcaagtgatatctatcagatatcagacgatacttatcatgattcctactacgtattaggtgatacttatcaggtatcagatgatttccaccacatgtcgaatgatacttgcaaggtatcggatgatacctagctaccaaatatcaagtgattcctactaggtattaggagtcgagcactgatgcgtcatcggcagtggccccaccctccacaccccatgctggagcttgtcgccggcggtcgcatccttcgtagtccatgccccacgtcggaggtcatcgtcgggggctgcatcctctaacatccacgtgcctcatgtcaaagctcatcgccagcggccatgtcttccatattgagtaggtcctccactatccacgcgccacatcagagctcatcgccagctgctgccgcgagcacgtcctccaccgtccacgtcacaccggagctcgtcgccggtggctttgtcatcctcgctccacatttgtccgacaactgctccatcccggccgttgtcgcagcccatgtccaccggcttcgactccgcgttcgaccactccggcaacaactccatccctgccgcagctcatgtccgctggctcagactccatgtcggaccactctagctacagttccatccccgtcgtagcccacatccgccggctccatcttggcgcccggacattcaggcgacaactctgtctcggttgccgccatagcacatatccgctggctcttggcaacgtatacttattgtattgttgttcgatgaactactcgtgacaacaacaaactactgagttttgtaaaatctgctcaaacagtacataacacgatttaaggctatataaattttagcaaccgtcgatggttgacaactataaggtagaaacgttgatgacgtgcgcatcgtcacaccgtaccaaccgagccaacgctagagctaacagagggcagttgtcttcaccgtgaagagatcaccgaaaaccaggaaaaaaattaacgttattggcaatgcaaggaaaaaaaaaacaattttcttgtccgagctcgatctgccaccgcgttcttcactatcaccaaaaatcttgtaaaaaggttgttatcagtagaaaaaaaaattcttccgctgtccgagctcaacgtcgtcgtctctgccttcgccactggtcgctcgtacgggtggatgcattgcatggtggccacttgtacatgtcagtttcagcacacgcacccatgccaataatcccgacaattagcctctcaacgttcgaaaaccagccgagtcgagtcgagcccactttggcaccttgcttccaccacacacacacacacacacacaaacaaccaaacaaacccaaaaaaaaaaaacagagagagagagagagagagaccatggtaacacagccaaacaggccacgttactactagtagtaggtaccaaccggcccagcagaaatatctcccggaatccaccggcggagaacgtgacactccctcggcgtctactgaaattcaccgcgaaaaactaggcaaaaatccggtcgccgctcgctaggcgcttggctccggctctggcgccgatcgatcgagagctccgatcctagccaatgcgaggccacgtcagccgcctcatcattcacaaaaaaaaaaaaagaaaaaaaaagaaaagaagagtaaaccgtactttgcacaggcagattgtgtcttgtttcactttgcatcaggtttaccatataattttactttacatcaggctggattgaaataagttcataaaattgaaggaaaatcttgtgaaatccaaatgaaacctttttgaatttagatcgaagtttcattcaaatctcaaataaattatgtacgtttgatgatgtatcctagagtaaagttaaagtacgtgctaaacctggtgtaaagtgaaagatacaatccaccagacatagagtgcaatttactcaaaaaatatttcagcaaaacaaatattttttttataaaagtgtatttacataattggcaagggggatatcaagtaccagaagcacatatagtgtgatggtaaagcatgcacagttgcgagaatgagagggtgcatgactatgcccatcagtacttaaaatcctgatacgaacaaatattatgcccgtgctgcattaccacgcttttcatagaattttagtagtgaggtaagtaattgactcttatctcgctctctttaagcgtgcgttagaaaacatgctcagaagaactagagaagaagtgagaagaggatataaaaaagaaggatgaaatgtgggctgcagattgaacctgctcactacaacaagcagttttcctataggctcgttcctagtttgtactgcttccatcccataatttggacaggatatgtcacatcctattctaggttgctagggccaaagggagtagttacgagtaccagcttgcaatggagtttgtaaaagtttgtgcacaaacacttgtccagcttactgaaaaggcctgaaactattgcccatcgaacagagtaaacctgaaattcagtaacctcataattttcacaagttagttcagctagtcctcagttcacatactctattctgtagctcattgaacaatgctaaagattctgcccatagcttcttggccacttcaacgttgtatgacaactgagaagacgttatggtccttcctttccctccaaagaaatactttccagatgagtcctaaagcccaatgtaaaaattcatcccgaaggttaaccggagaatacagtacatcatgttgttatttataatgtaattgtttgctaggattgaacaggaagcttacaggtggtgccaaagcggcatcaaggacagcatcaactcccgtatcaggttgttgtaggagattcaggaggcgcagaacagaaagcgcaagccaagaaagacatggaggaagctcccgcattatgcctgtctgtactacacctggatccgcagccctgggagcatgaaatgtcatacttcatatgaatagtaagcaacttcaatttcgaactggtaaaataagttgcattctcataaaaaaaaataaagggttggcatgaatcacaatagttttgataaactgccaagagcgtaatgtttgtcagtggcattgagatgagccatcctaatctatccttgcacttgcacaggaaacctatgaagcaatcaagtatattcttcaatgatttcaatatagtttcagtagaggttgacttggtgactactggacagaagttcttgtaaaattttaatcatctaaatgaaaaaaaaaatcacttccatcagcaataatttggatttgttcaacaaagaaaatatgcaaaagaaaaaaaaatgcatgcaaccaaaatcgatggcacatacatgacggagacaccagaagataagtgaagttgtcgatgaagctcgtatgagaacatcagtaaacaaactggaataagagaaagtgagcccaaaggaaataaagttgcattaagcctattcaaaaataaaagtgacgtacatttggtatactcataagtagaagctaagagatagcttctcctcgctggccaatgaccaaaccttactccgctcaatcctttctcagacaagttaatttctgacactggagatgtgaaatttgcaaatattaaccaaaatataataaccaaaccacatgtctagttctcatggagaaagaaaggaagcagatataataatggtaggatctgtctgaaatgcaacttaatattttgatatatcatcaattttgagctactataagagcatatgccaaacgcaagcaatttgcaaacatatgtactgattcaaaagtgtggcagagaaacgtctgtccgacaagatttcaaaaaatgcaatttacagcaaacaagatctgcgtagcaagggaaaaataattggacaaattgatgccaattaatgtatatgcaattaaaattattttcaatctaatccagatacaattcacatagttttcttgctatttataatagaagacttgacacttaccacatctgtgtgtgaaagacgttagattaaccacccgagaaggtgttgagctgttcttgagcaatggtaacagaatgttggtcaggacaaatggaccaatgtagtttgcctgaatcattctggaaatcgtgtgtggtaagtttcactcaaacagtagattaaaaaatgtaataatgacataagtaaagcatgtataagaagaacattagaatttcttctgcaaaagtactttcaacataaacacctactcatcaagaccgtcctctgtaattcgatatgactttgctaggatcccagcgttattgaccaaaagctgaatagagtgctccatatttgagtccttgatccactgattcagtgaagtttcaaacttctttattgacttgtaggatgacaagtcgatttgaaatgcttcaagatgggcatcaggttgttgatcccgaatttgttgaacagtctgttttgcacacatcaccacaatgatgacaatgggtaaatgataagataagacatctagctaaaagctccaaataatacctcagataacaattgtgaagaacgcccagctgacacaaaatagaatgcatatagtgttttagtccaataataccaagcgaccaacaaggttgaatcaattcaacaacaaaatcaaggaatactttctactccaaaactatagcaattggcaagtaggaaacaagtcaatatgaaatgaagtaacatctacaattgtagatgcaaaagaagaccaactaaccataggacaagtaatgaacattttaccaaaagattgcatacacatttgcgtattcaacaaatgaaaagacgcactacttttggattggaaaggacctaattaatgaagaacaagagcataagcttctacaggttcaatacttcacgaaatcaagcaacagcaaggaaattagtgctacaacaaccccatgatttggaccgttggcaatgctcgagtcaacaaccaaagatgcacacagggtgttcgatgaaatgcccacacaagcaccgaaaaagaaacaggcgacccaccgaggatgacgtggtacccctcccgcgccagcgccgccgccgtcgttttgcccagccccgacgtcgtctgcacacgcatacacacacacacaccccacccaccatgagctgagcacatcacaagacggggagactcgaaagagagagagaagcgactccatctgcaagcaagcaagcaagaaagagcggaggcgagagccatcggttaccccagtaatcacgcagacggggcggcggcggcggcgacgagcggcgtcgtcgtcgggctcgggcataggtcggaggcgagggacgggggcgccgcggcggaggaagaagaggaggatgtaggagtagaggagggagacggtccacaggacggccattcgccagaactcccgcgagcacaccatgcggagcgcttcgcggtccatggccgccggcggcggctgctcggcgagttgtcaagttgccaccgggaaagaggggccacaacggacggttcggattaggggagaaaattgagattgtgccgtcttcaaaagggtttcgctttcgctcaaatgccatgctgaaaataggattagttaattaaaatgccacttttaactgaaggttgcacgctataatattcaaactgacaaaaatattctgttgctatcttttttccgcctttatcgtcgacgacgcactgccgcaagctgatggggccgccttcgtctccaccttcaccactcccaaggcgcatagctaccgctccctacggcaggggaaccggatccgtccaccggcctcagccgcctccgccttcactaagcccaccaccaccgccgttcgggaagaaaagggaagaaagaagatggtagctggcatgtaagtcccacatttttttttctaacgacctagctatgggatctaaattgcatagtttgtatagctacgggtgaagatttatggaatcaaggatacgggtgaacttatttcaagtagctaatacgtgatggtttgatgggctttccatggctggtagtacttcggctgtttttaatgggcttttgacatttaaaagctagtggactgcctccctttgctcaatacttcaggggcccgcgagtgaagatgccaccctagccctggccccgcacgatccgcggatagatatttggccccggccccatagggggtggggaacttcggatccgacagggtaattgccatccctaggcgagatctgacggtagagaaagttggacttaagaaattaataggacacaactacgaaactactagtcgttggtttgttttagagcagtgaccacaccatctcaagtataaatccccttttagcttaaaagaaatacaattgtgcatatcttttgttaaccttttcaatgacttaaatcttttaaatcacatattatttttaagatatatttgcatccgtgtactccactcaaaatatttgacaaaagagatccatgttgaatatattcaaacatcttattaatttaaaagcattttatttaaattgtagaagtaacttagctatgcaatagaagtaactcgctatagcattagaagtaattacattatgagtgagtgaaattagaagttatgtggagtaaattcaaaagcaaagtttagagaagatttttaagtaaatacatttatcaaagtaaattcaataaatcctgaaagtaattcacataaatcataaaagtaacttagtaaaaaatggaagtaagttgttatgaaattagaattaaatccgttgtagggaaaaaattatgatctatccagaaatcataattagcacaaattatagaattgactaaaaacaataataataagtgtaatcaactcaaagcattataaatatattagaagtaatttaatcaaatctaaaagtaatttttatatatgataaaagtaacttacgtatataataaaagtaattcataacataaatgttttttcatcatgatataatcatataagaccttcttataaagatttaattacaatgaacgtaatgttgtagctggatcatagatcaaataaataatttaagagaattttctaagaagaaaaaaagcacgcataacctaatagaaaaaaaaacttgcatgtctgtagacgtgtagtagtacttctctcacatatggctggcgtcgctcgttaagcctaaatcgagaggcccctcgaagtagattttgtgaaattaataaccatgtgtttggtttggaatgggataagttaggtcatcataggttgcccatatttcctaataagacaaaaacggtttattaggaaataaaaattaatttgcagttaaaacttttatgtgtttttagtgataagtcaatgctgaaaaagaagctatgtgataatatcctaaaatcaacttgaaattaaatttgaaattcaaattttgccttttttttttcctttggtttattagagcaaccaatggggtatttaggtaaggatgaatttttttatggcgtttgattcgggacagataaggtgggatgatcactaaaaggaaaatattattccctcaaaatctaggttagctccatacgactaatcaatttaacacacttgctctttatcattagcatacaaaccacacccttttacagcatttcttaagaaatatgacaattttatctctcatgccaaaaaacacatgaatactacgatctttctctacctctcactgtgggatttttcttctttctttttttgttgccgatacttttattttattattgtcctttttgggttgttgtggataggaaaaagagaaagatgaggtggattcgcgaaagggcctgtagcctagtggttacaagagcctcagtaacacctgaggtcctgggttcaacttcccatgggagtgaattttccaggatttaacggcgttgtgctttcagtagtaggcgacgtacccgtcgacagcgagcggtagggtttacgtgcgtgtgttcacaggggtgagtgcgcgtgcgttgtactgtgtaattcgtgtaattcttaaaaaagaaagatgaggtggattcatcattttataggccacatttcctacccatttgtacagtttctcttccttttttcttgttggccacatttcctaaggagatactccctccgtttcacaatgcaagtcattctaatattttctatatccatattgatgttaatgaatcttttagatgttaatgaatctttcattagaatgacttgcattgtgaaacggatgaagtatcaggaggaagaaaaaaaatcctctttattcaggaggaagaaaaagaaaatcctccttgtaataagataaccaattcatgaactataaacctcccgtgcgaatgtcagagcttgttgatatgcatttgtcttcgcaaacacaaaaagaacatgacagctaaaaagcatatacgaacagtttgttccatctaaataataactaatgtacaaaacagctccttctatcgcccctgtttagaacaaagaaatgaaaaacacgagaatatggaaaaaaaatattgtaaagtgaaaaactatggaattcaaaactaacacaaaaacaggagatgtaggaaaatcccacggggaaacataactataggattttttttataaaattattttttggtagcatcatagaaaaagcataggaattaatagtcaaaaggaaaagaaaacatgaggtctagcctcatgttaattctccaaaatcagtatgaaatgagcaattcaatataaatgtaaaaaggattttgtagaaattattcctttgttccaaaggacaatgtaggaatatatttttttcaatggatttcaaatccctcaataatttctccagttttcttttgttccaacggagatcacatgaaaaacctaggagatcaacaaagtgacaggggtttcctttcgctcactccatagagtggaggattagcttcctttcccaaggaattcaacatcttccatttgtactgacttccaaacaagcttctagggaaaaaattccaaaggaatgcaaacctccagaattcctccaaatgtaccttgttccaaacgggaatgggtgatttcataacgcagatgaaaataacaagaatcattttactccagccgagaagataatgtaggacatggccgagcaaaaatgttccccacgaaaataacacgaatgcaggaaccagatgccttgcataatgatatactcaagtccaacgcagcaagtcacaccagtacaaaacttattcacaagatgggtatatctgttgcaaactacagctactggaaaaatacacacatgcagcggcaaaggtcagcaaaagaactggattagggtaaaacatataatcataataataaacaaatcgacctgtaagtaatcccccccccccaaaaaaaaaaggaaaaaagaaaaagaaaagagtaccagcatatttcttggcgccactgaacagcatgtgatagaagggccaagttgctgaattgaactcccccgttcaaatcaatcgcctcagataaggcaaactccgcagtggtagctttacaatggtagtgttcctcaaaggaggatgtgacaaaatcattccaaatcctgacttcctcagtgggtttcatgattttgtttccagaaaatgtacatcgagttcatcagatcttcttgggaagattataggttttctttaggaacttggtagccgtctcatcataacggtagcacagaactcgcaggactgtgttgggttcgttcgggctccagtgccctgttgttggtggcaatggtaacctattcttggctccagatcgattagactcagccatcatgcgtttgaatcggtcaataaggctctcggagtctgttcgtaggaggggtaggacattcttgacctgggaggatgccttatcgaccaattcctctggcaaaccatcaccatctgctaaaaacaggtctttaagggccttgaagtcatcctctattatctgggagtcttgacgggtgaaagcacgcaaaggcccaccagcaagaagcaccagcaagaacccatcaaaagtggctttcatcaatgcggttatagcacggttccgcactttgttatgcaccataccagatatggtctctagtatagggtcgagttctctcaacaatatctcgatcctacttgatgcaatgtcaccaatataaaggatatcccagagaacgtgccccaaatcatagaatgtcaccttatatgcagttgtctcacataactgctgaatgccctcttgacaggctgtctgacaaagctcaaatttgatgtccaatccatcggtaacatctgcctgagctgactcgacattccgcaagcctgtttttatcttcttctctaagttctcgagttcacctcgcacgaattgaagcgtattcaagcgtacacagagttgaggaagggctaagggatcagcgccattggttgttccattttgtgatcctcggtactgtggattctgtggcttttcctttttcttgaacaatatattcgatcctacctcgcatcgtgtcaacggaggtagttggggcataaaagaattccttgttcctgtaattaatgcatgtttaaaatatgaacatttgtaccctgcatctgaacaccatgttatagaaaaatgtgccatgagctcagtacttaccacagccagattttgctttagacacaaaaagctgtaggcttctatcaagtccaaacatcaggtcaggaagaagaactggatgcattggaatgggcaattggaaaaatgcatctaatgtttcaccaaccatccgaagcatctccacacaagagggagcaatattctctctgttggcagctggattccaagtctgcatgaaagacattgacagacttagtggaattttagaacaggaaaatcaagctaagttaattcaaacacaatatgtcaagaacaagttggactcatcattcaagaagaatattcaggacaattacatctcacaagttgactgagccaatctaacatttggtttacacatagcatgcatctggatgtgactcaactagctataattttttttccattctgaaaaactggtgtgatgtcaaaattttgactgcaaatcaaacaaatgcggcaattttggcagccatagttgggataagatgagagaatgaacatatatcagagcccagattggagattgcagtcatcaatgacacatggatatggacggttcaggaaaaatagcagataatgtttacaagtgttatgcatctacatgcacagagtaatttagtcttatcgtaataaaaatcacaacaacatgcatcatcagttactaaattaagatagtttctgtttataccaaaagaaaaaaatatgtactgtgaaataaagtaagagcacctcttgtttcaaagtccgatcaacccatcccttgagcctgtctatcctttctttaatccaaactttcaccaggttagcaattgcattttcagcttcatatggtggcatctctctgattaatgacttgcctccatcatcactatccacagaatcttcaactgcaatattaacaagatccttctctaatttatcagcagccttaagcacttgaaccgtatctggggtcagctctgtaagtccagctatgaactgtttcagctcatttccaaagcaagaatgaagggtggcaacagcaacgcctgaagcaaggggatgccatgtctttaaaattgggctgtacaaatttttctccttaattgctaggtcaccaatgtcctttgcaaggatagacagaacaggggtagggtttcttgatgaccgcttggaatctgcttcttccattctctgcaaagtgaaagctgtgtcacattactgtgctactgcactatagaaaagacgtacatgaaaggatcaactagcaagatttgaaaagttcaaattatatggttcaaaagaaacaaaattactaataggatggcttgagtttgaacaaaacagtttcttgtggttgattaccaggaatctactttctagcttttcttccccaaagcgcattagccattaaaagtaaagatattgcaataatctaaacaaggcatctcagcataccaaagtatggaatataacatttaatcaatatgaatcagagtgagaaataatagggacttacttgagcaaaagctgtacggagtgaagaccttatgtaggtctctatcctgctgcgagctacgtcagtctcttctttcctcctccgacggtattcatgggatatatcttcaacaagaacccttgcagctgacactccaattgacacaataccttgcatggactcaatgttacttgtattgaaggtctcatggtaagccagaagtcttttctctgtccaacccattattgagcttaaagttgaactcaacactttgctgtaatttggatcttttgtggttttggcatcctttgcaacttcggccaactgattctccgcagcagagagcaactcaatatctacttgcccggacataacaaaatggttgaacaatgcccaagcaaagcaaaggttgtgaagcatctggttaattcccagaataccccaggtcttctttaagagctccatcacctcatcaatctcatcaacaacagtgccatcatcattatcaaagcaagcttctaccaacatctggtatagatggagattcaaggggaaaccatcagcccagtggcatccgtcagaagtcccatcatcagacctaccagcaagggacatgacagcactacgtaggacctgcattgactcagagtttttcccagtttcaagtggtctatcgtatgctccacgtataatttgccgcagtcgttgtgcagaaacatctgatttgttcaatggaacaagtgggtgaacaagcaaaccagcctcaagaagcttcaagttcctactctgccatgcctcgtactcttgaggatcagggatatctgatgccttgaactgctgtaggaattctaagggcaagaccatagattcagcacgcctgccaagctgtttcaagaaaaagaaaaatggagttcaaacttggtaccaacaattacaggaacaggcgttaagtcccgaacaataatagagcagagtagagtatctttgatatgatatatacaataagatcatgtttggcttgttgacatcaaacatgctaaaagtccagaaaacacaaacacacattcagcaacatgtcaatacttagctatgtgtttgtttaaagtttaaactgtccaatgttgttgatctgttaacacatctatcaaacagaccatgtcataggagggtatataaaaacataaaacatatacaataaaaaaaataatcaggcagctaaagctaaactgccaaacttacaatggtcatctaaagcctgcaaatttgctcttttggggagaagacttggcaataaagatctaaatatcatcattcagcacagtttaactaagaaacctactgaagtggagatggcaatgaatcaaccattttcagaatgcatataagacaacttagagcatgaaggcaaggcaggaagcttaacactcagggtgtagatttaggatgttttggttatgacagagtagcttctgcaattaagataatccagcaattaagataatccagtagataccctcgctcctccctcctcccacactcagtacgctgcactcagcactaaaatcacaaattttacgacactttgtagaactatctttcttcaatactgcctctagtacatggatgcctctagtacattgctcatggatgactgcagtacattgccatatactgtttccattcctcaaaactgcggtaaaataaagatgtctttgttttgtagtgagcatgacaagaataaatggctaattgtccttttgtggagacacatccaatctacaaacttatgagcatgcataagtaaaatagcaaaaaacatttccgtcactttgtacttatcaaaaacagtccgatgataacattacgaacccatttcagacacaggaaaaatcatgtgtgaaatgaattaatctacggtgaaattgatataaaatccatgcattcgaacaaaacactaaattattgtccttgttgacattataagatatgctagcaacaaccatttggatgtgactctatcgagaagagttggtatgtatagctttgctttgtacaatgcatccgagtatcctactactgaagcaaaaccgcagatcaagctaagaatcatggtattgaaacagtcatagtaataataataaaaggcgcacataaaaattatcttgagaaaacgtatattgactaagttccaacttccgaggctatatgataaacaaatcacagaaaataactggatatactccggctgg

SEQ ID NO: 62586 - DNA, 15967 bp, Oryza sativa
agaacgcaccatgcttgtcacttttcctcttgttgtaaccaccaaatcacacaccaccaccatcacaaaccacaaattttcttttcctctttctttttcacccattggatttgttccgttttgatcatatcatcatccatgcatcatcatccatccatccatatgcatccttgtcacctcgcgcgttgtcgctggtgttgtagcagcagaggatgaatggttcgggtattgacttctgtccattaatgtaaagccttcaatgaacattcatttcggttataaatggaaagagaaaaaaacaaacagagagtgctggtaaagctggatgatgcgttcatgccccctgcttccctttttctggcccctgtttattactctactcctcctcctccctcctcttattacccatctaaccatacatttttcttcttaaaattatcacattatcactgcaaaccattttaaattttctctttttttctgaacggtgatatgtgtgattggatcattggagaaatgtgtgatatgaacggtggagatgagagggtatgtagggttttttttttcttgggcaggttcagtataagtgcggcattgaagcacggtagctgcggctgctggcgaaatgtttccagcgttttgatgaggggagccagggcgaggggcaggggcggctggctggctggctgggttggctgtggctggacgatcgatagaccgatcgatcgcctccggccccggcccgggaccaaataagtctcgacctactctagatcgcggcttaactaagtacaccagctcgagcttagcttgcacacgcgcacgcacacacacactacactacactctactctcactcactggccagccagctactgcctccgtcccggtttagttgtcgctttgactttttctttacaacgtttgattattcgttttatttgaaaaatgagtaaaaatataaaaaagaataagttatacttaaagtactattgataacaaagcaaatcacaaacaaaataaataataatttcataaatttttgaataagacgaatgatcaagagttacaaataaaaactcaaagcgatgagtattttgggacggggatagtacctagctagcttgtagctagtgtatctctgcaacatctccctgtctctgtctcttgctatagctaatgctaataataactgcaccacatcaagatcaaatcagaattgatcagaagaaggatgaagtgttttgttggagtggtagagacgatgtctggtcaaagattattggaggaaggagaggggggaagagatactagcttcatgtgtatatatggatagatatagtttggctaaatttgtgggttggagatatgggtttttgggagcgtttccggggaggtatcttttttgggggtttttgggttggtttttgcttggagaatatgtgtacgacagtattgaatgaggccttaaatttgccatactgttgcggcagcgtagagctcgtagttgtcattatccctgcccatcttttcagtgctttctggcccaaatttttgtccgtgttcttaaatgccccgcgaattgcacaacttgtatataggagtatgtatgtgtatgtagctagaacgttagtatatatacggaatgccataaaattaaaaggtgttctagctatctattagctgaaatttaaagtgtaccagtagtgtgtgctcgctcggctgctgctgctctatttccggtctaaatgcaatcctctcatcatttatttgccggtgttactatcaaaattaatcatgttttgttctcttgcccctgtcttttttatttatatatcttgaccattccttccttcctccttggaacgacgacgccataataattaactaattgattactagcttgtcatcatcgatgatcataaaagaaaatctaaggtagttacagcttcgttttttctaattaagatacaagtattaccgtggttttttgttagcacgtttccaaattactaaacgatgtatttcgtacgaaatatttctatatataatttgttttataatatcagataaatatatttttttaattttaaaataattaaaacttaattaatcatgtgctgatggttttctcattttacatgtctgcacttaatatttatctttagtgaactcaaactgggcttatagttgcattatgtcattgtgcgcgttgaacaagagagatcatcgagagagtagttaatggcgatgcgaaggcaagcatcggtcattcgaagctctccaactagaacactattcggcgacggcacggataacctaagcataaatgccgacgagcgaggcgctggcacgcgtggttgcatatacaaggacatgttggcctcgcgagaaatcgtcacgaaacggtggtggcgccaccggcacccgggcccacgggtcagcgaccgatcgatcgatcgcgacggtccggtgaggagtcggcccgtacactagaagctactccctccgtaaaaaaaaaagacaaaccgtatctaacattttaccatccgttttatttaaaaaaatatgaagaaaattaaaaaacaagtcataaagtattaatcatgttttatcatctaacaacaatgaagatactaattataaaaaaaattcatataagacgaacagtcaaatattggacacggaaacctaggatttatcgtttttttaaggacggtgggagtacaccgtgaccgccacctggggcccactcccagagaggaaatatatgcattggcctctcttcttttcttgcaaattgcaatgcccacacacacagctggttggtggcggcaggtacttgattacgcgaaaggaacgtacttggcccttaataagcacctagctagctggtcagcttacatctaagcatgtgaaattaaattagtccaactagtcaaatgtctcgtgcaatttgtgccgtttgaaatagtatattgtattttctatgcaaactatatgtatatgtctattaacatctctcattgtttgttcattagtttatcagccttcgctaaaatttgaattttaaaactttatttttagagttaattttgagttttttcaacatgttttttttacattgacttttaaaaccgctaataacacatatgtatattgtatacaacatcactaactcaccgtcattatctgaatctataaggctataataactattaaattgtgcaattcttactttctttttctccgattaacttagaacctcaaatgtagctttttttagcacccacttttttttagaattacacagtataacgcagacactcacaacgcacgcgcactcaccctacgcacgcaaaccctaccctatgagcatcttcgaagactgggccggcaaatcctggagagattgacgaagtcaccacaggtgcctcgctgtcgacgggtacgtcgcctactactgaaagcacaacgccgttaattcctggaaaattcgctcctatggggagtcgaacccaggacctcaggtgctactgagactcttgtaaccactaggctacaggccctttcgcgcatgcatgacattaattaaacatatatactgtcagttacaaatgttgattttttctaaaaaaaattgtggacgccttaatagtttaggacaccggggcatttcaaaagaaaatataaattgcacagtatgttttggtgctattggtttgggaatttcactgaatgttagatgatattgttctatacgtacattaactttcagaaaagttcattccctgttaatttgcacttggttggggcattatattctccgtttcctaaaaaagtattatttatttatggatccttgtattactaaagtgaaaacaggtaatacatgattccatattggccgggtaagagttcgtccattagtggttacaaatttacacaaaaaagataaaaatcattctctccatttgcataaagccattatttacgatcatatatagatctaacagttttaaattactcctttgatataaatacttatatgttttgacttaatcatatacaaatttgaccactgttttttagtataaaaatgattagctccaagtgtagaatattagtgcaccattattgactacaataatctaactataccacatttatattacaatataattacatagttttaaagttattgttgggtcaaacctttattggccaaagtcaaactaaaaaaaccaacaagttataattcctccgggtcatgaatactctacatgcagtgtccatgtgagtatttgtaaacaaagatagtatatacttcctcagtttcacaatgtaagactttctagcattgtccatattcatataggtgttaatgaatataggcatatatgtgcgtctagattcattaacttctatataaatataggcaatgctagaaagacttacaatatgaaacggagaaagtagttgacacgaagaaaaaaaaataccgacgacatattttcctgaagatataggtcaatggcattgccccattcatgcatgcaggactccaaagcagtaggaagggggattattaaagagttcactaccttctgagggggcttgaaatgttgggccatctagatgcatgcagtggaatggcatattaaacagtaaaggttgctcctgatcaagccggctagctaccagcttatttggacccatccaatcttggactaatgatactagttggcgatggatggatgcatggacgcacacatataatgtgtgtacatataaatgtacgaatatggtccctggtgatgaacaatttcgctggaaatgggcgagctgtgatccggtggcacgcccttaactcctcccagctcaatctgcgcaggctaatgagttgcccttgctcagccctgccccctagcctgcacgaatcgcagcgcgccaagtgtcacgtgtccctatttcttgctgtttttgcagattagcatatactgtgattcatttcttaacaattattttaaaatagaaaaatgcatttgcatttaccatatattgttgtatcagttctgttatttaaccggtcggttttattacaatctagatccacatatatgatcaattctctcacacggtcaatatgtatataggctaacgagttttactcttatcgtcccctatctctagcctgcacgaatcgctacgcacaatttctcaatataattcttgcctagggatgatatttgccaatgctacacagaatattgacgaattttacgtacgttgcacctcacacatgcaagtgacattcccaagatgtccttgcaagaaattaattatcttctcaacttctcatagttgtacactttgaaaatcttaatttcatcaatcctttttttttgtcataggttaatcagcatatattgccagggtccttgtactcttcctcttcctatttctggtcaacgtatagtactcaagttagtcaagttgaaaatggcatatatgtgtgtagatactatggtcccaacccatttgcaccaacagcatgaagagaagactctcctcctggtgttcttgggtggtatattttgttttagagtgtgtgttcagttcacaccaaaaataaaagtttgtttgaaattggaacgatgtaacggaaaagttagaaatttatgtgtgtaggaaagttttgatgtgataaaaggttagaagtttgaagaaatattttggaactaaacacggccgtagtagcattttcccaacgaaaagacagggaagcgaaagtacatgctgctacttttatcaacaatccaaacgaaagccatcggcgatcgacgtcattgtcatttgcaaaaaaaacgcacacatgccatgctgtctcagcaatagcatgcaaccaccatctacacacaatttaaatagcaatgcaacaatatcttccataaacgtttagccgtaaggttctgagtccagtttcacttataaactggatcaactctattttttattaaacgaaagcaggaaatccatgctctttttggatgttattttctaagaaaaaaattcttccaaagctaagaactgaataaaaaaacagagatagagagagagaggtgtggaattgcatgaccagctgctactaattggtaggagtagtatgtttggttggttcataataatggcatgcaaaataataaagccagcaaatttaattaattagacaggggaaaaagacagtacgagatgagtggacacatggcattggcaagctagccggccggaccggacagggtgcacgaggacagtggccatttagagagggagagagatgggagaagagaagaggaggaagggctatgctagtagtaatagcttttgcaatatttcgagctcatctatcgatcccagtaggttgttgtgcgatgatgagctagaaataactccctcgcaaataaatgtgcatttgatcctagtaaatggagggcatttatgccatccatatgagggcttcaatgttgttaatttaagtcatccaccagattccctgcagggtttcagtgatgaattgcaatgcgaagaaagagagaaggaaggaagaagagatctttttctttttgatcttttgctattcttgaatggctggctaaatgtgtgaatgaatattgcacggccttgcaaatcattgttgagccaatgtgagttgatagtttcagaaatgtttgaatcgtagcagtagtggtggtagtaatagtagatctcatcagcctttttgtgtactggccatacgtttttgtgcaaatcagtgaagtaatcactggatgacttttgcattatggccacttgactgatcaggccagcctgcaggtaatagctagctagggtacggagcttagcctttcccactcatggagagacatgccgtagaccataaggaaattaatcgatcgagaatccatcaaacatacaataaagaagaaagggtatttcttttaaggaactctcataatgatacaatgataatgccttttaccattaatacattcatgatatatatagttttattgttcttggcgatcgacgacgatgttgaattgtggtggtagtagtatatatatttattataattgttgatgagtagtagcattgtgttgttgtctgaagctttcatatgtcctgcactgacaataacttcattgattctagttgctgtcttgagccctagttgggtgctgaatgcaagataatcaagagctggccgactagtgaccaactctgaagacaatgacctcgcttttaagccataagctcaacatcaatgaactatagatgcatttttaaggtgctatattgatggcgaaaaattgaccctcctcgatcttggtcctgtcttatatattgcgcaatcatttgattttactcggagtaatcagttcttccttcttgtccatttcacatttgaattgaaggtgagatcaccagagtttttagtgtcggcatgtgaactaactagctagtcaatgcattaacaagccattgatactctgaaaaattcggttgtcgaaatgaaacctgcagctaattaaaccagcgagtggtcggtagtcattatagagtatagaccacaattaagctcactcttatttgcctgctaagtaactacacggtcagtgtaaccttcaagtgtgatcagcacatttctccatgattgtgatcatattatctttgatgattcacctccataggaaaagtatacatataatttctagtagagagtctcaaaaaaaaacatgatcatttttgctggccagttcacaaaccggcccagattagcaaatttatataggctttgggcccagatattagtaaagttcacatggcatctacaccacctgatctagacaggcccatatacggcccatataccaatattttgccttggtgttctgattttccgaatatgtttgtacgaccggtctgaggtctcagggatatattcactaccgtcgcatgtcgatgttgctgaatcttgcttattgggatgcaaaaatgggtagatcttctaggtgctttagctgctgcaaagtgatgaaattatttttccaccttggtgcaaagttaaactgttcatttgaaacgacaaattaacacttcagtcttcagctaggtgcacagtgcaatttgtgttgtagaaatattttactgtatactgtatatttgataagagcctctataatattatatattcgatatattgcaacgatggaattgaatggccatcaagacaaacgaaagaatagatatatattattcatataccgaccggttacattacatggggctactttcttggaagggaaaacaacaccaagttacatcattacaaggacagcttgtctatccagttactatatactgtctccgttgatttctataggacatatattttaatttctatctagaaagtccaaggtcagattttgaccactttcttttcataagttttattatcactaaaattacaaagaaaaaacaatattgtgtgaaaccattttaaaatcctattggtataacttctactatacactatatttacttgtacatttttaattgaatttacttttagttttaaaaatcacttgtaaaaaactacagagtttattttgtaaaaaatcaaaatatgtcctattaaaatcaacggagggatatatatatatatatatatatatatatatatatataaggaacgaacaaatttaactaattaataacaaatgaaagaacaataattaacgttgacccgcacaggtccacccgatatgatgatcactgatcaatcccaagtcccaaccaccggttgcttgactccaccgtagaccttaactttggtctctacgctagtgtaaaagggatcctctgatttaactgctgcgcagttgagtcactgacatgtaggccatagtaaagtgggacccatatgccagtgactcaactgcatgtgcagttaaattagaggatctgcttccgttctatctacttgatcatttctgggctgggttaatttacttgatgacctgcagtttaatcagcacggagaaagagaattaaaagttcaggttaaaaaatagttaacctttcttgttcaagctagcgagctggaccaagaaaactacaggaaaacacaacccggaaaactcactcacttaaattaagcagcagtaatattgcatgtacatgcagctggtcggagtagtggtgggcgcgcgttagcccgcggcgttcggctgatctggtggtgcgggctcgacgacgccgccgccgccgccgtggcgccgcgggcggcggcggtggcgacggtgatggcggcggcgacggaggagccacgagaggaggacggcgaacacggccctgagtaccatccccctcctcggcacgtaccgcggcgcgacgacccggcgtgccggcggctgcggcggagccatggcaagcagtggcggcgcagcgcgcggtgcagctggacgtcgacggcgagtgtaggtgagatcgagtggatcgatcggtgtgggtgacccggccaccgcccagtagctagctagctagaacgcagtggctcatgggatcgaggaggagaggtgatcgctgagtgctttgcaatctatttataggcggcgccgccggcccgaccggccggacgaacggtttggctatttttccatcgaacatcgatcggccggtccggtgttagatagctatagctaaagctagcccggctagttcatgagcaattgagcatggacacgtacgctaggtgcttgggttatacttacatatatattccctctctgttaataggtttatttttggctcctacttttgttgtaaaataagtttatttttaaataatcattgcattggagttcttttaaaatagggaataattgtattgggagtagataaagtgagtaattaattgtattattgataaattaggagtattctagtttattttttattttgtattgatatgtataggataagtgaagagtaaactttgtacaactattcttataaacctatagctgtaacatatacaacaacttatgtaaacctagctatagcaaattagctagctgatgcgtcgtacgtcatgcatgcatgcgcgcattcacgatcgatgcctagctagtctgatacatatgcgccatgaaaacctgagatagagccgggaggagataagcactgaggatatagctagtttggtattatgcagggccaaaccgcgtatgatatcgtgctcatcatctcgttcgtcgtccttaatttcgttggtgtttctatccgtcgcgtacgtcgaaactcgaaacgcggtaaggattgaaaatctctggacacattgttaattcttttaacttttttcttctcgcggagatctggactgactattttaatttgcagtgtgtttagaggagattatcttatctgagtgtaaatcaatttattaatttatatgaattcatgcatatgcgtcccgatcgcgacatgcaggtgtatccatcagctcgcaggatatggcgtgtaggacctgtgtttatggtccacttactcattccgacgctgacagtgagatcgagtgacactgctgcgtgccacgcttttttctttctttctttctttctttttttttttgagtttacgcgtagacgcgtagtgatgaatcagtttgattcggcagccaaaaacattacatcaccaccacggagatacgcttatcataagtcgtcttttaattttctgagacatagggaaaatagatggattatttgccttcctctaacgtaacgacttgacttgccacacttgttcagtcatggaagaaaactatactatagctagtactaaacaagtagggaaaccagagaataagaggacatgacgactcatggttttgcaagacgtaccatgtgtgtatgtgtgtgtgtgtgtgtgtatatatatatatatatatatttatttatttatttatttatttcctggttttcctgattacgagcttgtgatgactgacgacgaatgaccaaattcgcgccaaaatttcaccggaatttcccaaaatgacgagtatgacgtacgaacaccctcatatagtatgagctcgtttaccaactgatgatgagcaatctcagttttctgccaggttctgggaatgttcctgcattggaattatagcctgagcgcagcccctcacttttatctctgcagcgtgaccgtttctgcgttgacgaaaatacggtgacggccgggttccctgtcaccgactcactcacggctcacccgccgcccaaaactccaatagtcaagagtcaagatggaacttcgtggtagttctctcttattagcagcaacacgtgtttcacgcttcacatgcacatcaagataaatttataattttctttgcgttgggctatgtacaccttctaaggtgtagaagccgggtcaatataatccattatctaaaaaatagaatgaattttatatatggtatggtttttggaggcaattcttgtcatatatgtattgagtttgataccctgaacagaccgccgatgttaaactagcagaggagcggactaaaatcacacagaagaacttttcttgtttttgtttttatttagttaaaaagtatgttctttaaaaaatatagtcgtatgtaaatggttcgaagagacggctcagtaaggatgggatgatcgatcatcaaatcaagggtgacttcttggttggtgaaacaaaaagaagggggacaaaacacaccaatgattctctcagccgatcttcatttctaacttctggagaaacctgttgagatatattgatgacaacccccaccttttcatcctctcccttaccgggagagtgcacttctcttcttcttgtggccttcacctcctgcatggcccggaaacgctccccacccaagcgatttagatttgtcacaggttacgcgaccaagctctccattattctccccaatgtttatctttgttccactttgttttattttagtgttttactatattcaaccagatgttgcacttacacattatgcacattactttatcaaaggcgtgcaccgcaccctccactgtctcgaagttgcttgctggcaacaattatttttgttgatgttgtatttggttttctttgatgtatcatgtattggctttttaatattgcaatcattattttataacttcgcgtctagttgaaatatttttcaccaagtaataaaacatctaaaacaattctgacaagtggtgaaacaccgtttgacgctttgactaggatgggacctccaaccgctactcgtgtccacggtgtaaaaatgtttttagaccttcagaatgtacgcgataaatttgttgtgtaaaaatgttacggtcaaagtcacatccttaagaccgaaaaaagtctaaaattcacagtatactgatgatcagacagagtaccacaaattataaggtgcgtaccacatagtagtataagtttgtaagggtctgtttagttggtgaaataaaaatttttgggtatcacatcggtcgtttgaccggatatcggaaggggttttcgaacatgtcacgccccgaactataccgaccggaactagcccgggacgctccaaattaatctgttaatcgataccagtcccaggaaacagtgctggtatcacagggagacagaatatcacagcaacagaggtctctttattatagagtagaggtacagtcatgttgggctgcggacagatcccgagctcacaactgcattacaaaagggaaacggaagccaggacttggaccaatcaacacaggcgcgacttgggaactaggccgaaaccctaaaactcatcgtagccggcttgctcctggaaaaacccctcatcagcaggatccacttcatcttcttcagcaactgggggggattatttatatagagcaagggtgagtacaggagtactcagcaagccataggaaataagtgtttaatgcaggcttcaaggaaaggctgttgtttttgcaattgattttatttgaactcttttctaaaaacaactaagtgagtgcttctcaaacgacccggatgagacagtgcgcctcgtccggtcggagtatgtgcaatgcatcagtctttagaattgaaacaaggttggcacccggccaacagcttttcaaacggccacccgggccaacaactttcaaacggccacccgggcctagctgatcccatcagctgcagatttttcaaacatcgaacccctttcaacaacagtaatttcacaagcagtagtcaaacaaaactacgctaggaatcacctcacatccgcccttgaccgtgggcacggctgttcgaacagtttgttaacctctgcagagggggtacactttacccacacgacattactaacccggatcacccagcccgtggggatcagccacgtcgggagacctccaagctttcatgacaaggcatttcgaaagccgacacaggtttaccatatgctgacgagaggggtcccagaccaacaacaggttaggtcccagaccatactgtgccaggaagcccaggggtcctccccgacaccaccccggcgaatccacatgtctctcggcatcaagactcccctgataagctagttactcagccagggggtgtcccattccacccatgtggtcgtacttgtcttatgtttggatgaaattccaaggaatcggtccttaagtgcgagtgcgggaaaccgtacacccggtacgttccccggtccgcggttttggaaattcatttagttcgcaagcaccgacccaggtgtcgggttttccaagtcttttgtaaacccaagttttacccaagttgttattcaaattttaagtttgaaggcgtccgtcgatactcgcacagggtgcacgaatatcgagacgcaactagatcgatacaaggggacatgatataacaattaacaaaggaaggattaaatgcaacaaattaggtaggtccgccaatctgccttgcagacgggacaacagattaagtgcgatcctatcaatgcataatatttttcaagcaacataattaaatttcaaatataggctcaagatgttcaaaggtggcttgccttgctcgagatctggagcttgatcctcgaaatcctcgcactgcgggtcttcgggctccgaaactacacgcgagacgggacaactccacaaacggcgaaaataaagccctattaatgacctctaagcgtgccattagatagatctcgagatttgaggaattttggaagttgaacggagtcaaacggatttacggttgggaagatattgaatttctaagattattagattttcggtctaaaggaaaaggatttaattaaatcctttttggaaaagaaaagaaaagaaatgaaaagagggagggaatatagacttttctcaggcggcttgggcgcggcccaagagaaatagagcggtccggccgactaaatgggccggccggcccaagacgcgcgctcgcacgggagggaggagagagagagccggtggaccgggctcaccgcgcgtggtcccgggtgggacccgcttgccgattactcggttcaccgtgcggagcgagcacgcggcgcgcgcgcgcgggcggggctaggacgcggtgcacgcgcgcggttcgcggtggacgcgggtgcggcgggcccacgcgcagcctcgcggctcgcggtggaacgcgcgcacgggaggggctgaccgggatcggcccgacccgatctcggccgagctggcgccgacgtggctgccacgcgggctggcgggaggaagacgaaggcgccggccgcgaatggacggcgggcggcggcggtttctccggggcgccttgcgacgatgaggggcgacggggcgtacaccgggatgacgaggaagaaagagagggagcgagccaacggcttggattcgccggagggagtccgtcggcggcggatttcggcggcggcaaccggcggagagcaaagggggaaacggcgacgaggtcacgaggggccaattcccggcggtgagagcatctacgcggctacgagaatccgttgctagcgtcggattgggcggagctacgccgagcgaggccggcgacgagcgggtgctacggagcacgggcggcgacggcggcgagcacacggcgagcgatggcaacggtcggggcagcgccggctagctacggggaggctactcgtgctactgccgaaaactaagggggagagatggagcgaggaggaagaacggagggaggcactaccgagatgaggaggggcgctgtgacgagaggccgatggcgcgggagtaatctctccggcctcgggccggggaagaggaggaagacgagcgcccggagtccccttccgcgtccacgaacgcaccggctctcccggcgcttggcgatgaacggcggaggcgagacagagctcggaaggcggcggcaacaatggcgatgggaggagaagagagggagggcgcctgggctttaagggcggcaatgtcggtttggaaccgacttgggtggtcaaggcgcgagctggcgctcggcgctcgcgtccaatcggcgacagggcggagggaggatgacgccggcgggaggaaaaggggaaaaggagggagagaaaggggggcttgcccctttcttctttgggaaaaaggaggaggggagcgggggcgtcgcggcagagggaggagggctctgcctccgtcccttggcggcttgcgcgcggagtggcggggccgatgcgatgacgacggcgatgaccgcggggcggtgtggagcggatcggctacacgggcgacaggcgcgggcaggcactgacgacggcggcgaccaggcggtcggccactcggcacgcgcgcgcggcttgcaacgggaggcgtgg

SEQ ID NO: 62587 - DNA, 9536 bp, Oryza sativa
ccccgggggagatgggccgagagaaattcggcccatcgaccccgggggaggcaaaatagacttttgcggaggaatttgattggaatgattggattcggaattgaactcgacgatagatcggggatttgagatcttgagatggcacggacactagacgacaagcaaagaaacaaatttcgcaattagggtttctaagagataattttcccgctaggcgccacgacggaacgggcgctacagaacacgaatgaaaaaactaatttcataactcgcctggaaaaagcaagacgaatcttttaagcctaactaatccgtcattagcacatgtgggttactctagcacttatggctaatcatggcctaattaggctcaaaagattcatctcgtgatttacatgcaaactgtacgattagtttttctttttatctattatatactaaaagtccattaaacttcctacaaacgctctcaagctgccatgtggtgctctaataaattagagaaaatcttataaattctaagaaaaaagcaaaacatctaccccttgattttcacttattttggtcggtctaatattatacaccgttagataaaattgatcttaaaacaaaccaaatactatgggtcccacctttcctccttctcccgtgcatgtgtacgtgggtatatatatatacacgtacgtaccgtgtacgtacacccttcttttctttttttcttctttttccatttatataatatggatatatacttttttaaataaccataaatttacaacataaagaatctaccatcatataactcactggtaactaaattagctctacaatttttgaaaataaaatttaaaccattatatgtgaccattaaattaataatgtaatatagtttccacttaaacatgtgtactcattatttttactattattttcaaataatgcactattttaaaataaagtttacacaattatattgtgtacctatcaaataaacagtttaagatgtatattaaaccgatggacccattatttaaattatcggaactattttttattacatcggactattattctcaaataatgcatggtttcaaaataaagtctacaccattatattatgtacccattaaattaacaatttaaaatctatattaactaatgtacacttacactagaaccggtggacccattatttaaatcatctgatatattatttgctaataaataaaacgtccgaagttcttttttttgcccgctgcacaatgcacgtctgcacctttactttttgcacgcgtgacaaagcatcgtgtctgaggcatctaaggtgatcacgactaccgcagcactaccattttgctacatatcaaatcatatatagagatgatgcagcgagagaagaattaagcactgtgggttgtgtttttttccaacacttggctttgtttaagctgaaaccgagagttgattacaaaataattataatgtattgtgttatgtcgtatttggattttgtactatttgtttgtatagatgaaagaaatcattatgttataaatgtgagcacaatattaacgaatatcaatagcactcttacaaagactagggtgttataagggagtttaagatcctctttttttttccgattccatagtttgtaaatggtgtcttttttaaacaacattttaactttttagaagtcaatttattcgtttataccctcaaatagctatcacataaatcagataattcatcaattttagctgtcctaaaccctaagtagtacatattttttttatgcaagtcatggtgatcagtaaattggggatcaatggataatcaaagtcgtaagatgaatatgtaagtgctactatgaacaactgtaaataggtgtcaaaattaattgctactaattagacatctaatggcttgctagccacataattaatttctctcaacatgtatataaacatgcacgaagctggaacaaatattaccatatgccctatacatatatattaagcggttaatattctaattacacgtgttaagtcctttaaaatttcttaaaacgctctcaagctgtcacgtattagaaattctaaggggaaaagagtatcaattacttgatttttcacttaatcgctacgtccaatattataaaccgttagattaaattgatcttagaaaaaacaaaatactgtaaggtctcacctctcgtcccatggcataggtatgcacctacatacatgggtacgtacgcttcccctcccttttttcatttttccctttcttctttttttccatgcatacacttccctccctttcttactatatcatacaccttcttgagatgatttaatcataagaattttgagtatcttgctcttgtatttttcatttgtggccatactacacggtatgcatatagatggactgtatgatacttaactagcaatagtttcttatttactcgagaaaaaaaatgatttaaaagtcataccttaagaaaaagtttgtaaatggttttttaagataccttaagaaaaagaactttagtttgcccttcatctataagataaaatttttgaataaacaataattttacctttcaataatataagtgcccgcgcatgtgcgcgggccaccttcctagtttatatttaatgctctatatatgtgtctaaaaattcgatgtgatattttttaggaaaagtttttggcaactaaacaggacctaagtactccatggccacaatatacatgtgaaaacgtccggcggagaaatgaccctgcagttccctcccgacatcgtcgacgtgatatgtctactttcagcttcttgtcaggccacaagcccacaacaagctacaaatagatcactttcagaatcctacttcatgcggcagcaggagaatcttgcctgctttcttgcaaatttacgagtgcagtggacgtcatgcatgacccatatatacatggcggctcatcgtgtcatcgtaattaagtgtgactacgcgttgcgcccgagccgtgtttagttggagaaatttgataattttgacagtggggaccctagcggatgcacgtgtcatgggctcatggcgataacgaactctcaagacaaggaccttgatgtgttagacaatagtagcatatatagttaattacttactttttcgtcgaaacatgactaggttaattaaactttactgctacattttgactggtgtacagatatacagtacaatccatgatcccaaagtctccattttaggtaattgaatttaaagtttacgtggattttatacggtttaccacggtaaccataataacaatgaaatgagacgtagataactcttactcaaacggtataaaaaccgaaaaccctgattcaaactaacatggcccgacccagactatccgataatatatcaggccaagatcaggcttatctaggtcgggctcgggctcgggcctagcgtttatgtcaccatcgagtcgaaggtggtgccatcgatgcaccaccatcgccattaattagggcatcctgattgccgttggataacttggatgttgcgacggcagtaggttactaggctgctcatggtggaggagtccaacaccggaagggtggcaatatggaggcggccagcgaagatgagaccaccacgtaggcccctcggtcacccctctcgccagctgggtagagaggaggtgatggctacgagtggcttgggagagaggagttggcggcggtgggaagagaggcggcgggggcaacgaagctttcttgtgctcattggggagaagcgagagaggagcagtgtgtcttgggagatagatgtggaggagaagagataagatcgacaaaggacttagaggagtagataagatctgttggaacgtggcttggtttggcttgatttttatggagaccgattttgtaaaaaaaaaaacagcacctatatataatatagatgttggttttttaattaacaaacacatataatatattaaaggtgtctttttttgaaaaaaaacatgatgcttatagctgctcaaaggtgtcggttctatatttttccattccatgggggtaaaaaaatgtctataaataccaattttagcattaatttccagacctaaagtgccacccttttgtgatgctttttttatagtgtgattatgtcctgcaacctgtacgggcttggacaattcatgtccagtcttggttcctaggacaaaagcccaagagttggcccaacaagactatatatgatggagtaagtccacttgccatcccacatatttacgtagagtttaattggcatccataaattgcaatactagaaatcttcatccctcatcttggcaaaaccgtttaagtcagatcccataccggtatgatggatggtttcaatgacactgcaagttgatccggtctaatcgtgttgactaggcatttatgtggcaaaagaaagtgggctccatatgtcattctcactcgacctcgacatgcatgctagacgacatgggtgacacactggccacgatctcccgaggagaggttggccttgcattgtgccatggcatacacctgctagtagctggtgccatagaacccaccgttgctcccgccgatgttggcctccatatgtgcgaaggcggtgtcgcagtgcatctcaaagtcagtcccactattaccgccctttccacagttcttgaacaaaatttgggtgtcagacacctacgggaactaggatatcttgtatagtgcaaggcagtggtgagctggattcgcgcgaagacaaaggcaccgtagatgtcagactagaaggacatggggcaggagatgcaggcatgcagtcaaagacgaagaggtccccacgacactcgaatagagatggaggcggaggaatttgacgatgacaacaaagtcttgtagatcttggtggaggcggactaggacaggagcatggaggatagcaccacgatagttgggagagggggttaccatgccgggggggggggggaagctcttgttggagcgccctcatcagcctgggcgactcatggtaggcacccgttgcggagatgcgtgtagtggtggcggcatgccccgcatttgcacctccacgtcctcattgagcctggagagggtggaggcggcgctaccgtggtaggagggggtgcctccgccgttgtcagagctcaatgcccaccttaccgcagtagcttgcctcgcgcaggcctcgagggcaaggagctcgtcaatgtatgctgcggcgttcggcaaggagggaggccttgtccatgccggacatgctagcccgggttttcctccctcaccgcttcattggccttgttgctgacctccaaccgccgttgccgcctcccgcaaacaggttcgtctgctgtcgcccctctccccattggtgagctcctggggaagagaggatgggtcccacatgtttttatttattttttctaactaagatgccacgttaggcaaaactaccattcatattaccatggaacctcacttggacggttttgtcaagatgagggatgacaagtggacttattcattctttgtgacttaccatcctataatagccaccttttttttcccctgatatgagcccaattagctccttttataaaggtacctgcaggctgcagattctccaggcagaaaaaaggcggcaatacgaaattccatcatccctgccacaattttttttttgactggatgccgcaaaatgcattgatgccgaaagtgcttattgcctaattagagctggaaatggaacaaaccctttagggcaatccttcatctgagcatcaaacaagagtgtcctcatatagttaggcagaatgtagcaagagacaacacgcatattcagattacattattattatagcttcccaaaaacaaagaccacccactacagcagcaaaaaggggaaaaataaagtgccaaaaaaaggtgtgatcgatcaggtgatgttcttgtgcagatactataatcccattgccacaccatgctggacacaacaacttacagatacgaatgacaccatatcatgcaatctctacttagtactagtaaatataaatacttcctccgttttatattataagtctatttacttttttctaaatcaaacttcttaaccttaatcaagtttatagaaaaacataataacattttcgacacaaaacaaacatatcatcaaaatatattcaatgaaactagtttggtgtcacaaatgttgctatattttgttaaacttgatgataagtttgacttagaaaaaaaatgaaacgaggagtagtaatttatgaccagaaatgaaaatagtactatctgaatatatgttggatgattgactcttcctatggctgcccgatgctcgatcactcgctacctgaacagcagccgcagcagcagagcgcacaaaggaaacgcttcagaatgtgattccgcatttcgccacggcggcagaagcggacccgtcgacggcgacgttcctcgccgtcgttgtggccaccggcgacggcgacggcgacggtagcctgtgcctccatgtagatcgatgagattgcgagtagtgtgctcagtatatcgaagtattctacgctgtagttagttacctgatacaaaatgtgtgtgatcaaggagatgatcttatatagggttcagagttgagagttcagagtgactgaaacagcgtaactgaagtctgaagaccgaataaaggcaataggacacagaaaggtaacaccctttcggcagttatatatatatatatatatatatatatatatatatatatatatatatatatatatatatatatatatatatatatatcatgcatgatactactgagggaggttagttagttagttactactagttaactaatcaataattgccgcactgaaaattcctaataaactgtacttcaaggtaacaacagtagacacgttaaggcttaagatactgcgcgcaaggaatttcttgtggatacaaaggacagagcaaagcatcttgttacggcttgaaaaagtgatcttttttttttctggattgggattacttcaagcaaatatgtgccttgtaaaggtcatataattattcaaaacagaagagatgatatggtcaagattaagattgtttcaggtccgtatatggtaggataccaataccattgagctcatctaaaagctgaaacttttgtggaacagctactctttcagtgtataccatggaggcatttataccgaacatgggtcctacagtccaactgagtcacatagtcatcaatagcatctaatcttttcataagaccatcactagcatctaatctacgctttagtcgctgtattggcaaagttacaacattaacaattcctatggttgcggtatagtatctgaagaagagcatcatcaacttaatgtcggccagcttgtgattaacgagaaccccactcccactaaccacagagaaagagttaattaattatcttgctctttccaatgttccagttgaactttgaatgctaatctgaattgcctagtgctcatacaatgttcagaaaggcagcagttgattcaaacgaccagaaaggaaagactcaaagatgcagtacattcataatttcatatgcctttgtacaaagaatatttgtaagacccatgctatgattataatctgactaaatcaagctgttccaggtttgaacgtgtagttagcaactacgggccacagaagagaacctctctttcagtcacaagtcagtctcacagactgagtcagtgatcagaatatatgcttttgctggcccaaaatcagttgaagaactagaatctttctcagtgcattttaggcactgaactggataactactctcatttgtcttctggtttatgcagagaacatagagcatttgctagagtatgcagggaagaaaacctttttcagtcagaagtcacaaggcacagaatgagtcagagatcagaatatgagaatagatgccttgcaaacccaaaatcagttaaagaacaagaatctgtgtgggttttgagcacatatcataggtattttaagcaccgagttggataagtatgtgccagtcttctggtttcactggaagaatttggggaaaaaaataagtatgatactcctatttatgcctcttttaaaacatggaatgttttcaattcttatgagactaaacttactcctctgaatatctttgggtttcacaagaagtcttatctattattcttcccttttttttctctccgttagaaatagtttcacgggatttagagcaagtccagtttatgtattaaaatgagcatttcatgaattaatttacttacctacgtaacaatgtgacttggtactactccttgaatgcataaggtgcttgtttatcattgcataacaaaagtttgttaaagccaattaacaaaccgaaatggtactccatctatcccataatataagtgattttcttcataaatttatccaaaatataaggggtttaggatcctattacagtactataatcttcacctacaaacttttatactagtttactccactaccatatacttttatactaatttattctcccacctactaacttttatattactttattctttcacccatcaccctttgtcacatcacatgtcctttactacttccttaattcttgccaaaaagggtataatcgcttatattcacggactgagggagtgcttactaggctatgttcttcccctccttctccaactccactctcatttttcatgcgcacataaacagtgtgttttttcaaataaattatacaaaagttattttagaaaaaaaatcatattaatccatttttcatattcttttagctaatacttaattagtcatacattaatagttcatcacgttttccatgcggggagaaactcttaccttcccaaagcagccttagagcaggtacaatagcaagctataaacatattttaaagagataaaggaagagagagaagagcaacgggatacagatctatagccagctgtagcacgggctccaagacataatgtttgtatgacaggtaggatcaattattaatagtataataagcatctattgtatgattagctattacattgactatagatgatttgaagttagtacttggatatactattaaacttgctcttagagcaagtacaatagcaggctataagccagctataaacatattttaaagagataaagaaatagagagaagagcagcgggctacagatttgtagccacctgcagcatgaactgtcgaactccaagacataatgtgtgtatgataggtaggactaggtattaatagtatagtaagcaattattatataaatcggctattacgttagttatagatgatttggagctagtagtgtgctatactattaatattaaacggcccattaggccgtgcacctagggacgcccgggggtgcggggg

SEQ ID NO: 62588 - DNA, 5354 bp, Oryza sativa
ccgcgaaacggatcgtcatccattttagggttccaccatatatatacctcttgtaagccgccgtgcggcgttgtaacctcaccccagatatggtgaagatattttactgctagcgcctgtggttttttctctcctgttttgggagggttttccacgttaaatctcgtgtcttctgtgattgatctattgttctttgtcgtttgttcgcttatcgtttcctaacactgcgggctaatagcccatggctaaagccaactattagtacaatagattgtctattgactgactgaatctcataatcaaataattaattatgacatgcacatatcaatgtatatgatcaagagtgaattgtatcattgtagctatttgtgttgtgagatgaactttgttcaccaaacaccaggatcatatcacagatcataccaaccaatttctctgtagtactaaaattacaaagcactagtgtttgttggcaagaagagctcgtgagaaaggagtggatttctttggctgattttcgtcaaacgatgtggcatcagagtttttcacggcacagttttcgctcacgatcgcatggatggaagacgaagcacgcggaaggtgatgagatcgcgcacgaacggcggagatggatttgcacaccgctgggggaaggggatcgcgcgcggtgggcgaaaggggatcgcgcgccgcggggtaggcagttctcacgggatcgtctgaggacgtgagggccccacaaacagcgtttttagcactagggtcggctgcacacgaccaatactgcgtggagaaaagtgctaacgccgggcgacaatttagtcgtccgctttattctctctcatccacataggaaattgatgatgtggcattattttagagcccgctgagtcaaattattgtacctgctcttacaatgcatcccctgttccaacttccaagtggatcgcatacttctgtgaatgacggtgcgacgaacacaatggcacaggcgagcgccagcaaggatgggttacactgacatgtgggcccggacaactccgtgacaatgggacgtcgcgttggacgactcgccgctcggggtcacccgcgagccgcaactagtccaccgccctctctctcgctttcttctcaagtcccaactcgcgcgaagcggagagcgagaggcgagagcgaagtgaagcttcttcgtggcgcgcgcgcctcgagttcgtctcttccctcccgcggcccaggcagcgccggccggcggcgctctcaccctcctcgtttcgtggcgccgcggcggatcaacgcggtgatgcattttttattttttcctgattttttggggaaagtttcgcgccgaacgagttgagggttcttctaactaggggagccgagaggaggagagagcttttattttttctactatatttgttggggtttgattctgatgttttttttttgtatggatgttctagccagttagtgtacggtgactccgtgagtggagagtggagaagggtttagcactcaaacttttttttttcgaacttttttgtgcatttatccagggagatgagacgcgatgcatttggcttgttttttttccggatgaattagttgcttgttcctcgctcccgaatgagttctcgaccattttttattttttattttttttgccttgtactagattcgctgttcggagcttcagaaaatgcaaccatggtgatagtgggtggttggttagcgtatgaacatcgtggagcattttttctctaataatatatttttttcaggaggtgatgtttaatcagcctcttctgatggatttcctagcgcctacagtttctagccatttgtagattttttatatcgattctaatgcgcagtcaaacgcatgggcgaattttcactcgcttccctatgcggtgctctgaattttcagtttccagttgctgcttgctgcgctatcaaactaacaccttgtgttctgcgcagcttctcagcacttgctgtcaagtttgccggcaattggttgtggtaaatattagtcaagtctgaagtctccatctctcggagataattatcttttaataaatagccctgtatccattcatttttgtggttctaattgcagccgtcgcccttgtccttctgaattggttatgtgagctggggatgtgagtgacaaggcttcgtcctggattggtggttcgctagttgctgcagttcttgttttttttggggaatactggttgctgcagttcttgcatatcctgataggtgtttgtgcctctttttgcctgtttcgcatgaatatttgtttgattagtgattagtgtcgttggtatggtttgagttaccgcgtgtgtgcttttagctacggattcagaaagtatttttgatataagtactgtttgagatggagtgccttttggcttttaacagatttacctgctgaagtatgaccgattttttcatgtgtatgtcgttattatgctttatgtagacagttttcagtctctcctaacgttctttttaagataaaatgacatgtgtactctgtgtttacaccttttctacattttgctttagtttattatggttatccctttcttgggtcttaatgtagattcaagcaaattggataaccaatcttacatattactctattttaccaagaatgctagagcatgaatggtgtcccttgtatttaacaacttttcctgaagaagctttataaaaatctgatttgctgttgttgagtgcgactgaaatagagcaagaatttgcttgtaggaatgcttatcagagtaatcttttaaatttaagcgcataccttctgtatacaagaatattatactttatatgcaagtaacagagatcattttacttatctacttcagcacttaatgcaatgtcatctaatgcagtggatgttgggttccgtgtaaggaaatgtctggccaagagagagatgatgttccaatgctagagctacaaagatttcctactagaagtgtatcgatgtgtatacctgtcagggatgatatatatgaagactcaatcatatcccacagtggtcctattttcaccccagcaccaactcagtatacatccgtggctattccatcaggaaacagagacatgctcgataagctgcctcgtccaaaggttaagagcaaaccacatgttgttacgccggaagaagttggaataagtaactggccttatgaccagcatgttccgaagaacaaacacctgatgatgtactctgagcctctgggactgtgtgataatcctgattgtgtcgactgtcctcgtgcttgtaaaaacaaaaggcatttccagagaagtttagctccgtttgataacaaggtgatattctcagtcatgaacaccactgacttgccacctccctttaaacacatttccttttgagaaaagcataagcatattgattcatgtggtggcttggattggagctctatattaagaggtcttcaaaactatttggttgccttgttatagttgtcaaattttagatgtttatagatcaactgactgactcttgattcattctgtgcaacctttaaggaaacaactgtttcacacatattgtattttcatgctttagctgtggattatttgagttatctaagatctgtttggtttgacaaattaaaccatcctatgattagtcaattatagggtcatcccatggttttggaggcatgatcccgttcctcattttcctaccaaggatatgttttaagggatgaagtggttacgtaccactttactctattcattgaaccaagcaagtagctagccaggtttgagctagaatccaatggttgattgaccaacatattcctcaaactaaaagtcccattaaacattctcaactcgcccctttcataaatgttaaagcacaaaactgaagcaatgtaaagaaatttacattgtacaaatcccctagaatttattaaattcaagtggtgtttttatttttgaactttgcaaagctgcaaattttacaaatgactttaaatcatcataattgtcgttgttgttgttattgtcactgtctgttgttgactttttgcaatttcttggagtatttgttactggaatttattcatgtctccgtggctctgtgcatctctctactgatgaatgtgctattgatatatctcgtttattattgtagtttcacaacattctttatggctacggtgatcgatggaagaagaaagctgggcattacctttcatacattccaattatgaagccacatgataaggctgttcatcggtggaaccagttttttgtgatatcatgcttgctagccatattcaatgaccctctgtttttcttcctattgtcagtagataaggtaaggctacaagtttgacaactgttatatgaaagaatggactgaggccatctctttacatgttcatttctttcctcaatatcaaatgttgcagatttacatccacaatggctctaacacaaatgagcccactactattagtctgtgtgaagtgtcattgtcaagccactagtacagtttgaacatgtaggctaacgctataaaaaaatcaaccataacagttcatctcaattgtttctattcttgcaactatttatatataaaattatattacagagaatggatccaatttaaccacagtacatatatgtatttctgtatatttgtttttttgtggtgcaggattataagtgtatagtgttcaactggaatttcgcgatagcattagctgttggaagaagtgtgactgacgccatatattttttacacatgcttcttcaggtgatatattaacatgtaatttattgtatttatacttttccttctccattaaatgaatatgcagatccaatgtattcttaagtgagatgattggtttattcttttaatttcctatgatgggccaaatacaccttttggatttgcacaggttttgggtgcatgtacattatggcatggcttgttggacaaaaaactgcacatgcccttagttttaaagaaatctcttaaaagttagcatgcaaggctattatattttttccatatgttgtttaccatgaagtagtaatttttgcagcagaggttttccttctgttaaatatggaaatctacttccatgttagtttcttctttttcatgatagtacttctctattttatgaactatgtggcattttggttatattaagattccaagatgtatttatattacaaatccaagaaaaagcaccatgctcatactgtcatacattaagtgttccccgccaaaaaaaaatgctcatacatttgaataacttttgcagttcagg

SEQ ID NO: 62589 - DNA, 3021 bp, Oryza sativa
agagatttaatatactcttgatattaactgtaattagagattcaattcaatataattttggatcatgcatgtaatcgtggaaaatgaaacctccgtccaagtttttctttccaagtcccgcggaccaattgacggaaccgatcccaagccctacatatgcagttgcaagctatgactaattaattattacctgagatcaacataatagcaatagattccccgcgactttggaatagatggcattatattacctgtctatcagtttgacgaccttgtcaaaaatcttctcctctttattcattgagtcatacacagtgactttgcatgcgtccaagtcgaagaataacaggacccagtggaatctggaatatgcttgagatgagatatatatgaaaatgtacatgctatatatatcggaacgaaatttgttcgaacgacaataaaaactcactctgtgttgtacggcagtagtatgtacgtcctgaaatgctgctgcgttaggagatggacgagattgtcctctgtgtctttctcgtacttgtcgatcatttcggtgttgattttccgagggtcgatgaacccagtatcgtagaccctcgtcatcgggtcctttgaatctccatttctacaacgatgaaaggaaagtattattgcttatatatatgccaggagctaattattgaacgaaacaaatcgaactcaaagatactcacaaaatccatgagctcagaagagagacgtcgagggcgtccagctggtacagatcgaagagatccttgaaatggatccagagaacatcttctccttgcaagaagtcggggtttttgatcctcgctccgaacatctatctacccttggcgctcatttccatgtaccgttcatggaatttgtacatctatgtcggtagggactgcagctgttcaggtttgacaagcggtttaccgagttcaaacttgtatgccacttccgccttcgggattggtgcacctcgaatcagctgatccacagtagaccggtgtctgaaatgaattccgttatgccaaaatcttcgccggtcacgaaaggctcgacctcttggtttggttgttctataagctgagggactggtttggacttcttgtgataggctctctgaactgttcggtcatagtccgatatctgtaacgcctccttgtttgttgtggacattcccttgaagaagttcttcacgctcggtatctctcttgctcctcatccgactcctgtacgtgtggatgtcctccttaaatccaatcttccagggaatcacgcctttccctcgtgttcgtcctggatgctcgggagtttgtagggcgagtgacagctcatccttctctctatcgggtcggaatgtgccctgagaagagactaccactgcgtccgttagtcgactggcagcctcgcgtatctgatcgttgaagacaagggagccatcaactgggttaagcgttccaccgtgagcatagtaccagaacttcgatcgatccggccatttagcggtggccggttcgatacccctctcaatcaaacttgcctccatctcctcccacttcggcattgcgacgctatatccgcctaaccccaagtggtgatggtacttcttcttggcggcattttctttgtttctggccatcatcgcttccccttgttgccctgtcttgtaagcaacgaactcgtcccaatgatcccttagctttgggaatgtgtcgaagttcggtgtttgtcccttcaggatgtatttcttgtagagatctcccttgaagctctagaactgttttgccattttcttcagagtccactatttcactatgttctccgtacccgcaggtagcgtgaacgtctcgagcattgtggtccacagcatctctttctctgagtccgggacaaagctgtcattatccccgcgtgcccttgttctacgccagtacaccgtgctgacaggcacgttgtccctcacaacccaacccaaccgctgtggcgtacaaaattcttggctgcttctgccagggcactaggtcggccgtcttcgtccacctcagttatgatgtgccgaccctctatcttcttcgcggcacttcgttgtccgcgtgccctcttctgtccagcggagggatgacttccactagcctcctcctcatcgttcccctcctcgttcccctccgcatccctctccacgttcccctcctcgttcaagtactggtttggatcctcgttccccttttcttcgttccagtactggctgcttccctctgcgattgtatcgtatagtatctgttcctcatcgcgatcagccatctgtgcatacaaaaaatatttgttaggtatataggatgtatttgctaaccgtaatattaaaattctactaatcttatattaaatctctaacaatcttatattaaatcgctactaatctcatattaaaattgtaataatcatatatatatatgctaagtataacaatcttatattaaatcgatactaatcttatattaaatctctactaatctcatattaaatcactactaatcttatattaaaattgtaataatcatttatatatgctaagtctaacaatcttatattaaatctctaacaatcatatatgctaagtctaacaaacttatattaaatcgctacaaatcttatattaaaattgtaataatcatatatgctaagtctaacaatcttatattaaatctctaacaatcacttctttacatcacttgcctgcgcgaattccttcgatggctagctaccacttcggcttgagggacgacgacgacgtcttctctacaatattaccaggaaaatgtattagtctaaacgggccaagttacatatataatcatatatgtattacgagtaaaatgtattagtctaaacgcgtttcattcacgttcgtaagcgtttcattcacgttcgttcgtaaccgtttcgttcacgttcgtaagcgtttcattcacgttcgtaagcgtttcgttcacgctcgttcgcgttcgttaa

SEQ ID NO: 62590 - DNA, 14910 bp, Oryza sativa
cctctctctcgctcatttccccttctgttgatcggacacaacagcggtgccgacgccatcaccgccccatatgcccgcaacgctgatggtagatcgggcttgcttagccacaacagcaacaccgatgccattgctaccccacatgccggtccaccgagcaacatggagggcaaggcggtggttgtgaaggggaagatccggtcgctgttgactcaagcgtctcccatccctcccacagcgacgccttgccgcctatcgcttctctccagcagcgatggtgtggccaccgtcgatgcaaatgacctggccactaatatatgtaggagacgaccaacatgcagagaggtgcagtagcaacgacctcctcaacagctaggcgcgtgaggttgtgatgtatgtgaacaagagtcggcgcttcgctgctgcgctagccactgcctccctcggcggcaccctccttgtcgcccgtcgcatcaagtggagagagaagaagggaggatggaggaagatgaaattgacatgtgggtcccacgtctagaggtattttggtctatatgatgacaaaaaacgtgaaagcgatggcatggttttaattttacatgtatttcgacgatatggatacgaatagacgaagagcaatgacatttatctaaaatggcacatttataatggcatgatccaatttacccaatttcgaatggttttcgagagttcaaatataaagaagaaatttggacaaaatttgatcaaaatttattaaaaattggcgaaacttgtcatatgctaggatctaaatccagtactcgattagaaaagtgaaccctgatacatgtataaggttttcttttgatttctgaaatcattcactaggttaatagctttttgtttcttgtacttagggaaagtttttctttgctatatataattgcagatatgtaagctcagacagtttactgatactaatttgatcaagtgtggcactatgatagtacaacttgtctagatttatagaaaataaatctttatatttgtagacagaggtagtaatataagtttaacaattggctcgtttgctgatgacgccatcattaacacatctttaatgctaaatgattaaatttatgccattaacatcggtgatcatggttggatagcttagtgttgttctctttaccgatggcattcgtgatgacttctaactgcctaccgatgaaacaaagatggagagttagcatacggtgacattaacgatcaatatggtttaatgtttctcattttgatgtaatattctactacagcttgtatgaatattgctcaacaatataatattctactacaatttgtgccacatattcatgcctaatgatgcgatactcatttcgatactcatttcgatgaagtttcttatattaggacatatatacgttctccatccaaaaagagaatctagactacagtcaatatagatttatacgtatttaagctcattatctgaaacggcgtatttttagcgcaatattgcaatgactaagggcggagataggagtaggacagttagggctacaactctactcctgagtctaaatatctatattagctagaattatactttaaaacttcaaaaattagaagattaaaggcgaagctatataaattacattagttgagctccaggcttagaagaatcttggttctgccactggcgacgacgtatttttggaagccagaagttgtcaaggcaaatgcaataatggacacatgtaatcttatggggtgcatttccaatcgtaaccgcagcaaaaagttttcggccagtgctgatcgatctccattaccgtatgtgtcaaggttaagcaaggacttaggtaccatcaactaattcgtaccagttgtcacccagtaattgcatatagacccttacagtaatactccctctgaaacaagttacaagacgttttaactttggtcaaaggcaaattactttaagtttaactaattctatagaaaaaagtagtaatatttacaataccagcataatttcattaaatctataattgaataattttttataatatatttgtcttaggttaaaaatattactacgtttttctataaaattagtaaaacttagagtagtttaacttttatcaaagtcaaaacttcttgtaacctgaaacggatggagtattttatatataaggaaaaaaaagagaaataattgcctagaccaggtccttcgaagaatcgtcaatctgtccagttgtctggtgaaccaagtccacgaggatcgcaggaagtgcaggtcctacgtggcaggtatcgctggttttatttcaagtgtagcttcaagttcaagagattccagtttgattggaataagaaaaagatatgtaataaagtgttctataataagaaagcagatctcgtagttttaccatatttgataagaaaaaatacatgccgttataaaaaaaaagtacgagcgaaggaaacgatacactataatgggcataaatataatgggcatagttggggttttctctacggtttttagaaaacaagtttaaatgagaggtaagaggcatataaaatattgttaaattgtccttttaatatctgccatgttgttggcaaattgaatttaatgaatattgtctaggctttgaagtataatcattttagtttatcctctccacgtactttccttagagagctttttaaaaaaaaattgagttaagtgggttttgtctatagcaaccaaactgtaccagttgactgttagaaagcatgtccaaaataagaaacctctatgattgatactattatgcatgcagcaagtagagtaaggaaagttactctaggataaaggagaagtttattttataactctggtctcctaaaaattatggaaaattcggattttgggcaccccctaaagtatcaaaatatgttctaatagttttaagtcattactgattgtccattgtttaatgggctttatttagaaaacgtgcacttcattaatgaaaaataaccactttgatataaagtttattacatatagcgatttttttttgaacaatgatagttgtgtggattttagaagtaatatgacaaaatattttgtccatactcttgaagtagtgggtcaccaaactatgcttatggtggtaattatgttgctattttgatagatagggatatctttacaaaaataataagatcgaattgaactatcaattgcacatgatttatggaaacacaatgtatagattaatgtgttatgtgccaaccaaaagtaagtatggcactagaagaggtaaaccttatcagagccgaaaaatcatcttgtcacggaaccataaaaacttcaaataaaacctcttagagtatatgagttctcaggttcacaaaacctcgtatcaaggcggatccaccacccgacaaacttagactagctagctggatgcacaatagaatttgactgtttttgatgaatcacaaagaaaattttcataacaaaaacacattgatataatataataggatcaatttggccatgctttagaaatctttctaattttaaggtcggccactgcctacggttgagttgaaatttaaacgacctatgcgttcacattcctaatcccgccgatcctgcaaatgttaattaaatcgctgtgagttttttatgtataagacacagctgcaaatatttgcatgtatgaatttcaaatggacgtacgcgttaaattaaatttcaacgcctcgtgaaaagaacaattcaatttcaacgatttcacgagaagaaaaaaaaatcacggttcttagctgttaaacttctccgatccgatggtagacgcgtgatcgtcgtacacagacgcgtgaatataatgtaggactacggttctcgtacgagatacaggaggaccggccgttgaaatacatttgaaacttttttactgctctttaattaccattgcgcaatataatggagaattaccgcggccgatcgaaatgaccgggatataacggttatttttacagtcacgccttaggccgtatttagttccacgtcaaaattgaaagtttgactaaaattgaaagtttgaagaaaaaagttgaaagtttacgtgtgtagaaaaaaattgttgggatgaaaaaattgaaagtttaaagaaaaagttaggaactaaactcggtcttatctaactaaacacaggattaatccggtggtgattaatgaagagtgtgctgatcaatgcgcaaaattagagcacattgtattgacatggtacacgaatttaagtgcaatctagtatataaacttgtaaaatacttattttttatatgaatttgttaggtgtgtaccaaccaaaaaaaataataagactaattttgctaggctctcatcggatggcctgttcagccaaagaaaaagttaaattttaaattttcaaacttaatttggaggttgattttgagatattttcaacgtaatttcctttttatattagcttttaagtcaccaataacacatatataaaagttttacctacaaattcgtttttattccctaataagccggcttattagggaaaaagccaaccgatggggaccctaatttaagtgttaacatatcctctcttataacccactaactctttaagtttgacatgcaaagatgccacatcatcatccactaactatcattacaccatatcatcatccattaacaatcatgacatttaaacatcatgcaaacatgttatattagctataacttttaaatttattaaatttaagatcattatgtttacataatatttcaatgtatatcttcattatgttttataatatcctatgtatctatatagttcatcctcacttagttagtgcttaaatgattaatgtatgtacaaattatctatatcatttcttctctaattaagccatatcacctcaattgtttatagcctttaaatgattaatctacgatgcaaactatcttcctacttttcctctttcataaattcgtaccaccttacgtttacatttgaatcatcaatctacatactatttaaatttaaattatcataaaccacactaacttacttaatctgatattatctagctattttatatgttatttttatttattattgttatactaaattcctacagcaacgtgtgaggtttcacctagtgttatatgataagaatgctacctatacatataaatgttaaatagagatgattaattagctggtatagttatgggcacacggctgggccacatgtatgtaacccccaagttggttaatcaaataaatagtatgcgtgattaattggctctatcaatcatatggtctgatcctacggcgcagatatatatatatatatatatatatatatatatatatatatataggacactcatatggggcaccatggtgcccgggcaccatggtatctaatgcacaaaattactcaaatttttcaaaattttcaaattgtgagtatatacctagttataataatttgattcatacctatacttatcaacaaaacaactcaaatttaactttatttcacaatccatgattacatacctaactaattatatatatggatgctatatacctagaatcaaaatctaacaaaaacaagttcaaattcagttcaaacttgctttaaactagttagtaaagtagttaatgttaatacctaagtaattgaaaaagtttcatactcatttgaattgggtatatactcaatttcaacaatggtgcccgggcaccatggagcaccaaacaaatttactatatatatatatatatatatatatatatatatatatatatatatatatatatatatatatatatatatatatatatatagacacacacaccagctggaacgtgccaataattagaaaaatctctcgatcaagtcaagcactagtgtactacagctcaggcatggcggttgccaagcatgcgccagaatgtttctgcgagggagaaacatgggatccatgggatgcccaaaacgatggcgaaataatctgtgtgcattaatttgacgaattttcggtaggcgaaactgacacgcttgatcaagaacagctaattacaaagctagctagggccacatcctctaattcacacatgtacaccctgtttagaagagtttaccttttaaaatatccagctccactaaacagcgcaaattctcacatatattctgagaatatatatgtaactataaaaatgagaaaacaaagtaaaagccaaaatctagcttttataaattctcataagttactaccaactgcatatagagcctgaaaagacggaagtggactacaataattttgaagtcgctaaaacaacttgaaagcacattattttaatcaggcggtattgtatttttatgcattttagctattttttctagaccgaggggttaattcgaagagttttttttagagtgataaagttgctagaagcataaaatgcacatccctcaacagatggccgtggtagcctggtaggcgacgcacttcctccgtcccaaaatataagcatttttatcattgtactaagtcaaccattttaatcatgtaaaattgatgttattagatttatcattaatcaaactagcataatatgtaacgctttttatttaaaatattttatttttataaatattgttggttaaaatagtatctcaaaaactatgtcaaagttaaaaaatgtttatattttgggatggagggagtaccgtttacagacttgggggaggtgtttacagggtatactcactctattctgaattgatcaccgcattccatgtttacactgcacaaggaggagaagattgatccctaatccatttgatcaacgcattgaagaaaaagaaaaaaaatgttgctttggtgaacgcatcattcactacaggatatgaagggatgcaactatgctctgtatgcatgcacccaaacatttactttacgtagagaaatgaaaatacgctgcgaagaaatacctaatacgctgatcatttcttaaaacattgaaaaagtactatataatgaatatttgtgaatgaagggactatataatataattgattaataaaatatctagtactctatccgttccaaaatatatataaattctagcatctgatcgaaatgaagggatgcaactatatatgctctacatgcatgcgtcgaaacatttactttacatagagaaatgaaaagacagtgagaagaaatacttaatacgctgatcatttcttaaaacatcaaaaaaatttatatgatgaatatttgtgaatggagggagtatataatataattgactaataaaatatctagcactacatctttcctaaaatacaaattctagaattcaaaatttgctccaaactataataaatttttcacccacactcctttctgaactaatcacaacatttcaccactttctcttatcaatcaatcataatctttttatatttaattctatttactttctttaatactgtgtccattaaaactcttcatattttaggacggagaaagtatcttataaaagaataatttaataaactataggatatatgacactaatgattgaagactaatcgctttcaagggccaggacaacgctgataagtgattagatattgtgccttattgtttggcatattcatatgcttatcaaccaaaatttaaattttcaacgttaaatttggagttgattttggagtattttcatcgaagtttatttttcagcctttgcttttagatcgctaagaacccatatataaaagttttattcacaaattgattttcatttgcaaatatgccatttggcacgatgaggctgattgtatctgttctgggttgtcgtcactatcgtctagctgacagtaggtacagtgctgatattttaggcccacctgtcggtgaaatcgaaactcgaaaggttgttgaaccaaggttgtttcagtacctctgtgttggctgcttggtgctctatctctatggagagctaatgggcactcggacttgtccattcaattcagcaaaatgcttgtacacattcttaggtaaggtcaacttaattgctcaatccatgagagattttttttccttttcttcataaaatctttcagtgtgtctcaaaaccgttttataatcacttaactttctaaatcaacattccaaaaccgttttataattccaaaaccgttttactccatacgggtatgtgtgtgcacggtcataaagagtatgcgcccgttgtgagcatctgcgattatactgtgtttccccaaaaaaagttgattttcagaaaaattttctaagaaatgttggtgaagatttttcttttaaaaaatgacaacgtgctaaggtctcaagagttttgctcacgctaatccggtaactataatcagacaagaactatcttaggttgtgttcttccccattccccctcctttcccaactcacctcactctttttccacacgtaagcttatgaaactattaaaaggtgtgtgtttttttgcaaaaaaaaaaatctttacgaaagttgctttaaaaatcatattaatcctttttttaaaaaaacttagctaatactaaactaatcatgcactaatgagtcactccgttttcaaggtcggagagattagttctcaaccacaggaaacgaacacaacctaaagctaaagcattgtcttactgttttcaaagctaaataagtaaatgtgtagttaaatgtggaggtaaacttaagatcaagctgaagcgcatggaaacgttattattaaagagtccaaaatttttagtagtataaagaaaggtccggaattttgaatcaaagacttcttgggagaaaggcagcatacaattaacaatcagcatacgtgcaaacagttccaacagaaagaaaaaacgacgagacacaataaaacaagaagttataggaagcaaaaaagctccaaaagatgtgagtgaagcaaatcttgaaaataaaaagagagaagaataaataacaaaacctaaaaaaatgaattctcaaaaacaaaaatgcgattgtttaaaaaaaaagggaaaaatgaaaacaaaaaaatgttgacgcccaccgtggggctcgaacccacgaccacaaggttaagagccttgcgctctaccgactgagctagacgggccagcttgtctgaatggcattttttatgttattataagtaaaagttataaaaagattgcacaatttttcaattgcatttcgtgaggttgggcaggaacctgaatactgataagaacaatgtaccagtgcagaaaagcagacgaaaatcacccaagccgagaacgctgagcattacgaattttccatggaaatgtggaatctcacacccaacacaacgcatttaaaaagtccaatcctgttagttcttggaggtaatatgctcttcagttcagtcttgactaatccccctcttttcctcccaaattactgcacaaaatttggccatcaagcagccccacgaacagcccctaactaggttcggaatttgccaaagagggttgaaatgtaccatcaccgggggggggggggggttactgtactcatcaatgagttctgaaccaagcaaaaagtttagcccctaactaggttcggagttcctgttagttcagcattagcgcatacggcaagaggcaagaggcagatgtgtatttgacagtttgacacaagccatcaggagtgctttggccgccgggacaatcttctcaggttcaccctctcctggcatcagaaaaaaaacagcaagtttatcagcatcaagctaaattatatcatttgcaggaacggcatatcatttgtgatttaatggttgaacattcgcaggaacggcatatcattttttgttctaaggatacgtgggtaggattggttgaaattacctgggttccatcatggtcgtattcgacaaggaagacacatctgcacccccttatatcatgttgtttccgctggatttccagaacatgcgcatcgaaatgcaatgcttcatcattgctctcctaatgaacaaaatcacaatgaggaaaggaaaaacttcaataaaaaatacattttaaaaaaatcaataaaaacgactcgaaagtagaaagttgcagcagtacaacatattgtatagcctctcagttatagtttcagggcaaaagaaaaagggaacgtcattaccctttaccctaccttgaaacagaggacaaggtctccttccctgatgagtttgcattctgatgattccaacgggatggattgcaggcggatagccttccggacattgatccattcatcctcttcagccccaaatccttgaaatctcactcggacttcctagaacaataatgaagaaatagagttttcaaaaatagatctttaatttgtacggtgcgaacaattataaaatgcaataacgagattcatgtgatcagacctaagaagaaaacgaatatgttatcattgaagactctccaaaatccatgtggttcaaacttaagatcaagctgaagcgcatggaaacgttattattaaagagtctaaaatttttagtagtataaagaaaggtccggaattttgaatcaaagacttcttgggagaaaggcagcatacaattagtaacataggggtctgagacattctaaaattcagggcagtgcacaaatacttttgaggaaaaaaaaaaagaacacatgacatatgctagcaagccgataaataaactatcagctgaagagacataaatgcaaacatatcctacaacatcaattattctacttacaaattcaccagaacttaacttcctgtatgctaagaaagtggcgatatcatacctgcatagcacagaaaatcatgtgatgactatggcattagtgttggcttgccaaagttaagaaacaaaacaagataagaaaacttgaaattagtcagtacatgtacaaacattaaacttccagcttcatacagcagtactaagtactaagaacactgcacaaatgcccagttgcaaagttaactgagatcactaccacagttctagcattctaggttctaacgtaccaaactagcataatcaggaaaggagcaagtgatttgtcatggcaaaccttcccattgatgggaattatgtctctaagtactcctaacacaacaaacttgggtacaactttcaacagaagttaaatatattgcttgatcctgcatgattagcattaaaattttgaagacaaggaaatggaaagtatatgggagaaagggtcaaaggaaacaagaattgtatccccacaaagtaaaagggtattcaccaagcaaaatcctttgaagacctagcctcgaactgcatgtcttcaatttcaggaagcttatctatgttgtctgaaaagaagtcaacacataagaaataatgcacgaagcatcatgctttaacagattataatatttgcaactacggaactacctataggtaaatccggcgaaacctcgcctatatcatttgaaatgcttgtatcaacagctaaagcattttcttcagatgatggaggcttttcttcagaaaccggtgcacttgcttgggaggctaaagccttttcttcagagccagtaggcaaacaaggaggtataacagttgatgcagggaacttttgacggaaccattcttgaacctgttcaagcagatgttattatagtacacaaattgaaatttggggcataacaagagtcagacggtataacctgcacagcctgtagtgctttacttccaactcggcctggagaacaactgcgcacagcagaaaatgaaataaaaaaaaccataatcattagtttgaagctattgcatgtcaataataattcacaaattaaaaagaaacgtttttgcaacaccagtattcatacagttagacaacatttaactatttaagacatatctgcttaaggagaacaacagaagacacttcgatcctttcataagcttcttgcagaaaactacgatcgaagcctatagtctctactctctacttattgattcagaataaaaataaaggaaaattaaatgtttgccaatccaaaagattgataatctaaaatatgccactccacagaatgtaaatgctccaacgtgaatactattttgccattttgagccttttttagaataatacatgtctttttcccaacctgaattgccatttcctctttcctagattcttccccctactcccatctaattttctctcatcatcggacatgacaccgcacagttcagtttgtttgttacaaattacgaattaggttagtgttgatggcattaagctatcccaaccatactgttatttaaaagataaaggaccaccgccaccttataacactgacattcatggcaaagatgtgccacacaattgacctattcttgcacccacggtcagcaagattattggttatccaagcacctatctccaatacaataaaacatgaatctaaattcctcaaacatgactggactggctaatgcctcgcagccactgctgtcatgcatggcacacgtgagcaccaagccaccaaagtccttctgacctgctactcctcataatgaaaccacgcgcagatggaagttcgtatctgctgaggacatcttatccagacccagactaccattctcatgtcaccacaggtcatctagtcatgattcaacactctgaacaacttcaccatcatcaagtatatgtaatgctcggaccatctcgaccagacatcattggagcgctatccctgagcaagcccaactgcaaacttttggtcataaccgctggccctcaccaccacatgctggccttatgtgacctggagctgctcgacaaggatgccaccccattctggtcaccaaggataagaagagcgctacagcgtacaagggcaaaattaccgagcaatgtgtgggtctagagtctagaccaaatgattgaaaaaaagactgaaaagggcaaaaatagaatagatcctctcttcacagtggcattagaatgattatatatagttgagtggccttttgggcatgtcagccttggcaatggtaaatgtcaaagttttacctacaataaaaaggtttagaacaccctgtaaggttgtaacactgtgggactcacttaaattcttctgcgagcttccggcagaaaatttcatccaagacttgttcctttttatgtgtaaccaacttctccatccttgcaatctgcacgaggaagtatttaggttaccatggaagatgcaaactagcatagtacaaattgtatagctgatttaaccatgataatacagcatgcagagggaaagactgtgtactatactagtagttcacttaggtacagtggttgggatcatttgagccccatctcctaactttaaaaaaaatggataggatctcctttgtgttcccatttctagtcattacatgcatagctaaatagagattgatttacaactagagaattcatgttgaatcatgaaactacgtaaagctaacaaaggagcatttactttcccttcttccttcctctgaaatggataggcaacacacaaatgatgaactatagagtttaactcttaaaattggccataggatgcaaaacacagcaatctaataagtacacattgtgcactactaaaagcccacaaaggaccatcgaatatccttttctccagtagttaggatatattgaagagtggaagaacaaactcaaccgaagtgtttttcccatttacaggagcaaagaactgaaaagaataagttattctgcttcagttacaagaatattaagtttaacaaagaaggaagagttggcaaaatagcaatgctgaccagtggccacagaagaatatctgaataggaggatagccacttccttgactcaacctcgtgactttgattaggactcacatttagctattcttgggatcaatatgaccgggttaaatgaataatgcaatatgccagtattttattgttgcatgcattgatcactacatgcagcattctagccaaaaacatcagtgcctcatgactcttcatatttatgaaaagagtataaacttctaccaggatcacccaatgctaaactgaacattttgttcagtaagcaaaaaagaaaaggaacaaatatacactgtagtcaagattagtcaacagatgctgaataactatagtacatcacaagcctgcatgtaatcacctgaatgcgcactagcaaataaagtcgccatagcatcaaaatcccaatcaatttcatcatacacaaggggagagaacttcccatggcccccacaagaaccccgaccaaaacccaccaagaaaccacaccacttgaacgaaatggagcgtggggaggcataaacagcagcagggcgaatccgatcccccgaagaaccagagaaatttctcccagctcaatcgcggagatgccccggcccgttcgtctctccccaccccaacccaacaagaaccccggagaagcagcaccaccccaagcggaaccccaccacaggggcgccgacgagaggggggaatggatggggcgcggcgaggcctcacctcggatggcgcgaagcgaacgctcgatcgccgctccatttctcgccgccggcgaggtctccgccgccggaagaacggggaagacgccctcctcccaacttgcagcaaagagtagaaaagaaaatgaaaaggaaaaagaaaaaaaaattaaaagagaagtaggggaagtggttgagtgggccccaccagataatggccaaggaagggactggttggtgggcccaggaatcatcctgcc

SEQ ID NO: 62591 - DNA, 687 bp, Oryza sativa
agtattcaacaaatgttcgccacctatatgtcaatgcaagcaacatattaactgtgtatgcaagccttgaagaaaacatagaaataaagaaaaatttgagaagcttaataatatgcaaggcagatgttgcctcctggagctggacccgcacatctaatttcaactatgctctggaagaaacactgaaagagttaggaagcttacgggtattagtgctccgccatcctgctggtgttctgccaaacaacatccagcatatggtccaccttaggtatctggacatcaaagaaagcagagaatttacctttctgcctacatcgttatttggactctaccacttgcaagcattgagtctgcagtctcggtatgtgaatagactaaaaataggactcgaaaatggcatcagcaggttgacccagttaagatacttagatgctccaccaggaataatttcaggcataaaattgattggcaagctcacattcctccaggaattcaaccatggcaatgcaaagaaaagaaaaagaacagcatcattatagaaaaactgtaagtatgacaagtgaattccctccttaatcatgaattatggattaaagaaaaatctataagcaaatgaatcatgtctagtttgtgggtacaatgttatagttgtaacaaaaaatcttctgtgagaggcacaatggg

SEQ ID NO: 62592 - DNA, 1250 bp, Oryza sativa
ctgagctggtcactgtcagtaaaatctatagcatatctatatagatttttgaaaagaaaagagaaactacttgtgaaccaccagagggacgagttaacaagcatgtgaccattgtacccagtggggcactgggcggcgctgctgcacctacaagggaaatgtcaaggagtgtcgtgccacggcgagggttcacagatatataaaatctagtgttctcatcattccactcagcagcttctggcatctgcactaataaaatggattatattctgcactttaacatcatatagtcatgatgtaccatttgtgtcagcaagaagcagtagaactcaacacgaaaacaaagattgaatccatacactatgtttcagcttttcaggtttctccctgaatgacaaaaacaagaaattgaaggagatggaaggtcttcctaggccacattttcaaacctgtacactcttggaaccaaaggaaagaagaaccaaacaactgtaactaaaaaatgcaggtatttcctgttcagatcaattgagaacaactatcagaacttcattccttttacaccataatctgatctctatcgacaaaggtaattgagccaactacgacactatcatataagcaagaaagaaaacacatgagaaatgtaaatgttaaactaaatccaaaaggaaaatcctgaaagtaatcagcatttactctttgaaactgaatccaaaaggcatggactgtgataattctaacctactagcatcgctacatgcaagcaacatcaagcacatagacgaagcatccagtacataggcgaatcttttcttttgttagaaacaaagttgtactagcacaaaaattatcttccagttatgctagaaatttagggtgtgactcaaaacgaggggaatttaggtgtgggatgaatagatggataccttccgttcttggtgatgaggaggtatcgcgcactgcagatcgaggcggcagccgaggagccggtgcagcgctgcgaagggggaggtcgtcatggtggcggccggcggcgctaggtcaggaggagcgatggacacctgcagcggcaataggtcgagacctagcaggtgttgggctttttcactttgttactattttcaaccttaccttttttttggcaaagttaccaaaaaaataactacatttagtttgttgccaaattttagtaagtacatatgaaatcttgccaaaattttggtaaccttaccaaaatttggcactgc

SEQ ID NO: 62593 - DNA, 9105 bp, Oryza sativa
aggacctttgttgctctgcgtagttttgccgcttaaatcccaggtatagcagcccatgatttcagcctgtccttttagaactcggtaaccatataactccagaacatcctcagcctgataagtataagtagcatctgttatttccaatgtttgtttccttattagcttgtaatatcccatctttgtgtctcacttcttggattgtcagtagactctccttaaggcatctcagtttgttctttgcgtcttctcggtggtattcatgctcatctcctgcataagagcgtatcctgtcaactagatttggctatccatccccgtattttttatgctgccatttttagctcgatggagttcgtcagtgctggttccaagttgctgcataaagaggaaggattgttatttttgataatgaaagtggaagggttgctgatttagagaaaacttgtattttagagatagttaaagaaagagtcattatgatttaaactaaaaagctatattctccgagcagcttcatttgtcagtacagtggaaaaatcattaattgattctttttaatttgatttggttgcctagttttcttggatttttcacattttttatccttttagaaaacttattttagaaatgatcattttcatggagccaattcattggcgccgtggtccaacatgacggtgccaatgacgtttgcgtcatccccatatccccttggtggatgccccttggtggaagctaagtcactaatataaaagggacggcaccgatattgttggcgctgatgaccaatttgtattttttttaaaaaggctctagttgtaataaaaaaatatttacaaataggtcttcggtgctagcgtcattagcgttgagaatctatttgttaatacaaataggtccttttgtgctaaaagtaggttattttatcttttacaaataggtactcggctccaacgatattggcgctgtcctccttcacattaatgatgcgagggggacggcgtaaacatcattggcgccgttatgttgtaccacggtgctaaggtgctaaggacttaggctgtgatcgtttgggtgggttgggaacaaatgttttgtgcacgaaaaacggagtagtccatcagcgcatgattaattaagtatttatcaaattatttttgaaaaaggatcaatatgattttttaaagcaacttccgtatagaaaatttttgcaaaaaaacacaccgtttaatagtttgaaaaacgtgcgcgcgaaaaagcgcatgattaattaagtatttatcaaattatttttgaaaaagtatcaatatgattttttaaagcaactttcgtatagaattttttttaaaaatacaccgtttaatagtttgaaaagcgtgcgcgcgaaaaacgagggatgtgagttggaaaagttagggaaagaactcagcctcaaaggttaaaatccagcctagttttccatgcctgatcactgcacgtctgcgcggttttcagcttgttcttcaaagatattaacatcttaaaaattgtattcagctgcccacaaaggtattaattttaaacatagttgtaacatctaagacatagtttctggcgacccattccaggcagatcatttttattatgctctggtgaatcagcttatgtgaaaacctatgcctttctggatgctactgctcaggttggttctaggcagaattgcagataccctctgaaccaattatagctcgccgaggaaattacttggaacatgcctaatttaatggcaggtattgtcttctagaccaagaagggtcattcatgagtaatgatgcaagattatatttttccttgtagtttagttgtactgcttactatattccacagcaaaggtagaagcaaaatggtgtcttacatcttcttgtttattgctacatgttttccaggacgaccttccttgctctgcgtgtttttgccgcttaaataccatgacagtataattcatgtttgctagctcaatacgctagctgtgtcctttcattaaacctggattgtagcgttcgttttctgtacaataagagcatgtttagttcgcgaaataaaaatttttatgtcacatcgaatgtttgaccggatatcggaaggagttttcggacacgaatcaaaaaactaatttcataactcgtctggaaaccgcgagacgaatcttttgagtttaattattccgtcattagcaaatattggttactggttaattatggactaattagtcttaaaagattcgtctcgcgatttccctccttaactgtgcaattagtttttcttttaatttatatttaatgctccatgcatgtgtccaaagattcgatgtgatgtttttggaaaaacttttggggaactaaaacagggcctaaacattgccaggtaatggtctaattgtttgctcaaaatggagttttcatgcatatatctgctaatgatagaaaaaggtagaaaagtatatgtcaagtagcgcaagatcctatataaacgtattaacagtttttagccagttaggaataacaaaatattcgatcggccagtcgatcgacccagtcaagctatcttaatcagcctgtgaataaggctgagttataagcttcaactctaaacaacttcctcgttttctattaacactcatccctaactactaaacggtgtattatgtgcaaaaaaaaatatatattaaagctttataaaagcccatattaatctagtttttcagtttataataattaatacttaatcatgtggtaatgacttctctcttttctggtatcgcttaaactgcttctggtagcgcttaaactgctagccgaagtgctagctcgaacgcagccgtacgagacagctgggactgatgagccgattctagcatatacatatcaatgatggattattagtatataattaattgagtattaaccattataaacttaaaaaaatgatttgtttgagtttctttaaagaaatttctatagttatttttgtcataaaacatcccattttttgtcataacagtgagctctagcacggcctcgtactcccatcacccgaaggccgccgcaacaacgttgtccgcgtcgccccttcctccatcaagccgaagcccttgcagccatcaggctttgtcgtcatcatcgccagcttcacgtcatcaagccctacgcgtcgctaacattgcttcgtctgcttcgtcttcacccaaaagtcaccaccgaagttgtctcccaattaccgacccatttgtctatgtcccccaagccatcctctccatgtcaagttcgtcaccgctctcttctagccatgctagttcctctcctctcgtcgtggcttctctctttgtggcattgctattcaccaccgttttctagagggctttgatccccgtgctgctggcatcggttgccacccgtgttgtcatggtgtgcacgtgtggaggccacgtcagtgccacgtggttgcgcgcattgcatctagtggggcccgcttgtgggcaactggcttcggttgacacgcgggtccacttccatagacccgtgagcagtttctgtgcacttggtcctccatggtctcgaggttgacattctaggagcaataaacatgttttatattgcaaaattaattcaataatttgtagatctccattaaacaacaaataagctttggatgaccatattttggtcatacaaactctgaatctatctgttcaagcctcttaattataacctaaagaatccatggttgtgcttcttatgtactgatctttgctttttgaatagggttttatctttttttttgtgtgcttcatgtagttcatgtcattccgaaggatcctgaagtgcggttcgtttctgcgctgaagtttcagaagatcgtttctttgagcaaaggcatgtcgcatgggaatttgcaaaactgttttaatttaaagtattgcattacactttattaaattctcgcatataattgttttacttaggcatgcctatcattccttgctatggtcttactatttgttattgcttcattagacctcaacaattgtaggtaacaaatacaagctagtgagaactgatgcttacttgaccttttaggataatgcttacccatgcttagtgagaaacttatatatgttttacaatattagatttcgggaattatttcacatctcacatagtaacttcggactgttggcgggttcgcttggacatgatgagcttctccctttaaaattcccaaaaccattttttcgatagggctcgaggtgtggtttttttacaggaaatagtaggagaggctcctactgcaaaatatcatagagatagagtaatatttacagaagactataaaaaaacgaagggggaagtgaaatttacaaattgtcaatccatgattgccaaaagagtctatcttgctcctttaccctaaacaaaagtagagtaaaatcctcccagaaacgacatttacacaggttgaagcccggtgcaatgctgttgaagatcaaatcatttctgatttactaaatgttccagattgagattgcaaagacttcaatgaagaacgggaacccaaagctctgttttgctgaaatcaccatgttcataaattccatatctgtatccccacataactccagcattgtgtggcaaatgaatatgtgaagaataggtgcaacatatcttctgtatagatgtaatattacatgcagcagagttggagcagagttggagcttgaaatggtttgaaagtatttcattttctcagtccttctcgtacaggcggaccggccgtccgactagaaagaccgattttgtccgcctagaaaaatgtttttttctattagtgaccactgctgttcaacctgaaccactgttgccgaaaggtcgctggaacaccgttgttctctacggtggcacttgggagagggtttgactggttcgatcaattaccttatttaattacctcagatcagtacagcagtacagctgacctactaagccctggaatattcactacgctagatcggcccacctgtgatggcccaccagtgacatgctgaagtgcacatcacatatggtccatcagaaggtcataacaggtgaggccatcggctgaggcccatcacaggtatttggtcacgtgtgatgggttggaatttgcactcgacataggtctacctttgtcgggtgcaaattttggcccgtcacaggtggcaaaatatctgtgatggtccttattgttccagcccaacatagatgcgaggtatctcacctgtgacatgtgtaaaatttgtgtgcccatcaaagatgacaaaaaaaatcgctttttttccattctcttcccggctccgaagcttctccttatcctcttcttctttctcactcctctactcctctctctctctttctattcttccacccagacgtgcctccctcttcgaccaactgcggccggatgtggtaatggttgctggacactgcctccccctccaaccgatgagcgtcgggcgcttcctcccccttcgactgactgtggccagatgcagcaacgattgttgggcatcgtcccctcctccgaccgacgagcacctggcgactcctccaaccgctgggcgctgtcttccccgggtcccttgcctttatccctgtcggatgcgcctccgactaacgggcaccgcatcctacgagccctccttccctctcggcctagttagatgcgccttcgaccgatgggtgccacctcccgtgagtcctccttccccttcggcccaaccggatgctactctaatcgctggtcgccatagccgctctctctcgactgcaggtcatcatggcctctttcccatgaccgctagccgtcggaattggcctccatgaggtcgggggacatggatctgaactctaggcaccgcctccttgatcctcgtgtggcgactgaggctatcccttgaccgccagtcccagatccatcgtccacgtggttgggcgacacgaatctaaccaccggacactacatcctctatccctaggtgctgcgatatccaccccgaccgtcgtattcttcatccctgactgtcgggtattgtctcctccgaacctaagcaccggccacctcctcatggacaagcatggcatggtgccatggtgatgaagatgaagggctttgtcggccggcaactccaggcgtcgtcaagtattaccccccctcccccctccttctattgcgctgagatgatattgctgtctattgattgacaaaatcttatcatccccttctgtgaatgtaacagtttttctgatctaaaatttcatctgtttgaatgttgaagttcttgtgatctaaaatttcatcctttttttgtttttgcaatttcatcagtgttgacagcgagcaccacaatggcactggttgccattttttctcgttttttcacaccgggttgtaagctgtttttcttaatttatttttctgggttatagataccactgacgggtacatcaccaacctatggaccgtttgagatgtggtcatttgcgacgggttctgtaagcagcccatcataggggttggtcaccagcgacgggccttcacccgtcagatgtgaggtggagtcatcactggtcactgatctctgacgagagccaaacccgttagaggtgatagtatgagtccgtcagttagcgtagtgattaaaagttcatttcctctagataaaatatttcctagttcttgaaagacaaccgagccactcgttgtgtcattatctgcatagcaagtttgcccacaaaatgctaattctcatactttagagcaatataattaatactttattagtttaatattataagatgctttgttaaactttcttaaatttaactaaatttatagagaaacatagcaactcttataacacctaacttgttccattgagactaacattgaatatagtttgatagtatatgtttggtgttaaaaatgttactatatttctctataaatttgtaacttataaaagtttgacttaaaaacgtcaaagcgtcttataatataaaagatgaagtacccagtttcatatcactggtggagaaaccatctttcgtcagtcggcctaattgcacaatagtcccggttgcaacaaaaacggggactaaagatcatctttgtcccgattcaaatgctgtcagctgtgccaggcgccccagagctcattcctgctgcccggtgatatcaaccggggctaaagatcccgacgatctttagccccggttcataacaccaaccgggactaaagtcccacccctatatatatatatgtcttcttcctcctctagcccgagcaagcttcaaaatttcttcaaaaaagaggggaggtcatgccaaaatttctagtgaatttattttggtgattatatacaaatcggaggtacctaaaaggttagcaacttcatcctccaatgttttttttgtcatattacatttggagctatgttttgcacacttttttgtctccaaaattttgttgttagttgatgagagagaaaatttgtgtggggaagaaagaatatatagaaatttagtttatttgctaaagaaggttttataaaatagttgagaaggaaaatatagtgaaagttaatcttgaataatagaaaacaaactaaaatgaaaaattaaaataagtacaacacattaatagtagtttaaaactttataaatagtaaataagaattatttggtgtaatatttcataatttttgtatgaataatgatatgtcattattgtgtgactgttgaaagagtttgtaattattttataattattgtattactgtcattattatacgaataattatttgtgtacgattttttttcatgtcatgtagatggatcggcaatggatgtacgctgaccggcagtccaaagagtttattgacggcgtgcattattttttgagagtggccgaagctaacatgcaaaagggttttatttgttgtccatgcgataagtgtaagaatcagaaggagtattctgcatccaggactattcatttccacttgtttaagtcggggttcatgccaagctataattgttggacatcccacggagagcaaggtgttaaaatggaagaagatgaagtggaagacgacaatattccgcactttgctcagtacgctggatttgaaggaaatcaaacaggcgaggaggaaagggatgctgatggtaacaacgttacggatgatcttggtcagatgttgcaggacgccaaggaggattgcgaaagtgaaaagggggcccataaattggacaagatgttagaggaccacagaacgtcgttgtacccaggttgcgagcaggggcacaaaaagttggataccactctggagttcttgcaatggaaggcacaaaatggtgttagtgacaaggcatttggcgatttattgaaactcgtcaagaacattcttccggagggaaacaaattgcccgagacaacgtacgaggctaagaagatagtctgccctctaggactggaagttcagaagattcacgcatgtccgaatgattgtatcctatatcgcggtgaggattacgagaacctagaagcatgccctgtttgcaaagcactacgatacaagattagacgagatgatccaggagaagttgacgggcagctaacgaagaagagaattcctgctaaggtgatgtggtatttccctataataccacggctaaggcgtttgttcaggaacaaggggaatgctagaatgatgcgatggcacgctgaagagcgtcaacaggacgggatgctgagacaccccaccgatggtttacagtggcgaaacatcgacagaaaatttaaagactttggaaaggacacacgaaacatacggtttggtttaagtacggatggcatgaatccttttggagagatgagcagcggccatagcacttggcccgttacgatgtgtatctataacctccccccgtggctatgcatgaagagaaagtacataatgatgccgattataattcaaggccccaagcaacctggtaacgacatcgatgtgtacctaagaccactgg

SEQ ID NO: 62594 - DNA, 6418 bp, Oryza sativa
caagctctcttccaacaatattgttccagatgagcagccaacatggcaatgatggtgagaaaaccctacatgtgcacatgttttgcagtatattttcattgatcaccctcatcagtaatgattcataaaatcagagtaatatcagttggtggtgatacactcatatgccacagttcaactgttataagtgactttataactaaattcgtaaccaacagttaaagatggcaagctctcatcgctaaccaatgaactatgttggttcaacgaatggggcaccctgtattgtagtgactatgaaattaatcttttgctttgttacaacatactaaaataaacaattttataatttgtaaaaaggtaggtcctagtttgaatgtcattttaccatcgagcttgtctgtacagaggcggtctgtgaactacaccctactggcgtattgcacatatgatttaacttatggaccacttgagcaatacaagggggacatttgcaaaaatagttttgtcattttgtttttaatttcctagcaccgttgcattcaacagttgaagctttcatgataaattgtctcattagagtactactagtggacatagacgaattagtatagagttaatatagaatacaatcaaaagctaccttgtacatcttgtccatgttgtctccaccagctctaatctcaaccagccagccctttggaagccattcatgtgtcctctgcataaatcatggtagaactcagacgtactaattctaaacaccaactaaaatcttgaatgatatggtcatatatataactcaccgtaaggttactgcctacagcatggttctttgattccaagaaacactgatccatctctgagaatagataatccaaaacctctgacttcgttgtgaaagtggttccggacaagggacatatgtaatactgtacaaaagcaaacaaaattagcattgcaacaaaaatcttttagaacaaacaataaaatttaagttccacgaaagaaatagattgccatctacatattttaatacccggtagatggtgccatcatcatcacaatagacctccattatccagccatctggaagccaacctggtcggccatccacatcatcgtcgtcactttgcaaattctttgttgcttcctcagaagatttgacttcatcacgatcatcgtcgtctaagatcccgacagatggtgacttgcccatggttaaaccaagatcaaagaactctctcccctctacctccctccctcgccctctctctctctctctctctctctctctctctctctctctctcaccctcctctgctccctccctctgtttctatacctctctcaactttgcactagcttgtgtatatgtagaacaggatgtttagctgcatattaatagctgcggtttttagtaaatagtgtgtttgtatacctttgagggacaacccacaaggcgtattggacagctaatgtttaatataatatgcatttaatgtgatgagttatacatgtttggttaagatatgttctagatagtatcatatctgatgccaaatcgaacatattttcgaaattaatttatactatttatcacattgtagctatccatcctactataaacgataaaatgtatcaaattaattaaatccgatgccacctccagaattgaataaacgtcgtcagtccttaaacttggaccagggtgtcatctaggtttataaacatgtaaaatgaacatataggtcccaaatctcggtttaatgtattggaccataatcattgtgctccacctcattgtgacttaagttgtgtgctttactcagttaactctatggaggacctgcttcatctcttctttcaatgctcctttgcaaagaactgttggaatgctcttggtttctcctgggatacttcactgagcatggatagtatgatggttcaggcaaacactctctatcagggtcggtgcttcatggaaaaattcttgtatggtgcttggaatatctggaagcagaggaatggtttcatttttgaacaaaaaactccttccctgtcttcatggagacaaatcttcaagggtgatctcctccttttgctgtttagaataagtgaaagagataaggatgtaatcctaaactggagcagtttgttgtaatttttctctttcttcctttatcaataaaagttttttaacagtgggggcctcctctgctgcattcctttcaataaaaaattcgtgaaaccacacgctatgataggttgatccactcgaccacacaaacaagtggatctattgcccccctcaattccttgcaaggaaatgcaagaaattcccaatctatggcataacaaggaaatgcaagaacaatctatggcagaaattcagagttcctctctctaatttaggagcggctgcacgacacctaggagatgaaaaaaaaagcaattttcgctgcgtaatttcaatagaataaatttggtctaccctcttatgaagaatacgggtactagctgatacacaaacaacctacatatccgactagagatacacgcgtaaccctgcaaaacaaggattactttgaatggtcaattctgaaaaatggacaatttttagttagctctatgtatatcgcaaccatgaactctagtgttaggattggcaagtggattatatgagatttaaaggtatattaaaactaatgtggttccttaataacaaagtaatcctaacaaaggataaactggctaaaaacactgggggtagacaaacactattgtttctttccattatgcaccagagacaatccaacatcttttctttgggtgtcttgttccttgttttctttggagacatgtgttctttgcttttaatgtcccccacctcgtaatgccataaatatttttggtaatcgtttacggtcattgtagaccaatttcaaccatcaatacatcctaaaataatggggaactagcaatgcttgcatgcatatttatttaaaaataatttagttccacttgtacttagcaaagtatttgaatacaggagatcacaccataaatggaggagaaatgatggaaaatcacctttaaatcaatcagagaccgacatatggttgacatatggatcgatgggcccacaaccccattgaaacttctgcaactgggcccaaccaccaagccactgggctgaggatccatcaaacaatgcccaggaggaagcactgggctagggaagtctgctaaggttcagccaacaccggcctggctctgctggcccaggcccaagccaatgactagggatggcaatggggcggggcgggggcgggttgggctggaacggccccgaccccgacccccaaactctccacccggccccagccccgaatagacatgcgggtgcaaatcaatccctgccctcagcccctgcggggccccacagtgagtagcaactccaacaaatcagcaaatcttgttctaatgttctctatcatcggaatgtaaaactaccaaatatatgaaacaacatataaatatacacagaaatatagatcgagaaatagtgttatacctctcagactctcactgtcagtgcgtgaagcaggccgtcgtgcctgtcccctcaccggccccgctcctgtcccctcgaggccgccacgggcagccggacgccacatctatcccttcataggatgccgcgcctgtgcgccaaaccctcgccagccgctgcaccctcgctgcttgaccgcaccctcgccgcgcagcgcctgtgcgcctctacattctcgcctcatcggcagacatgagggagagccggagaggggtactggagagatggaacacgagaggccggagcccataggggaggggagagggtgaccggcgacgacgtgatctagagaagtgcgccgtgcatcctggcaccgcctccgcctagatggtgggtgatgcggacgggagtcgggaggggagatgccgagatggggagacactggagaggataaggctagggtttgtttttatccctcactattcttttgggttgggcccttttgggcattctatgggctacattttaagggttaatatacacccttggggcctcgcaggtcacccatgggtgaactgtctcccctggcccctccccacaaaaatgcggggccccggccccgcttcccccacaggtcagaaacggaacccgcctccggcccgtgggggaaatttccatccctaccaatgacggttgtaaccgacttcccaagggtggttgtactgaaattaacgcccacaaccgtcattctgaagctataaaaggacttctcatcctccattccaacaaacaccatgaaggaaatcaagtgaagaagctctctttagtttacatatttcgctctagtgctagtggatttagaattagaatggtcttccttagttcttcaagttttacggagaatttgggtatggttctagtagctcttcccttttttgtaagactttatccagtaatgaaatattcttctttataggtccttttctatatttgcataattattcaagtaccaacttaatttggtttacacttatctcgtattaattatatggttagcttgccagagatatgcaacggtattggcatagtgttcacttatttgattgttctatgtcatctgcagaggtgtagagtagtatttactaatgtaagcatggtgcttagattattaagtatcattaagtggtgctatatgccatggatctatagaggtaggccgctgatgctgacagttcagtacgagtaatcctccacgtgcgtatatagggctaagaaaggttcctgttcgtgtactcctccgtatgtaaaactggttggatagtcatgacggattgtcgtaaggtactcggcaattaggggtggtttctcgatgtaccacatagttgtacaatagcaagtgtatcgcaaaaggactatatactagaagtacataaatgatgcttttcttatttcttctctacttagcctagacttataatttagtgagagtattctaaactgaaccttctatgtgtcaaatctatccttatcctcaattgataaacccatgcgtaagactttgatttgcataagtgtaatatgaatttatagcacatcactctcttaccatatcttcccttgggattaaataaatacgataacttggaagtacttctaggtgaaacgctacagcagtatatccgtgcgcttgcagatttatttatgtaatccattatattaccatttaatatttctagcaacattgcttgggattaacttcctagtaaagaaatatcaacactaaatggtttagaagagtacctaggtccatgaaaaatatgatattaattggaacaagtgctttatgttggtcaatttggtggtgccgcaatgatagttctcaattgtaaacaattgtttaacccgatgcaagttatctttatgtcttcctattagctctccttttggtttactatgctatcatcaaaagagcatagtacaatgcacaatggtgctatatatactcttgaaattggtagccatggttctctgaatgcaatatgggtggcatagtttcattaaaatttgttggctaaactatgtggtttaacactagttaataataaggaggagttgggggctctgtcccatcaaattatatctcattttaatttgttgaatatgtgtaatcaaagtgtgtttggattattattttgtgatgattggtttttatgtttggtgataattggctgctagtgattttgtctttggacaggccggtttcactagggtgcgtgtaccagtcctcccttttatcaaattcaactgaaaattcaactgagtgattgtttctttgaacacgacctctgcttctaccatgacactactggagaattgattattaacgacccgaaatgtggtcgttaaaagcttaaatgtggtcgttaaagatcattaacaaccacaaaagtgtggtcgtcagtggtcgttaaaagctccgtcgtaatagtactaacgaccacgcaactttttttggtcactattttattaacgacggcattttttgtggacaccccgagtattatatcatccagtgtccaacacgaccaccacatactattgaaggaatgggatctatacacgcataaatagccactcgtcctcaatgtgtccatgatcgcggttgacaaccttctattataataaccggaatgtcgagtagtgagcgcaagagataaccgtaagacagcttgccagtacactccgtcatatgcccgtcaaccactcgaaggtggcgaccaaaagtataccccagtgactcgatccaaagcgctatccccgattatctcaagcgatcaaaacccgttactcatgcttagctag

SEQ ID NO: 62595 - DNA, 3338 bp, Oryza sativa
ataatagggttaaagtgcagcgaggtacatgacacataatagggtccgaggtcccaacatacaacacctaaatatagcagcggaagtctcaaatagagttcataagcaaaagataaaaccggtggtgccacaaccccactagggcaaaccaaccgggcaagagccaagctgcaagagatcactcattgccctcgccgtcctcggcagaccaatgaccacacaagaagcataactcataaccggaatcctctcctgaaattgcagacaccggattaagtacaagattgtactcgcaagtcttacccaaaattatatatacaaaagggagagagaagtatgcaagctttctagcctatagtgggtctctaggttcaacatttgcatcaagcaaattttattgagcaattaatgagtaaaataagcaaggacaagtaaatctagcatcattttaatttatggacagcaagtatataattctgaaatatataagcaaatgagcccaaacggcgctctcatcatcaaccatggactaccaaagtccataacaacatggcacaacatgccaacaccaccatcaaacataatcccatccataataatccacatttgatgctaacataactaacacatcaagcattgtctataaccgaggacgcgactattcgaatagattatactctgatcagaggtgtacaactggacccacacgaaatgaacaaggatcaaaagctacacaccccgtcgagtgcggtacacaagtgattcaagctcattacatgccctttcttagcctcaccccaaccacctataccacgctggggttcccgacaactcagtcacgtgcgtgcgtgatgtgaccaaggcgggcgcgccacgcgggaggcacccccggccaaacctaggcacccgaggccctccaaaggctacctgcctcacgactctccaacgtgatataaatgatcacagtagaactagtaagaacaagccggtcccaaataaggcatgtggtaagtacgtagggtgcttgattagatgtcaaaatgttcggtccttaacgacctagacggggctacttgcatcaggggaaaccaacctcccatcatcgccctatcacccgtccaagtctaacatatttcatcaaccattatttagtgtaagtgctcaagttttatgcccaataatgcaagttatttatataccacaattaatagcactgtccatccctatagttctattagcactaagcatggctaagcattaatgaataagacatcccaaataatcccaaccagtggtaataggatataaggacagcaataacacaagaactaaatgcataaataggttctacccatacaccataaaccgacaatattaatatctaggcaatgcatgcatatatatacgtatagattgcaaccaaatcatttttagagaaagtataggttctatatgcttaggtgcttgccttgctgctgtatggaaacacactcaacctcagagtctcgctccacgaactccgaattctccgaatctaccgataagaggcaaatatgcaaataagattcaaataaacatgcatatgcaacatgctctataaatcatggcctaattacagtaggtagagagtatgataaactggttttagaaacaagaatcatttcatttacatttgtggtttgagagatataaaaatgacaagccatatacactgaaaatggcatttctgtaattacatatgaactacccttggtcatatgaaatgctgacattttctagttagatttcacaagtgctatcatttttaattcaaaaatcataacccactggttctaaaaaaacttggcttactacatttggagttaaaatatttagttatgaattttacaactttaataaaaagaggattacttaatcgctttagacttactttaggaggtagttttgtcaaattattccttttcagataaaagattatatctttataaggtaaccaaaagtggtttcataattttaggatatagcataaagttcctagagattatacaactcctcggtgcaaaaataagtgtttttatgaaactcacaattttagtgactttttcagtactgaagttgtaatgttttaatttacaaacataaagactacaaaattatgaatacatagaaatttggttcactcgaaaatgagttaagatgaattagttatggatttttgaagttttcctagttctcatatatgttttcaattattcttttggactgtactttttcatgtcgaaccctgggatttgtaaaacttgcaaccaggtccaggttcttctacactcgagcaggaagcagcgacagccatggctgagctcgatctcaagctcgccggcacaaacggcggctctaatgggggcgaggtcaaaagataaaatgtagagcaacacattgtgattccattcctcaacttttccccagccaatggtgactggaacgacgcaggcggcggctgcaatcggaagcgctcgggacgccatgcatgcatcgatgcgtcacggtggacggctcgatctatttcatgcatgtcaagaacatcacatgcaggatgtagaacaccacctaaggttgctactactgcaagaaatcgacaaatggctcaccggttgaatgggaatcgacgacggaggcgctagatcggagttggagaagacggtggtcgatctccctcctcgctgcacggttctgagggattcttggggcgttttggagagcatggtgaggcgaagctggtggcgcagtagctcagccggattcgcctcgaggcgacgggaacagctgcgcgaacccgcggctgcgcgttgacgacggtgtggccgcgctccagagctcccgtggcgaggtcggcgttcccagagatcggctgcaagaaacggggcaagatcagatcagaggctatggcgtgcaagggtgaatcggaaacgaaagaaagatggcgacgacgatgacccgttgggcggcgtgatggcatcatcccggcggccggcaagaagatgatggcgaggagagcaagaaggagctctcccactctggtttcttggatctagggtggactacagagtgaggagggatggctgggaaagctagagagcaagggacgagtctagttcgcgagcattcgtccgtcacgaacacctccaacggatctcagccggtggcaacccaactgaattacagaattagcatgcatcccgccacctaattaacgtgtaattagtacctgtcagatattattatatagtaattagcattggacaacgcaacaaatataggcgatatttttccacgccgta

SEQ ID NO: 62596 - DNA, 7734 bp, Oryza sativa
tgagcgaagaccggtggctaccctcctctcatggagaggagtccagatgatgcccctgatgtgacaatacatacctaccttcacttcaccggggacaaaggagacgtggggcatggccgcgtgtcaatcggatgtgaccggtgacaggccggtcacagaccggttacgcccgatttgacgtgggccagtggtggggctccacacgtctgccccgatcgcactaaatgcttcgagggacggttggagcgccgcccattaatgaccgcccagcttggtttcctctcgctacatggcagctgggcaagggcctcgggtccaggcagggcgagggcccgaggggcctgacgtggcaccccgaggggctgacatagcaccccgaggggccttacacggcaccccgaggccccccgaacgtgtccgcgctttgcgcggtgcgaggagcgggggctgggccaggctgtacagccacgtatgaggaagtgaagggaacttccccttactttgcatacccctgggcccatatctctgacattcggcgttaagcatagccttagccatgcatagatgtgcaacaatcagattatgtgtcaacggccttggctgatcaatacaacagtggactccaaaattagcatggtgtaatccgtaattcatctttatcttgatcatttgtgtgtcaacctaagcaaaagtaaagtgcaagacttaggtagtatgtaatgctcgtcaatatcgagatattgttcacctaggagcaagttcacctctagttgtcatttcttggctctggtacgtgtaattggtcattggaatggtgtaactagtccttggtcctccttagcaaactcttgggtcagtgtaatcatttctgaattatgcctaacctcatcatttgatgatttgtttctgtagcatttgtgttggcttggtaatccataacacatgaagtaatcacaagtatccaaataaacaaccagaaaccaactccaaacaggagcaagctggtcagaccattaggttggccaatctgaccgtcaccactacttcggtctaataggtgcatacgactcggtctgaccggctccatcaagtcaaaacttgttcatcatcagaaacactattcaccacaaccaccaagtttgaccattacacgcatcccggtcagatcggccggtccaaagacaaaaccaacacttcaccaattatctccaaatatcaaaccaatcatcgcataagccaattgtttatcacaaaataataatcaaaacacactttgatttcacatgttcaacacatagaaaaaacataatgtgatggtacagacccccccccaactccatgttattattaactagtgttaaaccacataattcagccaacaatgttaatgaaactatgccacccatactgcattaagagaaccttggttaccaatttcaaaagtatagcaccattgtacatagtactttgctctttctatggtagcatcgtaaaccaaaaggagagatactaggaagacataaagataacttgcatagggttagacaattgtttacaattgaaaactatcattgcggcaccgtcaaattgactaacataaagctctagctcattttaaaatcatatttttcatggcctaggtacttttctaaaccaattaccaaaaatatttatggcattacgaggtgggggacaataaaagcaaacaacacatatctctaaatagaacgcgtaacaagacagctaaagaaaagatgttggattctttgttgtgcatagctgaaagaaacaatagtttttgtctacccccaatttttttagccaggttatccttcgtcagggttactttgctattaaggagccacataacttttagtaaatctttaaatctcatgtaatccacttgtggatgctaactctagagttcatgatcgcgatatacatagagctaactgaaaattgtgcattttctgaagcgatcatccaaattaatctttttaatttgcagggttacgtatggatctagcccaccttgtatttctagtcagatatgtaggctgtttgactatctaatacatgtattgttcacaagagggtagaccacatttattatattgaaattacacaacggaaattgctcttgttcttctcctagattttgtacagccattgccaaatgagagagagggattgggaatttctgtcgtagattgttcttgcatttccttgtttatgccatagtttgggaatttcttgcattcttttatttgtttgcaaggaattgagggggcaatagatctactcttttgtgtggttgagtggatcgcgtgtggtttcacgaattcatggtgctgcacgggcactgtgtttgtcatcgagtttatgggatttcatggtgtatccggatcctacatcgagaaggttgggcatcccagtatcaataatattactcttagatttgttaaattttggaggtgacattggatttaattaatttgattgttcatagtacgatgcatggttacaatgttatgataaattgtataaattaattttttatttaaattactaccaggtcaggcctagtagtagtataaattaatttggaaaatatatgacagttggcatcagatattattctatctagaacatatcttaaccaaacatatataactcaccacattaaatgcattgcattaaacattagctgtccaatacgcaatatgggctgtccctcaaaggcataaacacacactatttaattactaaaaaccgcagttattaaaataccagctgaacatcctttgctacatatatctaagcaagtgcgaagttcaaagagatagataaagagagggaggaagcgaaggagggtgagagagaaagggggagtggaggagggatacagagatagagggcaaggaggcagcgagggagggagggcgggagaggggagagagttcttcgatcttggcttaattatgggcaagtcaccatctgttggtgtcttacatgaagatgattgtgatgaagtcaaattctttgagaaaccaagaaagaatttgcaaagtgatgatgagaatgtggatgagcgaccaggttggcttccagatggatggataatggaggtctatcgtggtgatgatggcaccatctgccgggtataaaaatatgtagatggccatctatttcttttgttgaacttaaattttattgtttgttctaaaagatttttgttgcaatgttaattttctatgtgtttttacagtattacatatgtcccttttccggaatcactttcacaatgaagccagaggtgttgtattatcttttctcagagatggatcagcgcttcttggaatcaaagaactgtgttgtaggcaacaaccttacggtgagttatatatatatatatatatatatatatatatatatatatatatatatgaccatattatttaagattttagttgtgtttagaaatagtacatgtgagttctaccatgatttatgtagaggacacatgaatggcttccaaagggctagctggttgagattagagctggtggagacaacatggacaagatgtacaaggtagcttttgattgtattccatattaactctatgctaatttattatgaaagcttcgactgttgaatgcaacggtactaggaaatcataaacactgggacataaaattgtttttgcaaatggcccccttgtactgcacaagtggtgtataaggtaaaccgccctatgcagtacgccagaagggcctagttcacgaaccgcctccgcactgataagctcaatgctaaaatgacattggcaaaatttactacaggacactcaaaatttgtggcatttgctgtgagacatccaaagaacgtgaatcttctcgtggatactgtaaaaatatggtaattagctattggacactcgcggaattattttattattttccatgaaaacggagagagaaatattggttaaagacaagtttgcccatgggcccactcccatactctcttgttctttctcccatcctcttcttcctctttctttcgttgccgctgaaggcatcgtcggtgagctcccacagcgaagatggagtcgacgcacggggtgtgcgtgcgcaccgctctagcgtctcctgctctgcctgcctcggcgttggcatgttgttctccttctcctgccgctgtcactgtggctcgtgccggtggtgtgggtttgcagcggcgccatctccggccgccaccaccgtccatgtcactccaacgtggcctggacaatacacggagcagcggcgaccatcaccggctcggacgcgccaccgacattgtccgcgatgccgccgaagcccaccgcccgcttgatgcggtcgcgggcgtggtgaccatgctcaccgacctgcggagcagcttggtcagcggcaaggacatggccggctgcagcaacggcccggtccgcgaggtcagcacgacagacggggcaggtgacatgcgcggcgagccacacgtcgatgcaggcggtgtggaacacatggcagcacccggggaggaggcagagcttctcgccgtcgtccacaaactcggcgaggcagaccgcgcactcgagcgccccatgcccggccttcaccgccctcgctgtcgcgtacgtcgagccccacgtgcctcctccgatgttccccaccgacgacgcgaacggccgcgctggcgtgcacagcaccgcccccacggcaacgatgcgcggcagtggtggcctcggagcagcgtgggcaatggagaggaggaggatgacgtgggcgacgaatgcgtagtgacgccccatcggaggcgccacactccgtctgcctcgcattgaacaaatagcagagagaggaagagaaaaaagaacaagagagagaaaagaataaggaagaataaagaaaaaaatattcgaagggtagaaccgtacttacacagctgtttctctctccaattccttcggatataataaaataatcccgccagtgtccagcagttaattaccacatttttgcagtatctacgagaaaattcacgttctttggctgtctcacagcaaaggtcataaatattgagtgtcatgtagcaaattttgccaatgacatttgaactagcacctaccgcttacatgttattaatttgtttattccaacatattgtaacaaagcaaaagattaattttatagtcactgcagccatctttaactattggttaacaatttattcattaagtcacttatagcggcgaaccgtgacataatatgagtgtgtcacaatcaactgattactctaatcttatgaatcattaccattgggaatgttcagcgaaaatataccgcaaaacatttgcatatgaaggatttgctcaccattgttgccatgttggctgctcatttccaaacattgttggaagagagcttgaggctgctcctccatgtgagtgaatttgatcattcattttgctatttcacagttctatgtgtacccaccagatagagttcgactgttctcaaaagatgatgtactactctacattaaagaaatgaagatttctgaatttgatacagatggacaatgcaacacaagtatatgtttcttgttggaactatttctcttatttgaatagtaataattattccctccgtcttaaaatgtatcaacaaagtaccagattagatatattgtattactataaatctagtcatagagtctgtccagatttatattactagaatatgtctaattaagtactaggttgctatatattaggatagaaggagtgtcgactagatgatttctcactttgcagtactaatgtttggatagtttcctaaatgaaattatagttgatttatttttagattcttgctattcttgaatttaatcctgaagggctgccacaaggatgggtaaaagaagtggtctttagaaagacaaataccagcagaattagaagagaccaggtatgtgattgcaattaattattcttattcactttgaatgcacttgggttttaaacattgtcttttgcagcactacaccgatcccattaaaaattatgtattccgtactatgaggtcagcagcactataccttgaaacagggaaagtaataatacgtgcctttgttcaaaagacaagtgtccatgaggtgtactcttttgaaaagttcacacatttggtaattgttcttcacaatttcttacacttcatgcttgttttactttcgataaaaaaatcacacaattgagtgtaattatatggaattaccatgttttatatctttagatattctgaaaaacgtataagttctaagccatctactttaaaaaggtatatccaggacactcctaactatagttggtctctatcatgatattacgaccaatattcttaatagaatccttctacaatatactgcttccatgtgttattacaatatgcttttcaatgagttgagaagtaaaactataacttaagagggacgaaccagctgtgcacacagtcgtcaaaactccaaaagctttcactgaaagaagagattcttagtgatgagcaaggttcatctagcggtaaatttgttcctgaggaacaaaagttcatcaggtttcttgtgttaaatcaatttttagacatatttgcttcttataatgctctcttcaggtgtgctatccagtataattttactacaataatatgcttcaaattctatgttataaaaaatgataataattaatatagcccaaaaaataagacatattgatcctagctagaaggccaatatcattttaggtgacaattttgctataagctctgataactgattaaatagtgcacctaagaagcaaatccgtatgaccccaatcatacaccattagtttaattaattttcacatcctaacttccacgcaactaaactatacattttggctaatattttcatttttttattataaagtagtactattataactaggtccaatttatttacaattagatctagcattccaaatatttgcaaaaaggagagtcttgggggtgttatggttgtctatatcatcgtactgaaataatttaaaaattgtcatgtaacattagtttctcaatcttttgacttcgttaaacattgcgcaaaataaaaatacgatatatattttacgaccttaatcgttgtgcaaagtgacagttattagaagctatgaccggaagaaaaaggagacaatgactagttgtctgtagacatggtcacatgggttatgtttcctatgactgatactggtggctcggtgacacctcttttttttgaggcatgggtttatttagagttttactatcagcatctttggcaataattgatattatattttgtaaaagaaaacgagactcaaacatctggagagctcgataggctataaggtagcactacagtaaaccctccctctcgacccctcttcccccctttattctggcatatcattgctaatgatggctagaaggggtttgggtgtcctcctctatctagtaatgttgtgtactttagcttcaggtttagtgttgtactgtgtcgggcgcctagtcctattttggatctgctggtgtcatctccatggtgtggaggggtggtggtggtgctggaggtggcgattgctggtggtcgtctgggcagttgtggctttggtggcagtgctagtgacggcatttgtgg

SEQ ID NO: 62597 - DNA, 5215 bp, Oryza sativa
ttggaattctggccctctttagggtgtgtttagttaaagtttagttgaaattggaacgatacgatggaaaaattaaagtttatgaccgagtttagttcaattggaagtttgaagaaaaaaattggaactaaactcggcctaagatttcaacttttttcttcaaacttctaatttttccgtcacatcaaactttcttacccacacgaacttctaattttttcgtcacattgttccaatttctttaaactttcaattttagcgtggaattaaacacagccaaaattggaagtttgatttataattggatctatgccactataaatttgtttgtttagaaaaataccactacaattcacctaataggaaaagggaaatgctgaacaccggtataccgtcccgacgggataggatagacaccaaccaatccactcttcttctacctagctattctttctacaacatctctctcacacgtgctgctgcaactaagtcaacgacgagctccggcgtggcatgggtgtggatgacggaggacgcggtcaccagcgacgagctccgacgcggccgcccccgacgagcccccggcatcgcggactccgacgacgagcttcagcgtggcgtgaggcacggacggcggaggatgtggccgcggcgacgagccgcgtggcatgggtgtgcatgacggaggacgcggtcgccggcgacgagcttcgacgcggccgtccccgacaagcccccggcatcgcggactccggcgacgagcttccgcgtggcgtgaggcacgaacggtggaggacgtggccgcggcgacgagcccggcgtggggagcgacaacggaggatgccgccgacagcgacgcggtcgccggattgctgcttggagctccagcaccgccacccgccatccacggcgccgccgttaacgcccacctccggctccatccgcgtggctagccggtgcgccctccgccagcgccccaactctgtcacaggccctctctagtcgtcgccttcgtcgctggccgctggccgtcgatcccgctgtgagtccaggccttcatcctatccatctgctgcttcgagggagcaaagagacaagacggggtgtaaagagcttgttgacctggtcatggttggctgtggagtgtggtagaatcatcttctacatggtaagaatcgcataatacctgatagatatcatcttctacgttgtaagaatcgcatgatacttgataggtatcatcttttatgttgtaagaatcgcatgatacatctcgatacctgataggtatcacccgataccagctaggtatcaggacctgatacatcgcaagcatcacccaccacgtggtaagaatcacatgatacctaataggtatcatctgatacttcacaagtatcacctgatatatggtagaatcgcatgatacctaataggtatcacccgataccggctaggtatcaggacctgatacatcgtaagcatcacccaccacgtggtgagaatcgcatgatacctgataggtatcatctgatacctcacaagtatcacctgatacgtggcagaaacgcatgataccggttagatatcaggacttgatatctaaccggtatcatatcgtttttgaatggaattgcggtatatagtagctatgatactgggactgataaccaccaggtatcgtttatcaagaccgatgcccagcatgtatcaaatatgatacttggccatccggttatctggtacttgataccaaacggtatcacacacgatgcctgttatgaggcatggcacccactcggtatcaggtgtgatacctgataatagacttaatgctcactcggtatcagatgtgatacgtacccagtaacagatttgatacctggtagctaggtaggctactacttgctatactaaactagcttggctatcacatgaagatttttttgcgtatgcacgtggacaaaatgacaaatgatgggtcaatgggggtgacatgacacaccttttgagacacgatgacaatatacatgacatactaattgaacggaaggaatcgtccggctaactgcttgtaggcctgtaccgtccgaacggtataccggtatatagcagccctctattgtttaggtattactgaaattttataaatttagaacgatgccatcgccgtgatgttttccatcacttccgtcttcttccgtctctttttctcatctccttcctcttctcttcgtttcttctccccgtcggccagccatgcctcagcgtcgtgctgccggcgaacgccatgtccacgcgcaggagcctgagccgaaggagactgtgtcacaccctgaaaattcaaaatatataaattgttgtttaaatggaatttttagaatttattttaaaagcctagaagagaagatctaattttaattaataaattccaatataaaatggggccagataaaatttcattaaatactttgcttaattctataattcctagatttttctgggatttatttgagctaaggaagtattttcaataaatggaattgcatttaagaaataatttaaattgaaaaaggttttaaaaagtctcttttggctttgggccaaaagtcggcccaaaaccgctctctctctcctcggcccagtccggcccagtccgccgcagccgcgcgcgtgcgtccgcccgctgacaggtggggcccacctgtcagggccgttgtcaacctccggccgccgccgcccgaaaccctagtttcgcgccgccgccgttcctttccaaatccggccgctcctttccttctccggccgaattgatagaggggaaatgatcctcgggatctcctctaccttttctcctttggaaacatcggctaattcgttttggaaattgttggaatcgagttcgaatcggattcgtctctctcctccgaaccctaaaccttccttctcgtcgccagccgccgtgggccttcgccgtcgccttcgagcccctttaaaaggttccccggtgtcttctctacccgccgccactctcgccttcgcctctcgtcgccggaagagctctagcgccgtgcaacctagcgccgccgtcaccgccgtcgctccagccgtgcgccgccgccgtctcggtcgtcgtcatcgctcgggaaggccaccgtcatgatcgccaagtcgccgccgttctcgtccgctccttcaccgccgccgaagaccgccggaacaccgtcgccgccgtcgacccgaagtttgccgccgcttcctcctcgtcgccgtcgctgtctgttgatcttccgccgctcttttggtcaccggtgagttcgccgcgtcgcgctctacccgttggtgctctccgttcgtgccgaagtgccgccgttcgccggcgagcatgcgcgcccgagccgccgagccgccgccgccggtggtgacgtcaccgccgacgtcatcgtcgccctctcccgtgagccggtcgtagaccgatcgatctcggccgtccgttttggatggatcgatctcggccgtccgttcgcgtgaaccgtcgcccgtgcgcccggtccaccgaaaccctagccgctgacgcaataaacccctttttccttttcaaaaataattcattattgcgtcataattcaattaaaatcaatttaagtgttttaatccgattaaatcttcaaaaattcataactaattcatcttagctcggatttagttggttcaagtctctaaatttttctaaaattgagatctacatgttaaaaatatccacatgtactgttcatgcttatttatatgctgttttggtgattttgcttctttctgcttagattccgccgtttccggagagtccgttttcgcaggagaagaatttgaagagttccaaggccagcaaggcaagtcacacagatcccaaacaaccctttgagcatgttgatcctatttaaagctattgtttctattcaactattgtatttattttcgaatgtcattgggtggaattaacctattctttgctatagcccttttgtatttgattactttattccttgataccttgggttattacaatttgactagttgagctttatttatattggttcaactagatattagatataattgcttagccatgcttagaaacattagctcactattgggataacttatgactcattattatttaatgatggcttaatgatagttcacgatggtcaatcgtgattgtttaattatttaatgtgccaactaaaacctgataaaggtgggttgtgagcacatgattttgttggtcgtgctcatgacaattaaggaccggttcacgagtttcggttgtgaaacattaaccgtgccaaccacaagccagcgtgggcaacggctttatcttttgtatagcatggttcattgcggggcaccagactgagaagtggcggagataagcccacgggggtcgctggggagtccatgccttatttataagggggtgattatgatccaggaaaggtgcgctgtagtggattgtgttgtgcaaggggtattgtcacaactcctttccgaggtaccgtggtggtattgaggcacatggtgacatgatgtggggttgtgtcttgtgggtacagtggtacacctctgatcagagtaaaactattcgaatagccgtgcccgcggttatgggcgggtctaacaatatctttcgtgattagtctcacccttctcaccatagtaagtgatgctttaattggtaataatttgattagctcctggtttggaatggtatattcctggtttggagatagaactgtgcagccgggatggttgttcagaatggttgggcctatgcaacagggtatgttgtatagcgttggattaatattgtttaattattactcaactgttttattaaattctcaaatatttgctaaatgctgcttttgcaaatgaaaccctactatgccatcctttgttatcctgtgcacttgcatatttgctgcgtggcttgctgagtatgtcatatactcaccttgcaatcattcatcataggaagggttctacaatgatgctgatggtgtggaggattaagtgtagccttggtcaagctgcttgtggagtggagccgtctgcgccgtttattttattttccgctgcttagatctttattgattgagaggaactatctacctctgtaatgacattttgtttcgcttattaattagcgtcataattg

SEQ ID NO: 62598 - DNA, 4273 bp, Oryza sativa
ggtggcaaatcatatacgtgcgacaaagtcagtggcatataaggaattatctctataattagccctaggaaaaacaccgtgggaatggtggaagattaacttgccacctcatcaatattttcagaaatactgtcaagaattcgacgactcttccggcatctcgcctagttgaatcaggatttcgctagggatttggattggagattggggaaagggatgaactgaggagggaaaggtagtttagtgacattcgatttctttcatttcttcgatatcgtttacagacaagggatttccccttaaatggtcacatgccacagcacacacacccacctgacgcgtccgccggcccagcacggcacgtcagttcactcacacactcttggcccataactggcccacacaggcaagccttgatgaactacagttgtcatgacaatttccctccccttaaggagtggcttgtcccaaagccggtgcatcaagaaagtggtgacgctgttgatgaagattctcccatgtcgcaagctcatcagggagactagtccaacgcaccagcacttgagatgttgtagttcgtcctgattaaccagtcacctgttcaatatagattgcggctgagcgtgctctgtaccattaacacaagcatgatgtgaacttgaacataccatgaactcctgattgacagcctgtttaagcctctatacatgtacgactgggtgcaccagactgctcactggtaagtccaagcgataagccaccttcccaaccttctctagaatcttgtacggcccaaagaagcgaaaactcaacttctgacaagctcgattgaccactgatagttgcacatagggccgcaatttgagatagaccatttccccaaccgaaaactgtcgttcttggcgatgcttgttagcctggcttaccatccgttgttgggcccacaacagttgttgatgaatcaatccttgcatcaatgatctctgctccaaccaagtctgcacatctggaacagtactctgtccaagatccaccaccccaaagtgcgtcggcttttgagcaaacaacacttcatatggtgacttgcccaacgcagtatgaaaagctgtattgtaccaatgttgcgcttgagacaaccattgggaccatttgtttggagttgcatgaactgaacagcgcaagaaggcttctatacactgattcagcctcttaggttgtccatcagtttgaggatggtatgaggaactcatattaagcttcacattagcaagtctgaataattcctgccacaatgcactggtgaagattctatcacgatcactcactatctacttaggcattccaaagatgtcataaacattagtgataaacgcttgggccaccgtcagagcagtgaatgggtgagatagaggtataaatttggcaaatttagagaatttgtcaattaccaccaggattgtgtcaaacttgcctgacttaggaagcccttcaataaaatccatgcacactgtgtgccaggcttggaggggaactgacagaggttgtaacaaccctagagttcttccatgttccacttttgctctctgacaggtctcgcattgctgcacaaactggtggacatccttcagtaagcttgaccaagtgaatagactttggggatcctctagagtcgacctgcctggcctgaatgccccccaataccactatcatgcagagccaacatcatagcctgtttagctgcaacatgctgtcctaaccaaattttgccattcagtcgaattatcccattcaccaatttatatccaccttgtccttctggatgtaagctaagtgcagctagaagcttcttggtatcagcatcctgttggtacccttcctggattatctccaaccaccttggaacactgatagaaactgccaacaactcatctgagttacttctcctagacaaggcatctatagccccattgtctgaacccttttagtacttaattttatactgcaaccccatcaacttgacaaaggccttatgctgcatgtttgttgtcaatctttgctcacctaaatgacttaaactcttatggtcagtcagaattaaaaactctgcatgctggaggtatgccctccacttttccacagctaacagtattgccatacactccttttcatatgttgacatcatctgagaccttttactgagccccttgctgataaatgcaattggatgcccagcctgcgttagtacagctccaatccctgtgtcactggcatctgtctcaaccacaaattggtgagaaaaactggcagagctaacactggggcctccaacaattttgatttcactaactcgaaggcttgttgctcttttgttccccacttgtaactcacatccttcttaagtagggtggtcaagtctctggtaatcaccccatatccttggataaatttcctatagtatccagttaatcccagaaatcctcttaactgtttgacagttttaggaacaggccagtcttggactgcttttatttttgatggatcagttgccactctagaagctccaatcacatgcccaagatattctagatgttgtttggcaaaagaacacttactctttttgacaaacagttgatgccttgctagaatctctaacacaatcctcaactaactaacatgttcttgtagggttcgactgtaaatcaagatgtcatccacaaacaccatcaccccttttttgatcaaatgggcaaaaattgtgttcatcaatccttggaaggtggctggtgcatttgtcaatccgaaaggcatcactctgaactcatagtgccctacatgagttttgaaagcagttttaaactcatcacattcttccaaccttatctgatggtatcctgatctgaggtcaagctttgtgaaccactgggctcctgccaattcatccaacaactcttccactactggcatgggatatttgttcttcactgttacttcattaagtgccctgtaatcaatgcaaaacctccaagacccatccttctttttgaccaaaagaactagtgaagcaaatgggctcacactggtctggattatgccttggtgcaacatctgagctacttgtttctctatttcatccttcacattcactggtttaacatttggcagcaagggaattctatggtcaaactgcgtatgaggtggcaactctgttggctctttgaacaaatgttgaaattctgttatcacctcattaatttggtctgggacatcctcagcttccaccaactcctccctcattgcacaaagttggaccacttatgacacagccccatctttaagcatcccctttagttgctggcttgtaacctgctcacaggattttatttcctcctttactcctaccaaagtgatccttttccccatttgagcaaacctcaatttctttctcctccaatctatccacattggactaaactcctctaaccaatccattcctaggatcatgtcgtaccctcctattggcaacacttttagtttatcctggaatgtactaccttgacaccaccattccacctgaacacatttgtcacaagtcatctttcctccatctgctatggtcactgaatttgcaggcattctttctgtgggaagctgcaatttgctaaccaaactctctacaataaaattactagagctcccagaatctaccagaatcagtacctcttgatgctgaatcataccttgcagcctaattgttttctttcccattgttccagcagctgcacactttgaaagtgttagctcttcttcattatcttcttcttcttctttctggatgtcagcagttccatcctgtaacatcaatacttcaagcaactcatctaacacatgcaattgaactgactttggacatttgtgcccaggtccccatttctccccacacttgaagcattcaccccttgctcgcctagcagctttgagtgattcatatatgtcttcccacttgggtttctcctctcctttcttgttttcctcaggatgtgcccccaatattcccttggcaacatatgctggcttgatgcctcctttgaatccttctttcacaatcactttctgttgagccttcgatgctgacaattctcctagcaactcctcctgcgttttagccaaagacagagccagatcaacagttctaggtttatacaatttgaaagctattttgacttcaggtttcagtcccctcacaaatttggtaacaaagagggtaccgagctcg

SEQ ID NO: 62599 - DNA, 6310 bp, Oryza sativa
cttcaggtttcagtcccctcacaaattttgttacaaagaaggttttatcatagcttctattgtagactaacaacaccctatgcatcaactccacaaacttaacataataatcatccacactcccacactgttttagattctccaactcttctaggtgttgctgatatttatcccttccaaatttcccattaacagctacaaccagctcagcccaagtttccacaggatgtaaggcctcataggtttacagccacaaggctgcattcccaatgaaatgcaaagtagcaaaggatgaccaagagttgtagggaacctaatacatttcaaaatacttctcagagttggttttccagagttttgggttatctccatcaaactttgggaaatctgtcttaggcagtctagggctggcggatctaacactaaagctggacccccctactcccttctctgatgtttctcccaactcaaaattaacaggcgaatggtggaattggggcttactcttgaccagggtttgctccttagccttgaaggcttcggatgcgtcaccctggtgagtcgattcgacgccgtgcctacgggcgcttgtgccgcctgcgatggtgtcgttggcgtcaccgattctagctgcgtcaccctgaccgcaatctcatccaccggcttgttcagctcccggattcctgaatccacgcatgggatccatttctccagaccttgaagcgatccgaggatgttgttgatacttgttgtgagctccaccaccttctcgcccaacacctctgcttcttcttccgctgcccccatcctctcggttagggttggatttgccttcttcctcgccagtgcgcacgagaaccgaagtgctctaatactagattgtcacgaattccatgactcttccagcgtttcgcctagttgaatcaggatttcgctagagatttggattagagattggggaaagggatgaattgaggagggaaaggtagtttagtggcatttgatttctttcattttttcgataccgtttacagacaagggatttccccttaaatggtcacatgccacagcacacacacccacctgacgcgtctgccgacccaacacggcacgtcagttcactcacacacccttggcccataactggcccacacaggctagccttaatgaactacagttgtcatgacaaataccttacattcatgccatcctgtacacttatactcgttttgaattattcttttaccaacatacccttgtcaatttgatttataaacttgcctgctgagtaaaaaaggttaaaaaaaaagagaaaaattcagctgctccagcccttaccctatcatagagagagagagagagagagcgagcggccacagcaccagctcggagagcacagccaacagcggcgaggtccgcggaggaatgctggcggaagggcacaaggcgatggcgcgagctcgccagtagaactggcggcgaggttagggacggtggcggcaggcgcgagctaattcggctgcgcaacctctgcacacgtggcgaacaaatacgacggcgccaatgcaaggtggggctgcggcacgatgagcagatccggcggcagcaagcaaggtccaagacgataggttcagcggcggcacgagctcggggaggatggcgggtcacgacgtggaggcgatggccggctcaggcggtggtcgccaatggcgagccctccacaccagctcttctttcttctttttcttgccttttctctctataaattatttttatcctagattttctttgtctctagtccgacggcaatgaaatgcatatgtggcagcaactatttcaatttgggattttgatccatatggcatgtaaagtacatgaagggtatttcggtccatacgaaaatacaatagcaaaaaaagggtacaaaacaggtattaaggttgcaagatggcatggatctaattttgaaaatattgcaatggcatccttccaattagatgaattgtagtgatatttttcaaaaccgttaaatttatgatggcatagatccaattaactcttgatttatccaggtaaggactcctttgaatcaaagtgttgtagagaaattttatgagattgaaattctatagaaaatttttctatttggctctttgatttaaaggattggtgtttttcaaatccaatataattcctatagaatggcttattacatgtaggtttgaaggaaatttagcaaaaggtccaacctcttggaaaaaaatcattttagtctatctgtctcatctgatttctgtgttttttctacggctcaattaaacgatcattcatgtgttttccatgtgttttgcgatactctgttttacacttgcattactgtcagaatcaaagtttttctattcctctattttttttcattcctacggttcaaagagacgctaagagtatgaactaggaagtcttgattttgtttcatttatatatgtaaaatgttgatttgttggtgagatggtgagattgaagggaacccttccacattaaaccaggttacaattgttgtacataatgaaatggaatcagttggcatgttaggatagatagctttttaagtcaaattgttagctcaaaatatgcatgagtgtgagatttatatcttgctggatttacatgagtattaatacatatggtaccggagaaaatgccaaccatatcaaatatccggttggtacctaagatttgagaatcccatgtgaaatataaattgaggcactatatttaaaaacttcctagaaacaaacaatagattagtattttagaatcttttatcatgatgtagtgatttatttttattaagcggaaaaatataatcctaaatgcttggaacgtacatttatatcgtcaatatgagccatatctattaccattaaacatgtatcataagctaatacaacaagctcgaaaaatctttaaacatactgaaatgcattgacatgaactaaatatatactcctacctccgtgcgagaatcggaggtataaaaaatccgaggccttaattttttagggaggctgtttagtgacccctgtcaaatagtacttgacttgtttctgacactcataggttaagcatgcatgaattcagaactagtaatccttccgttctaaaatacttatatttttcgaatattgccaagtcaaatattattaactttaactattattagaaaaaaataaaaaacaatcatgtaaaatgatgttactagatttatcattgaacaaactatcaaaatatgtaactattttttaaaaaatattttacttttatagatattgttggtcaaagtggtatctcaaaaaccgtgtccaaattcaaaaatgcttatatttttagacggagggagtagcctggatctacaggatagtgggagtgcaagcccgtagttaatcttgaaaaatagaggttattgggtatcccatatacatatgactaacatatctaacgagctactccctccgttgtttaatatatcacgtcgttaactttttaaaatatattggaccattaattatattaaaaataattgttatttattttattgtgacttaatttattatcaaatgtagtattctttaagcatgagttatttttttatatttgcaaaaaaatgaataaaatgaatggtcaaatgtttaattttttttacttatttgtgtagatttaggttcccttcaatataagttgaataataaacaaatgccccgatcggttgagctgtggttggacggagcaataaaaaaattaataagcaaaacctttatgccaatatcattcacgattttatagtcaaggctagaacatagtatgatgaaaaacccagaaaatgagctttctctcaaaatttaaattttcggtattccattcagaagtgtagtaaaacggtcaatgtgttgacacgtttcaataagatctgaaggtcgcgtgttcgatccacgctcaccgcacctcaattttcaataagttaaattatttaaattcccttctttagggttgaaaattaaattgcttacttaagtttttaatttttctattcatcagtgtcgaaattaaattatttccccaagtttctaaaattttgtttcttcaggatctatggtatttttcagcttgcaattttcatcaagttatattattttcctaggattttaaaaatttcccctcttcagggttgaaaattaaattgcttacttaagtttttaatttttctgttcatcagtgtcgaaataataattatttccccaagtttctaaaattttgtttcttcaggatctatggtatttttcaacttgcaattttcataaagttatattattttcctaggattttaaaaatttcccctcttcagggttgaaaattaaattgcttacttaagtttttaatttttctgttcatcagtgtcgaaattaaattatttccccaagtttctaaaattttgtttcttcaggatccaaggtatttttcaacttcattttgtcttcaacgtagttaaattgttttcctaggttttttaaaacttatcttctttagggttcaaaattaaattggtttcctaagtttttaatttttcttttcgttagtgtcaaaattaaattgtttccccaagtttctaaaattttatttctatagggtctaaggtatttttcaacttcattttatattcaaggaccaagttaaattgttttcctaggttttaaaatttctgttcttcagggttcaaaattaaattatttttcaaagtttttaatttttctttttgttagtgttgaaattaattttttttccccaagtttctaaaattttgtttcttcagggtctaaggtatttctcacctgtcgccgcttcggatttgtatgtcgtcaccgtctctgctgttccacgccactcggaaaagggtgccaccgtcatcgccgagggagtgggccgctcggagccgctggacgcaccaccaccgccgctctgggtcaccgccttctccgccgctctccgggtctgctctctctctctctcctcgttcttgagtcttgacggttgcatttggtatatgaaaacacgatccaaaaacaagttaccgtgattttcgttttttgttgaagttagtaaacaatcagataattacattgaggcgagcttcttttatgagcttttgaataaaatttttgacgaacggttgctgtaaattattaactatggaatcaattgtatgatgctcctattgcaaaagtgaacttgaagaaaagttgtgctatgtttcagcaatgtgacaatatcacttgttttactgcaggggttgtgcttatatatatttgttttcagaacttttttttaaaaaaaaggagactacttctgtagagttttgagtcacatcagcatggtgcgccaattttgcatttgtttagaaaattccaaggatgtgcacttttttttgtttgtcagctagcatttggccaacacatccatgtttctatgcatctcgagttcaaaattttctctccaacaaagatccatcctaactatcacaaacttgcaaataaaatgctgcctccatgccacatcttctccttttttttgtggactgaattacttctgtatatgtgaaagtatgattggcattctaattctgtgctgttttgagcttttcgtcagaagcatgcaatgatattatggcatactccttgaaatcctgcgaattttattaagaaaaatactttcttcctactgttgttacactagctgtgtggagagaaaactttgtcaaaagctaaatattacggtaaatgttcttggtaaatcttttttctggcattatagtatgcaactgagctatgccagaaattgcgatcacacccaactgattaactgaacgacatagtggagacttaggttaaaggattagaaatcagagtaacttagaaaacgatacctgtccaatgctaatgcagaggcttgctgaaagattatgtagagtttttacctgaaagaatctctacagacactacaacacgttcatgtattctaagagccttctatggtttttaaagctcttgtcctggtatgcttgacacggagctgccttgacaaactactatcacatctggtgtgtggttgctatttgcttgttcaagaatgtcgggaaagtggagatccgtggagaacttacggtgagtttgctattcccatgtcatccaatgaaccagttttttacttcctccgtttcacaatgtaagtcattctagcatttctcatattaatattg

SEQ ID NO: 62600 - DNA, 8765 bp, Oryza sativa
agttcttcctgctccgccgcgacagcaagacggtgcacgcggactacgtgcaacaggtggtccagttcgcgcggttcgcggaggagagcatcctcaggatgctggccttcgtcgacgccgccactctcgccgtcgtcgaggaggacgacgacgaccaccgggtggccgaggcgctcccggggatgttgcaggtgtacgcctgcatctccgaggcctctccgaccgtgctcgccatgttcaaagaagcatccgatctcctcgcttccggctcctcccgccatggccaggaggcacaggttttcgacggcatggacggcatcttcctgcgcaagaggaagaagctgagcgacgcgatctgggacatgatggagaaggttcgatcctccttcttgcaggatggatgctggcaagtctcgccggaggcatcagcatcaggagtccatgagaccaccgtgctgatgatgaactacatcgcgcttctctggcgcaacgacgacgtcctcaccttcatcctgcaggatcaccacttcagcgtgttcgtctctcacacccagggcttcagctcggtcgtgaacctgatcaccgacatcatctcttgccttggccacaaattggaggaaattgcctcctccctttccaattccatcttggacccagcgttgcgttgcattttcttgctaaacaattggcagcttgtgttgcaccgcatcgaatccctggacctgccatcttgggccttgatagacagatgcaggacacggaggtacatagacacttacattgacgtcttctggtcgcctctgttgtgctgcatcttcatcggaaattcttctgatactcctcgaaagaaaacctacagacctgctttcggcttccgaagatacctgtctcttgaaaattttgagatagaattcagaaaaacctacgcgaagcacaagtttttcaaggttccagaccctaagcttcggcagagattacgtcaagccatcatccagaaaatcattccgcattatagcatgtatctggaggagcgagcagcaaggggaatgcacaatcgacctcccaaaattactcctgagcagttgaaggagctattagaagaattattcgaaggttgaagcagatgaatttcagtggaataaatggctatatatttaattagcactcaccgttttgtcaccctagcttgggtcgtaggtttgaaggtttgtgctccggccagcaattaaggtgtggtttgtcttctttggactttggtgattatggtgagagtataattcaccaagttcctgcaaacagaaacttggttagtcttgccttattcgccggagaccttacttagtcttgcctgcttgtgaagatgggggttactaaaactgttgaaatgagttttacttaaatgttacaaatttaattatttccgttgtacagataatctattatcatcttcgtgtactctctttggttttgtcgtgcatctacttgtactttaatattgtggtgtaccagtaaagtaataagaagtaatacgttgtgagttgtggcatcccaaaaataattttcttgagatgttagcttacacttacagacgacctgttctcgacttctagtatatactttattttgttgtctaggggcaagatctactgtaacaaaataaatgtaaaacatgtaattttgacagtttatacaatgcagtaggagcatgcatggaagtataaatcaattgttaacaattggaaacatcaaacaaagcgtccaattaatggtttcagacgccgcctcatccccaagcttcacactctggtcgcctcaaaccagagcgcattcatcaaagatcgctgcatcccggacaactttacgatgttctatcaatcaaccaagcgtttgcacgagagacggcggccggccttgcggctcaagttggacatcgccgaagctttcgattccatctcttggcagttcatcatcctggaagtcctggagcacaagggctttggacaacgttggaactcctggattgccatgcttctgcgtacggcaagcatgaagatccttctgaatggcatgccgggggatggtgtagttcatcgccgcggcattcggcgagatgacccaattatatcccccttgtttttcatcttggtgatagactccctgagctccctctttgttaaggctcagaatgaagggttgcttcaacctctcagtgtccctcaccgggtgtctttctacgttgacgacgtggtcgcattcatctagcctacagtgcgagagatcagggcagccacggagatcctcaacatcttcggtgaggcttcgggcttatgggcaaacttcgccaaatgcgcggccctgccgatacaatgctctgaagaagacctattactagcgcaagctgaacttccttgcccacttgcagctttcccgtgcaagtatctggggctccctctgtctattttccggctaaagaaagaagatctgcaacactcatcgacaaagtcactaaccggctaccgacgtggaaggctgagcaaatggaaccgataggtcgcattaccatggtaaaatcggtcctaagcttggtgcccatctaccacctaattgccattgatccgccgaagtgggtaatcaagggaatagacaaaatccgctagggttttctctgggcgggcagggccaacgctcatggcggtcactgtcaggttgcttggtcgaatgtctgctcccctacaacgtatggcagtctgggagtactgaacctagagctcatggggatcgcaattcgttcatgctggatatggtcccatcgcacttctcaggaaaagccttggcaaggtctatcaatcccctgttctccaaaggaacacagcttcgtggctgcgtccatgatctgccgggtcggcaatggtgcttcggcgctgttctgggaggaccgatggttagatggatcctgtatccgctcgctagcaccggcgctctacgatcgtgtccctaagcgaactcagcgaggagaacagtggtggagggactgctcaacagaagttggatccgcgatattcaaggagccctcaggacccaggccattctcgactacctcaacctctggttgttgttgcgtgcgatgaacctcacggactgatgggaccatttttttcgtggaaatgggaaagctcggcactctactcttctcgctcagcctactaaggtttgttcctcggtcggattcccttccaatgtgtgccgatttggaaatgactcgcatcaccgcgatgtcgctacttcctatggctagtcgctctcaagtctcaaccgatgctggtcggcggataggttgcgcatcaaaggtatgccaatcccatcctccgcgtcctttgcgatcagcatggagaaagcatcgatcatattttagtggctgctgttttcggccatcgggagcccagaatgcttgcctatcaacgaagtctccttccatacttggttgtgcgacagtaggaaatccttcaccaactcccaacgatgaagtttcgacaccattgctacactcgcagcgtggacaatatggaaagaacagaataactgggtgttcaaccaaaagcagagaagctagatggaagttgcaaagggaatggtggaggcggcggcgttgtggcggctggccaatgccgccatgccggccatccacctatagtgcccttggactgcttaggtcgcatcttgcatctgtgagattaggctttagcacggtataacctatcatgtccttccgtccccttctgttttttctttgatctgtacagacttttactcctcttaacaaagatgcacttcttgcatattaaaaaaaatggtttcagacgtggtggaagtcccaggagtagcattatcatcaaggatatgaaagaactggaagtcggtgctcaatacatttagtatctctcgacgcggctcatcttaatcatagacaccattgagaacacataaaccaacaataatagatagggaatcaagccaaaagcaaatccaatcgtgtgcacattcacttcaaaatgatggagcattttttttttcatcttaggaacacgtatacaccttgcagtgcaattgacacacaagctactccctatgttggacctaatacactattacttaggttaattatccaaatatttagatgattatattaaaaaaatgttgtagggtataggccactggccatgattgtctgtcttgctgacgagagaaacgagcagtacaatgcctagatataaaattgttccatgatcgatcgatgagagattgagagtgctagcttgctttcaattcatccccatgcatgccaggagaggtgaatgagcatcgggttcagaattcagatcatgcttgggcccaactcctccccggttatcgtctttgccggtggggttttctccccgatagccatgcccgtctgcgaaaataaaacccctacgtcaccgaaaatgctttttctagtagtggggattgaactcgagcatgagataacaccgaacatccatgcatccatatatccgatgagtgatcgataggcattttttttgccgggacggcccaaggcaggccgcccaaattgtattaaggagcgagagaaggtttcaaaaacttttacaaatcgacattaaacagtcgaggagaaccaaaaagaaaaggaaaacaagcacaccgccacaagcgggatctttagctgacttctctaaaaatgttggcctctctccacactacaacttcatctttgatatctctgaagagttccgccgcctcgataggcattggacaaccgcaacattgatctatctatctcccatgaacatacaaatgcaaacccgctatggatgcggatataggctacgagcataaatgcatgcatatgcggaaccgggtatagcgagttttctttaagtggatcaacaaataatttttaatagaaagttaatgtatctaaccaattattttatagaggtatctagttgctaaaggcgatttcagaataaaaaaagtaaaatcaaaatgatttaacttattctctcaatttcaatcgaccgctattagtataagaagtggtgatgcttgcagtaatatatgtcgaaacatgcatgcgtccttcggtcttcttttttcttcgatcaaagttaaaaatcttgcaaattcttgatcttccgatgtgaattctaagcttcccctccaacttagacaaccttgatgaactaggatttaaggtggaagcaagaggtaggaggggtgagggatgaggagaggggaagttccccaactttagagggagatatgtggcagcccaacaatggtcaccgacgacgggagcatgacgagccacagggactgaagagggtagtggacgcaaggaaattttggccatgtgattgggtggcgggtgctgccggagccggaagagaaagacaagcaggggcggagcccaataggcctgggaggggggttcccaggcacccgggccgaagcaaaaaaaattagctattaccactatgaatccaccatacaggcaccccttgatccaaaactcaggaaccccctcgctagccttcagcccaaaatctgcaaaacgccaaggcccaacaaggcccaacatctgcacttcacaggttaatccaacgtcgatcgttgggcacggcacgcatcgtcgttccatcttccacctcttcctctctctcgactcagcgttgcggcgccgccgcctgttggccagaatcgccacgccacgccacgccacgccgtcgcccattggctaaaatagccgcgtcgtcgcgttgtgccatcgccgtgccgatttcgtctttggctgctgcacttgaatcttgattaggtgattttgccttaatattggcttgttggctagggcgagcactctaaggagagtctaagtttgtgattaccatctcctcgtggaatggctggacggcgtcgccttctccaacagcccgacatggcaagccaatgatgccaaccgggcactagagcaaatgagcagatgcaaggtccttttatcccatgtcatccttaactccttttgttttcagttaatgtagtaagtaccgacataaagcttgaaaattttcaattaatctcgaatagttttttctctatattttaatgtctggtttcaagttgaactttcaaaaattttgagtatttgaccgtactgttgtgcatagttcgaatatataactgtttgtatttgtaaatgatttcatgacttattctttacttaaaatttaagtatgatcctctctttctttattcagtcctaatggatgaatgaagacagtgatatcacattttttatgatatattttgtgatttgtgactttcttatacgattgacaaattatcaatttcacaaatatttttagctgattttataattcaggtacacaatttctgtcctttttctcaacactttcttttagtataatgccctcaatgggagaatcgatgtttaggatacacaattatctgcataatactagtgttagctcaccagccgatctcattagagatgagagtgacaaatccttaattgacacttataagagtggcaattagtaaaatatccccacgcttagaagcatcgggtaggccatcgaatcaattcttttttccaaaaagtttgatttgtatgaatgttaatttcgtgtcatatattctctattcaacttaatagatcactttataattaagcacgtcacctttacttctagtagaagaaaacaggcgaagttgtatgagccggaaaaaggcaaacggactcgcatattagccaggtagttttaacatgcaacgttgcgtgcttacacgcttgctgagctaaacctcatgctacagcttaaatgcttaatacaatgtaatcaagggaagacgaatataacaattaacattataaaaaaatttagtgcacttcacacatacaaatacaatgcaagatattagactgccaaatttcaaaatccagaagcaaagaataaaagaagcattagtggattagtccataatttctaggaatcagaaagagagggattagtagagctgattgtcgcaaaaaaggggataatatattcagttccaaatgactaaaactgatcccaaattatggttactacatagtcaaaagaaagaaggctgcggaagacggatcgatgatggccatgactgtacttgaaacaggacatataccaccataacggcctgaaaacacacgcagaaccttaaacgagtacctcattttcaaataagtcaggcaacctaaactgactttaagctctccaattacatccataaacagccgggcgagaagtactttcatttgcaagaagatccaactattggcataacaatgtcctcaagcaacggtatcaaaaaccaaagaaaccaagctcagttgccctctctttctcgaatgtctcgaagtactggtagatgatagtaacagcaagcagaataccagttcctgaaccaatagcacccatgaaatcagctagaacagtcaatgcaccaatgcacactccaccaaatgcagcggcagtggggatgtatctgttcaattccttctgcaagtttgactcacgatggccaggcatcaccatttgctgttcctgttatagtgacatagaaatggagtttatagatggcctttgagtaaaccaatatagactattagatcacctcaacactaaatatcccactatatatagattcctcagcacaaggtcaaaagtttctaaatatccactaaaaaggttccagcagtttcagataagataataatagttaagaaactttggataaggcttcatggaaaacattgaacgctacttgaacaattcatgtgcttgaatgactataatgttgcatggcacaacaatatttggagttttatgtatacagagttcagaggttagcatacatcaaaacatgtgcagatgggatatcagacttaagacatcaccacacatgcaatgtaatgagttggactataggtaaacaggaacaataactagatagaaaatatgtatctacatctttaccttcagctgtttagcaacatcctttgcagatgagccagatacttcaatccatgtctttgagaagagagcacaagctgacagcatgaagaccacatagaacaacgcatggaacggatttgcaagaacatcagccaaactgcatgtttccaaacatgaaaggtaagaacaaaaacaaaaacataaaatggtgacaaaaacaaaaggcaagaccataaggatagaatggtgacatcaaacataacgattattcaccttgatggagcagttacatagtaagcgagaccaccaacaggaaccgaatggccagagtactcagattccttccatttcccaagaaggttaaccagaaaatttccactgtacctcctgtagagaagctgcaacaaaataaaaacatgttaaaaacttgatcagtaatgtaaatattactgcggcactacaataccgcacgcacctgtgatatgaagtagaggttggtaatcagtgcagagtgcagaatgatgggcatgtttgaagtgtagaacaacttaattggatatgagccttgctgccccctagcattctttgatctcactggaagcacaacacggaagccttggaagtagatgactatgaggaagaccaatacagttgcaagtaaatttgtcacattcggaaggttctgacggtaga

SEQ ID NO: 62601 - DNA, 520 bp, Oryza sativa
  unsure (1)..(520): unsure at all n locations
cgggcnnnnnnnnnattagatacactnnnnnnnnnnnnnnnnnnnnnnnnnnnnnnnnnnnnnnnnnnnnnnnnnnnnnnnnnnnnnnncgttatcatctgtgtgattctgtttgaaactctgaactcatgatcatgtcagttattttcagaattgaagattagttgctacttactatactccatgttgtgtgctgcaggaatgggtgtatttccttaacagaggatcggagatagaagtagcttacagcgtcaggagtgaaactgaatcgtctcgtccaatctgcatgatcattgcgcgaggtaagaaaggttcagatatatgaacaagtgtgtttaagtgtgattttttcatatcagtaacagagtttcactgacaccattaaaattcttgcgtgttggtgcttcactgcttcataggcaaagaaagcttcttgcaatgggctgagaatccatcagcaaatgagaccacattatcttggcacttggtgcacggtaagcatgatctcattgactaagaa

SEQ ID NO: 62602 - DNA, 3158 bp, Oryza sativa
ctgcctctagcatcttttgcgattcctaatatacttttatttcttttcataggtgaagatagcgactctgattgttcagataaactgcatgagccaggacaaaacaaggtcaatcatgtgaagactactctaaaaggcaaagaagtaatggcctcaaccactgtcaagcgccctagagggaggcccccaaaacgaggaaaggctagaaagtgaacaagctgcattgcataaaacaaatcaaactatgagaccaaagtggccaagagggagggtgccaaaaattataactagctcaaactaaagaaatcatcaaaggaagtatgttgtgtctttacaaaacattttccattaaatggtgaactcgttaatcattctccaagaaaatattttctagtagacatattttgaactagctaatacattgtcgattctcgtaacccaaaagtttgatggttaatgtgtgcttattttattctgtggtccaaattatcgatatctattttttgaactggaattgactatgctggttatttttgaaaaactttatgcctacatagattctagaatcagacggcgggtatgtagtcatcttcctttagtccaggttctctatatggtgtagaataaaataactggatgacttgcaggaaatcagagaagacggtggtagtgaccttaattggatgtttttacaattgatgtgcgggattggaaaagtggaaccaacctgttagattttactcaaaattcacagaactctagaataaatagcagggaatggggatagattccgagataggaagacagccgccagctagcttaattgtcatctcaaccgagcatttatgcatcccttcatgcataggcaccagtctcaggctttgagcccatgcactatccattctttttgtctttcctattgcaatttgtcttgtgatgttacaacaatcatgtcacacagtggcgtccgtccaccgtgtacttttgcatcccattttatcgccttgtatctttgaccgtgctacaccacatcccctgagtttggtcctagtctgccatctatcaaggttgacgtcaagtacttgcgtagtcatagacagacaattgtttccatgaacaaatgttacaaactaaaaaaaaagcatctaggccctcccttgatcaaggttttggtgactaaccgtatttactaagtctgaaaggagcaccatccatattaggaaatgcgctataatggctcatccataaaggatgttggtgaatgaatggcttcaacaattcatccataaagaagtatttcatcccagtgattaaacgtccataaaggtatttgtgtggtattcaacaaacaaagcaaagattagagggcccgtgttcactagtttaccacatcaaaggggttgaggtgatgtggagatagaatatgggaaggaattggactggaacttaccgaggtgagagttcccaaatcaaatgcacagaggcgttcggtcagcaccaagaaaagaagatcaggcagtgacaagttgtaccatggaggaggaggaaaacggattaaggtgggagagaaacacatggtgaagcttgttggataccgagatacttaccggggatagagtttagcgcttgttaggtcatggtggtgccaggtcagcgtgggagtacacgatggtgctgcggttgtgctcgctatcaactgagtgcaaaaatggaatcagtgggtaaagggacacgaggtgacatggctgggacgagaagatagacaacggtggtgttggaacggcggaggcatgctagccggcgccgcaggtggcacctcttgttcctggcgaaccaaggggaaatcccttggtccttggctgcctgagaacaagggggagatagggagataggaggacaaggtctcggttaaggcggaagccagggaaggaaggggagagatggggccggtgcttgctctacaccctcggtctcgagatggtatgtgtgcgggcaagcatgcggcaaacaaatgggacagggcagggtgttgcagaggctcgtagagggaatctcgcgaggtcctgaggcaggaggcctctctctcgtgcacactcgagtaaatgaggaggtgctgttggcagcaataaattatggtggagaaggacagatcagccaatatcgcctagggcgagtgcaatgcgactgaagcagcgtggcgtgtggtctccagggcggtctggtgggacgtggcccagccgagacgcacagtcacgcacgagggctagcctggcttgcgcaaccctgcgcaggaggaaacagctcgtgtttggctgtgctgtggcgcccgaattggaggtggggaccaacaggtcaacgaaacaagagaaaacgagaagaagagagaaaggactccaatttcggctgagcgtttgactaaatggttagatgggcagacttgcttcaatctgaatgtaacttggagtcaaggttggtagtaaggtatggaagttttaggaatttaaccataacttttggagaagtttcaaaactgaaggttggttagggcagtgggaaccgtttagagcgatggtacaaacattaatctgctcagctatgatttttcatgcacgaaataaggcatgcggtgcaatgcacatgaaaaaagtttttatgcaacaaagaactaaagtgggttgttacagagtgcattgatcagccttttctgtgtaagttgtttatgaggggatgactgtaatgttctacctcacatttatttatgatttgttaggggacgactgtattgttccgcttgaggggacgcctcactgttccacctcacgtacaacgttcagcgccacatagaggtgttaacatgaaattcatcacgacacacgaaggcctgggagatccacttatctctagtgcaggccctattaatcaggttcagggcgtgccagttagtttgatcctgcaactaacaagatgaataaattgactgtacaagatcaatgagccaatcggacaataggccgatgtgatgcagcgaggccagccaatgtcgatagagttttgatcaatcggctataggttcgacgtagattcaaataatcaaataaaaaatgaagttcattgtcagggttacggataaggtataccctctacccttggatatatgt

SEQ ID NO: 62603 - DNA, 999 bp, Oryza sativa
ttttactcatgattgaatttgcgagtaaaatttttattgtttggtgacatgaataaatcttagacgttcatatttaaattcaaaggcagttttctagatttcgaatatatatatatatatatatatatatatatatatgtgtgtgtgtgtgtgtatggtttgcactatatattttcccattgacattcgttgtagccgttggtaaaaaaaaaaaaaacagtattatagaccagtcaagggacccagtggagtcaggtctaagttgtcgatcggtccggcgcgacggcggctgacgcgagaagattttttgaaggaaggagaaaaaaaaacgaagagagggtgttgtacgcggacgactcaatcggttagctcgcttcgtcgtccaccgtctccctcggtcaccgtcgccgcgcacgactcccatccatggcgatcgagctctgcccatttaagcccggggcgcctctcttcgaggacttgcaaacgcttgctgcaaggattggatcctctggcttctgttgatttggggagcttttcatcgtctcgaccgaacggccagccgccgagatcgaggaaggaggagatcgaagggcagagtgatttggcagcggtggacatggatgtgaggtttgggcccgaggagcagatcgtgtggccggcttctgttcttgctgggatcctcatgtgcgcagcggtaagttgttccatcgatctcttccattgcttagctagatacgagagtgcattcccagtaagtcctactttgatttgtagaggaaacataagatacttagaggatttcaatattgtacaaaagaaattgaagaaattcctatgaaggcctttgaaatcaatcttttttaaaaaaaaaaatcctacgaaatggacaatattatagagatttagaaaaattaaaaagagctccaacttttttgaaaatttcctttgactatatttcttttatctcctactgcctaatcaaacaacctgttttgcaat

SEQ ID NO: 62604 - DNA, 8192 bp, Oryza sativa
ctgcgcgcatacggatgtttcctgtacacgttaaggaaatccatcacgtaataggagcagtatccacatatgagagaagtcctactcggacaagactgggtcgtcactgtatcatgaagggtccgatatctccgagtcctacttggagatcaactgacccgtgatataaaagggaccccccaggaggtcctaaggcatcgaatctcaccgccaacacatccacctcagcctacgaagtcggagcctacaggagccaagtcgccgggtgatctagtcgaaccaactcgactacggtctcgtcggtatcatcgagttccgctattccctttgtaatctgtggtttccattatataatcccatatcaactggattagggctattacaggagccaagtcgccgggtgatctagtataatctttgtcttctgcttgtttgatgtcgtactacgtagatcctcataccagcgtaccccaataccctctatatccggtctgcgggtatccaccgtcgacagttgcgcgctaggtacggggacttggtgctcaaggttctactactatgccatcaagcctcatcaacaataacgtcaacaccagcatcaaccaaggagtttaaccttcaacaatgctggtgtggactcaagtcggtgaaatcgtcttcccagttttcaccacggtgccgatctcggctggtccatcaatgaccggaagcgagaacgtcgtggttacgaccccggacggctctatgtcgaaggatcctcccgcggacgtggagagcggaacatcgacgacgtttgagcccgataaggatcctaatgcagccaaatcttgtccttccgatgagaatcacgagccgacaaggagaacttccgaggcaacaaggtcctggtgtcctatctacaaaaccaggaaacacaccttgcaaacttgctgggtttttctcgatgtacaagctgagatccgtgcctgcaaagagcgtggaattcaacgtacttctccaacccgtgatgtctattgccctattcacaagacaaagaatcacgacctctcaagctgcaaggttcttctcagcgccatgaggacgtcacctcctaaggtccagcagtcacaaatctctcttaaagatgcgaacaaggaacgaggagcgacagttatctcagatcgatttgttggggtaatcgacatcgatccccacgagttgtcagttctacacttgcttgaagaccagggcacatcgtcgacgagtacaccacgcgatgtgtttgctatcgatgggaccagcacgtctgcgcgcgctaacacagaagcggaggatcaagtgattacaccggcccagcacatcagggccatcaacgcaatattgagggaaacctcttatgatcccgttctgaacaatgatctcgcacaatggacagaacgactacgagaataagtggctaacctcagcaacgcgttcgaggagaccgccgctggagtactgctagaacaaccgccaattggcggtgccaatggcgaactacctgagcagaatcacatcgtcaagccactccaccacctcgcggcaccaacgatctccgtgaccatttgaatggccgccgagaagcacgacgcgcgcgagacaacaaaaatcgttcccggcatcgcgtctcttcacgacatcgagagaacgaagagcgaggaggacacccgagcgagaaccaagaccgtgataaccgccacaaccaccacgaacgcgatgatcgcaaacaacggatgccaggcgataatggtcgaggacgccgccataacgatgacgacgacggagatcggcgtcgggacaacaacggtgggcgatgacaggattctcgagaacccagacgtcatcctcgtaatcgtaccccggaaccaagtgactcattgtcatcgtcatcatcctcatcatcctcgtcgtcatacagacatccacggaggacatacaatcgccgacaacccaccgcccccggtggtgggtgtagagctttcagtcgtgctctacgagatgtttgatggcctgagatattccgaccgggagcaatagagaagtacgatgggagcaccgaccctgaggagttccttcaggtctattccatagtactctacgctgccgaagcagacgacaacgcgttagcgaattatttgccggcggcgttgaaaggatctgcacgttcatggctagtccacctcccaccatacttgatttcttcatgggtagatttgtggcaacagttcgtcgctaacttccaaggaacatacaagcgccacgcgatcgaagacgacctacacgcgttgacacagaatccgggcgaatcattgagggactacattcggcgctttaatgagtgcagaaatacgatccccgagatcaccaacgcttccatgatccgcgcttttaagactggtgtcagagatcgctacaccacccaggagttggtgacaagacagatcacaactgctcgaaagctattcgagattgtcgatcgatgcgctcacgcggacgacgcactgagacgcaataacgacaagccaaagacggggggagagaaaaaaccagccaaggacacacctgagtcaagcaagaagaagagttgcaagagtgggaaaaggaaagctcaaatggaagtcctcgcagcagaatatgcggacccacccaagtacccagactcacaaggcgacgatacgaagaaaatatggtgccctatacacaagtcggacaagcactccctagaagcttgtttcgttttcaaaaagtcactcgcaaagcaacttgcattggagaagggcaagcgagtacatgtagtcgagaaggccgctgaagcagctactcaggactcggactcagcatacccaaattccgatctccatgtttcgcacatcttcggaggttccacggcatactcctcgaagcgagagtacaagaaagtggagcgcgaagtttgttcgacatggcaaggggctgagtccaagatgaagtggtctgagcagaagatcgaattctcagaggaagaccaccccaagactgctgtcaccccaggtcgatatctgatcgtggtcgacccactattcggaatatcaaggtcgcacgagttctcatcgatggcggcagctccatcaacctactcttcgccagcaccttggacgtgatggggatcccacgaagtgacttgacgcccactgatcaacccttccatggaattactcctcagtcatcgtccaagccattgggcaagattacgttgcttgtgactttcggccaagcaaacaacttccgaacagagcagatcacctttgtcgctgaatttgatacagcatacaatgctatcatcgggagaactgcactcgcgaagttcatggccgcatctcattacgcgtaccaagtgctcaagatgcccgggccaaagggaacaatcactattcaggggaacgcaaagctggcggtgcagtgcgacatgcggagcctcgacatggtcgaacacacgcccaacccacctgccacagctgagccacccaagaaagtgagcaaaacaaacaagacgccgaagccagacagcgcaatcaagatcgttccactctccagcgccaacctcgacaagaccgtcaagatcggggcgtcactagacgagaaataggaactcgcgcttatcaccttcctccgcgacaatgtagacatgttcgcttggcagccgtccgacatacccggggtccctagggaggtgattgagcacaaactcatggtgcgacccgatgccaagccagtaaaacaaaaactgcgcagatttgcaccaaaccggaaacaagccatacgagaagaactcgacaagcttctcaaagctagcttcatcagagaggttatccatccagagtagctagccaatccagtcatggtgcacaaggctaacgggaagtggaggatgtgtgtcgacttcaccgacctcaacaaggcgtgtcccaaggatcacttccctcttcctcgaatagaccaattggtggactcaacagctggttgtgagttgttaagctttcttgatgtctactctggctaccaccagatcagcatggcaaaagaggacgaggagaagacagcattcatcatgccgttcagtgtattctgttacgttaagatgctgtttggactgataaccgcaggaaatactttccaacgcacggtccaagcggcacttaacgatcagcctgggaacaatgtcgaggcctacgtcgatgacattgttgtcaagaccaagacaagcgactcattgattgatgatctccgggaaacgttcgacaacctccgacgatatcgcctcatgctcaatccagagaagtgcacattcggagtaccatcgggcaagctgctcaggttcctcgtctctggaagagggatcgaggcaaatccggagaagatcaaggcaaatcctaactggatgcatggcggcactgagcaggttcgtcgctaggatgggagagcgcggacaacctttcttcgctctgctgaagaaacaagacaaatttgtatggacacaggaagccaaagaggcattcatcgcactcaagcgctacttgtcaaatccccctgtacttgttgctccccaacctgataaagaattattcctctatattgccgccacaccatattctgtgagtaccgtcattgttgtcgagagagaaggtgcaaagaccagtttactacgtcagcaaagctctccatgacgcaaatacaagatacccacagatcgaaaagctgctttacacagtaatcatgacatcaagaaagctacaccactacttccaaacccacagggtcacagttgtttcctccttccctcttggtgaagtcgtgagaaacaaagatgctgtcggcctcatcgcgaaatgggtagtcgagctaagccagtttgatgtccactttgtgccacgaacagccatcaagtcccagctcctcgccgattttgtagctgactggactatgcctgaaaataggtcggacagtcaaaccgacagcgaaacatggacaatggcgttcgatggcgcactcaacagtcaaggagcaggggcagggttcatattgtcacgcccggaaattcactaataatttccgaactaatttgtgcataaaatcctcgtccaggaatcagccgaggtacacaaactgacaatttaatatacaaatccatcataataataacgttacatacttacaaaagaaaagaaaaacaacagcagcggaataacggtctagcgatggcttcagctccactcccacaggcaactcaactagggtataagccaaacgtcttctccttctggatcctttttcttcaactgagatttgattattgcaagaatgagcatatgacatactcaacaagccacacagcaaatatgcaagtgcacaaggataccaaaggatggcataatataagctcattcgaatagttttactctggccagaggtgtaccactgtacccacaagacacagcctcaacatcatgtctaccatgcgtcgcgatactggaaagtacccgaatagaggctatgacaataccctctgcacaacacaactcaccacagtgcaccatacctggatcataatcaccccctctataaatataaccagagacatggactccccagcgacccacacggacttctcgccgcttctcagtctagtgccccgcaatgaatcatgctatacaaaaggtaaagccgttgcccacgctggcttgtggttggcacggttaatgtttcacaacagtagctcgcgaaccggttcttaattgccatgagcacgaccttcacaaccatgtgctcacaacccaccattgacaaattttaattggcaataattaattaaccaatcacgattgaccatcgtgagctaccattaaatataaccataagtgatagtgtaatattagttatcccaatcatgtgctaatgtttctaagcatggctaagtaattatatatatatagcatttagctgaacccaaaccaatatataaggttctagctaatcaaattataacccataggaaaataaagtcatcttcggccattaattaattgggaaaggctcaccacccgatgacattcgaaaataatgcataagttgaaataaaacaatagctttaaatgggttcaacatgctcaaagggttgtttgggatctgtgtgacttgccttgagcttccgcaaacacttccgaaccttcctcaacgaaaacgctctcttcggaacttcggaaactaaaatgaaagaacaaaatcaacaaaacagtacaaaaacaagcaaaaacagtacatgtggatatttttaacatgtagatcttgattttagaaaaatttagcaacttgaaccactcgaatccgagttacgatgatttagttatgaatttccgaagtttaatcgattttcatctaatagagaaaactaagaaaaagggattaatgacgtcatcgctgacatcatcaatgtcgactcgacatcagcgacgacctcgccggcgctagaagactcggccggacttttggagggtacctacgcgtagaggagaacaacgcgaactcaccggtgcaaagaacaacgactgacgacgacgaacgacggccggcgacgaggttcgacggcggctcggctcgggtcaacaatggcgacggcgctccggcggtcttcggcggctgcgaaggggaggccggggttcccctcctccgtgcgcacccaacggcggcgacggctggcaacggacacggctaccgcggcggcgcgacgcggctggaaggtcaccgacgacggcggcggctagggcaacgtggcggcggcgctacgggcgacgagggagctcaggacttggggcaaacggaagaggacgactaggggatgctatttataggcttggattgaagagatcggactccaaccgagaggatttgagccggaaaaaccgagggttagttgcagagataaactcgaaaacgaattcgattccgcgttgatttcttcgggataaagtccgattcttggaggaaatgatagaggaggataagagaaatatttcccctcaactaattttgcaaacggagcacgggatgcggtggatttggtggaggaagcggcgtcggctacagggcacaggacggcagctcgggcttctgtccaagcttgaagacgacactgtagcagggacgcgtattagacttttcgtcttgggctggctgaaaacaaagcaaagaaagaaagagaaggaggagctcggctgggccgacttcggccgcacagcacgcgcgcgagggagagagatgttgggctgaaatcagcccaacggcttaggagaggatttaaaaactttttccaattaaaataatcactgaaatgatctttgaattgttaaaaatacttccaatcctcaactagtttcaagaaaaatcctgaaaatacttgtacactcaaagtacttaaaaaaataataatcagtccatttaatgattaatttaatatgtggataattactgaaatgttctttgtatggttaaaattaggaatggagctccgaaaaatccgagaaaattccagagagtataattaaccatggagaatttaataaaaaataaatccatccatgctttatatttaggaaattttatttcccacatttaacttctcttgtaaatgaatgaatatttaatataaattctaataataatttattaaataatttataaatcctaaaacgaaaatcaggatgtgacacatcttgatatcaccttcgggcgatcagtttaagcacgcaattcacctcaacttcagggcgaccaacaacacagctgagtacgaaggactactcgctgggataagagcagcagccgtacttggagtcaagcgattgattgtgaaaggggattccgaactagtcgcaaaccaggtgcacaaagactacaagtgctctagccctgagttatccaagtacctcgcagaagtcaggaagctggaaaaaaggtttcatggaatcaaggtccgacacgtataccgcaaggacaacatcaaaccagacgacctagcacggcgtgcgtccagacgagagccactcgaacccggcaccttcctagacgtcctgacaaagccattggtgaaagtggcaaacgacgaagatagcatggtcgtccccgacatcagctcaggggct

SEQ ID NO: 62605 - DNA, 1670 bp, Oryza sativa
  unsure (1)..(1670): unsure at all n locations
gaccccgaaaatgttcccaccccggtaattcgatcctcttcttctcccggcgagttttcctttttccctcgcagcggttaacttccgtcgcaatttgtcgtcgtcggccctttccctttataatccgtccggtagcttcactcctcctcgacccgcttgtcgctccggtggtattccctcctcccccggtgcctcgccccgccccgccgacgggcgccactgtcccctgtccatttcggccagcttttgtcttccctcctctcgccatccgacgcggcccccaattaggcgccacgtcggctagaccaagtcaacccgccagcctcgtccccgctcgcgtgcgctcggtccacggaaagcctaccggctgtgcgtgggcccgccacccttcggtccacccggtgcaccaaaccgcgcgccactcccatccgaaccctagcgcgcgccacatgcaccgctcccacgatgagccgcgccaccgacaagcgggccccactcgggaccccgcaaggtggactcggcccaccggccctctctctccctcactctccccgcgccccttgggccgcctctctgggccggccggcccattagtttggccgagccgcgcctctcctctcgggccacgcccaagccgcccgagggagtctaaatcacatccctccaatttctttccaaaaagggtttaataaattattaaatcctttttcctttgattagtaaatccaataaactttgaaaatccatatattcccaaccgctcatccgattgactccgttccacttccagtaattccgtaaaattgagatctatttaatggcactattaattaggctaaataggatctttcttttgggtcttgtgtaggttttcgattgtttgcgtatagttgcggttaccggattttcgtcaatcgtggttttctcggagattcgtgaagcttcgtgaagaccttgagcaaggcaagtcaccctttgatcaatttctcctataattggaaagtcattattattttgtttgcaacttgcattattagaatcactcacgtttaacttgcttggcctcggtttgcatgccaaaccgacagacctacctagtagtcgcactaattcctgtaggctgtactaccctgactccttatcgctccacctttgtggtaccacggtatccgtgctctctgagcgcgtataccaaatatcccacatacaccgttgtttatcgaaaacttgggaaatgggtttgtaaagccttgaaaacccgacatgtggtgtcggtgtgtttaaaaataaaatgaattgtgaaaactcgcgatgcgggggttgtgcctatgtggcactgtcccgtattcgcatataaggaccgattcctgtgggaaacgcatcgagcataatcaaagtgcaaccacaaggtggaatgggacaccctggctaagtacctagtcggttcagggaaacctcgcaagccaatagttgggtccgcctgggcggggtcggttggngccggtccgggttcctgggggttcnntttcctnnntnnnggnnggtcaatccgacacaaacaatnnnacactggggggggggnggngaaattccaaatttccacaacaccgcgaatctgagaaatgtgaggaactaccacacaatttgccccattattccaccgttcacgg

SEQ ID NO: 62606 - DNA, 858 bp, Oryza sativa
  unsure (1)..(858): unsure at all n locations
aggatcgggttgcgggttttaagatgttgttgtttgattcttccacctttctgatatnttatagattttggacataatttnaaanctccccctccccccnccccatgtgttgatggcacntggcttgcnagcnccncnanacnngaggaanagggaacccccacacgcagnagncaaacaaaactacgctaggaatcacctcacatccgcccatgatcgtgggcacggctgttcgaacagtggtggtaacctctgcagagggggtacactttacccacacgatattactaacccggatcacccagcccgtggggatcagccacgtcgggagacctccaagctttcatgacaaggcattttcaaagccgacacaggcttaccatatgccgacgagaggggtcccagaccaacaacaggttaggtcctagaccatactgtgccaggaagcccaggggtcctgtctgacaccaccccggcgaattcacatgtctctcgggatcatggctcccctgataagctagttactcagccaggggtgtcccatttcacccatgtggtcgcacttgtcctatgttcggatgtaattccaaggaatcggtccttaagtgcgggagcgggaaaaccgtacacccggtatgttccccggtccgcggttttagaaattcatttagttcgcaagcaccgacccaggtgtcgggtttttcaagtcttttgtaaaacccaaagtttacccaagttgtttctcagattttaagtttgaaggcgaccgccgatactcgcacagagtgcacgaatatcgaggcgccattgggtgggtacaagggacatggtttaacaattaacaaaggagggatcaag

SEQ ID NO: 62607 - DNA, 7225 bp, Oryza sativa
tgatacagaagccgagaagttatccagacaagtcaagatctactgtatgatcggcaacgatcatacaaaaaggcgccaaacggggtacttctcaaatgtatctcgtccgacgacggcaaacatctcctcctggacatacacgaagggatctgcgggtcacacaccgctggccagaccttagtcgaaaaagctttccaacaggggttcttttggccgaccgccctcaaagactcttgcgacatggttcagcggtgtgaagcctgccaattccacagtaaaaacacaaggctatcagcacaagcgctcctgactatccctcttacttggccgttctcatgctgggggctcgacatactcggaccattcccacgaggacagggcggatataggttcctattcgtggcgatcgacaagttcaccaagtggatcgaagcgacgcccacgggggaaatcaaggccgacaacgccatcaaattcattaaagggatattctgcagatatggattgcctcaccgcatcataacagacaacatctcccagttcatcagtgccgacttccaggattattgcattgggctgggagtcaagatctgctttgcctcggtctcttaccctcagagtaatggacaggtcgaaagggctaacggcataatactacaaggaatcaagacccgtgtctatgacagactcatgtcacatgacaagaagtgggttgaagaactctcctctgtgctatgggccgtgtgtaccacaccgacgacatccaacaaggacacacccttcttccacatgtatggttcagaagccatgctctgacatcgagagaacactagtacaaaagtactctgacgaggatcaagaggagcagcaaagcgacaatgtgaatctactcgaggagcatcgagaaagagttgccgtcagagtagccagctaccaacaggcccttcgccaataccacgagaagcgcatcagagcacacacgctttcgatcggcgattacgtcctccgacgggttcaaagccaagcagggcgtaacgagctctcacctaagtgggaaggaccatacacgatcacgcaagtcttgcggccaggtgcattcaagattgcagacggcgatggttgtgagttagcaaattcctggaacattgatcaattacgtaaattttatgtataaatcaatagcatccatacttgcaagacatcttacagcttcaataaagttgattttcaggtaaagattacaatcaaagtgtttcttcccgacgatcccttaccacgacgacacctagcgttgaaacctaccctcatgtccctttacgccgtcttgacaaggcctctaaggaacctcagggaacttcggctggggacacccagagcagataaggccttgtcggatcatgtagagacaaacgaccatgtaagatcaggtcatgtaagagctctcgtcgtgcgtattaaccaacccgtgtaatcggaaaccgagtattccaacttcacggctgggggctagggtcaatgctttttcaaccgaggcaggtcaagggtcaaggagccttatcctccgagaacgtttctccgacaacaaggctgggggctagggagagtgtatgactcaagcgattgatcgaagtcgcgaaatgagaaaacactcacacacagcatatccagagtaagaaaacttagttagatagattccttgtctatttcacaagtacttcttacaattcataattgctccaaaatatattacatgtctccttgagataatttttacaggatacaaagactaccaggacggcaaacgccagtccatggactgaaagacattctcggcaagcggcacaatcgacttcgccagattctctatctctgcgggagtcctccgagaacgtgaaaacccttcgtggaggaactcgaggtgcagctacgggcggtgatctcagatacaggccagcacgtgccctctggcatatcggctcgaccgacgacactcctgcttcagcgcctcgttgatacgcttgccgatgccttcaagctgagcacaggccctattcaaccatgagatatatccagccaccgactcctcgggattcccgcgaggtactcggcgttccctacagactccagccatcgccatacaacagctcctgaggtacgagttaaactacacctcgcgacctcggagtgcttccacagcttggtcttttttcacttccaccatggtcctctcgagttcggccacctcgaacttcgtcctccagtattggatccgacgatctcggtcggccaacgcgctctcgaggtctgctcaaacacggaaatgactaagtcaagttgttcttctctctcaagaacacagcaaattaagtcaatccgaacaaaagagtgaaggaagtaaagcccaaggtgcaaacctaaagacgtcatcgccatgttcgcctccgcggacaggctctgatcgacgtcatcctgcggcacgtacggctcaagcgctagtgccgggatgaccaccggcgtctcaggctgcccgcgctgctggacatcctcaatgtcgacatctctacaacgacaacaaggtactcggaatcacatgctaagaaaacaaaggaaaacagctgcatacataaaagaggtccgggccaatagaagtttttatagtgtgttgattaaggggtacaagggaaacagaatcctactcttcaaaaagggggagaacagacctcctgatccagaaccctcttgatgtcgaggtcagggtatgccagcttcacgcatgcgaggacatggcacgccccggtgtagatcccgttacacgtctccacgccgattctggccgcatgcttggaggggatctcctccatcgccacagccaggtccgcgagcgaggacgtcagcgagaactcgtcaggggtcgccgggatagtggtcgtcacgccgcactccccgacgagttggtgtaggccggtgtaagacacccgcagcgagctgcggatctccgacaagttctcgagctctgacatccggtgctcgagcccttgtcgccgccattcattaccagccaccaactccctcatcttcaggaggtcctcgcgggcctccgccagaccacgcgccagctgctcggcgctgtggtttgccgacgaccccgccgccctggcttccttgatctcgcggcccacgcgcgagcaccagcctggaggatgcgctttatctcggcttggagctccccctaggtgagggcatcaacgggcgggccccgagcgggcacaaggccgccgacgggcccactcagcgtcgcctcccagtccctagtcacgaccacgacatctgtcaaggccgccacaggggacatgctggaggccgcaccggacccgtcttgcgtcacctttgcccgcaccgccctgcgaatgatttccacgattttcataaagtcaggcggccaaggttttgcgaattaaaggacctcaaaatcatctacttactttttgctgagcgtcaccagcctttgccgtcgctaaggcgggggagacgcgtccgaggcctaagtatgataagcatggtgtgaggtcaagatcttccgactacgtgttaaaggacaagagaggcttaccgatgggttaggcgccttccagtgggtcccgggcacggaggagaacttcctccccttcttcggaacgttgctgccactcgtcgtggcagcagcagcaacgtcggacgcctctttggcgacgccctctttcaatgacgccgccgcctgatggtccgcaagcggcccgatgacatccgtcagagggagagcctgcatacatgaagtcacgacgcgatcctaggatgacagaaataaaggagtcatcaagtatactcacgttgatcacagcctcgcattcggccacccccttctggcaaagggggacggggatgttgctcgctatcgtagggctgctgatcatcactttaccgacgcggcgctccacggtttcgctattcaaacctgtgagatcgagaaccagaactcaataagtcaggaggaacgtgcacataagaaatgaaatctgaaacacgagaaaaataccccgaggagaacccgggacgcgtcctttggcccagaatagtcaaaggccgggtgggctcgagcctggagcagttggatccgcctaccgatgaagtcggcagcaacttcataccccaacaaccctcgtactcagaggtcatcgatgatatcgatgaaagactgaagggagggagttagggcgggtttggcggtccattccggaatcttgtctggttgctcctcagggacaacaaagactggatccgagttttctatctgaagataaaaccacctcgcccgccatttgctacgagaagaggggcactagaaggggatgcccgccatcccgaagtcagaatccgacgcatccagatatcctattggattccatccagcgcaactcgtagtaaaaacgaaagaaatcaaggaatggctctaccccaatgtaggcctcacaaagataagagaagatactgaggaatgcgatggaattggggttcagatggagcaaggaaaggccataaaaattcaatacgagaagaagaaattcggagggcggaggaagaaaaccgcaagaaatataatcctcaaccgcaaccatgcggcccaggaggggttcaggttcaatacctcctgcttccctctccatggtcccgctaccagggagggcgccgtcgtcctgcagcttcttcaaggacgcggtagtggaggtagacttatcaagatccaacaccgctagagatcgccggagaacaaactgagatgagcaaactagggttttttctgtgggagcggagaagacgaggggcgcttgaaggctggagagttctgcggcaaacgaacttcaaaatagatccccaaaactcctttaaataagcgcattaccgacggtgcgtagtccaaggaaaggagagagatggccgccggaaatttctgggtccgttacgcgcagcagttttcagacttcaatttaaattcactcatgaccgttgaacttcgtacaatgttatcgataactctatgtctctaagggacccccgggaggtcctaaggcatcgaatctcaccgccaacacatccacctcagcctacaaagtcggagcccacaggagccaagtcatcgggtgatctagtcgaaccaactcgattacggtctcgtcggtatcatcgagttccgcaacctttgtaatctgtggtttccatcatataatcccatatctactggattagggctattacctatcaaggggcctgaaccagtataatcttggtcttctgcttgtttgatgtcatactacgtagatcctcataccagcgtaccccgataccctctatatctggtctacgggtatccaccgtcgacattcatgctatcatcggctagaaccaaaatatgtatgatcatcaatatgagcggatgcaacacttagaaatagtaacatgataactcatcagctaaaacttcgatgaaacatcgcataaaaacttattagcttaatagaaataaacttattagcagcaatatgatagatcaaacctaaccgagacactataagattgaagataataagaaaaacctatttagccgacagatctatatcgataaatctaaaacaacaatttaattagagaaatatcaacttactcagaatatcgaacctaaccatgaaagtcctaaccgtggaagatagactcgatatatcatataggcaagacttgcattaacttgaatagaatatcgaacctaaccgtggaagttctagccacgctgatacaggcgaactagatggaacttacctcttgccggagtcaaacttaaccgatgcaaccccgctcgaaactaacaactcgtcggaataaaaggtggcgatgcaccaaaagttgtatattgatcaagagatagtttacaaaaaccccgggtgtacatatttatacccttggattgatacaagtcctgattggacacgagataagactcctaacaagaaaacgaaaataactaatcttgcctatttaagatatatactaaaaatatgaaacagccttgtcacggtcttcacgattcttatttgaattcagcttgatctggataaagtttcatctaccaatcaatttccatcattaaccgaatccactagagaatcataccaaattttggcattaaaaaggggacaactgtaccagttcgcctacagcgttatgttggtaccctccccctccccccccccccaaacctaacggcattaagattctacatttagtgtggaataacactcgtcatgctcatgcaaggagtagataataaataatataaagacatcattgtgacctctaggtagcactcagtgtttacagtgtggtggtatcaacgggtaccggataaactagagcgattcatattatgtggatcaaactaaacgattagacatgcaggaaaatatacaaaatgaattcttcttgaaaggggagaattgtttcgattttaaaaaatagtcaattttgtgcttttattgcaaatatggggagatttttcttttttacttttttttatttttcagtctttgtgcttttttatttttcttttttcttttcaaaaacacaaattgcattttcaaaatatggccaatgtgttcatcaagggggcggttgtgaaatcaaggtggtaatttaatctatgtgattaacaaactgtcaaaggtcagtgtttattgaaaatacggtggatagtgttttcggtcggtgaacagtgcaatcggcactagatggccaatcagaccgagcaggtgccaccggtcataccagaggtatgtgggcgatctgaccaggtagctcgccggtcagaccggtagactattgacggtcgttatagaccaattttgaccttcaatataatcggaataatagagaactagctatgcttgcaatgcatatttgttttagaataatctatctccacttgtacttggattttatttgtttgtagagattaacacaaatagaggacaatcgatggaaattaacagaacaatcaatcaaaatccatcgagaggtagacttatggtagataggactctaaacccattaaaataatattaaagggcccaatcactacacaactagaccgaggaatcaacgaggagcgcactgaccaatttctaggccatttgggccaggc

SEQ ID NO: 62608 - DNA, 705 bp, Oryza sativa
  unsure (1)..(705): unsure at all n locations
ggcgggttagacgcctgnnnnnnnnnnnnnnnnnnnnnnnnnnnnnnnnnnnnnnnttcctgaaacactgaaaagaactggtgagtgtcatgatgcagaaatttcaagagaccacatggtctacacaacaaaagtaatatcatacctcagaatttatcacagtcgagttgacagtcatggaagatgcaagaaggttggtagagaaaataacatagtgccggagaactggattttcaagcttttgcacattggagtactccatgtcagcaaaggatttaaagtagtctactgtcaatctcattgaaaggcagtggaggctcttaggtaatgtctgaactccaagccggtaaagatatgcaccttgtcttgcatgaaaatgagcttcatcctcagtcatatcaagcaattgcctcagttttttctcaaaattagtgcattctatcagacatgattttgctgcagctattgtcttctccatctttgccatattggctccatggcttcaaaaataacaaataatcactataacaaaacaaataatcattatagcaaactctaaacctatggggaaattttctgttccaaagtgaatctgtataacacattgagccatcagatcatcagtccactcatcatttagaacttactgctacaattattggtaaattattcatcccaatatcacacttttagcttaatacaatg

SEQ ID NO: 62609 - DNA, 4045 bp, Oryza sativa
cacagtcatctcttttgcaaactaccatgtgagacattttttactgacataaatggagcatttatttggtagatggaatgttgctaatccccagtgtagaggcaaaacaactatggtgggtgtatgacattttttgctaacctccaatgtagaggtcaagcatatatggtgggtgcgcatgtgtgaccttgattaataaagtacgaaaacaatctcacaagggtcacaacaatttcaaaaaactcaatgcaataacatgtagcatatttgtaaaggttttttcattgtactcatcatatggttttggtaggaatttttcatcattgaggaacttacaaatttttcattcttttgaaaataaggactccggagttcaagtatcgcttggagaaatatcatagagtctctatttcaccatctcatatcccgtaacaatttagacatagatcatgcgtgtgcaacccacaagtttcaagttcaagacaaagattgttatccaacaaactcaaaaacttaagcaaagactaagttataaactaagcactggaggaaacaaaatagagaaactattcattatttcaactattagaactagagcattcttaggctgagttctttctcccgctttcccaactcacatctctcgtttttcgcgcgtatgcttttcaaattgataaacggtgcattttttgcaaacattctttatacgaatgttgctttaaaaaatcaaattaattcagttttgaaaaaaaattgctaatacttaattaatcacgcactaatgcaccgtttcgttttttgtgtggtagagatggttcccaacccgaaggagcaaacacagccttactgaatatggaaagcacatatttttggtatttttaacttttgcaaatttttataggtttttctttttaaatgcaatgcattgaaatatatatccaaattaccttagtgtggggatcctcctccaagctagggattgaatccctttgactggaaaggccaacatgttagcctgacttttctgtacggtggcgctgatgttcaccgactggccatcggtatgctgctgccatgtgtgggtctcatggacatgctgttcggtgggttctgcttctggtcggttcagagatcaagctgtatcagagctaatagtacagctcacttcttactattagcttattttaaagtcaacatatataatatattagctataaggttggctataatttttttctcttctttctatctctttcttatacatttaatgtaattgttttgaagtttatgataagctccaacactcttaatttttcactatctctcctccatctaaatttatagtaggcttatagctcactattatactcgctctcagctgttgggtgatgtccgcaaaccctcgattcaaggtcatgataacctctacctgagaaagagcagcatgcaccaaacgacgggggtattccattatagttagaggagtggtctgcactggtaatgttgtcctagcgtctgctaggctgctcccggtggccacgactcgcgctttgctaaggagagcctccttctttatatgtttgcggtggttggtcccaaacggttgtgtgcacagctactgcggctgctgctacgactgcttatcacaccttaatttttatttcggtgatttataaattatttatagaatttatattgaagtgtacattaatttgcattaatttgcttgtaaagtaaaacttcctaaacaaaacgtggctggatttaatttttattacattctccgaggttaattacactctagaatttgctcggatttttcatagctcaattcctaatttttaaaatacaatcatcaataaagcaaatatttaaaaggaaaagtaactaagagcatgctaagattgtagccaaaataaatcttaccaaattttggtaggatttcttatatattttccaaatttaacaataaataaaacatagactttgccaaaaaatagtatggttgaaaatgacatcaatctgaacagtccctaaaaatatccaccgaagctttgggccatttttggtcatcttcttttgtaataagttcactataggtccctcaatttgttgtcgagtatgaaatccgtccctaaccgtaatcctatatcgatagagtttattcccacttagtgtatttaatatgattttcctgcaatgtggttgttccacgtcaccttgattgcttttgaactgttgatttgaacttgtatggtaggattagatcgtttttattggtctgctgctggaaaatgaaccatggtcgaggcccaccaggcgaagcatcgaaatacttacctagtagtcaccgatcaggttccgattttcctggttttttgaaatttttttagtctcttccattgcttgccgcgtgtcctgctgatttttttttacagttttccactgatttggtgaccggttgatttcctattggggtgacgtatccggtgtatgttactggtggccaactttcttcacatggtgcccacgtacgtgtcggtgattttttccattttattttacgttgtgttttacttagccggtaacggccggttatatctaacgtgccccttcctgattcgttatttcttacagtacacgcagtattatgttcttgtcgtttgttttagcttgtgagctaaggattgtttctctctccttatcttcttacagtccatgcatggcaagctacaatgttgcacacatctagctagctgcttctgcttgcctcgtgccgacatgcgcgtgctgcgtgctctcatgctgctcatgtgtgttgtcatgtgttctcttctttccaatgtttatgctcctccttgctccttaagtatgtggtattttttctctcactttattggctctttcttttgctatttaagtccgaccatctcgttgttttcccatacattcttcacatcaatatatattctttctttatttcttcagtgctacttgagttgtttcctgtgtgttgtcatacctttttccgctgccatgcatatttcttgtttggttggtgtcttatgttttgttgtgttcgataggtgtacgtgagaaatgcgatggcgggatactggagtaatgtgagtgtgcgacccggacagtgaaggggacggaccgtaggtgtggtatgaggcgacgttggcgtaccgggtgcagtcacaggggtgacgatcgaggaaccagccacccggacatcatcatggtttccttctacgtacgtactcgacatggggtccgtccacccacaccatactgcccatgcctaccttctacggtgagcgtcacgcctaccttgccccctgcagcatcgatatcgttaaggttgatgtgcagaacatcattgagacattcggtgtcgggcatggacgcatggccgtgccgctgtgttcatttcagcccactctcttgtttttcgcgcgtacgcttttcaaactgttaaacggtacattttttgcaaaaaatttctatatgaaagttgcttaaaaattcaaattaatctatttttgaaaaaaaaattacttaatacttaattaatcatgtgctaatggaccactctgtttttcgtgtgggagagggttcctaaccccagtaaccgaacatagccatattgcaggcagcttcgccaagcatgagcggatgtgtgctatgctgccatagcaccaacgaggttcctacgaccacatttgaggatttaaatgaagcacattctgtaaggctcggaaatcaatagaagaatagagggtgtgtttagttcacgtcaaaattgaaagtttggttgaaattggaacgatgtgatagaaaagttggaagtttatgtgtgtagaaaagttttgatatgatggaaaagttgaaagtttgaagaaaaaaaattagaactaaacaaggccagaacaaggtagtaggtgcgtgagtcgggtcacatgcgaggaggagcagggacgtgaagcgtgagtggcaggaacagatggcgctggtgtcgaggtctccaacggtattactc

SEQ ID NO: 62610 - DNA, 6283 bp, Oryza sativa
ctttccaccaacacaaaaaaaaaaaaaagaaagacgaattacgcatagtagtttttttcaagaaaaagggtgaaaaaccgcaaaagaaacaaaaaaaattccagctcatcatataaaataccccaactgcctcgcttccccttcccctatggcttctactagtactcctgcatgcacgcccctaaccccgcctctttccttttcttccttactcgccgcgcgtgcgcctctagatttggcgaccttcactgccgccgccggcgccagatcggagcgcggcctcaccgttgtcaggtgagcccggtgatccgatccttccctcatgttatccttgtttttccccatcagatttggccgatccgtgtgtgcctgatctaccgcgccgcgggggaatgggggcggggcgcggtgttgcggtcgcgcgatctagagtgtgttttttttttctcgatgtggtgtttggattcagtggagatgggggttgtgatctgctgcagttcggtttcgctgtttggaggagggggaattgggttgatggtgtcgggtagatctggatcagcatgcccgcttaggttgcgtgcatgctggaaatttaggtatttaggtagggatgtgatctgcgaagccttgtgaatcaacagctgtgttttttggtcgggttggcggtggagatgggcttggatcgcacgggtgctgctacctgtgcagaattttgcacgcccatgtgaaacttggttcatacggtagttaattttcctttttcattttgattgtagttcctgttccgttcatgtgctgaccattgctgcgatttatgcaagtttttttttttttgcaaattcccgtaatagaagaattggattgctcccaaaaaaaattgcaatggaaaattacctgctcaaagttaagtttgacatgtcaacctagcaagaatggtaactttcgcaacgctcaattcctatcaaaattggtaaaattgacttggatccggagtcaaatttagcatatatctacgcctaatcattattattattattttccttcaaaccaagcatgtcagcaacgtcacgaaacgaaaacttgtctatttaggcagggatgtgatctgcgaagccttgtgaatcaacagctgcgttttttggtcaggttggcggtggagatgggcttggatcgcacgggtgctgctacctgtgcagaattttgcacgcccatgtgaaacttggttcatacggtagttaattttcctttttcattttgcttgtagttcctgttccgttcatgtgctgaccattgctgcgatttatgcaagtttttttttttttgcaaattcccgtaatagaagaattggattgctcccaaaaaaaattgcaatggaaaattacctgctcaaagttaagtttgacatgtcaacctagcaagaatggtaactttcgcaacgctcaattcctatcaaaattggtaaaattgacttggatccggagtcaaatttagcatatatctacgcctaatcattattattattattttccttcaaaccaagcatgtcagcaacgtcacgaaacgaaaacttgtcccagaatccaagcacaaatccctgccaaccacctaaccaaccaaaacatcgctctcgatcacatacttcactagcatcgatccgatacccgccggataatcacaactaccaacgaacacaccaacccaggatccatccatgcgcatggatctggacgcccccacctactcaccaaaaaaccacccgcaccataatcaaacgcatccatcccgcagaaaaccaaccaaaagaacgcgacacggatcacacacaccccgcggatacagtacagatcgagcatgagcacgggccacagatctacaggagaagccgcaacgaatggacccgccccgatccgatccgacggcgagaggaagaaacaagaggagagagagagagagagcccgagctgctgcctcacctggccggcgccgccgccgaggcgagtggaagcttcgccgccgccgcgggatcggagggcgtgaaaccctaggcgaggagagagagatgcgggggcgcgcaagagcacgagacgggaggagatagtactagtagcagttgaagagaggagtacctcgatgggtcgctgcgggtggagcccacctccgcggtgatctgacgtggcgcgcggggacggtggggccgagcggcggatggaggggtcccctgctaagcagatgaaaatcaccaaatttccatggaaatgtgaaatcttaccccaacacaatgcatttaaaaaagttcaaatcctgatagttcttggagccggtcatattatcgtatacttccttcatcctttaaaaaatacttaacctataagagttccttcgtccttaaaaaaaacttaacctattaagagaatatgagtcatgtgatcccttctaagacaacaaatctggctaccctttatctagaatctagatcacatcccctcctaggttgagtttttttttgacggaggaagtatgctcttcttaccatgtccaaaatttagacatcaaggacctcacaaacagcaattcaaatgggaatttgcccaagtgagtgggttgaaatgtaccatcacatggggttactcatgagttcataaaacattttagaccctaactatcggattgaggggctgtttggttggcttctaaagattgccatgccaaaccttaggcatgccacaatttgttagtacagtgtttggttggttgctacacttgtatcatgcctcactttacaaaatcattgggcctacacgttatagactcaaattcttaccaaacttagccacacttgtggccaacaaattgttagcctcactttttgtggcataacacacttgtgacaaagtgagatatggtaaacttagccatcaaccaaacaaccccataaagtaaggtgtggtaaacttagccatcaaccaaacaacctctcagttcctctcagttcaacattagcgcatatggcaagaggcacacgtgtattcgacagtttgacacaagccattaagagtgcttcggccgctgggacaatcttctcaggttcaccctctcctggcaccagaaaggaaaaaaaacataagttttttagcatcaagctaaattagttcgggtggtgaggttggaaactcacctcccgcgcacgcaaaatgaagcaacgcattttcttacgattaattaagtatttattaaactgttttaaagatggattaatattatttttaaagcaacttaaaaaccttttgcaaaaaaaaacgcaccatttgatagtttaaaaagcgtacgcgcgcgatacgagggaggtgagttgggaaatatggggaagaatacaatatcattcgcatgaacgacatatcatttgtgatttactggatgaacattcgcaggaacggcatatcattttttgttctaacgataggtaggaatggttaaaattacctgggttccatcatgatcaaaatgcaatgcttcatcattgctctcctgatgaacaaatcacaatgaggaaatgaaaaacttcgataaaaattacatttaaaaaaaatccatcaaaatgatacaaacgtagaaagtcgcagcagtgcaacatataatatctacggtattgtatagcctcagttattatttcaggaaaaaataagggaaatttattaccctttatcttgaaacagaggacaatatctccttccctgatgagtcggcattctcatgattctagcgggatggattacagtcggatagccttccggacattgatccattcatcctcttcagccccaaatccttgaaacctcactcggacttcctataacaataacgaagaaatagagctaaattaaaacatgcaaaaggtttaaatgtttctcaattctttaatttgctttaggatctactaacccattagttcacatctcggccattgtgagccccttaacgggaataactaaggctcatgcgagagagaagatagatatagcacttgcgatgtctgatatagttttagctctcaccaagtcttgccccatgagctattgctccagtgagggcagaaggtgagagtgaagatgcttttaacaagagaacgttggacaatgctccaatagtacagaagtacaacactgatcgtgcgaagtaggagtcatcaaaatgcaagtgcttgatggtgatcaagagctccattgtggaggcaataaggggagcaatcccactgccatagagtaccttcaatgggtggagaatcagttcactggttctttaaaggcctgtgcgaaatccctaacaagaggttagtaaccatgtagtatacgagcgaaggggttagagagcatattttgaagatgagtggcatcgcttcaaagctcaagaagatggactttagttcttcctgatgagttcctagttcaccttaatttttcctccttgccttcagtttttgaggcttttgttgtgaactacaattcattgcccgaaaactgggactttgagaagctcattgccaagtagtgcaagaaggggcactatcagaaggattgccctgaattcctgaagcatcttataaagaaagggattccgtacgaggaggactcttcaaagagcagaaagacgcaatagtaatgtgaatgttgtatgcaatgaagtgaatgttgcatgcaatagtgtgtcttcctcgtctacgaatgtaagaagtaagcgcaaacgatgcaatgaggaaaccacggcgaaattgtggcactgtcgtttaggccacattttgaaggggagaattgaacgatttattaaagaagaaattttgtatccgttagacattacggattcagaatattgcatagattgtattaaaggaaagacaatcattatgatctaaagattaaagcaataaggtccaaccgtgaagaagagtactactatgctcggcataccccttatggccaaatacctggaccttttgcaaggtttctacaggaaaatggcatatggcatagtagcccagtactccgcaccggacgagcctcaatagatcggagtagcagaaagactatggatggaggtattaaaaccgcctgcccatattcttaatcgagtaccaagtaagtcggtacccaaaacaccgtatgagctattgacaggaaggaaattcatgctaaattatgtacgggtgtggggctatcaagttgaggcaaagttatttaacccaaatattgggaagctagatcacaagacagtcagttgccatttcattggctaccctgagaagtcgaaaggttttcgtttctactgtcctgatagacacaccaagttcgtggaaatgagacacattgtttctggaggatgagatagtcagggggagcatggtaccccgataaattagtcttgaggagaagcgggtacatctaccgactccgatgattcaagaaccctttttctcgatacctgttgatgtaacaccgacaacacagaatgttgttgtgacaacacctgatgttagttctcctgtgacaacaacgaatgagcaagaggaacctgagattcaggatcctacagaactagttgtcacacaagaggaagagcaacatcagccccaaatagaagatgtaccacaacttagaaaatctcaaagagaaagaaagacagatattcttagtgactaccaagtctatgctagtgaagaagttcaaacacagggtgatcccacctcgtttgaagaaaccatgagaagtgctcattcatcgaagtggcttgaagccatggaagatgaaataagatcaatgagtaccaacaaagtttgggacttagaagaaattcctaaaggagccaaaacagtaggctgcaaatgggtctacaaaacaaaatgtgactctaaagggaatgtagaaagatataaagcacgacttgtggcaaaagggtttacttggagaaaaggaattgactataatgagaccttttctcccgtgtcagataaagattccttagggatcgtaatggcacttgggcatattatgatctagaactacatcaaatggatgtaaagacgtcattccttaatggggatttatatgagaacgtctacatggcacaacccaagggtattgttgtggaaggaaaagaataaatgggatgccatatgaagaaatccatctatggattaaaacaagcctccagacactccagacagaggtacttaatgtctgatgaagtaataagaaggtttgggtttaatgagaatgaagaggacaattgtgtt

SEQ ID NO: 62611 - DNA, 791 bp, Oryza sativa
gatggaaaaacgtgatggctataatatggttccaattttgtgcgtattcggatgatatagatatgaatagacgaatagtaacagtagtaatgacatgtatccaattcaccttttcggaatttcactccaaatctactttcgtcctcgaaacctcaaaattgcatggttgtggatcaatgctctgtactccctctgtcccaaaatataagagattttagatagatgcgactgtctcacgtccacccaaaatctattatattttgggaccgagggagtatactacctacctagtggctatatcttggggtacccgttgcaattagcacgctctctttctctctcctcatcatccctccgggacaaaaagcggcacgcacacctcccctcctctccctttctctctcctcctcccctcaccacgagagcgagcgcggggagctccccacccaccaccaccaccgacggcgactacctccgccgctgccgcgatgtctcgcctcttccgcgagtcccgccgcgactcctcctcctccaacggattctccgccgccgccgccgccacgggctccaccggcggcctcccctccccgttccccgacctcggggtccccctctccgccgccgacctccgcgaggccgcctacgaggtgctcgtcgcctcgtcccgcaccacgggagggaagccgctcacctacatcccccaggcgggggcatcggcgggtggtggtggtgggccggcgtccccggcctccgcctcgtctctctcctccgcgaacgcctcctcctccccg

SEQ ID NO: 62612 - DNA, 1078 bp, Oryza sativa
ctaagtacgtttgtattgttttgatagattttccttagttaaattttattaacaatagttttttctatttgatccctagttaaattaactagggatttttttatgttatttagtcgattgaaaatttggattgattttaaatttcagttgaaggatatcaggaaattgacactggattagttttaattactgtaattgatttaattgcaaactgcgatataccgttgcattttgcacttcaaaaaccaattgattattcactaaattaattaagcgataacagccaagatattctgttggtaataaatgctgtagttttttatctatactatttaattcattagcccgtaatacgatacggcttaaacttgagctttctaaaatatcactaatattttttatggtattatttttcatcttttacgggttgttatctaaacattgattcaatatatgctaatttgttgcccattttactagaatttagagtataattgacactctttttgccttataaacgcggatattaatgaatttatttaaacattttcacaaaacacctttttggtcgcaattagtctttggagtaatggcaattttaacgttacctgaatttcaaacaacagcagcaagtgaaagtcagcatgagcaaaatactattattaatcaagcggctatgcaatctgcattaagtgtagatgaagtcgaacagcaagcactttttgttgaattaaaacaaatcattcataacattgcgccacaagcggtcattttttaagattttttaactaaatgctatcgctttgaggtcgattatcaaccacctattcgagcccggtccttttatttaaatctaaattaatcaatatttcatcatcgcattaaggtgataggacactattgcgcaattttatttaaatattaaagatcctttattatgatttcaaaaattattacctctattttcggttcaagtaacgatcgcacgttaaaacgtttaaaaaaacgtgtggtacacattaataaattagaagctgaatttgaaaaattatcagatcaagaattacaagccaaaaca

SEQ ID NO: 62613 - DNA, 5863 bp, Oryza sativa
  unsure (1)..(5863): unsure at all n locations
gttttccgtctctctctttctcttctaatatttggacgtctttgtcttcgcctccttatctaaggtgtgtttccacttattccatgcctctctcatcactccccccccccctgttnttttagactgtgcttagagacccacnnnnnnnnnnnnnnnnnnnnnnnnnnnnnnttcaaggaatccgtttccggcgcctgatgggacggaggagcaccgatgttagccggcgacgagcggcggccttcgggagcggacggcaatggcggcgaggccatgccgggcggcggcggggctcggggtagcgtccacgcgcgtttgggaaagtataggctagcaatcgcgcaagctaagggggaggaagagtggggagggagaacaggagctaccgcgtcgggagatcgctgggaagagcgttcgacggcacaggcgggatcacctcggtctcgggccggggaaggggagggagagagggcgaccagagtcctctttggctccgcgcgcacgctggcttcccggcacacgcgatggcggaggaaggcgaggaccgcggcagcaaggcggcgatggcactgcagcggtggagactgaagcgggagggattgagaggagggactcggctttatagtggaggcgaggtcggttcgcgcgggaggtcggttcaaaccgaccttggggcggtcaaggcggcagctggcggtcgtgctcggagctagcggccaaacggcggcagaggcggtcacgggcgtgacgccggctaaggaaaaaggtgaaaagaggagagaaacgagctttgctcccttgctattttgggaggaaggaggatatgagaacgagagagaggagcacgagctctgtctcctggttttggaaggatgcggcatgggggcatcggaaccaggcgatgacagtggcgacgtcggcaaaaggcgagcggggctgggtggctgcgcggcgcaggcgcggcaaggcggacggcggcagcgaccggccggtcggccacgcgcgcgcgcgcgcgggaaagagcgaaggcggtggcgggtttgaacgacaaagtggcggcgcggagcgcgggcgagagagagcgagagaaaacgagagagagagatcgggggagagagagaggcgctttctctcaggtagggcacgtgcaacgcacatgaggaggggagcgggctgagaggagatgggccggggaagaagagtcggcccactgagccagagggaggtagaatagactttcacagagaaggctgatttggagagaattggagtttggatttggattcaaattcgatattcgaactcgagggttcagggaggaatcaaggaaggctcaagatagagtttggtatttttcggaattgggagcgagcgtttagcgaggattcaaaggatgcgactgaatttcggaatttgatttggagacttgaatcggaagaggaatttgaggtggaggattttgatttcgatgagagggaacaacgagatttgaaatgagatcttggcacgacttagactcgcacacaaagaacgaaaattttcgcaattaggattttaccgaattagtttttaacgtctcacgaaaagcggagcgttacatatgccatctcctttccctcgatcacacttggctccactcgcctgcatgcgctcctctccatcatctcggacgcgccggtccttcgctccaccacgctgtgttgactgtgcttcactccatcaccgtcccggccgccgctccaccccggcggcccggccccccaccccctcggccactccatctcaccgttccagtcgtgctccactcaaccactccatcaccgtcccggctgtgtcgctctaccaatccacctctctgtttagtcatcgttccccctggccgtggcggcagccgctcaccctcgcttgcaatgcgagatggatacaacagtaggactcatgtgtctgattcttgctagcatcgccatctccttcctgatttacgctccatactactggggtcttcgtctccatgtccgctctggacgatatctgcgtcgatcagatggcaagcgctaggtaattcctgatctttttctttggacagtcaatctgattaattagcacgtttatgactttgatggcatcttttcccctttctatttgcgtttgcagccctgaaggctagctgtgcttgccattttgtcatttgagcatttcatcaagtagttggtaggcaagcgctggtaaaaactgcacttttttgtggagcaagattatgaactggctacttgccaacaatttggggtttcttgattgctgagaaggagattcggccattgatctctttcttgaagcaacttgtggtggtcatttctaggaatctgaagcaaatgattatctcacctgatgcatgcgaactctgttcccccattttcaactatgggaacttgattatcgagaatgactgctagagtaaagtcatagagaacacaatattcttgccggactctaaagttcatttagtcaagaagccatttgggatctcttggttcatggagattggcactggtcagcttgcggcgctagctgtgtttgtctgcatttttgcctgtgtaggcatggctgatagccagaacatcaccggtgatggttcaaggctagctgaggtgtgcactgttcacatttgatttagttattgggagagcagtggtgtttcctattgagctctcaaataggtatcgacaaagatataggtgttcttcctggaacgaagctgagcattataaggcatgataccaattgcagtggttttctttgatccatgaaaggtttgggtttacttcttttccaccaagttttctttaatagaattgtccttaataatttacttgtaatttacacattaatctttcattttcagagacaaaagtaaagtttgtaaagttgaatggtatattggtatgcaattatgcatgtaactattcactgtgcatttgcaattaggaattttcccttttctctcctgcaaaattgtatgccaatttttttggaaactctttccaaatatgttagtcctttctagattatccatcgccaaatatactataaattctacaacttttgtattgatacaaattattcttaaattgaatttaactttacaaagtctggacttgggcttgcattgcccattaattggatttgaacatgctctactcatttttttttatttacctcagatttgtccattgggtcgcatcccacatatttgcatggtcttcagttgctaataatcttctgataattgataaatgttcacagactgcttatatcttagttttatatttattgtggatatatgaccagtgcatgctcacgttttgacatgcattatatactatgacatgcgacataatatggagcatattttcttttgttttgttcattttcatttttcttcaatgaacatcgagagcattgcacgagcatctcatgacaggaagatggttgaagtaattctcaactccattcaacatggttgaagtaattttcaagtccattcaaccagtctatctattttggatggcatgtccaaccagtcttataactaatcaattagatggagcaatacaatttgcgatcttttcatatctgaaagtttagacagaaactaaactgtcgtataagctaagagtcaatatggtaaaaatcttgtaattttgtatgaaattgtagaagttggtcacatacgtcctgctcgactgtctttcaataccgatgctacggtgcatcatctgagcttgtgctgctctgtgtactgcaaaactaatacggaattaacatgaggtagttagttgattcccaaatgaacctacatgttggagagagagagagagagagagagagagctatataattggaaaggtaggctctagcaatttgaaccatctgagattgagaaagtcattactgtcagaaatacttcaatagctgtctacaatgtttaactaggttaaataatctaggcaaactgtaggtaagtggttttttcatgtatgctttcattactatgcaaaataagaatcatgagtgtcatgatagtacctgtagctatatgacacgcatcaatgcagttctgcttatgattggcaatgatgaatatcgatttctgatattgtcatgcatgaataagcaatcaagaaatacagtactaaaattaggggactcataaggttaggaaaatgtatccaaacgggataccgttctgtatcatccccctaaggttactccatgcttaagaaaatatgcatgtagcactactgttttccttcaggcctgtaagctttctttgaaataaaaaatgatttgttggtgctatttgtttgtttaaatgtaagttttcttatgactcatttttcaggacgacaatgttatattttctcttctacaattggatgttaattacctagaaacatttctaaaaatatcgagaactaaaatgaaaatatgtaagcagttatttcttcgcaccaagatctattgcatttttttggtcgatccaagacaaataaaaaatggggctgtctatatagaaatcgaatgatttctgaagctccaatcatgcagattttatctaccataggatgcacatccaacaactcagaaaaagtgatacaaatagatattacacttaaaaacagatatattatttgattatttgaacgccatttttttaaagcccaaatctagatccagatccataaaagcccaaatccatatccagatccataaaagcccattagtaaaaagaaggcccaaaatacaaaatttgaatcaaacacaaataaacaaagcccatgattttttcgcccatgcgaattatttgaaggcccaagtccatatccagatccataaaagcccattagtaaaaagcaggcccaagatacaaaattagaagcaaaacacaaggaaataaagcccaaattataatccaacagcctatccaaaaaagtagtaggggccaaacttggaagccaagtagatgaaaaacatgtcacatgaatcaaccatgtatgggaccacacttttcaatcccctacttttcaacagcactattagttcacaaacagatctagcacgaatcaaacatggagctaggagaagagaaagaagagagaaaaagaggatccaaatcgcagatggaaggagagagtacaatgtcagaatcaaagagtagttctagaggaaagaagaaatcaaagacaacttctgaacagaaagttgagatccatacaaaggaaacacagaatctggcgaacacaaagaaaaaacaagaggaaggcaaaatcaagagaaacaagaaggctccagttcaaggttagttcaaggctccaattcttatcccctatatacaattcctgaaaaagatcaaagagagagtttaggtcaaatatacaattcaaaagaatacatgaaattgctgaatatgtcaaatgaaacaaggttaacaatccactttgctggataaatacaacaactcagaactgaaaatttcatatgtttgctctgtagatctgaactatgtaatgttagaagtaaaactacactgcattcagtactacgaaactgcattctggatgattgtattactgtgtactattgatgaataccaaactaactttataaaaaaacatgacagattgattaatcttccaaccttactgaatttcactctgaagatatcacagttatacagttatacagaaatataacaactaggccatatagcatatcctgnnnnnnnnnnnnnnnnnnnnnnnnnnnnnnnnnnnnnnnnnnnnnnnnnnnnnnnnnnnnnngatntataaaacagggtttcaat

SEQ ID NO: 62614 - DNA, 529 bp, Oryza sativa
  unsure (1)..(529): unsure at all n locations
gagaggagggactcggctttatagtggaggcgaggtcggttcgcgcgggaggtcggttcaaaccgaccttggggcggtcaaggcggcagctggcggtcgtgctcggagctagcggccaagcggcggcagaggcggtcacgggcgtgacgccggctaaggaaaaaggtgaaaagaggagagaaacgagctttgctcccttgctattttgggaggaaggaggatatgagaacgagagagaggagcacgagctctgtctcctggttttggaaggatgcggcatgggggcatcggaaccaggcgatgacagtggcgacgtcggcaaaaggcgagcggggctgggtggctgcgcggcgcaagcgcggcaaggcggacggcggcagcgaccggccggtcggncacgcgcgcgcgcgcgcgggaaagagcgaaagcggtggcgggtttgaacgacaaagtggcggcgcggagcgcgggcgatagagagcgagagaaaaccaaagagagagatctggggagagagagaggcgctttt

SEQ ID NO: 62615 - DNA, 2773 bp, Oryza sativa
  unsure (1)..(2773): unsure at all n locations
ttgcgacattttccagtttatctggtgtaagtcggcgttacnagtttcgtttgacatattttattttttgttccgtagaaaancatttccctcccncccccccagtgtgatgtcagcgcntgacancnacgcnccnnnagacgcgaggaaancggnaccccaaactcangnaagaaccnacacaggtattcttattctatttcagaacaattttttcattacagttaatttgtataaaaattacataaaaaactgtaattccaatactaaaaatttcaaactggaatacaaatttactctaatttttaatgttgaatcaatcaatctattgcaggcataacaggtaatgaggtaggaataagcaatgctctggatgaaccaaacacaggtaacaattcaaaatggaattgaacaaatgcataattccttcagtaaaaaaacacaaaatgcaaaaattacagtcaatttgaaacagaataagaataattttaaacttcaacttgattgttatacagtttgactggaacctatatataatttgatcacaattactttaattgcaaatataacagatcatattggattaggagcagaagatgcaacagtagaaaagcaaagtatggataattcagcaagtgtgacagaagcatttgttgattacagcaacaaatattcatatgatgaattatctcttttcggatcaatgaattcagtaagttcatattacaaagtttttgctattaaaggaaaaatttgaaggtggtagtcaaaatactatatgaaaatttatttgcaggttgcaaatatgtcgtacacaagcttaatggaacaaatcatatcatcacagcctacgatttctgatatgcaggtaagaaaaacaatatttgaatatcatatataatttagttgtaatatttctgtttttattggaatttacaggaacaaaattcagcacactctacttttgttgcgagtccaagtgcatttcaggtatgaaatattaattatttaattgaatctaataattcaaattcaaaagcaaataagtattgatataaaaattttgttttgcagaattcaatgatattaacaacaaatcgtactaatgctaatattgaagaatggaataatgatgcggcaaatgaggcatgttgtcttggatgtattacttcctgttgtagtattaaaaattatgataattttagtaaattttaactttgtaatgtaattcaaattccaggaagatgagagtaatgaagaggatgcaatggataattggaatcttgatatattcaatttgttagatggtgaaaaggtaatttttgttgtttgtacctttttctctagataacaatgattgatgattgaagtttcatagtctgcaaaaaaagagtacaaacattaatatttcttaaaaaattaaattgaataattcagattagcaatgaataggctagaaaattaatttcagaaactaatggaactgctttttttttgcaggaaccaagttcaatggataatcatcgatgtacttcagttcaaggaacaagagatgatgacaataatccaaatgataactctgaaacaaatcaacaagagctgacagaagaagacataaatattttcgtagagaatgaacaggaagaagctacaaagggtaataatgcagcaattgatagcagatatataccaagagttggaacacaatttaagactattacaaaagcacatgaattctttaacttctatgctctgttggctggattttctattgtcagggctcacaactaccacacaacaagcaagaaaaggaatggagaagtgactagagtaacgttcagatgtaatagacaaggcaaaccaacttctcaatccaaatcagtaagcgcagaggaacaagtggtttcggaagaaaatacaaatgaaaatgatgcacaagattgcaagtgtgctctggttatttcagagaggaatgagatttggaatatttcaagggtacaattagaccacaatcatcaactaagtccaagagatgaagtgagatttctcaaatcacacaaacacatgactacagaagaaaaaatgctcataaggaccttgaaggaatgtaatatacctgacggagcgtggagctcctcaccgggagaccgcgcaggcccccctttgccggttcggccggggacgctaagtgaggttcttcgccctcgatcgatctggagaatgttcgcgagagagcaagtgcacgagacacgggcgatgtagacaggttcgggccgctgagaagcgtaataccctactcctgtgttctggtggatctgtgtgtgaaggagttacagagagccggagagctagagagttcaggctccagaacccctctagcgtccttttttctttttttcccccctttttggtgggcaaggtcctccttttatatctcaaggggataccacatgcaccacttctacctacttttcttttgggtggggacctaccctatcttgaccaaaacttggcttgcaccttcgcctggaagctaaatcacaacttgtccttgagtgaggctcagcgccgtcactcgcctgacaccggggatctccctgttactccctcattaatgggcggagatttgccatggctgctttccaaatgaccatccgacgagatgggtcatacctacctccactccaccggaggcagatgcatcgtgggagcacggttgtctgccgatgacgcgaccggcgtcagaccagtcacagaccgatcattcttgtcc

SEQ ID NO: 62616 - DNA, 1235 bp, Oryza sativa
aggtgaccctaaaaggatatcaaactcatggaacgtgtgtaatctacctaaggctaagactatccaaggaccactattggtagtctagctaggctaaagaggactttctatgtgttttaattatctaaagtaagtcgaaggtaatttcctatctattgcttcgggcatcgacccctgctagtctgctagcatggttccagctatagctctatgatgtacccgaacgtggaggattactaggacagggttcagggctgtcaccacctgccgtctacctctgacaaatccgtgggatacataacaaacaaaggtaatctctaacctagacatcatgcctaagttattaattactactctaatacttgtgcagtaacttccttgtttatccagagtcctattactggagcacttactatgaatactcaacaatgaacccgcaaagatagaaatatatcttacttgaactaagtaattaaataacataagaaaggatcccgaatgcttactttatagaaaaagtttctccgaaccttgagcagagtgtaccgacagctccactactcctccagaattcctcctagagagctacactcatcgaggtggaattcagagagagcgccaaactttcgggcactcctccagagcttcccctcaccctctacctatttctaatgtataaaatatacaatagagcctcttataattcagctcaaagttgagtgtgggtgtctgggtgaagtgggggagatgagctctatttataggtggaggtgccttgggagtgtggagatcctccatagcatccaaagagcatatttcttctcctcttgtcaagtgtctagctgatgacagtttccaccggtgaaaacggccataatcgtcattggggagtggtttgctaccgaactggacttgggcctgagctagcggcctctgtcagggttcggccgaactcatggacattgattttgaggctctcagtccattggcatggtggttaggcccatttgaaggtgtttaattgggtttttgggtccaaaactccataagtttggatatgagtttgattctcctccttcttcatgtatatttcctttcaactttggtagtcacctgcatccaaatatataccaacactagtagaaatgattagtaataaaccctaccactaagttgaatatcatattttattccattatatgcaggtattgacagtcagatattatgatttaagg

SEQ ID NO: 62617 - DNA, 2947 bp, Oryza sativa
ctgagtactttgtagcattatgatattggcaccgataaggccggtgacatttagtggtgaggaagtgatccatctacattattcagcaataggcggtatcacaaagaaaaaaaaatgtaggcagtgggtaaagcagacttacatataggctatatatcttccctggtcgactaatccttttaagtaagaatttataattgtgccataaaaaaagaatttataattgtagtttcatattcactatgtatgaactataatggaatgcacagataagtatagaagatacatcaacatttaacaatctttatgctatttatgggatatcataataatctaaaacaaaatatgttctccacttgtcaataggcataaagatgtcaatcatatatattcataattgtagtttgatatgtactatgtaggaactatactggaatgcatacagatatatagaagatacatcaacatttaacaatctttatgttatttatgggatcgaccataatctaaaacaaaatgtgttctccacttgtcaataggcataaagatgtctatctgatagtgaaaatgaagcataccgacaagaacattttgtcctggttgccactgttacaaaatgcgatatattcttctcaattgatgaaattggttgtaaaacatgcatgcatgagatatattaattcgtactacattctaaaaaaagattcgatatatgtcattttgtatacttatagatgtttgaagttttttttttggtgaagaaagttttaggttggaaagagctagaaacattaatggttaatggccatggtgttacgcaatgactaaagttgatataaaaagttataacctaggactggaggacctattcacaggctgcgttggcagatcatgatttctatcatgcataatcagtggagtacaggcaaaacgtgattttaatttcttcagtaacatttaaatacatatagctaggttagctatagaaaagatcagaaaaagttagtcatatacatcaatgctttagaataagagtaacttattttgacataaatcaagctgataagtccataccctaatatcagcctctcctggaaaaaccggccatccaaagtggggtgtttggaacacgtgtcattcgtctttttcatgtctttggcgacacaattatttcattctccactttataacatgtcgggcgtgtcaagaaattattcgatatatgcgctttataattattattcctatcaaagtgcgcgtgccgaacatccactacgtacctagcttatgcgacatggttatcctcattgtgtggcaatggcaatgaatctttctctatatatactacctcctccgttggacatatatatacgacccagcttggatgtgtgcttacagaaggtaagtagatatcagtcataatattatttcttcccttgttgaaatggtacttatgtgtattagtattaccactatcgtgattattgaattttgctatccatgacatttatagacagtaattaagcccacaatgtatctaaattcttgtgagcatcattccagtaagatcatgtagcgacaaaggaaagagctttacaagtactacaattttgagtacagccataaaaggacataggtgttcatccaaaatacaagttttgttcaaaactattttgtagaagaggaatattacaacaattctcacataaagtttccagtaatactatacatgaccaggcatcaaaattattgggatataatgctatttgtagtgtccaaatacttgtttaattgaataattagtacagaaaactataattaatataagaatattttgcctgttattttggacaaaattgtagattttcattacgtttagtaccgagcatatattgataatagacaacgaaatatatgctcggtttaatgttcaacatgcatggtgtggtggaattgatttctaggaacagacatgattgatccctaaactatcactcttctatatatatctagtttgtccaatgagatgtattttgatagttcttttgtggtatctatcatatttgagttaattagtatatttttactacatattatataactcattgacgatactgcatataatcattcagtcatcagtgacaaaatggagaagcgatgttccattcttgcactacttggcttagtactgctgttctccaacgttattgctgagggagcaggcctgaacaaagcgatcttttctcgcaaaggtctgaaagaagaacgcaaactagctgtcactggaacagcctcatcccttggcggtttacaagggcaatcgtcaagcaccggtgttggaggtgttagcagcaacaatgctgaaagtacaaattctgaaactggagactcttcgtcagcctacacaccgatgagtactgccaccaccacagactcccaccatgacatgtccatggatcagtatcggaagatcatccacaacagccagatgaacaaaccgtaatgaccatggattgtcccgaaggacgtaccattggtgcagcatcgtccttatacttcatggggtatcaagttatgcaacgaagtataacaagagtcttttaattaatgtatatatataaactcgggtattattatatgctggacttggcttgtataaatctacctggtgccttcggctatataaacaaatatttatgcatgtgtttcgcatgcatagtaatgtatgcgctagattatgtgtcgaataaatcagatgggagatgcccatggtttatggttaatagccaaagcaatatttgtctaatttctcttgtttttaacgaaccagaggcgactagggatcaggtgcccgatgaattgcaaaaaaaaaaaaaaaaatcgggcgctcccctcctccctactactatcattgctacacgggctgggtgacatgcaaagttttgag

SEQ ID NO: 62618 - DNA, 1170 bp, Oryza sativa
cttccaacaccaccttctcagctcggtagagcagaatccggtagtcgccggtggggctgtgctggtacaaccccaagaacatgaatccggagatcagcgggaggtcaccgaattggcgcgtggtcgggttacagatggagtattgcggggggccggtgttccgggagatgagaaggagtccatcgcaggacgaatccaggtagtcggcggtgctggcgtaccgggcgaccggatggagccgcgcggcggcgcccctgcggcggccgagggtgagggtgaggacgtcgatgaggtacataatatcggcgtagtcgcaggcggcgatgagggggagggagggctggtggcggtggtgggcgaggaggaagtcgcgggtggatgtgaggcggcgccatgcgcggcagaccaagcggcagcggaggaggggcttggggggtaggcgtaccaggatctcccagaccacgagctcctccgggagcgggaggccggggctcaccggcggcagccctcgcgttgccgcctccgccatggtcgccgtcgcggcagcggcggtggagccgtggaaggaggtgaggcgaggcgacctttttcccttttttgagaggggaaaggcgaggtgacttgggttgggtaggagctttgaatgagccttgggccttttcctttatgggccagcggagctatgtgactaattaaggaataagtttatctgaggtctcttaacttatcaacgaatccgattttcgtcctttaaccggaaaaccagatacaacgggtccctcaactgttaaaaccggtggtctcattttagatggcagtcgctgtgcaccacccctcctcactcacgcttggagagaggacaaaggagatgggagagagatgaatacatgggagttggggagagaggaggaagaagaggggtgagaatgacatgtcggatttgttgacagttaagggacctcatatgaacttattccactaattaaatggtgattttcgtgttgagggctagtttagcacagttctagctccatgtcaaatagtttcaactccaccaaaaatagaagcggagttgggtagagttctctcacaaaataaactagatgaatggagctgggtttaggctgctacacaactccacttcagacccaactcctgtagctaaattca

SEQ ID NO: 62619 - DNA, 850 bp, Oryza sativa
  unsure (1)..(850): unsure at all n locations
gtgggtcnnnnaggtatagtctcagcnnnnnnnnnnnnnnnnnnnnnnnnnnnnnnnnnnnnnnnnnnnnnnnnnnnnnnnnaatttccctacaaataaaaagagagataaaaatataaggactaaataaaaaaaattgtgaaaaaaataatgattctaaaaaaaatttacctgagcaaagtcaatcactagtttctttgttcctgtaccgagaacagaattgtctggatggaagaaaagacggttgacatattgaatcctaatgttttgaatgtctttttgatagaaatggtttgtcagctgaactcttggaccccatagttccatgtattttagagtaaaaactccgcaatcaaaactaggaaaaagaaaaaggacataagtaaccacagttacttatcataaaaaataaaacaaacaaaaaaaattaaaaaaagctaatgcagttatggtcatactatttactctgtaaatttactaatgaaatctattgcagttctagtccatgttgtactaagaaacaggctcttatcccatctagtaattctgaatgaaacaattgacaaacaggaactaaattttttgaatgataatcataacaaacaaactaaaattgtgcattaacaacaaaacaaacaggttatgcaacaattagaaaaacagaacagtcaagaatttctgaatgaccaacaaaacatacaagattcctgtcaacaagagaacaattgggcatctgtacaactctaacaaaaaaaaaccaattaaaaatattattggacttaaagttacaggtaagaaaaacaacttacagattattttggcgaggtactggtggatatacaattttgaa

SEQ ID NO: 62620 - DNA, 6531 bp, Oryza sativa
catacagaacaataggatacttgtaatggctgcacacatcactagttgatgcaagggtcgtaaggtacaacgtaatcttccatcacctaaaaaacagggataccatttagtggcagtaggggtctgttaggataggtctaaaactctaaattggagcttgaaacagtgaagcctactcaagcttaatatatggtttgacatgctactctagaggaatacacaaaactaggcacatttgttttgagaaactgcaagatcattctattcatggattcccaggactttgttgcagactgtgggcaagagttacatactattggaacatgtgaagtgttattcctagctcatagcaaggtatctactgtactatggaagagtggaaggccatgatggcatgggtaatgagggagagttttggggtgggagtttgactatgaactgggaggaaaaaccttcaggagaatctgcattaattctttcatatatttttaacttaaacaggcaacaatgctgtgcctataaaaacctggcgataatagacagtctaaacctcccaagttccaacagatacagctttgatagcttgctaattggattgatactatgcttaatccttcagctgagtttttcaatccctcaagctcaagcttatgaatgattatcctttatccctctgctttgtttgttgtagctgtgggattgctagactatttgtcttgcattgctagtggacgaactctcccaaaaaacttatcttctgaagaatcaatcgatgagttgtttacaatatttgatgatgtgcgaaggactgcagtgagtacaactgacagaatcctgaacttcattggtgagctactaagattctagatagtttatgctctttacaatttacgctcttatccatggaatgaactttaagcaagtgtatttaacttttaagtacactgtagtcagtcattttcatactagagatttgtttggacaattgggcaggtaggctgttagaaattttgttatgcttgcatttagttcttcagaatccatggtagtttactgctagaattgctgtcaaattgctgctaattcattgatactattttgaattcattcagttgtatattcatcattggaagagcaaaggtttgccaagaatatgaagttgctgttgtatgttgaaacgtatagttgcactatttgttcttgagctgctttggttaaattaagatatggtttactaaagtacatgatatttattagaattagatcctgataatataatattgctgcaaattttgaattccatacatttgttcaccaacagtgccagatattaattcatctggaatggagaaagaataagaaaacatccacaatattgtatatatcaatcacatgagtttctaaagcaatactttgcaggaacaagggctgtattctgggatatgcgggactcgttacttttctccttgtaccgtgctagtgttgaaagtgcacgtatggagatgtttatccctactattgatcaagtaggaaaccatacttgagatacctggctacctacattttatccttaattttgagttttattaatggatgaactggaactatgttgtaggttcttgaccaggtatgtgatctgattgttgatgccctacgtgaccaagttgtgctgagagtatttcaagcatgcatggtatatatttttctatcaatgttccattgtggagtaaaagctttattcatttaaggtagagtaaaagcttatgaaatgtggatttaattaggaagggcttatttggatcctactggatggaggcccatcccgagcatttttggagacagatgtggacttgatgcatcaagatcttgctatgatcaaggtaagaatgagatttgagagtgcattgtaattattatcgagtgaagaaagagcaaaagtctctttatgtatccagcatattttatatttttcaacatgttgatatctcggcgaaccttaacactgtaacaagatttatttgccttgactgtgattttcttctaggatctctttatagctgaaggccaaggtttaccattggatttagttgaaaaggaggctagactaactcatcaaatactagacctatttgtgttaaaggtatgctattcctttctcttttgttttgcagaaagaaaagttctgcagtagccaactaaatgaaaatgattttcaggctgatacaatcattgacatgttaataaatgtaagtgatcaattgcctcaccatcttgaacttacaactactcgaagaagacatgtacatgatgcccatacccttcttcgagttctgtgccataagaaggataaaactgcctctacgtttttgaaaattcaataccatcttccaaggtcttcaggtcagaagaatattaattctttctaatctagagtttagattatctgtaattttgttagaaataattttaatggcaggccattgaatttgtccagttggtagcttggggaaaataatttttggaaattggctatattagttcgggaatggcagtttgatattcatgcactgccttagcaatactatatggtggtgccaaatgggtgtagggatgaaagtgagcaaacatgtagttcagggtgtgatttggccaatttcagctagagaatggaaattgagccaggatttcttagtgttgtaaccccatttcatgtgtatttaagcacatactaagtatgctgctcttgccccttatggtaaaagaagatgaagaagcctattttgctctagcgattatgtgtttctactcatatgcactttaacagcggtgcttagcatttcctccaaattaagtgctttccagttctatcagttttgattagggaatgactgctattgctccatttgtgcagattatgacgatatttctacaaagaacgcaccatcaaaagcacctatgttttctgacatgctgaaaagtacttctttcaattggtcagaaacaggacagcagagttttagggttatgaagaagaaactgcaagatacctggcagtaaaatatgtcttggagataatcggcttggtttgcacataacttttccatatatgtgcagcaggtacgtcataaaaataaatttcaaatcccataacacctgggtatatgcaaaagaaaaaatgtcagcactgtatgcaaaaaaaaaaaaaaaaaaaaaaaaaaaaaaaaaaaaaaaaaaaaaaccttcacctcctgtgctttcaatcctgcctaacatttgcactctcggattatttttcacgattgttacatctttcatgtttattgcacttgtaaaaacactgtgcaattcagctacatatccaggatggttcttacttctcaaaaggttggtattgagagcaacaaacacacatttctcctgatgcctctgagggcccacagcctttgggaatcgtctggccctgatagaaatgaagcaaaccaatacccaaatttagcagtaaaaggtgtagtaataatattatatggtacaatggacttgctctatgcatgatgacctccgtatattaaacagatattacctcacataatgtcatttgacattttgcaacagatgacgaatgcaaaaggaagttctaattgcctattttgatgagttggaacttggcagaactggacttattatacctgggactatccacctcctgggagctcaatatattccctgtcatcaaggaaatgaagcatcaaagtaagctactattacactagtacctctaaatgtatttccgttgctgctactatgtgccgaagtaatgaggatgcgattaaatcagttgtttttctcgaacacgagattaaatcagttctccgttctatcttgcaaggagcaaggtcttctgagccctagaactaaatcaccatgagggcagcaaccgcagcatgcatctgggaagtgttgctgatagttggaggtcagagttctcatttctgactggagcttccccagcgtgatagcattcattgcagaccaatgtagaagatttttctggcgactacaggaacggtgtcgtgcctcaacactgccagatcgtcggagaaaatctgcatgtgaactctctggcctagagcggcagcaggatcaagaggggaaaagaattgcttgtttactgtcattgcacgagtttgcgttcatagacgccgttgccttctgttctatgcctgcggcacattacgagaagcgacagcaataatcgttcgcgggaaagaagctgggagaaaaatgccactgatgtctcctcataacctgctactgtagtttttgacgtattgtatctgaaattctgaaattctgaatgccgtagtcaaactgctgcatgagaaattagatgtatgttttctgcacccagcgacttcatcatctaggaattccagtcgcaggtacataatctggtcctccaaggctccaacaatattatgctctttatgcacaagttagtattaccctctttatgcccaagttagtattgccgcttttattcaagagaaattatcaagttattatttcatttctgagagctacaacaaaccacttaaaaggttagcatgagacatgtcctaatttacatcatcatgacaaccaaggctacaatgttcctactactcccgaaagtatagtttagtaccctgtaaagtggctgcagtttgcttggtactggtacgaactacaattcaatttggctcatgtgccatccaattttctcagttttacgccgcatataaaatcaacagcaagtcaacaaccgttacgagaccgagctcttgcggtcacgggaggccccgcccggcctcgccgcggccgccgcccgcacggacagcgcgagcacgtccagatccgacagctccgtcgtcctcctgaccttcccctccctcacggggacccgccgcgccgcgtgcctctctctctcctcgtcgtcttcctccacctcatcgtcttcgccgtcctcgtcagccccttcctcctcctcctcctcctcgtcttccccgttctcctcgcgcgatcttttgccgccgatcgccacgccgaacagcatcggcttcacgtcgccctcccccgcttcctcctccccgccgccgtggtcgtggtcgtaccgcgacacgaggcgccgcacgccgtcgcagacccgccgcgcgcgtgccagctcccgcgccagcctcgcgttctctcgccgcagccgggcgttctcctcctccagctcggccaccgcgccgctcacccccgccgcgatccccgccgccccgcgcggcggcgacgacgacaccgcgggctccccgccggagctcgtcggcggggacgagatcggtatcgccgtcggtatgccccccgccggcgccgcccccgcgcctccggtcccagaccccttccgcctctgtatcccaccgagcaggtgcttctcccctctcctgaagcagtcgttggcgaactcccacctatccgccaccaccttcttgaatccctgcaccaacacacgcaaatctgtcggaaaactcgtcgatctaccgaaaccaaactgagattagagagggggagagagagtgttcagcggagggagacgcacgtaggtgttgagctggcgcacgaaggaggagaagttgctgtgcttgaagtgcttggggaggaggtcgcgggcgaactcggcggggcgccacaccacgaaggccgtgccggagtcgttccacgagatggtctcatcggtgctcgggtcctccaccatcgcgtacgtcttcgtcaagaacggcggcgtccccgccgccggcgacgccatgaagaacctgtgggccgggagtagcgctcacacgagaccggggaggagacggagaagaagatccagagagcgcaatttgcttccagagaatggaaagcgcgtctagaatgggggatttgggaacggggataggttagggatagggcgagaagcatccagcggattctagaaggttcccggcctttctgagccgacacgtggtaacgtttctagaaaatattgagtgggcttcggatcttagaggtttgaggacaagaccagcccagaactaagctttacacttattttccaccagattttccttgcgtatttctcagatttctagatgggaaaaccatgatcattttgcaattcaatatttcgattacatataagttgggaaattccttttcagaggaacttgacgatgggaaaaaacatgactactctctccgttacaaagtcaaaccgcttaagtttaaacaagtttgtagaaaaaagtattgttataaaaatatatgtaattattgatttgataaaactaatttaataatataaatattactatatttatctataaacttagtcaaaacgttttataacagggtgtacattgtaattcaacattccgatcacatataagttggaagttcttttaattagaggaatcacacattaggttggatgtacttgcaatttgacgaaaaagcattatcaggcaactgcaa

SEQ ID NO: 62621 - DNA, 593 bp, Oryza sativa
tttgtcttcctaattagcaaagattactgctatgatggctgtcaccaaaaccctaaataatcaacaaaattcgaccacagcttccacactcgaaatcatcaaataaatagaccacagctagcataactaccacccatctgcaatcaaccaaaaaaaagctcaaattttgggtccattgtacataccgtacaccggcggcggctctcctgttagccggaacaacatgcctcctcgccggcttcaacacctccgggaggccagtgtctctgcaccctccccgcaacctctcaatccctatctcaccagtgatcacagcccgcaatttctccggcgatcgcctctgcttcgctgtccaggggagaagagagtagagaagagagggctaaggtttggagaattcgagggaactgaggggcttagatttaaaaagtgcacggtgcggggcggtgcggtgtggcatcacacgtgtcgcaacacgttgctgtccacgtatgcacgaaacgggtcaaagcgttctctagaccggattgatacaataaaacaagattagtgaccttgaccccgtgtttgtaagttcatggacctggatgaaa

SEQ ID NO: 62622 - DNA, 38820 bp, Oryza sativa
gaggcgaggaggaggtcccccggggaggccggcggcgcagtgacgtccccgacgcagtgcgcggggaggccgaggtgcgcgaggcgcatgcagagggcgcgcatcatgaggccctcccgcccgacgccgtgcacgaacacgcggcccccgcgcgcggccgccgcggcgagctcggcgacgaggacggggcgcgcggcggggtccccggagaagacggccgcgatctgggcgcagatggcggctgcgtcgccgccgccgctcatcgtggacttctgttatcttatcccaaagctgatgacgagcctccgtttgagtgggagtgtggtacagcttatggtcagcaagatcgtctgataatggatagcggagtgctgggaaacctgcgtccgcaaattggattttttttttacttttacattttttattaaaatatttaaaaactttaacaacttaacaaaattcaaaacattttaaacgacattggatgaagataaactttatataaaagttgtagatcccatcgagatctataaagtcaactttatagtttattactcttccatataaaatcatttagagcatcaaataagcattattagtttttttttagaaattgaaaccaacgaaaagggtctgaacataaataaaaattttacatttagatcccttaacgtctttagaaaaggcgatttttaaaaaacatccttccagaagacgtgaggcgtctatatttgtattccctccatcccaaaatataataacttttagccctcaagatttgtcccaaaatataacaacttctctatcaacattctcttcccaaccaatcaaaactctccaccgttcatttttttccacctaactccactacttaaccaatcagaatcttccaccattcatttctacctactttcttaataattatgtctaactctaaaaatgattataatatgggacggagggagtagtttgtaaatattttttaataaataaaaaatatcccgtaaattggatggtgcgtgcggcctggtcgactgcgctacagtttagcccacattggttgggccggaatggaagtacgtgcgagtgctgcgagccatattatttgggccggaactgtacgcgttgttgcatctttgcaaagtcgtgttcggtgacgttggcaaaaacccacaattcacaggagaactgctgcttcacagaaaggtactgtaacaattatgcaacatagcaccggtgcacgcatataaacgcatatacgaggccctctctgtcgaaccttgtctgatcatcgcatagcaacagatagacacacgattcgaacgcccacacgttctaggctgtctactatgctaccaccatgtatgcctgcaggttctcgtggaaacctcgtaaccgtcctgtgcggctactgttctcaacagtagatcagcacgcagcgaaacatgggggggagatctgtattctgacacgcccaacgaagcagcccgccccccgcatcatgcccgtacgtacgtgcactgcagccaccacttactgtaatactgtgtgtcacagtgtcaaccatgcatggcccccatatgcccgcgaggccgcgacgcgcgcgctcatcctcctctactttcatcgtacgcgaatacgcgatccacccccgcatgcatcgtccccacaccgagcgcgcggagccagccgccgagccgagctgtcccgcatgcagcgtcgcgtcgcgcggccggcaccgccgcgcgcgcgcgcgcatggtcccatgcccatgcatgggcgacgcagcgcagaaacgcggggggagcccagatcggaggaccatcggcgagccccggccgcagatccaatgccaacgcctaataactggatctaatctagtaccccgcggctgtcccccgtcgctgctacagcatatgaccaactcgctcatacgcccttctcctttcctcaacctcatcatcatcatcatcatcatcatctcgtcgtcattatctctctctcaagggaaaaataagcatatgcagtaatattatgatacggaatgcagagcataggagaccatatcttccagaggatctaattaaaccgggtgtagtataattttagtatttagtagagatcgtgtttgacggaggggatcttgtggagggattaaactaactaaccaaagttggaagcttgcaatgaatctaggagggatcttgggctagggtcgtggtctccgctgtcgacgccaagatgtactgcaagcaacaaaaggaaaagcacgagggtgcagggattaagatggagcaatcaagcaaagcgagcgcagctgcatttggctaatgcattggcagctgcaacgataacgataacgattattataactgctaactgcacgggctactaattgcacatggaatcgagcgtctgctacttagtatatgcaagataatgagatcatggagtgcgtaaagaccaattagcaacaagagtgatgagggtcataatgaacagctcgtgatcctcctacgatcggccgttgttgctgcaacttgaacgcaaaaccgctccaattattcaaggcgctaacacaatcattaggccgtggtcagaagggacagccttgcacccacgcaggcaccaccaccatgcctcctccgtgtgctcattcatgcccaattggtaattgtccaatcctgttctcctgtctgcaaatctaccgcctggtcatttttttctgaatttttgacagagccatgcctgcctgtctaagatttgccgttctgacaagatgctggattttactggagcagcgaaaagacggcggcagcaggagtgtgtgcgactgcaaacgaatcagctacagtagttggtcagtctcatgctgttctttgaatcccaacattacctgaaaaaacgtacacttgttactgcttctgttgtgttgttggtcaaggatgctggcttcaagctagctagactctgttgttgaccaccgccccttggtcagttaattctgaacttccaatcataggactaatggagaaacttgttcgcgacagcagaaatgcttgctaactcagcgactaatctgacctggaattcatctagaagcagtgtaatagcacgtgaagagttattgaacatgttatacggtcaagatgcttgttcttgcttggtccaagctccacatcttgattccgatttcccaatatgctattgtttcctagcattgtgctcctgatattaagctagactataaacgtgatgatcctgtactttagtaaaggattttgcagtgatgcattgcaccattgtttcctattctgtcacaagttactcatcacctgaagtcaaacaatgcactgtaagtaatgagctcatcaagcaaaaacatgatcttcagtaaacaatgacattgcatatcacctttgctttcttttcttcctcctccctagcatacacactacaaggaaggagctcattgtgtttggggtccatcttaatttatccatgaagctgcattttgctcagtgagctgtctgcattttgcaacctccaagatcccatctcccacgcatgaacagaagatgcacccaatgccaaatcgaaaagagcaagatggtgtattatcctatcttgtaccagcatgtctcccactgctgctacagcacaagacagctctcatatgacgcatcctctgaggattccatggacagtgcgcagcggctagcatcacatttcagatccagagcacattgcactgaagatttgtgttaaaaagggataatgaagctagatcacagtacattatactagcattagggtctgttttttttagacctacactatgcactgcacatcactgtcttgtgccggttttgaatgaatggcttcttgtcatttgtaaactgaatttcttgttgctaaaaaatcactgaagagagtttgatgtactagtactatttacagatcaccatgctgcaaaatgagctgttgctcagtgcaatgcaatatttcaaattgcttcaattatgcctgaacgagcgcaataatgcgagcgtggcagaatgttcaggttcggacagagtagtaaggctcaataattcgatggctgttgtaaattctcttctactgtttcgacagtgctgtagtaggagtgaaacctgctaacctccgaatctgcagccgtggccttttcggcttttccaacatgtttctgactcgcagcactgccgctgatctgagaaagtgtgtcaggtaagaaatgacacaagcagagagaggggaaagaaatcagcagtgacgaaacagctcacagcatgagagacagcgtgcttactttgaagctgatgaagctactaagcaatttgactgattgtttatcactagtcagctttaagctaagttaagcttctgttgaacacacttgttttataacgatggcctgatccaatgatgacaagaagtcaaaagccactagtacactataaaatactagtactaacagaaatgcttactatacaaaaccggacaacctgacagaagatgtatttctagatagtacagtatttgacatggtcagaatggtaggcttaatgtaaatagtctgcttaacgtaatcctaatatgacgacatgtaaaaactgcatttgcaaatctcgatatcgagtagaactgaagtataatccaggtgaaatgaacttacagatgactcatgagaactactactgaacctctaccaaacagagcttgcacgaaacagtgctatggatctgtcataatctaatcagtatcagaacacaggaaatagaaaaataactgcaattggcattagacttcaccttccatgatccatactgagtaacctaatgttttgacacacagggtctccccatcttggtcaatcactcaaaattctagaagcaatcatcgatccaagtgaggcatccgagtatacaaatgcttactattgctccaatgttctagtgagttgccgtgcagcaaaaaaaagtttcagtgagttgaatccgaagtagtcctgacgaatagcatcaaggccacatgtaccagaaccctttccagccctaaaatagccgggaattcgccttcctgacaaatcaagaaatgcacctacagaaactcccaaatttcaacagaaaaataggttcatattcagaaagtcctgacaaagagaagcctagaatggaatgcagaagtataatacttggaagcaaatcagaaagattgagaaaggatgtatcaacaaaatttaggcattctggaacagatcagcacccttctagagagagagaaaaatctgatgcacattcatcctagaatgctaagtccggactcaacagattcaggaccattagatttatgagatgcacagctaacatgggaaataaatcaaatgatcaaccacctcaggtcccattagaggaacaataatagctcttgagatgctccacaaggtccacagcaaacaacttgtgaccccaaacagaagcacaaattgcccacatctgaagttggacaaaatccagatcaggaagcagaagatgtgaaaaactggatgccaggttttaaacaaatgaatgattttttttttttgtatttgaatggaaaatatgtaactgcagttccgtcgacctcccagataacgaaaaatgggaggataatttacactcagatgagactaaaatttctatcatttcaatgagcaattgagtggggggagtaagaacaaatctgatctacactgaaagatttctacaaaaggtacaagctaccgggcctgccacgaacaaccactgatgtagagatctcaaaggaccactggtttgattatgtacaacgctggtccatgtacaattcagcaggagcaccaagcatgtgatgtcttgtaccaagtaaccacacgctgggccagcatagctgggtgcacgggtgcttttcttgaggccatgtgaggtgccaatgctgcgtttacttccatccaatgctcaaactattcactgatgcactggtaaaccgaaattctggaaatacctaatcctgccatcccatcctgcagtaactatcacttgaccccaggagtttgatgttccttggaaacagttccttaagagcttgaactgtgactcgtccaaatttacactggctgtggtagatggtagcatttcctctggccaagttgctgaacttttgcaagaggactcaatgaagaactcctggttcagattgaaaataccaggagcagcaggcgttgacacaatttttttaatggaagaatcctttccacagaggcttgaattgtatttgatagccttgctcattgaccagaaagtatctccttgtggtggtaaaatttgggacgacaacggaactgggcttcttggttttgtgccattccatggtattgcaatggctgcattgttggaccggaaatgctcagatgtctgtgtggtttttgcttgtttgcatgcacactcatactggttttcatggctccaaacataaacgttggagtcttcactggcagaaattatgtgctgcccttctggagtgaatgttgctgacaactggcaagaaccacttcggagtcctgatagattagcaaaaaaaaaaaaaattatccatccgaatacccaggaaatgactagatagagcagaaataataaacgagtatttgggtgtaccactataattctgaatcacattggtcccatcaagtattctgatcttcgaatcggcagatgtcaccattagtttacttgggttgcttgggcaaaactgcaatgggaatgaggaaaaaaagagtcggaaggatttctagtgaaaaaggactgatgaatttattgattacagcatgcctcttccttgcccaagatgttacctgaaagcctgtgattcttttgagagatgatttcttctttccattgagagcaatttgtgtttctagcttcagcagattgtctgatccaatgcaaaacagatgaaataagcataagtataaacacgtattctgcctatcaaaaatatattttaaagctaataatcatttggcaatttagtgtttagtactaaccagatatttcatagaagcgacaatttccagtaatagtaccaaccaccactccctgcaagatattcgaaaagaaaggacatcagtatcacaaattactgacgcagcaagttagtcaaaacagctaagatggccgctgataatcatacctttccaccaggccggtaacaaactgctgttactatgtctctaatatccacccagtccacaacactgcttctagtaatgtcccaaacacgaattttgccatcaattgatccactaatgaagagattctcgtcagctagattaaattggacacaagtcactgtaaaacaagaaaaaaaagttagctcaaatttatagatgaaagtgaagacctttgaggcagctaagtaggatcacataaacctaccaaagttgctatgtggataaactctgatgcagtttgcatatccaatttcccacatgcgaacagttttgtctgttgatgctgacagtagatgctgtaaagtagcaaatattaattatcagaaccaaaaagtacagcataaggaaaaacgcaaaggaacaattccaatacatggacaaaagagcatttcattaactaaccttatcgctcgaccatgacaaatcaagcacatcaccagagtgcccacggaactcatgcactggttcctctgagatctggaaaaccatcgttggaaccacaatacaagcagaatcggattttttcaggccattgatcttcgatttcttctcgctctcggcattcacaggagcaagcccatacttgcgccgcgcttttaggtagacgcaagaaggatcatccagtggaattttgcagtcctcggactgcatgacagcccaaaccctgacaactccatcttctccaccggttgcaagaagctgcccatcaggactaaacttcatcgtcaggatggcaccatcatgtgctttgatcacttgcccctgatacacggcggacaattccttcgaccgcttccggtacgagtgaaccttgattctttcatacctcccagccccaatttgctcactatctgaagaactggtgctggcttcatctgctgctccactatccacaacacaagcactgacgcccagcctccggagccacccatttctcctcctgtcgatcgtcttcggagcaccagaaggcttgccattgcggctcatgagcctctggatgaacgacagcgagctgaagctcctgctcgccttgccggatccactcacggagttgtcatccgacgcgccgtcgtcgtagctcgtcgtctcctccgtcgaccagctcgacatggagcactcgttctcgtccgactgcgacgaccacctcccgatctccgcctccgccgccacctcaccctcctcctccacatcgcccacgacgtccgcgaaatccgcctggcggaggctcgggctgcgctccaggcccatgcttcgcatgaaccgctccctccgctgccgcacgctgtcgagcccacccgaccacggcaatgccgccgccggcgacggcggcagcagctcctcccgcgtgtcaaagaacgcctcttcctccacctccatcctgctactgctactactactactacacctcgctaccaattggcacccctccatggatcgttgtggcgagcacggccgctgcaagaagaagaagaagagagaagcggcaagagggaaacacatctcagagccatgtccggggagtcgtttgcttatatatataacagtaagctaacaagaggagggcgatgaattgcatcagcggcaactgggtgacgacgagaaagaaagcgcggacgcggggggagcacgggagagggaaactaaactagcagggattgattgatcgattgattaaacaagaggaaattagcaccaaatccccaactattcaattcccccccgaatctctcaaatcccgcacctcgcatggcccaatcgccccgagcaatgcatctggccatggcgatccgaccaaccgcgcgcccattattaaagcggggagacaacagcagagccaagaaacgttgccaaaacgaaaaaaaaaaattaggaataaaaattttggcccgagaagaggaagcgctgaattcaccagatcatatctcggaaggatttggcaacgttgcggataaacaataaagaagaaggagatatctttttttcctcggcaaggggaaactcacctgggcgagatggaattcgcgcgcgcgcacgctcgctctggaatccaagaaaaggcttcggttttcgccccctcagggatgctgccgccgggagccccgcgcgtgttcttggctggtggtcgcggcgcgcaagaacagccgcggcagcatcatcgcgcgaacggggagcagctctattattaaagaagggattggattcgtcgagttggctagaaatcaaagagaaagctggaagaaaaaaatggagatgggagcgatttattaggacgtcgtggagagacggccttggggggggggggtcctcgtcaccatcaccatcgccagatttggaagcggcaagataattagaattttaattctggtaattcacttctgctaaaaaaattataccagaaaaaatactagtactggtagtggggaataaagaacaagtagtaaagaagaagaacaattatgtactgcctgcacaattaccacctccttttgcctaattgctgcatcaaaattgcatctttttagttcttgatgctgcaaaattttgcttgtcacttctgattaattattccacagtccctctcactccagacgattctgccactggtccagtgctgctgctcatgcgtgcctgcccagctgccctttttttttctcatttttcctatatttttttctctctttcatgttagtggagtactactagtagtataattttctaccacctctctttctttctttttcttcgttttggttgtcccccaataggtgaactgtgcagtgcctgcatgagcaataaatctcccagctctaggtccctagtctatagatcccctaggcctactgcaaacgggagcgtcgctgatgcatcactccgatttgctcgtgtaattaacccgcctcatattgcatccggctgcgcttctccggatcttttccttgctctgctccggtgagaacttgatgctgcagtacagtggttgcatacttgcatcgtcgcatgtaaggaggagtacttgttaccactggaatggtgccagtaaatggtaacaaggagtacttgtttggcatttggcaaaatcaattcgcaaccaaacagtgacgcaacgcaacggccggagaccggagcagtgcttgcatcgcatggaacgagcaaaaaatcctccaaatattcgttgtcacagacagagaatgcgcagtgcagtgccggtggaaaattttacgtcccttgttttgaaggcaacctctgcaattacttactgttcactaatgatgtactgtcctggatggatgtgttcagagtggctacagcttgatgcacctaacacgtactagtgaacagtacactactcttggtcccctggcatgatccaacagtgtaatttcctttacctagtcacagaaaaaaaagcacacgcaaattaaattcgggtcttttaatttggccgttccttttcacttggtctaggtcaagcggtcagctaagggctgcttgttctgaatctgggttgagaagagatcaacttccgtgaacagatcaaaaagactctccacctaatgactttacagcggatgacaaatcataaatgctactccaaggaattgatgcatgcatgaactaaaccaacccaagtgacctgaagattttcgccttacaagagggtcaatgcgttaagcactcgagcagaagagaagtgacgatgacagaaagcactaatcagtcttgtttaagcaagacacagctgatggagatagagatgatgagtagatttgtagacgtatccatctctagctaaccccaacaaccccaattgttacatggatgatttgtggttgggcaaaagccaagatgacaacggacaactcgacgacggcaacaaccggaggtgtacacgtatgcgtctcctgctttattttggacgacgtatgtatgtacgtgtctggctatctagctaagctgtgtgtaaattcaggtgcactgatcattatattagacgaaagcacaagtggatcattagtcgattccactgaaacaaacattcaaactaagggagtactaatggctaactaggctttgcattattggtggtgctagcttggaggcctataagtatgtagagagatttgttttttcatgttccccgagatgaagcaaacatggcgtctttaaacaattcagctggcgacgtcccagcaggctatacttaatcatatataaactgagctaaattcgagttaaatactcttctccggggcatctgccactagcacttggctagcaatggtccaattttagtacgacatatagaatatgcaagttcagtctcactgtgataaaggaagaagatatgatacctacaacaatcccgcaacttcttcaaattcacacaaaaaaatgttttacaaattaggtatgatctcactaaatgcaacagtgtctagtttgtccgagtttgccggtcatgcatccccctcaaaagatatatatggccctttaaaggaggcaaacagtagtagtattcagacaattatatgataattattgcatagattattataaaatgatcactacaggcctaaacaatccaaagtttttttggataacctaatattgttcctgttatattctggaatccgttgtgccattagtatatcagggcatgatcagtgatggcatccggacttaatgtataatacgtgttccttacattagtatttatattttcttggcacttagtggcactatccttttaaattactttattggttgatgtggataattccttgatgtgtcaaccccgaggtagtaacatattatcactagcaccagtctatattgtcctactattgttgacagtgtcacaagaggaaaatttttctcaatgttgatattttgtcctcttgcagccggtgaccacccaactgaatgggcagacatataggaagaggtgtcatcaaatcaatcactcaacagcagggtcagcatgcagcagagaaacatatcgttccaaattaaccactggtttgcttcagattttagatacgagaggattgggttggactgcacctgatagcgttcggtcgagcgatcactaccgtttgaaaagaattgggtgaaaagctaacatggaaacatcaacatgcacaaaacaagatggagaaatcagtgggaatcagcttggatgtaacggttgattccactgttaaagttggcgctcggtgtatgtaattatatgtatgcatatatgcaaacagtgtgcagtttggcatctcaacatcacaagttttacctgttgctaatttattgtcatgccttcgtacaaaggtcacccgaatgttattagcatccaatttgactgttttatataaaaacaaaatgccacacagaaagtgtcaccggatacttacccatcaccgctccaaacatccaatggttgattgctaaacttctctttctttcagtggacgagtgatccatacatacagaaactgttcattgaaaccggtaaaaaaaccaactttatcataggaaataaaacgaagctagtagatgatgtgatggatggatgatggatctaccgctgtacataggactcgcaagatttggcaggaactttctaaagtgattgcacacaatgattgtcctcacatgtcaacttgcagggcacataaaagaaagtcatgggctacctagctcatgagctcatagccgacaccgcggagcaacggagggggggtgcaaagtgaaaagaaattccttcgtacacgcgctgttcatcacggcgatcgtcggtaaccacacgcacaaaatgacgcccgatcgatcgatcgatgcatgcatgtgttgtgctgcgatgcgatgcgagcaaatgagcaagattgatcgatcgatctgtgtgactttaaaggctaaaatcgtactgcctgctctgctctgctaccgatctatccaacgcaattgtcgcgtgaattaaggggaaaaggatcataggatgcctgctgtaaagagcccgtagatgccgtgctcaataggggaaaaagattatactactacacatcaaaggcatgtaccgatggaattctcgggtgtgattgctcgtacgttttcagaattgatcacccggtgtgccgtattcatagcggatggggtgatggtacatgcatgtgtagcgtattcttatgcacgatttcagctctgcagttgacttggttcgctagctagctagttggctggtcgatccgtagacgagaatgccgccgaattgaattgaattgaatcccaagagcaacgaatggggatcggaaagatgttgcacttgcacacaggttggcacacacgacaacgacggcccgcccgggctagtaatactgatgtggtcatctttgccgtgtcgccgccgaccaaattttcagagtcagcgcaagcgtaattagaccctgtggctttctacctgttattttccgtgagtcccagagcccatcgagtgctctcaattgagggatgtacgtactaccagcggcctagctagctagagatagtcgtgtcatctgactaggaagtttataccgtgtcggcgtaaaaaaccaaagtaatttcgggaggctctgtgctgaccacgtcgcctgcgcaggcgcgcggaaacgtgtcggttccaaagcatcgcaaaagcgatactagaacacacgtctccaggcagcccatgccgtgccgcgccgcgccgcgccccccgtcgcgatctcccaagcctcaagcgtttcgccggggcggccggcctagtacgcgacaagcggacaccgcgcggcgcggcgctgcggttggggggtggaaacccaacctggcgtggcgaccgctgcgtacgtgctatccggccaaaatagtcagcggcttaactggctgggtgaaacagagttaataaaaaaaagaagaaggggcacgcgctgcacagtagacagcacaggagtaaacggttttgtactgtgcggtgggggtgggggcggcggcggctgccttgccgtgtggtgggtttgcagttgcaggctttgcttgcagctttgtggtgtgccttgcctggcttggctttgcacactggcctcggtaccggagccacaagcctggggctaccggcaggcgatggggcgccatgctgccgcgcatcatgttgttccgttgcaaagcgaccggttttacaagcacagtacagtactcctcctactcgttccgatgcgcagtaggttttggattatcgaagcctgcagtaacacccagcgtcagatccgggattaacatgggcatttcattgtcatgctcttaatcctacatcaagagaaaggggtcatgactcaagaagagctggcctcatttcttcctacattttgacttcgcaagtgatcaagcaccagtctgactttgcagtatataatactataatagaagcaaagcattaataaactgaggtgctaattaaatacggtcataataaaataggctagtgggaacctggaaaatatatgatcacattgcatcccatgtataaataaacaactcctcaggccggccctcacacacatactccgtattaagcaagcctaatgtagaaatattctgtgctttgcgtccctagttgctccacgtactgcaagccatcccatcctcattaatttacaagacaaggagagagtgaagaggaagagatgcatgcacactgtacccatatataactgcatatgggttcggcactgtcgaccctcctgacagcaaatcccatgaactctcgatcaggagcttaattactgaaccacaatatatacgcgcatagatcgtaatgctgaattaaactaacccggtttagattgagtcctaggaactgcatcgccggctccgaggttgcatgcgatgtacctcgttatcgcagcacacgctacgtgcgctgcactgtacagagcacacagcatatgcgatcgagcagctgacttgcacgtatgctgtgcgcaatttgctaagctatagataaaattgcatgtatcccagttgtcaaaccgcatgctaacattcgcaagtgtcatcgtgtcagtgacgtgtaggtatctggccatcctattaagaaaagagatctactaactgatcgagttaacaaatagcaacatttaaccgcaccttcctgaatcccgatctgatcactctgtaaactgtcatgatcgagttgctattccagcatagaacacgcgggtatgcgaaaacagagccaggattagcttatgtccagatcacatcacgccgaacttttcatgccaatacggcggtctgacagaggaagcatgggcggacagaaacgagaaatccagccgatcgaatcgaatcgtagtccctgctcatgtagggggcctaacaaactcacacgtcgcatcacggtaagttaattaatccgagccaagaacccgacaaacgggacaccgccaaacggtagcagcctcgatcccggcgcgcagtttcctcccgaacactttgtcggtgcccaagtcgtcgacggattatttctcaaggaaagcgagcacgacacgtacgtgcacgcgcttcggctgcactcaattaggagtagtataactgtgttgtcgtagtaaccatccaacaaatttaatctagagccagagtagcatagtattagcgcacgaagctgcctggcacccaggcatgggcgtaaacaactcgcgtactctacagtctactgcaccacgcacgccgcaaggtgacaggtgacagagcgaaacgcatacaaaaacgccgcggataaaagtgtgtgaaggacagtgagtgagagatgaagacacatgcatgggcatgcaccgtacctacgctagtaatagtggtggtagtatactgcacagtaggtgtgtcgttttgcagtataaaaattgtccccatacgcactacgtggcgggacgcgcgcacgtacggactcggcgagctcatgcaagcggttagatagaaactatagctacgagtgtagagtatgtatgtacgctccaaacatgtgccttttttttacttcttttgttttaaaataaacaaacttaatattaacaaatatataaaatagagcatgtctaataataaatttgtttattttgagatggaagaagtagatgatgagagcgcagactcagcagcgagcgatttctctcatcccatctcagtttttggatgcatttatccgcatgcattgatgcgatatatcgtcgatttgggcagcaagaccggatcgaccgtaccaaccgcgccggtagcggcaagtaggtcgtcgtcgtctcgtcggcatcctgcctgtacttgtcatctggcatctgccattgtcaaaatgttgtatgttcatccgttgtccaagcaccaagcgccatgggatcggagagtagctagtataccccacgtagtagcaagttggttccagctagctagctggctggctgcatgtatatagtcctatattatatagcgatataaacaaggtgcgtgcatgcacgcaccgatggatgcataaatacagtatgctggtgtagctgagcttcagatatggtcatgacataaaagacccagacgtgtgtgccggccgccgccgagctaattaagttcagtggagcgtccacgtccatgcccctggcgcgtaagtacgtaccaccagatagagagggacggccggccacggtgtgaggagttaattgggaatcatttggttggttgtttcatgctttgctttggtagtactccctcagtaccatatcaaatttagatggaggctacagaacgatctaccgttccaataaaatagataacatagatatcaaattgatatcatgacatcagctgttccattgaaatgattaactgttctatagtatttctgttaaatttatttttggcttatctcatttatctaaaataagtcttttttaaaataatcagtgcattggaatttgtgaaaatagaaaatagtgattgcactagaagtagataaaataaaaaatagttgcattgagattagataaagtagggtattctagtcttttgatgtttctttagtatgtgtggcagtgagggatcgatgaaaaataaacttattttgtgacagaggtagtagctacgtaatacctttgagatggagatgacaccagcttactgaaaaaacaaccgattatgacagttaatattgtcacgcattgtcaaatacagagatcaattaaaaaaccacttaaaagaagataagctatactgatagctcaagtaggcatgcagttgagagacaccacagtgtcccaacacccaactgggcctgatttgccctggttgtatttgattgttttctcgtgcgcgggccaggcacaaaaaaaccaccgtacgacggtacaagcaagacgaaggtcggccatcacctttgatgatgatcgatacatatgggccacacccaaaagaggacaccgcacgtcaatctcgaagctacgcgccagcagaccggcaatcatatggcatcgatcagtaccgatcgattgatcgtccatcgtccagggccatggatgcgtatatccatcctaccctatatatggagttttggccctgcccttaactcggtagagaacaaatcgccgttacatgccaacagtgtcgaacagttcaggcactgtgcatgtggtgtcgcatgtagacatgcatcgtgtagtagttgtactcgtaaaaaaaaattctagcaaaatatatacttctttcgtcctaggataagtcatattaatttcatactaagtttgtttagtactccattttggaaagaagggatcaagggcgtatgtgctgggataacggtgatgaactaattttggtggttttgtcagcctctgcctccattactttggggtacagtggcgcgtacatatccttcaggctacatagttaacgcctatctgatcaacttaactgctactatagcttactcctatctaatcaacacctataaacaaatgcatgcacgtggcaactgcgcccctgcatgcgggcccaatactagttcagaacttgtctagggcttttggcctgttcgttggatgcaagctcgccagtgacatgtatctatcttgttcgatcgatgcctcgatgatcaatagttccacgatcatgatcttttcgcctttcaagtaaggatccaatgagaaagaacaatcacgtatggatagttttatgggcttctcggatggttattttcgctaagtaggccgtactataggactccatgggctgaaagttgcatctttcaattcggtctagacaaaaagaactccatcctgcagatggcggaataagtccacttgccgatcctcaactttaggtcgagtctgtatgacatccctaatccccaataccagaaatgtctactcctaaattgttcaaaaccgtgtcaagtagatcccatagcagtatgcatggatggtttcgctgacgtgacatcctagtcacaacaagagaataaaaaatatgtgggctccacatgtaagtgacccaaccacatgatattttcgtagccaatccaaatgggcaagctcttctgcgacgactctgccaccaccatcaccaaggctctccgccgctcccatgcccctgcgcgcccgttcctcacttggcccaccctgacctcgtgctgggccgctgtcatcacgctcgaggaccaacaacgtcgccccatccaccggatctgggagcatggaatcgcctggaaacccccctcccaactcttgctcccaccccctcgtcttccgccttgaccacactgaggaggtcgacgctgatgacaattgcctcttcaccgctgccaacaagcccggtgagcgtgacctcaggcacaacatcgcccgcctcttcgctgatgtctatgccgcccaaatcacacgccaaaaccagcagccacctccccaacacactcatttggtcggtgcaagaacaatggcgacggtgacgaaaaggtgctagagctctaccccaactgtgcccgtggcgagggccggccaatgcccgtgaccttgcactgccgggattctacatcgatttgtactgatggtgtcggcctcgccaccgtcgtcggccagacatcagacttgataagaaaagagaagaaagaagaggctaacatgtgggccctttttttctgtgtgttgactaggatgcccttttttctccctatagattctaaattgcatggttttgtatagtttaggggtgaagatttctgatattggagataagggatggtaaacaaactcgacataaagttgaggactgacaagtaaacttattccgcagatggccgagctcgtcttgccaatgtgtgggccgaacttggcctcacgtagctaaccatgaaggaataagtctattttatctttcttatcttttcacttcggatcgaatcgtctctctcaagtctcaactataaaactagatgtaacatctccaacaaaatttgattgtgaatagtgtataccatttacactaaaatttattattttcgtttcttgtacaagttgaatttatcttttttttttatgatttcttagatgacatccacctccgaacctacggactttaactaacgaggggatatcgtgaatagtgtataatgattattttccatggttcagtgtttttttttttacaatttgattgtgaatagtgtataccatttattatgtgttgatgacaaatgacatgacttcttggatgcttttttaataacaatgatcgctatactaactggtataatgaatatcgagttatctagtaactaatgagaaatagtaaatgcaaatacttaatatatattggatggttgtgatgaaacatggaaatgatccaatgactcctattttgtgggtgtgatgtaattctatgcatgttaagcttttagttccaattatataagatatatagacaggattcgatttgttacataagttcgggaaaagttgttttagaagatgatggcacgctatcctgtgtttctgtttacagaattcggatgggctttttagatgggcctacacttgtagtatcggttgggccgactttccttgcctttctgtgaggaaactcgcttctgctggcagctaggcaaagcttttgcctctaaccggtaaccggcacggaaactcgcccggcggccagcgcggagagccggagagccaaatcaggctcgtcttcgagggcaagcgggcaggcgttcagcgcaaccatgcatgcgcgtgcaggtggcctcgttagttcgggttgcgctaagggcaagttttatgtatatcatgtataaaatttagatatgtatgaaattagatatgatagtcatctctaccatataatccctaatatctctaacactatcacatgtttattgaagcttgtgtaggggctgccccttgcatgagaggtgactatttctttctcatccttcttctcttctccaccttactatttgggccctgtttggaatattagcccaaggctaattttgagagctaatgtttagtcatgaattggtaggctaaacattagcctagggtggtatgtttggatctatgggctaattcaaggctaaaaggtggagagagagtagaaagagaggagagagagagagagcttccccacacaaaattagccccattagcaccccttggagaggctaatgttttgaggggggctaattcactttagcctcaaattagcccacctgtttggatcattgagggctaattcagggctaaaaggtgggggctaataattagcccatggaaccaaacatggccttagtcttatgtggcatcttggggcttgtgcttggatgtccatagtacgtgccctaagagcaggtacaatagcatgctataagccagctataaatatattttaaagaggtaaaggaagatagataagagcagcgggttacagatctgtagccagctgcagcatggactccaaaacataatgtgtgtatgataggtggaaccagtattaataatatagtaatcaattattatatgaattggctattacattagctataaatgatttggagagtagtgggctatactattaaacttgctctaaggcaaccaaatgttgatggtagcgtctactagggctagtttagccacgatgggctggctaagcacgcttgctaccttaagcatgataattgaggatttgagggatccaaacttagttcatccaatctttcgttggtttctgaggaaaattgctagtcattgtacccaaatagtttcacaggagtaactacaaggtttttcgctagaattatattctttttgggaaagatggagtagttagtaacttgaagagttcttagcactgtagcatagctcctcgatgggggcatcacatccatacctactgaacggtaagtcggtagcccaatccaactactcggccggtcgctcgcccccacacgatccggcgatcggtgccccccccccccccccccggctcgcgctccagacgcggacgtgccctagtggagagcggcggggcggagccatcacgctgcggggccctgcgcgcactaagctagcgtcgcgcgcacctgggctctctggctgtgctggccgcgcgcgggctggaggcgcgtcgagactccagagcgaaagcgacccccacggtgccgcgcgccgcgcttgacttcttcccgtagccgcgcgccctctggcgaacgaagagtcagaagaagccactagtagtacagtagtactccgctggtttcgctctcgcgcgcggccgcgccgcagagcgtacggtgatgcgccatgcctccacttccaccgagagctagcggcgggaggaaggtggcgcggtgcgtggtgcgatggagacggtgcgtgcgggggtgccggccggtgcaccagcttttgtcccgtttgacactcgcgaagtcagccggttcattcgtggtctccagcgtacgagcaactgtacggtctccgttgctgcgtgctgctgcatgcatggggtgaccggctcgatcttgcacctgtaacaaatcggcgacagggggcaatggatttgttaggtggtttaccgtcaatccaaaaatcagcgattgaataccactactacttactactagtatgatagtatcgcactactagctgggagggaattaaccacaatatagagcagttggacggtttgtacgatgagacgatgatgtgttttcgtcaaagaagacattcttgcgagtcgggtcatatacgcggatcgtggtctgatttgacctcaccggcagctgcgcaatttcttactacctccgtctcaaaataagtgcagtcgggaatatccgtgcccaatgtttaaccgtccgtcttatttaaaaaaattatgaaaatttttaaaatatttagtcacacataaagtactattcatgttttatcatctaatagcaataaaaatactaatcataaaaaaatttcaaataagacgaacggttaaacgttgaacgtgaatagtgtaaaactacacttattttaggacggagggaataatttgttactcttacgtcgcttgttaggactaccgatcggtagatcaaaaacgggactggatgcggaagtggagatggtgaagatgtgaggtcaggacggtgacagttgaagacgcggtccgatccggtgttgaaatttggagcattctgtcgggcgatgactcgttggcttctagcgaccaaccgaatggtggagtgctgagattaattaaaacaaggaatatgttcttctctagattgcgaatccacggtgacttgaatggtaaacaaacaaaatacgcaccattagccactctcgtggacatttgattcgtcatatacttttacaattgacagttccattaatgaagtctgaatatagtgcgcacaatttctcctgtaaattcagaacgtttgcatcttactttttccaaggaaaaaaagaggaatatttctcctgcatcctctccatgtttggaacaactcctttttttttttaaaaaaaactctagttatattcatgaagtctgaatatagtgcgcacaattttcacttatcttctgtaaattcagaacgtttgcatcttactttttccaaggaaaaaaaaggagaggaatgtttgtcctgcatcttctccatgtttgagacagttccttcgaaaaaaactcccacatgctactcaagtacttaatttgaaaggaaaatactctaatagtgaatatgtttacagaaatggttggtgctgctttgatcttttctacccgttttcatcagatcatcagacttctcctaactaccgctaaaactgctgattgctgaaaagttggtttcagaaatgaggtcgctcaaagctatatagttgattgagccatcaccattttgtccttgttaaccagcttcggtgcccctctaccgctctggtcataagcccatcatcatactttcactaattaatcccctcacctttgcaaccgcacgcacgcatgtgagttcattcttgagcctgttcaataacttcaactactcgttcagattcagattaggctgattggtgcaactagacaccgagtcatgacctctactttctactgctactttccagtttccactaggaacattccgcatgtctaaaagcatagtttctctcttttgttttcgcagaggatgcaatccgacttatcgcgcaaatccacccaggcacggcaaataaggtctttttccaaacattctcctttcccaatgatcggacgtcattgtgccttgctgctgcttccctgttgttttgtgcggtaaacgcagcttcctgaactcaactgaaagctcctaatctcctatacgaaacagtggcgcttatgtatcttcagatcgaccaacttgcccttcggcgctcgaccatcacgtcggaccaaacgccgattttatagccgggaaatccattgtcatcttcccagttcgctcgtcctcccactactagcttgctccagaacatccaatattcctcctatcgccacaacccacgcaatctcccaaccagttagagacaagatcaaaagggaaagcaagacaaaacggtagggggagaggacgcatgccgcatgcgatcgaatgtcaaaaataaataaatattgtttaagagacgcttgtaaagatatgaggatggtggctgcgcctgcgcgatgcaagtgacaggataataaaattttggaggccgtcggattgaaagctgcagttggcctgcctggaaccgaaaggcgagggggaggcatggatcatggaattccatattccattcccgcggatcggacagagatgttggattcttgcgatgggagcatcgatccactgaggctcagagatcaggccagccatcgtcaggtgcagggtgctgtggagtggaagcgtgcagtccacgactaattgccgcgcggacttgacatcagatgggacccgtccccatgttgttcgtattacagtatactcttggtttgttcctggattgatttgtcgctgaagcttgtttttgacagtggtaaagcatagtgagatgaggaccaagcacagggcatccatgcattacttcagtactgacgggtacagcaaagtcgtctagtaaaagtcgttgcctagagcatctctaatagattggctattttcagctctccaaatgctcatttggccagttatctaaaaaattggagagttaaatttgccttttactccaactgtctctccattcacattctccaatttaacatcgggtcccacatatcagtctctcattcctcctccttcctctcctttcttctcccgttgatggcgcagaggacggcagcaatcgtggccagtgacggcgcggagggcagcggtcgcggctggcgacggcgcggaggaaggcagcggttgtggccggcgacggcacagagggctgcggtggcagccgacgatggcgtggagggctgcggtggcagccggcgatggcgcggaggagggcggcggtcgtggccggtgacggcgcggagggcggtggtcgcgcctggccggcccccatctgccgccatttgggctcatcgccgccatacaccgccgctcgggctctgtccccatccgccaccaccacctgccgccgccgccgccactcaggttcatcgccaccatccgggctcgttgccgccatcctctaccgctcgggctccgtccccatccgtagcagtcgtcgccggtggtagtgcgcagatggcgtgggagccggctcgagtaggtagtacgggtgagagaaaaagcatctctaacgtggggcccatgaatggctaggcaatttgggctagccaaatatggccattgaggggaggagtttggccggtcatttggctcagccattctagtagagaggttgttggagtgatattttttactaaaatggctaaattttaacttgaagagtctgttggagatactctaagtggaattgagaacatggcacgcttggatttgcatcaaacatgtgactgcaatataagggcctctttagttcccaaacataatttttcacgctgtcacatcgaatatttagatacatgaataaagtattaaatgtacaaaaaataacaattacacagttcgtcaggaaattacgagacaaatcttttaagcctaattacgccatgatttgacaatgtggtgctacagtaaatatttgctaatgatggattaattaggcttaataaattcatcacacagtttcctagcggaatttgtaatttgttttgttattaaactacgtttaatactttaaatgtatgtgtgtccgtatatccgatgtgacatgcaggggcaaagttttttttgacaactaaacaagccctaaggttttgttcggcatcaaggtttgagagctaattctttatgcacgtaacacggagcgacacattagcatatgattaattaaatattagctaaaaacttaaaaaatgattcatcggattttttaaagcatcgtccagttaggtgtttgcgttgaaatgtgtcccgtgtcggagcaatgccaagcacccacttacaacccatagcaattcacaaaaacgtgcatctataggaatgttgaaagttcccatttatcggatgttaaggtaaacaatactccttccatccaaaaatatagctacattttggaaccgatagagtagggggtatcgattctaactgaatgattagacagattatagacagaagaaatcacttctctcttataaacgagtacattacaatttcggtcaaggttttttaacaatagtttaattttggactacctctaatataatgttttcaattatacgagctatgtttacctagtttgcactttggaccacccactctcaaattctctcttctcctctagttctccattgtatcagcgctaccgccgatgacccctccacccgctgctcgatcctaccagcggccgtggttgcactcgatcctacccgctgctcgatcctaccattgtaattttgcatggagctaggtttttagaaagagaatttaatttgctatgtacgacttttgtctttgtttgatatataaatacgatttttttagataatgggttaaaccggactctacacccaaagaatatacacagcctaaatatataaatacgattaaatttgtatattaccagtgtcgatcaatctttatcgtggtaatatgaacttggcaagataaaatgtgcacgcatttcatttgtttgtttaacgtggtaacctttaagcctcgagcaaacgtagcggctcattttcaccttctctcaaaagaataaattagctggccagtatagacaaagataatgctaaattggacaataattagccagacaggcagacaacccaagtccaagctaggtacacacgctgatggttcctgttgtatcagtcatcacacaaactccaacctgtggagttagatgacatgcgattggactgtctactttgcacttgcccccctccccaattgacacctcccaactattggagttggagatgctcaagcataactatttcaaaacactgttatatccacgtacccatccgttcttaaaaaaaaatcaaactctagaataaattaatctaaacacattttagagtttgattttttctgagacggagggagtaaaacgttgatactcccaccagccagctcaccttcgtaccatattaagttcatttttaagtctcttatatttgtttcaaaataagtttatttttaagtaatcattgcattgtagtgaaagtatacaataattgtacaatgagtaaataaagtgaggaataattttttttaataatggaataaaactgctcaagatctacatccagttattacaaagttcacaaaaaacaaactcacacagtgagtatgtagctaaagtaacaaaatcaaaaataaaaccaaactaataaaaaccaagcaagataaaaaccccacaactactgaattctattggtgaatctccacccgaagttagcaaagagctgcatgatcgttgactcaagtttacgacaagcatattttattagcttgatatgagcatcatgcatttgtagttgagctcattccggagtcaatatgttgcattgaaaagaacctgcacattagattttgaaggtgatctatcaaaaaccatttcatttctactaagtcagagagcccaacatagaacggaagctccaacaagaataagtttcttgatctttttattaacacccacaagccaattcctaaagatatgagatatattaggattacattgggatttgataaaataggagtgttctattttttttgttttgtattggtaggtgtgggatgaatgaaaaatgaatttattttgatggtaggtagcagtaccatcttgaactgtacaatacaaaccgaatgaatccatggtaataaagttgatatgaatctctgtaaaaactcatgtgggcatcgcgtccggcctctcgtgcagcggttgttgcggagcagcgtatggacatggacatgagggaacccccagccatcagcagcgagtagcccactaaaccgcggcgcagcagctgcaacgcagttgatgggacgcaagaaagccgccctagtacaggctaccgtgccatgcagaaacgccttctctagagcgcgagaggaggagacagcgagagcgaggaagaggacaggtccattaatctgcaaagtggaaatcagggccctctgtgctctgttccttgtcacccggaatgcccctacaacctcctagctacacctactgtcccatgttcgtgatcattttagcatgttactttcatgacctttttttttcgaaaaccactttcatgattataaatttgaacacaagtacttagtattggtcactactcacagtgatcaaactgtcattgatcatgtgttcatacaggtcgtcctgatcaagtttgttgaagacttgcaatagaaaagaaacgcagctgcagacttgcagtacttgttggactttgagaggagtctgaaaatgggactggctaattaagctggacttcctaggtcagccaagtggtaagcgagcaccagcggctcagcgcaagtgtcattatcaattggaacacccctggggccatacggatttcagagcaattttcaacagatttagtaatgattgcttggcctaaccaattccatgcttaggcaagtgaggatggaaactgctacatttaatgacgaaaatgatagctctagctagcaggcagaggagagccggtcctaaatcctaatgaaaggcggtgagtaatcggctgcaactttattcctattctcttcatactttttaccaccttttgactaaacttacacaagtaggcacttaaggtatcgaggaagatgattactccgggaaaaaaaaggtggtatttatttttcctcttcttctgccttctaagaaaagtaccagcagcgtggaaaatagactagaaactcctgtacttgtttctgcaccaccacttcacattgttccattgtttggcttaaactgagaccccctctgaaaaaagagaggacaaaatcatatacggctttccagaaaaatgttctaccaacacccgttttccgctaccattaagggccacttgcatcgtcaattgttggactgatctagtcagctccaggcgaaaatccgcgacattcttttcccacgcgccgacgcgctagctgctgtccacatcgcatcgcatcgcatcgcaaaaacccctggaaatccgttccggcgtcgtgtgcgccagcaggaggaaaactccaagcgaggagcgcggccgcacgcgcgtgcgcgagagagaacaaatccgtcggatttcacctttgcgaaagcgaacaaaaagaggaaggaagcagcccggggagaatgggacagaagaagagcgcgcggaagcgagcgagcatggaaacctcgtttcccttttcctgcttgggcagcagaataattaacgtagctgggaaaccattttttttcaccctttctggtcatcgctcgcgcgctgccgctgcgaacacagttggtgattgagtgggggcacgcgacggcgacggcgatcaagcgagaagagagaaccaggacacaccatcatgctgccgagcgtactcatcaatcatcatgcgtgcgtcccgcgctgcccccctctccgcccggccagccggcccagccaccgtcaccgcagccggcccggccggggccgatcgccaagaggcgcggcgcgcgcgtccgccgtccggggcgcactagcgagtgtgggtcggctggggccgctggggcaaggccaagcggcagagagagggcggcagctagctaagctagcgacgcgagcgcgcggcgtgcctcccgttgtcggagcggagggccccggtggagcagcacccgcgggcaacgtggcagcgcgcggtggggcagggaatccactaccgcgggtggtggtggatcaccggtactgtacttgtgtgcccgtgccgtgcgactcctcgagacgcctctgtgtgcctggctgcctcgcacgccttttcttctttctgcctgtacaggcgagagaacgagctgtgtacgctcaccggccggccggccagccggagcgaaccaacatcattcgcgatgcgtgggtgggatgatgagtctcctacaagtatgcaccaacctgggaatcgactggtcgagcgagccgagtagactggctgcatgcatgctcgtgacatgatgaccccgacacgcaggtggtgtggactagaagcttaaggctgcgtttagatctaaagtttggatctaaactttagtcattttctatcacatcgatctaccatacacatacaacttttcaatcacatcatctccaatttcaaccaaaatctaaactttatgctgaactaaacacagcctaataatacacgtatctcggctcgctggctaagtacgtatgagtatcaccaattgagcctattttggactagaagcttaataatacatgtatcttggctcgctggctaagtacgtatgagtatcaccaattgagcctattttgggactagaaacctaagagcatcgaggtcgctatatagccaggtgcgctaaagaaaaatgaccatacgtagagagtggtgagcactgagcagtgccaacgtagtataacggtgtaacttgtatatctggcggcagctaagaccgagtacacacacgacgaaaccgaaatggaaacagaaacgtgctaatgacagggatgcaagggggttcggtaaacaaattggcgaattttggcaggttcttgtctatacatatgtacgcatgcataatgactcctaggcgctacacatttcctacactacttgagaactaatctttaccgggttggccaaaaaacacattagtctcggttcctattctaaccggtaattaacaactttttttgttctggtttaaaactaccacggaacttagatgatctttagtcccggttagtaacaccaatcgggactaaagatcatttttagtcccgttcacaaacatgtgagtacaccattatctttagtcccggttggcggactaatgatccatatttagtccggttggttataccaaccgggaccaagattaaaaaaaaatcgcggcttccccgaaccgcacgctgcctgctctcacagactcgcagtctcgatcgtatctcctcccctctcctctcctcccccttccttcaatccccttcctctccccattttctctcctcccccttcctccccttcccggcttcccctcacctacgggcggcgcacgaggctgcggccgcgcaggcggatgtggccgcggtgggccgacggaaggggccgcggcggcgggctgcggacgctgcagcggcggcggctgggcgccggctgagcggcggcccggtggaagtcgggaggccaggaggccgtgcacggctggcggatttgtggattttttttttgatttgtagatgttgtaaatttttttagttcgtggataattttgtgaatgatttgtggattgtggatgggtatgtattgtggatgattttgttgtgcatgatctgtaacaatggaaaaaaagagaaaaaaaactttagtcccggttcttttaacctatagtcctggattggacgtgctggtttacgacccaagattaaaggtgttgtaaaccgggagtaaagagcctttttccacagtgctagtacgtcttatagcagctccagtatgcaaagaaattgaactgtgagccaaaaatattgaacacaacacacattggagtcgattgttgtgtgtcaaatagcaaaatcaacaacaaacatgaatcaatgctagacaaataaatactatttcttgcaaatgggattgaacgtacatatccaaatcgagtcacgcaatttacaatttcctctctacttcatttactgtatgtgggtcccataaatctatgcaaatgctgcagccaccaaacaaagttacattcgccattcatcaactgtagtagtcgaacacacactggggttgctcttagagcatctccaacagcctctccgaatacccattcaaccagcttgccagttgaatagagaatcaattttgttttcactccaacaacctctccatttttgtagtggaacccacacgccagctcctctccctccttcctcacttctctccacagcttggagagttcaagtccccacccactaccggcacaccggcgataattgaagggggaggcagtcaatggcaacgatggaggcggggcagtcgcaccggagagggagcaattcggcaaggatggcgagctcgggttccatcccggtcagctgtcgccgttcaggacgacagggctgtggacggcggtgttgtgcaaccgcggaagacggccacagcggtccggggccgcactggagggatgacggcgcaacgcatggtgtcatagcggagggaccacagcggtggtgcgcgcttttggagccgacagcgctcgatctaaggacgacgacgtggaagaaaacaaggcgcagcagaaggacagtgccagccatgcacttgatctggggagggggagggagtacgggaaagaagaaagagaaaaatgtgtggggcccacaattagctaggcaacttgggctagccaacttaatttggccaacgcatggaggagtttggccccggctggccatccggttggcaagtctattggagtgcatttttttctatccaaaattgcgaaaatttaacttggaggtgagatagccactctgttggagatgctcttatcttatagattcataataacccataattactaaaataggctccacctactatgcataaggaaatagagagatttgtgcaatgtatatgacatatccaactctataatgagacccacacccatgaccatcaaaatgaattcatggcatacttgtaaaataaatactgttttttatttaagatacctggtctcaagggaagagccctttactatacttgagacctgtgttcgcaatgtatagagcctttgctaccgtgaaaagattctcttagtgccccttctaattcccacattgcagatgctcttaggacaatcttaacccatgaagcatccaagaatttttcatacttattatgtcatatagacactacgtatagaaactatggctcaattggtggtttcttcaacatagattttcatccaatgatgtcttctctctctctccatccacatatccccttattttctttcttggtttctatgtagatccagtttcttgcatgagaaatggattattcatcttttttcctctctccacattaactctcttgccatatcagaaatttttttaagtggcagtgtatttaatgctatggaaactagctaaggtggaggtttgggactgtctaagagtaggccatgcctctttgctagagattgtccacgcatgcacgtaccaggatgaattggcacgagtgtttcaacatgtgcatcgaacttccatataacgtgcgctgtgcatacaattactttggtaggcttgtacaacatgtttattactttctccatccaaaaataaatcaatttttatacatggatcttaacatagtcttttacatagtgtaattattttataactaattaactgtagctcttctatataacttatgcacactagagagttcatgatttctacatgtttatatgatacagctacatggttactaaaatttaaagaatttaatctaatattcgatatacaatataagaactttatatctatatgtttatgtgtttatgtcagaagccacaataaagtgttttatgctttgattactatttgtggccttaatcgtagtgtaactatattcaacaatactattcattttcgttttcatatctaaggtattcgttcctttttttaatatatctgaaccatttgaatccttatatgaaagcgaccacatgcgctttgcctccttctcaccatttgctattgttgaagcacctagatgtcaatatgttcctctcccatcccttacccacaaggctacaatccatacatcaagaaaaagttgctcctagttgaattatatcttctttgtttaattaagctcaactcctaaagtctagaagtaatcttgccaaattacaaccctatctttagacacatgtgagatgagcgaccatacatgacctcaaaatattaggggccccttgtgtgcttcattatatgccaatgcgttctgatatgtttatagcgatctcttcggtctctttttttttatctttatgctgcactaatttggtcggaataatttttttctcagcttcaacgagtgttcaatgataattggttatctctaagaacgtacttcatgatgatgacgtggatgtgtgttgcaaacaatatatttctatttttttcacttaataagaaaaactaatttgatagtgattctttttctacttaagccaaatcgtcattagatggataagtaaggtctcatcttgtattttgcatcgggccaagatagatagggatggctgctaaattgaggtaagtttgccctttttcaattgtttatatacatccagttctacatacaaatgtacactagtaattaagttagcaaaaatctgttattctacccgtgatgttaaaaacccgttattctatatttctacccatgatgtaattctgactgcgctctctttccacaagtttttttctgaccctgcccctgttgctgctcccaccgttcatttccaaggacaatgtccaacggatcccactccgattgaaatctctgagtctcatatgggcccatatatcccatctcccggttactgttcaagtttaacacgacgatggtagtacaaccaccttcggtgtgggcatatgcactgcaatcagagaagaattacacgagccacaactgtacactgaaaacaaagaggctggtgccctgtcgcacaacaagaaaaggcacagccgctgaggtgggggagaagtagaagaagaagaaagaaagaaaaaaaatggaaaacggaaaaaaggtgacaccgcacagtgacgcccccatggaattataaaaagatggccgcggttggccgcacgtgccgcgccgtcctacgcacgcgcgacgcgagagcccccacaaaccgccattcccagggcttccaccggtggctttcctcctcttttcttcggaatccctgaccgaacgagcatccatccatccattcactcggtcgcatacccctgataataatactcgcgtgtgccctgtgcttgagcaagaagaacatcatcatcatcagcggccgagcttaatttgacagaaatatagtatatagcgcttcaaagttttggagtagtagctcatctcgtctctgccgagtttctggtagagctggaggagcggaggagtagtagcgaaatatatataataaaagaatccactagcagcttggctatttcagcaaaacgtatgtgggtagagagagagagagagaggagggtgcagagatagggaggaggcataattccactcactgccccaaccacaggacattctcttctctctctcccttctgctcaagaaatccaccagctgctgcatcaggaggtggagctcgctcgtcgtcttcgtcttcgttgcgcttcgtctcctcaggtgcccggaggagcaagaattgttgggggggcagcgaggtagacgcagttggagagccctcttgcatggatgcagcccactggcaccaggtaaaaatcgctttgcaaagatcgatcgatcgattgattctgcatctgtcagaatttcgctcttgtgcttcttcttcttcttcctgatcttgttgctgttcatcttcctttctgcgccttgttctcggtgcatatgcttttctttttttttcttctgattgtctgcctctcggaagatgttcttcgctttatatgccaacccttattctttgtgtagatctatgcttcagtattcatcatcatcagtagcacacacacgcttctctctccctcctccataggctttgaggggggggggggggtgaggccctttgtggctttaatccctctcccttttgatccttgaaagcagcacacacacacacaccatcgcctttcttctttctaatccccccctttcctcatcttcttttctcatagcttttctccttcttttcttctgtctccttgccgcttgcatcaaaagagtagccatgtccccggtgatgtgtagtagcagcagcagcaggagcagctgtggtactactactgcgcgcaaccctacaacagcacaaacaaagttgtgttttgtgtggtggtgtgtttctctttcatcttttctttccttcctttcgcttatcaccttttcctttcctctcccccctttaccagtttcacctttcctcccccctctaatctgcctttgtatccttttgcttggttcttagttgcaccataaagattctaaacaccctgcttgctgccatggctagctctctctctgtcactgcataaccacatgccatttgtgctcgcttgttcttgcgagcttgttgctgtagtagtagttggtgtgaagttagcaaggtgtttgtttgatctttgatcgtttgtgttctaatggagtgctgcaccatgtgtgtaccatcaggggctagggctggtgaagcccatggaggagatgctgatggcagcgaacgcggccgccggcgcgaatccgaatccggcggcgacggcgccgtcgtcggtgactgggggcgcactgaggggcggcggcggcggcggcgcgccgccggtggcaggtggcgcgggggcgggtagcacggagcggcgggcgcggccgcagaaggagaaggcgctcaactgcccgcggtgcaactcgacgaacaccaagttctgctactacaacaactacagcctccagcagccgcgctacttctgcaagacgtgccggcgctactggacggagggcggctcgctccgcaacgtccccgtcggcggcggctcgcgcaagaacaagcgctcgtcgtcgtcggcggcatcggcgtcgcccgcgtccgcctccacggcgaattccgtcgtcacgagcgcgtccatgtccatgtccatggccagcacgggcggcggggcgtccaagaacccgaagctggtccacgagggcgcgcaggacttgaacctggcgttcccgcaccacggcgggctgcaggcgccgggggagttcccggcgttcccgagcctggagagcagcagcgtgtgcaaccccggtggcccaatggggaccaacggccggggcggcggcgcgctctccgcgatggagctgctccgaagcaccggctgctacatgccgctgcaggtgccgatgcagatgccagcggagtacgccacgccggggttcgcgctcggtgagttccgcgcgccgccgccgccgccacagtcgtcccagagcttgctcgggttctcgttggacgcgcacggctcggtgggcgggccatccgccgcggggttcggctccagcgcggggttgcaaggcgtgccggagagcacgggcaggttgctgttcccgttcgaggacttgaagccgacggtcagctctggcactggcggtggaggcgcaagcggcggcggcgccggcgtagacggcggccatcagtttgatcacggcaaggagcagcaggccggtggcggaggcggcggcccaggcgggcacgacacgccggggttctggaacggcatgatcggcggcggcagtggcacttcttggtaatgcggcggcggcggccatgcatgcatgcatggctcatgcaaaagcctccgcgctgtggtggcgtgggttcaaattggagataggcagtagagacgacgagggttttaataagaggttggcattggcgataatccatcactgattcactgttactccgtataaggtgttttgatctctcttcttcttctttcccggtgttgcatcatcatcttggtgttctttcttctcccttttgctgtctttcatgtgattgttgatcggctttggtgctcaacacaacaaccgagctcacatgattcctcaaaaggatcatgatgcatgatcgatctctttctgaattctgatcttccagttctctccattgatcactgttactactagtcatcgcttgatcgatgtgtggttagagagctgcatgcgtcagtgcagtactagactagtagagcatgggaagcttctttttaggctggcttcgagtccgatggcgtgtacgtacgtggtacacaggcatgcatgtggtgtgtagctcattggttttgcaggggcattgtgaagcgaaggatgaagggaaggactcggttggggaggaagaaagaaaaatggacccccatcaccatgcatgtatgtcaaacttagctacagtatgtttggtaacggcaatgca

SEQ ID NO: 62623 - DNA, 682 bp, Oryza sativa
attcctgcagccccaggcgccaaaactttcacactcctcgttgtgtggcgaggttgaggaatctgatgtgtctgatttatcttttgtactccaaatatccgatgacattgaatctttgtccctatctgagccaacattgtcagctagttcttcctcgagaattttcagtgccgcagtagcatccaccggcctccaggttgaaccagtgagcttttctgcccaggcatcatcaatctcctccggcaccacatcattcaaccggggaggtagtacacccacatgttcctccattgcatgatgtacatgtgattcagcatcagcaaaatgctcctcacaccggccacataccaaaaactcccattttccactcctagtggcaaaccttatcgcctcgttaagcacatcagataccaaactggcagcatctttctccttatgcatcgcagtagcgtagtgtgacttgagctcagaaatactggtgcttaagaatgcaagcctccgatccatgggcactgtggcccagaactcacgcacctgattcatgcgaccggacactggcgaagctgctgccttcctggacccacccttcctccggtcagccggcgatgcccagacactgatgactgacacgacgaggagggggcctcatcccccggtgactgtgattgggaggtggatgatg

SEQ ID NO: 62624 - DNA, 560 bp, Oryza sativa
actatagggcgaattcgagctcggtaccctgtagcaatgctactgatgggagtagacattgctggtacatggtttggacagcaaacgtgccctagaaagttagagtgttcgcctaccgcatcgcacgagacaatctccctacttaggccaataagtttcaaaggcaattagtgacataagaaaagtgcacgatttgtggatttgaaattgagaattttcacacaatggttagatgtacaaaaagcgaaagctctgcgacatgctctgtgcaggatttgggctctcctaggggaaagctcttttaatttttttggcgtgattgctggaaaggttgtctatccttttatccttcttagctctgtaccaactaactcttgtcatatccttgtgctgttttggggagcttatagtatttacgtaatgatattgtccatggcaaaggtaggagatgtggcaagatctgcaatgttcttacagagttaccatgactcttttgcacaagccgtggtacaagaacctggtaaaaaggtaaggcagttttgagtgcagtataaattaat

SEQ ID NO: 62625 - DNA, 1606 bp, Oryza sativa
tggtacgctctctctccttttgggatcctcatagtatagtgtgttgcactgtgggtatccgaaaagtgatgaaataaacatgagtaaaacagatactgattctaagattaaattttaaatttcaaattctattacgggtacgttataagtcgattataagccgctcgatactgcagattcgaactaaacgaactctaagtattgtaagttaaaagattattggctaattcattcattatttttacaagaagcaagacactcattcaaatagtactagactggctccaaatctcaaataatcgtttggaggatgtggagttgaagcaaacgtttcgtgatccgataaaaagcacagaaatttaaaaaaaattgtagatgtggtgctgcctttcgctcgtagaaattcctaacttctcttcaaacaaagcgatgaattagcgtataattaattaaaaagaaaataaacactagactaatataaggccccctttaaataaaaggaattatgaaggaatttcataggattgaaatcctataggaaattttcctatgtagcaagattgaagttttctaaatcctacaaaatttctatggaatggcttattgcatacaggttttggaggaaacttaacaagagatccaacctcttcgtaaaaatcctttgagtttatctctctcatccgattcatgtatttttcctgtagtccaatcaaacgatcattcttatgtttgtcctgtgttttgcaatcctctgttttacccttacattcatgtcataattctatgtttttcctattccaccgtttttttattcctacgattcaaaggggccctaagtttgaaaacaattttcctatatatatattttttaaaaaaacatagtttcagggaatgcacgcgtaaaataagtatagagaaattagaaagacgaacaaataaacacaccctaaacccaattgcatagttgtactctctcacgagttttttttatggaaattgctatgcatacgaccaatgcgtacgacccacatccgactcaactaggacatagacacatttactatttttttatcccatatagaaggaagctaagtgcaaggattggtggatgaggtgtgattggatgctcgttgtacgcactggtcgaatgtatagtaggactctttttttaatgcccatttgttacggctcctactcgagcatagctgagaagtgactggaacaatgttcattgtgcttatttgaatctgattacaaagattttatatcggtttttgttattaaacaatgtgtttcatttaaacatttctatatataaatttattttataatattaaataattttattttccaagtttacaataactaaaactcaataatcccacccttttctcgttttgcgtgcacgggtttaatcctcatcttcagccaaatctaacgagagtgtacactaatttcttttaatgaaacgacaaaccattggcactgcaattagtgctttactccttagggcaagtactacgagcatccaagcacaagccctaagatgccacataggactaaatagtgaggtggaggagagaagaaggatgagagagaaatagtc

SEQ ID NO: 62626 - DNA, 1469 bp, Oryza sativa
ggtaccccaatcttctccccaagaggattattttctttctagcaccctgcagaggacacaactgaccccagatgagctgctcaactatcgctttgagggtctaccatcatcatcatcatcaccatcgtcatcatcatcgtcgtcatcttcatcgtcgccacccgacctcttcctcttcgacgaggattgcgccttcgcggaatcatcatcgccatcatcgtcctcatcaatctcttcatcctcggcaccctcaccgttttcatctggctcgaagtcactggaatgctcctcgtcctctgcatcaccaagtggcttgaccagatactcagttcctagctcctgcagaaatttcatcaaaagcgtgtcatgactgattgaggtgaacgatattcggatattaagatgcatggtgaatctttaagcttaaattgccttcaaggcaaactctaatttgactaaacatgagaatagaaacaactttgggatcagactgacgtgcaaattttcatcattctgaaaataaatccataaaggatatctgagatgaattgttcatcatttcccaaacatgatagattcaataaggtcagtggaagatgagcaatcagggcctacttgtatgacaataccttgggaaacagacctagattcagcaaggttacacaggtacataaacagcaaaagactagatggaatatggattcaatgtccatgctaagcttattttgtcttccgtgataagttctgacccgcaatactttcagaaatagggaataggaatcttcctcagaaagcagtgaaatatcactagatctccaaagaactgcggaggaacaaatcagaccaggttgtcctctcagatctactgagaatgggatcggactgacgtgcaaggtttaatcacaggcagaagagatctaccctcagaaacaacctctggaataagtttttcgtcatatccctaaaataggagctaagcctttcagtagatgctctcaattctcgagcacatattcgaaagcatcagatagcaacgccatcttaatttgaccaaaaaaaactaggcagatcttttaagggagaaaatgcaaataaagaaagagaattggatcagaacggcaaatcagttcttttgcagcactgggtgagctcaaggctcatcctcagaaacagcctctgatataaatcatcatctccaaaagaacatgaacaaagcaaaaacaaaatccaaaatccaattactttataggtcaacaaactggtaccactcccccctcagatctaaaataggttctacttgcaaacagcaatctacgaagtggttttggatcagaacggcaaatcagttctttgcagcactgggagagccattggcccgtcctcagaaacagcttctgatacaaatcatcatctccaaaaacaaaatcctacactaatctttcacagatctagccttccaccataggaaa

SEQ ID NO: 62627 - DNA, 2459 bp, Oryza sativa
atgccctttggacttattattattgggggaggagatgggcctctgatgggctacaccacagaccacacaaacagcaggtggataagactagactagaaaagtagaaaacctaacatgtcctcataggaaattaccacatcagcgcaaaagtactgggaaaggataaacggtatggcagagaacaatcacccagatctacagaaaatacggaaacagggttttcgtacctctttttttttgccaaaaaaactgaacctttttactccaagatctatattttttttgcccaaaaaaggcttctttattcccagatctatagtttcctgagtggtaaaaacaactcacaaaaacaaaattaagttttgaccgtctacagaaatcgatatgcaaaaaaaaaaaaaaaaaaacgacctcagacttgcaaaaatctcgaccttctagaaaggttttttgagaggaaaagtcttcaaaactaagctgatacatctactgatgtgagagaacgctattgtattcaaaactaagcagatacatctactggagtattttagggacaaaggtgctgaacagatctgagaatagaactacttttccagatttgtgcaagagaaaattagcaagaaaacgcgcaggaagctgaagaatttcatactaatcgtaacagtagagcataaagatagatctatcagggcaggcaggaagaacacatgaacaaagcatactagcatatattcgagggatcaaggcgtgaaaaaaaattatacctcctgctcgtcgccctcgacttcctcctcttcctcttcgtcatcgtcgtcgtcgtcgtcatcatcatcgtcgtcgtcatcgtcgtcgccgccatccccctcctcgccgtcctcctcatcctcctcgtcggagatctctacgacggtgtgccccgccgcgcccttctccccctcctcggcgtcctcctcctcgtcgtccccctcctcctctccatccccctcctcgtcgccgtcgccctcttccccatctaccgcctcctcctcgacctcctcctccccgttcaccacctcttcctcctccaccgccgcctcctccgccttcttggccgccgccgctgcagcagcagcggccttcttccgggcaagctccgccgcccgctcgtccccctcctccacctcgaccgccggcttcatctcaagaagcgaatcaaaaaaaatcaagaagaagaaagaaatctctccctttgctttggtttggtgctgtggcggcggaaaaatcaggggaaaatttggggcgaatttgtaagcggcgcggggaagaacagggggcggggcggggcggatgcctgcggggagatcctggccgtccgagacaagaacagtcacgcggatcgatgacgtggcggacgatcggacggctgcgggggatcggttcgtgccttcgtggagggggaggactccggagtccggagacggggtaggaggagaacgctagggctgacgtcagcgtgagggagattcttttttcccaagaaaataaaaaaaaactctggattcacgctctcttctaaattctgattatagtaaaataaggccctgtttctttgagggactttaagaagaagtccccccacttaagtccctaaaagtccctagagaaacaaacaggagggactaaaaagtccctaatagggtattttccagaagtcccaaatggaggtgcttattgggaatatggtcattgtgcagtgcatttaatgaacttaagtcccttttagtccctataaccaaacagccatgaacttaattgattagtcctaagactaaaataagtccctaggacttatggatccaaacaccacctaaaatcagttggtatacattaagatttagatttatcgcccaaaaataacctgttgcatttttttatttactttcttagaatgtaaacatcccggcaaatgacctcatggtctaccaaaaatatttctcctaattaaacttctctttaaacaagaatttttaaagatagaattgtacagagttttctaaaatacatgtgtgtgtgtgtatatatatatatataggacactcatatggggcaccatggtgcccgggcaccatggtttcaaatgcacaaaatcacttaaatttttcaaaattttcaaattgtgagtatatacctagttataagaattcgattcatacctatacctatcaacaaaacaactcaaatttaactttatttcacaatccatgattacatacctaactaattatatgtatgcatgctatatacctagaatcaaaatctaacaaaaacaagttcaaattcagttcaaacttgctttcaactagttagtaaagtagttaatattaatacctaaataattgaaaaagtttcatgctcatttgaattgggtatatactcaatttcaacaatgatgcccggacaccatatagcaccaaacaaat

SEQ ID NO: 62628 - DNA, 1130 bp, Oryza sativa
gcgcctgacccacgtcgacgagccgcaccggggtgaagagaaagaccgggtgataagagagataagggagagagagcgcgcgctacacactgacaagtgggtcccaccacgttgagtcagcttgtcagccgggtcaacaatgccacatcggatgaaaccgccagcagaaccaccgagggaggtgatttgctctggttttcagagatgaagaaggcgttatatccggttttccgattgagggatgttattcacgcaaacgcaagagatgagggaggcaaaatggacttattcctaccaggaaaaagtacataaggtccctcatcgggtcaccaaatcaattataaaatcgtccctaaaccagaacatcatatatatagtatcccccaacttacaaaacagctaattttaggtcgttaggcagtattgactctggttgactcgggttttatccgacatggcaactgagtcagtgttggatctacatgggcttcacatgttagccttaggcggttttgctgctgcaaccgaatccaattattcaatggcaattgcatcaggggcagctttctcggtgaggccgtgcgtcgcgtctgcgtcagccgctggtgcctcgagggccgggcaattgggaacagcggctacggaggaggtgggaagtggtgggtgccactgctggggtggtcggaacatcggtgttggcgatggatgagcggcgggaggcgatggtggagtggtacatgcagtcgtggaagctccgccgcggcaaagaagaacgacagccccgctgctccgccatcaacgaccgcgcctcctccatcggatgcgctacctcattttttcttcctcctcctccattgatttttcttcctcctctctatatcctgtcagaggaagacaggcggcggcagcggtggcggcgagggtagtcagagaaggggcgccggctgggtacctactccgcccaagccatggtggaggaaagtcgaataggccgcccttgtggtgtggcacgtggaccgacgccgagaggatgggcgacgatggtgcagcgcgccagctttttcacaccacacggggtcgcatgctactgctgctgcaagctacaagagtcagcagacgcaacgaagaaa

SEQ ID NO: 62629 - DNA, 7093 bp, Oryza sativa
gataccctcaggcccagaagatgctttacgctattctgatggcttcgaggaagttgcgccattatttccaggcgcatcgggtcacggtggttacgtcttaccccctcggccaaatcttgcataaccgagagggtactggacgggtggtgagatgggcaatcgaactctctgaattcgatttgcgctttgaaccacgccacgcgatcaagagccaggccctcgccgactttgtggcggagtggaccccagctcccgagcccgtctccgcccccaaggccagctcgggcccctcgcagctgcctcacaccgcctactgggtgatgcagttcgacggctccctgtctctttagggcgccggtgcgggggtcacgttgacctcgccgagcggagacgtcctcagatacctggtccgcctcgactttcgggcgaccaacaatatggcggagtacgagggactccttgcgggactcagagtggcagctggactggggatccgccgcctcctggtgtttggcgactcccagttggtcgttaaccaggtctgtaaggagtaccagtgctctgacccgcagatggacgcttacgtgcgccaggtgcggcgtatggagcgccatttcgacgggatagagcttcggcacgtgcccagacgggataacacggtcgccgacgaactctcaaggctcgcttcctcgcgagcccagaccccaccgggcgcctttgaagaaaggcttgcccagccgtcggcgcgacccgaccccctaggagagacggacgcgcctgaacggcccccgaggcccgtcggagtccaggcctcgggacccgaggggagcgctcccagctcccctagattgattgcttggatcactgagatccaggcgtacctcgcagataagactctacccgaggaccgcgaagggagtgaacgcgtccggcgcatctccaagcgctacgtgctggtggaagggaccctctatcggcgcgcggctaacggagtcctcctgaagtgcattcctcgggaacaaggcgtcgagcttctcgccgatatccatgaaggcgagtgcggagcccactccgtctcacgcaccttggttggcaaggcctttcgccagggtttctattggccgacggctctcaacgatgcggtcgacctggtccggcggtgcagggcgtgccagtttcatgccaggcaaacccatcagccgacccaggccctgcagaccatacctctttcgtggccgtttgctgtctgggggctcgatatcctgggtccgttcaggcgggccccgggcgggttcgagtatctgtatgtcgctgtcgacaagttcactaagtggcccgaggcttatccggtcatcaaaatcgataagcactccgcacttaaattcatcaggggcatcactgctcggtttggggtgcctaatcgtatcattacagataacggcacccagttcactagtgagctcttcggtgactactgcgaagacatgggcatcaagctctgcttcgcctcccccgcccaccccagaagcaatggccaagtggagcgcgccaatgcggaaatcctcaagggcctcaaaaccaagaccttcaacatcctcaagaagcacggcgactcgtggatcgaggagctgccagcggtgctctgggcgaaccgaaccacgccaagccgagcaaccggggaaacgcctttcttcctcgtctacggcgcggaggcggtcctcccatctgagctcaccctgaggtcccctcgggtcaccatgtattgcgaggctgatcaagatcagcttcgccgagacgacctcgactatttggaagagcgaagacggcgcgcggccctccgagccgcgcgctaccagcagagcctgcggcgctaccatcagcgccacgtccgggcccgatcactctgcgtcgacgacctcgtcctacgccgcgtccaaacgcgtgctggactgagcaagctctcaccaatgtgggagggtccgtatcgagtaatcggcgtcccccagccgggctccgttcggctggccacgggcgacggcacagagctgcctaacccgtggaacatcgaacaccttcgtcgcttctacccctagtgggggtcgggtgtcatgtctcgagctcgggccaaccccgcacccccccccccccgggcgtgcagggttggccgggggctaccacatgcatatacttaccttttttctcttccgtatttcaataaaagcattttcgatttcctgaggactgtgtctgtgccatcgtttccttttgaagaatcttggcttgaattagcacgctcgtgctcgaccctgccctcggcggcccgggccggctaaaatcgccaaacggggcccagaaccgagccgtgccccggggcgtggtgaactccgggggggaatcagcaaaggcccacaatcgggtcatccataaccctcggtcaccgcgctcccggcctggccagtctcgacacgaggatctccccaggcactagccccgacccgcgccgtttgaggctgggacctgggcacgagcccttgttcaagctaagacacagaaggaccgcggcacagaccatcctcgtctcatacacgcaacaaacagaactgacgcagaaatttcctctttacttgattgcagattaagtcagtctatacaagaagggggcccgaaggcctcggaagaagaaggaaaagttattaagattggcgggggcctgggggctcactccgacgcgcccgggtcgccggcctcgtcgtcgctgtcgtccgcaccgtcgtcaccgccctcctcatcggagtcgagcgcgaacgcgagccgaggggccgtaccctcgaagctgtggacgatgtggtcggcggcgtcccggacctgcgcacgcgcgccgtcctcggttccgggagggaactcttccagcgctgcccacggggagaagtcagggtccctggcctggtagcttgccagtacgagctccaccgccccccgggcgaggtccctcgaggatgacctgatcgtctcctcgagctcctcggggagccgctcgagggccccggccatctctgagaggcgctgggcgaggcccccctgattggcggcgtacttcgtgtaccgcccgccccagaggcctgcctgccgcccggcgcattctagacgggagacggcgtcccgaagcatgccgggccctacctcgctcgccaagcggagggcctcgacctccccggcggacgagtccagcgcgccctgcagctcggcgatggtgtgttcggcggctgcgaggcgggcggctaggtcgccgtggcccgcggccgccccgctgctgtgcgctctcgcgtccagctccttcgcccgtgcctcgagctcagcggcccgctgatccagtacggccctctcggcgcgggtgccttccagattgcggcgcgcctgctcctcccgcgctgcctcgcgaaggaacaggctgtccgccagccgctgcgccgcggcctcggcctcctcgagagcttgcccccgctcggtgagcgcgtcctcgcggaggcggagtgcggactcctcttcggcgcaggcggcctcgtgcgccgccagtgttgcctcccaggtggcgacggcggcctcgcggtccgccaggtctctctccttcgcgtccagggcgcgggcgcgctcctccagcgccgtggcgcgagcctcaagggcctcttcgcgctgccgggacgccgcctcgttctccgccgcccgccgttcccgggcaacggcggcgtcaaggactccctgggcggcgtcgagcttctcctctagctccgccgcccggctcccgtattggaggcggaggtcgtcccgcgcctcgtcgagcacggcggtggcgatgagggcagtctcctgctcctcctccacctccctggcgatctccgccaggtccctacgacgggcctcgagctgtgaggcgtgccggcggtgtgcctacggcccgcctccaccatggcctccaccgagcgccgcccctcctcgacgcgcgcccacgccgcgtcgagctccgcccgctccgcctgcagggcctccatctgggcacttaacccgtccagcaccgtgctgttcgcggcggccaaggcctgcaggaggggctccacgctcagtggggcagcggaagacagaggggagagccgcctcggggtgggtgccgcgcggctcggcccgccgatcgacgtgccggactcgggggcgtcccccgaagctggctcgtcccaagcgtcgcccgaggggtcaggcccgagcggcgcgcccgcggcctcgtcgtgggtggcctcggaagtcgtcgtcgcctcgggcggagtcgggtcgggggtttggcaggccgcctggcgtgcgcgcgccgcctctgcctcccggacggactccccggcccggcggagtctggcctcctcccgagcggcctcctcagcctggcgaacccggacggcctcctgggcagcctcctcggcttcccggaggcggtccgcggcttctcgccggttagcttcccgcctccgggcctccgcggtcgccgtctcctcggcctcagcccggccggacttggaatggcggggggggcgcgacgggatctcgctgaggcagaagaaaaaccagaagacaaaaagaaacgggtgagtgaaaactcgccttgggagatgggagaatgaatacggccgcggtgggcgcggggacgaacctgcggggaggtcggctaaacgaccacctcgggggcgagatgaggttcccccggcatggcacgatcccccccatcttgcggggccgtttcttctttcgctccccctcgggctgcggcgtcggcacggcaccctccaggcgcctgctgctggcacgcaccgccccgccccctcggggaggagatggaggaggggtaccctcctgcttcctcttcccccaggcgtcggcagggcggttgccccccgggcccccgtcgcggggcccagaagcacgaccccctcccggggtagattgttcccccctgcgactcccgcccgcgccatcgtggcctcggggggcccgctcccccgatgccccgaccacctgcatgatggtcaggatcttggcgcgctctggatcgcagcagagggggaggaccccttgggggatgagggatgcctccacggagctgagattcagcacccgttggaccaccatcctgaagtcctcagggtcccagtcccatttgcgcccctggtgggtcctcatgtagtcctcgggcccggtgtactcccaagcgccccgggcgcgccgctggagcggcgcgatccggcgacgaaggtagtcgccgaacaccatggcccccgtgagcccctgggatcgcagacccgccaggcggtcaagaacggcgtcgtagccgtctcccagatctaccgccgcccgccagctggaggcctgcgccgggggctggctcggaagacggaggcgcgcttcgtcggcgaggggggtgtagaaccaatcgctcttccagtcgtcccactttttgcggaggacgcagggaatgtagcggttcagcacctgcccccgcggctggaagtagcagccaccgactaccgtcggcggcgacaccggctgtacggtgaagaaccaccggaacagccggagagatgggcgcaccccgataaacatctcgcacaggtgcgcgaagatggccaacgtcattatcgcgttgggggtgaggtgcgccatctggagatcataaaactccagaatatccatgaaaaaaatagagaatggcgggaccagccccgccattgcgaaagagaggaagaagacggaccgccccgggtagtgtggcaccgggcgtccctcgcccagcgcgaccacctcccggccggtggcagattccggcatgaatcggcgcggcagcccggcctgcctctcgctcacgatgcgggaaggcggcagcacgctaccgtcgagcggtgcggagccccgtgccatgacgccggcggaggaggagcttgagagcgagcgagtgcggcaagggtagggcacaggaaacgaagagttagagcacaagtggcgaaggtaaggggaagagtggcgagaggaaagaaacgaatcccttcctcggcgtctttacacccttgccaacgctatgcccggctcctcgcttcccgcgcccactacctcgccccctcgtttctcgcgcccacgcctccactaaccccactcgcccgtttgcggcgcacgcggcagatgtgcggccgtggcggttgagatggggcagattgtgcgcgcattaactacgatcgccaaccgtgaaaagcgccatcatcatgtctccaggcgaaacgaaccggctcgtcccgattcgcgcgctgctcgagtaatgtagcggtcttaaagaggccgctcattattgtcggtcggttttcccttgccgatgcgcgcgatttgcgaccgctgggtttctgcccgcctgtagggaccggccccacctgtcaccgggcctaaggagtggcgtcacgctcgagcgcttccctcgaggggggcgatcgccctggcgtaacgccgggggctactgtcggtgacatggggccgggggtatcgtgactagaggcttgggtagccgcggtcacccacgtggcctgaccccctcggggggggtcgggcccaaggatgacgtggccacccctccctctgtctccccgaggggtcggatcgctcccgtttcggccccgagggctggggcgcccccgtttcggccccgaaggctggggcgccccgaccccctgtggttttggcgccacgcgtgtgggttaggtgagcacagcggggctcacctaaccgcatttatagcagggttggacgagcgcaccacgccgcatttaatgcggcgcagcgcacgcttatccggtccgtgaccggtcgcggtgtgtgaccggtcacagaccggtcagatcgcgggttaggtggcaacaggcggcctgtcacacgcctcgccccgtcccgtcggaatgataagagcttcttggctctcgtccctagccggagccggcgtgctaactcctgcagttggtatgtcagtcccggtcagatccattccaggcttcagcgcaagtacggcaaggaagtcgct

SEQ ID NO: 62630 - DNA, 1015 bp, Oryza sativa
tttgcttatcaccaagcacgtgctaaaaagcgtgtagtggctgaacaaccatttgaaatgccagtaagcaaaaacgcatttgccacagaagcggatattgaagctgaatttgagtttgttgcagatgaagcgacccaaaatttagcggcattattaaatgcgacagatgaagaataagcgatagcgtttatttgaaaaagaaaaaagctaggtaatttacctagctttttttatgtctgaatgtaagcctaaatatctctttaatattaatttatttcatttgaaatatagatcgcattaaaaatttttcgcaaattttcctgatttagtgggcaatatctcttacattgctgtaacgaaaggggtacactaatcgtctaatataatatgcaaacgattatctattaatataaaaaggtagtgattatgaataaaactttaggcagtacattattggtttcagggacgatgattggtggcggtatgttggctatgccattgacgtcagcaggtattggtttttgtttaactttagtattattggtcgtgctgtggatattgcttacttatagtgccttattatttgtggaagtatatcaaactgcagaacatgatgttggtattggcacattagcggcgcgatattttggtaaaacaggacgagtcattgctacgttagtattaatggtctttttgtatgcgttgttatccgcttatgttacgggcggtggtaatattttagcgtcaatgtttccagctgcgcctgatcatttaatgacagagaaagagaaaattgcgatagtcatgtttacgataatttttggtgcttttattgtttttggcactagaagtgttgatggtattaaccgttttctgttttttattatgttagccggtttagcgttggtactgtttgctttaatgccttttattcagatagataatttactcgcaatgcctgtggataacttattattagtttctgctagcccgatctttttcaccgcttttggat

SEQ ID NO: 62631 - DNA, 622 bp, Oryza sativa
ccgatgactaaacgtaacggcaaaaactgacaattttggggctgtaccgcctatccggattgtcagcatattgagaacatcggcaaatccacggcacgacgaaaaggtaccgctaattctcaaaatattagccaacaaattgccaatttaagaaagttggttcaatgagtattttttatgttatgattgagacttaaagagccgcttagtgaattgtcggttatcaattcacaaccagccaaaatattcccagcatactgaaagggagttctattacgttacaacgttgataggtatgccacctaatattttgagtaagtctctcttactcacaccttttctaaacgctcgccattgcgaattcttaatgatatctgtttacttggtatgattaagaattcgcaatggcttgctactttttccatacctgagctcccaggtgaaaaaaggagtgccgtttgtgtcaaaaagatgccacagcttttaccgattaaagaccacagagtaatcggataatgcgaacgtaaaaataagaacattgtgacgaaaatgcgattgtttttatgcctcaatttatattgcaccgcttgatttatctttagttaatctataatcaaatata

SEQ ID NO: 62632 - DNA, 1822 bp, Oryza sativa
agaaacatactgggtaatttctagcaaaatatattaaattttccaaggacatgaacccccctgctctgcaagcattagatacttcaaaagattagttgtcgaggttcaagcggtgttgataaatgcatgacagcttatatatatatcctaaaatcattactagggattagcgaaacgaacctaaaatcagttgctggatcagaattctgccagcccatctccttccatagatctgatttcagaggaggaagttgtcggctgggataagctaatctccaaagttctttcagagcatcctgtcatagaaaaaatgaaatattttactatcatgaatgttagtatatgaattgttcagtttatcatttcttctgagcaagaaaattggtgtcccattggtgagaacaatagaacaagaataccaaaggcctataggtagttaggtacagaagcggaacctgatgcttgacagaggaactgtcaaatggcacatttaatctctgtctcaagaacctcagtctctcttcctataaagtaaacatggaactgtcaaaaccatagtatcatgtaaaaaagttcctaaatgtaaaaacttgaaacagtcaagaataacataaagatgccatcgatgctcctgtagaacagaagggttggaattaataaaccaagtcaagaattcatttgaatttttaaagcatgcaattcaactactaaatgagtgttgtggaagaaataacaagtttcatggatgttaccatgatattgttcatggatataccaacatttttgtccatgaataatcacaaaagcaaacaagaacttttattattgtaaaaaacgataaaaaataaatgaaagatgaattgagcatcaaagatgtcgagagtatgctcgaaacaactcattcaaatgcttaaactactgaggaagaaaatatattttccttcatacttcagtaaaaggtttgaaatatctcaaaatatttacatgaaattaacatgtcacatctgatactcataagaattcatgcttttgatgggaaacttaacccatcaatcatatggtattttaaatggaaataggagatctgcatgtgccagcactgattatacctgtagtggactgagatcaagtagaactgcctgttcatcatgtgaaccatgggaagcacaagacctactaaagaactttgctagcaatggtccaaactgagagagcgcatttcctggaaaaaaaagaagatttttcagatagtaaatgttctaaaaggtcaagtttaagcattctgctgtgtacattcaagagggcagtaagacactaaaaaatccacttctctggaatcatattcatgatagttacctatctttcttacagattgagcaataaaagtcgatataacatgcatccaaccaaggcgctcttgtccttttccatcccataaatttggctgcatattaggctcatgtctctataaaaaaaaagtacgagaaaaggggtaaggcgcatgaagaactaaaatgcggttaataacctggattcatatgatttggagaaatttcactaacctcggatttgctttcatgagttctgtttcctagaagaggttctcttacagaatctggtatgatcgtctccatctgtttttcgcttctatcaatatcagcagtgtaaggcttccttttaatggcttttgaagccatactattttttcagtcagtgtattgcatgaatcatgcctgttatgtaggaaaaattggaacgccaaagagattattgaaaaatttatattgaaaccaaccaacccatagatagtggcaccaacaaa

SEQ ID NO: 62633 - DNA, 21465 bp, Oryza sativa
  unsure (1)..(21465): unsure at all n locations
cttcgggggaaaaaaacatcatccatgccttgtgattaacatttggttcattgatgatggatgatgtgatcgtgaaggatcttgaactcttacaattccattatgaatgtgcaaaagtttcatatcatggatttcctctcgaattttgtgatcttccattatcatccgtataccatctatttagtctctctcgagcaatctctacctaaaaaaccaatagagcacaccattaaaatctaaaaaagtgtgctctttcaatggcccacatgtttttctagatagacccttatattatgtgaaaaagatatttaattaaatacaagataagaaaaaatatgagcaaaaagataataaagccaacctgtttttcccaatcagtcctaagtgtgatgaataaaagcacaagagtctgcactagtgttccaacaagcatgccaatccaaatgccctatagagccaattaataaaagtgagaaacacagcttagacctaagatttcctaatgaaatttacaatggcaaccaggaccttacctttacttcaaatcctagagcatagcctagtattgccccaatagggataccgatcaagtagtacgatgcaacattaacataggcaactatagtttgccaaccagatccaatagcgacacctataaatagttagaaaacgttgtaatttcaaagtgaaagtttaaattattttgatatattcatctgtcaaataaaataacatacctgagagcacaggttgaacactatttaataaaatggagaaagctagaaggggggcaagatcagcaactgcatctactacctcttgactttcagtaaatatgtatgcaaggcttccacgaaagaaaaggaagagcacaaaaaacacaaatcctatcaagaaagaagtggtgaccacattgaaaatggcaaacatagcccttcttgcactcccagctccaagttcatttgccacccgcactctaaaaatgtatatgtattaagtataagtcaaatttataggacataatggaatagtcagatgaaccacttaatgagtaacaagtaagatcatgaagttacccagttgcagccaaaaatccaatagaaatcatcatctcccaaccattgatattaaggctacaaattttgtaagtgaaaacaatagtgctcaataagcaagttcttcaagcactaaaggatagacacaaaacaataaattgatgtacatgatacaacatgcatgctttggctattattttctaaactactatgcaacaatagtatattaacatattaccatatagaaagagcatcaagagcaacctctgcattcttcatataaccagtgaggagcaccaatatggtgttgtaccataattctacactgaaaggcaaaggaacaacaagaacaaatcaatgagctaccaaattagctataggaaagaacttggttaacactagcttgatataacatattgccttttgtttgctatcatcaaaattatccagaatttcatatgtatacataaacataacagttacttaccaaagcatcactccggatgatatcgaaagcttgataatagcaccgagatcagtaaaagcagaggacgagaaccctgtccatgtttgaggacaaccaccaaaaaagacatatgcgagctgaccaaatatagggatccaacaggcaatgaccgtggagcccatcaccccagcaaggccaaggtgaaacttgaccaccatgagccatgataggaagagatggagtccaaagttgagcaaggagaggtaggtaacgatcatgttcttgctttgtgattgtagatacatttggattgttaagccccagacgtaggagaacatgatgggaatgtaccatagtgagatggtgccagccacaacagagatatcgggatcctgaccaagcgcaattaggagcggggtggtgaagaggtagattgggagaaggattactgcacaacagaagagaactatccatgagcgttgtagatatatgcctaacatgtggtattgcttagcaccatatgattgcccacacaaagtttccaatgcgcttgccatgcctatctgcagttacaataatgtatatgtatggttaactatcaattaattgttaatagtgaattgtttatgtatgcattttgtacaagatgatttgtaacaaaaaatgattgttagtaaaagataaacatttttataacttaaagtaaggtatgtttatgttttatttgtatattttgtaccataaagagtttgttattgttgcagtgctggttgtcagaggtagcacgaagaagataggatatggaagatccaagaagaataaagaaagagcacactatatagttattgcatgaagaaaatgccatgattaaggggtggatgactagatgaagagcctgcttcaaatattaattagtgttttgaaagttgaataatttgatgatccccttctcaagaagaaaaaaaaatgtgaggaggcaagtatcccatataattttcttccttcggtacgtttcatgtctttttttttacatcgagcctaactcttatctatagtacaatggtggaaaaaaacactttgaaagtataaaggcaaaccaaacatacatgatttgtacgaattaatcgatgncctacttncctgctngnnnnnnnnncttagtgacgctattagtatcgatagacataattaagttcatgactccaacattattaaagttatgtttttaaaattggcaaaatttctcagagggggaaaaaattttnaaaatttncccccccccaaaaaaaaaaaaggggaaaaagggnccggggnaanttntttntattaagggnatactcccaaaacgtggcttgaccagaggacacctaaaagaacgtgttaatttgctagaaaatatcatatctattattttatcatttttagcatatttgaaaacgaccagaatagcccagccctctcaggtgtgaaaaccagaccgtatccctatctcctagtctctctgctctctcgctgttgaaccctagcaagagtgaagactagagggaataatcgacattttgtatgtcttctcttttcttagctgagtacttcctcggtcaaaaaagaaaaaaaactaatcctgggtaggattaggttatttttgggatggagggagtagatcgatgttttaaggtgtattcgtacaaagccatgttttgatggtgcgtattagtaaataagggttaattactaccataatttgtgaatatcatgtatcaaattttgtctttaaatgttgctagttgcagaaagactaatcatgtgaaaaaaaatcgagttgaactgttacacgtactaacgaaaactaacttgtacctgtaattaaattaagtagtactacgtactaccgtataagcaagaataatcagcgttcatcaggcataccaggatgccgacgctcaagcgcatgaggacggtggagacgagggcatacgcggcgagctcggtggcgccgatgtgcccgatgaaggcctggctgacgacggtggcgccgaaggaggtggcgcgcgcgcagatggacggacccgccaccacccacagcttcttgttctcctccaccaggcgccgccccagcgacccaacctcttcttcctcctcgttgctgcctccgccgccgccgttgatcgccggcttaggctccaggagaggatccgtcagcctctcatcatcctccgtcgtcctctccattgctactctgctagctagctagctctccagtgcacaacaatggagatcgatggagttaacaggagtacgaatactttgagttgcagatattagtagctgtctgaattgaagaaggctgcagggagggaaaagaaagcatccatcgatgatgctcaggtctccccatctaccgtttaatggcggggccagagacgatcgagcgaggaagtacatgattggccctgtggttgctgcagatggtgggtaggtagggagggcagtgtgggaagaaattaataaacaattattcaagtcccgttctttttctccaataaaaaattagataaaattttggatactcgtgacacgcttttttgcgaaaattttatatataaaagttactctaaaatatcaaattaattatttttttaataattaaaactcaattaattatatattaatatcaacttattttacacttgatcatcatcatcttttatctttatcttgtgtgggaatactatcatcgattcaggcaggggttgtgtgtaaacataatgcatgtcagcatgtggcgaggagggcaatcacgtgtactttctcttttaaaagtcatacgtattctgtttccgacggatactgtaggtaatctccaccacgtacctccaccaccatcatgaagcacggccgggcgtacggaggaggaggagcgatcaagtctataataattaaaattaaaacttaattaactatatactactctctccgtattttaatgtatgacgtcgttgactttttaatcaacgtttgaccattcgtcttatttaaaattttatgcaaatataaaaatacttatatcatgcttaaagaacatttgatgataaattaaatcacaataaaataaatcataattatataattttttaataagacgaaagatcaaatatttgtcaaaaagttaacgacgtcatacattaaaatacggagtgagtaataactttttcgttttatatacatcaacgtaacttttatcttcatcagttttaagtccaattagaatttaactttttttttcttggatgaatggagtaatataagtagtactactagcagcgatgtggcctaccggtatcaacgtcatcgataaatggtatgtttgtccggcctcgctgctgtgctgcatcagtgcatcctcatgtatctgcgtcacggtcactggctcactgccaaattaattaaagtggttgctacaaaaaatgattcatcatccaacgatgccaacgaatgcatcccggaaaaaggagatcacgggaagggaaacattacatcattgcatggagacaccatcgacatcgagtcgccgtctcgtgtcggccatcgatgaactttttttcgaacctttttattttttttgaattttaaaaatgaactcttacaaaatttaatttcaaaactactccctccgtcccacaaaatcacaaaccctagaatcccaatgcaactttaggacaagtgacaaaagacaacaatgccctcaatacaagtacatccaatcattagttacaaataaaataataatacaagttgaatatctgcagccaacttgagtagagtagtacaagtagtacaccaatcatgggcaccaaatatctgtacaggccactaatccagcgcgccaactaatttgaatcaaacaacaccattgcttggcggcaagaaatacaaatttgagcacaccccagcacaagataccctataaaagctcaaaatgaaccattctcacaagtttccctcccaacttatcacttcatgagtctgcaaaaacaccaccttcatggctttagatctaaatgaactagcagatgagggagatgagcaagctgtgcctgaccttaatgaaccagtggcagatgagggagatgagcatgatgtgcctgaccttaatgaaccagtggctacagaagttgaaatgcatgttggtcaagaggaggatcaacttggaggtgatgtacagggaggtgccaaccataaccatccaggtgaccttgcaagcaagaatagtaaacgatcgatctttgtacatatgacttgcataaatcactctaaatctttggcatttttttttaaaaaagataccatgtgcattgatggaactgctatgttcttggttttttttctctttgttctttaccagctcgattctgtgaatgagttgggcatattgaagttcattcccttccataatatcacaagttatacatgtatctagctataactaatcaaatagtgctcacatgatgcttatcttctgtctacgatcaatcctcatatgctagattctacatgtataatttcctttacagtaccactgatattgagctagtattagtatatatcaaagttagattgcaccttcaatacagatcacaaaaatccctgaacttcagcaccaaagtttgtacaatgtagaaaagtcattcaagtatggccataatataactagagcagcaaaatacccaatggttctcctgactacagcacaagcaccttttgataaaatcacaatcatgaatagcacaagttagggaaaaagaaacatgagcacttccatgagtttatttacagctgacatggacctctattgaaaaacaaggtgaagagtacaataacaaaataggtagacaacaaaactaaatttgagatggatataaaattggtaccttgattgtggttttcagatatgataatctcctttgctgatgttgtactgcacaaagtaacctatattaatcattggttccattatatatatagcataacagatcagttattcatagaagtatttggctacattggaagagtagtataagcattattacttttagtcacacatatccagttagccaatatgcatggcatgtcaaatagcaagtatcagcactaatgattggttgtaataatgcaatgtgtgagctatctgagtataatggcccataattattttattgtagaatgtaataaaatagctgcaatagtattgtacctaacaaaatattgatattagacttggtactcacatggtaattgttattgtagacggtgccgatgccatggatgaaattctgcaaatttatggaggtcacaaccaacatggctttccttttgatgttaactctgatgcctatgaggaacatctacaaatgcaagcaggtaaagcacttttagctgacatggataacaaacttagtaaaattaataaaatgtggttgtacataaagcaccactgaagaataagattaattaactgaaaccatgtttttaattagaagatactaatatgacatcatgcgaactacctagaataatctaaacataacattggatgcattagttgcaaattatggactgtcaatttgacatttcagcacataaagtaaattgtgtcaatgtttctatgtccttctgaaatctaaaatcagccataagtttacaaccatgttgatccatgataataaaatatccaccatctaaattggtacagacgactcaccttgtaattgttgttgtagacatgcaggagtacggtgtgtatgctggtgatgtggaaattgtttttgaacaagaggagttggatgattcagatgaggaagatgaacatccaaacaaaaatcttaccaacatacaaaggcaagagatatatgatgcattggttaagaaaactatcaatggaagactaagaaaaaaagcaacaactgaagttgctgaaatgttcaatatcaaaaggggtagagtgcaagatatttggcgaagagcaaagcagtgccgtgcacagggaattccagtcaatgtaagttctagaaagaaaactaattctggtcgcaagaagaatgaaattgacttgtcagatgttgctaatgcccccctgcaactaaggggcacattacggtcatttgcatcagctgcgggtataccaaaaagcacgcttcataggatgttgaaagaagggctgataagacgtcactcaaacacattaaagccattgttgaaggaagagaacaaacgatcaaggctgcaatggtgtatttccatgttagattggcatactttgccaaatgaaccgaagtttgttgatatgcgcaacattgtgcacatcgatgaaaaatggttcaataccactaaaaagacaagaactttttacctggtccattgggaggatgatccgtacagacccgtgcaaaacaagaattctattgataaagtgatgttcttggcagcagttgctaggcctagatacaatgaagaaggtatctgcacttttgacggcaagataggcttgtggcctttcaccaaaaaggtattataacctcttaatatatgcatttttacttagtgatgtgatgtgaaacttaattgcttatctaacttacttaatgttatatacataggaaccagcacaaaggacaagtcaaaacaggccaaggggaactctagtcaccaagacaatcaaggttgatcgagacaccgtaaggtcgtttctgattgctaaagtactaccagctattatatcaagttggcctcgagacgatgcacacagcactatatggattcagcaagacaatgctcctgctcatgtgccagtggatgattatcaatttgcctatgcagtatcccaaacagggtttgacatccgccttatgcatcagcctcctaattccccagatatgaatgcattagatcttgggttctttgcatcgctacaatcattaacatatagaaggatatctaggaatatggatgagctaatacataatgttgagcaggaatttcaggcctatgatgacaacaagctaaatagggtgttcctaacactacaatcttgcttgttagaggttatggaagctgatggtggaaatggatacagaatacctcatatgggtaaagagaggctagagcgtctggacattctccctaatacccttagttgtggtcgtgaactgtatgaaaaggtcatatcagcattagccaatcaagtgcagtaaattatgcaaaatgggaaggtctatcgtagtttcagcttttggttaaatgtgatgttgtatatatgataaagtaatatcagtattactcaagtaaatgcaactaatcatgcaatgtggcaagttctatgatggtttcagcttttgtaatatgtaatatgaagttttatgatggtttcagcttttgttggctacatttcagattgtatatatgacaatgcagtatcagcatttgagtatcatgtcatgtggaaagttttatcatggtttgagcttttgcctaaatttcatcctccctccgttcccttttgatcgacgtattgcaatcgtgcagcgagaccaaggtgaagtaaatttctcccattatcatttaaagcccacctcataaaaggcacaattagcacttcagttacttgcatgcaaaacggaagagagagagagaccccgtttttttattaaaactagtgcctagtatgcgaaatgaatggctagcgtctccttgcatgcatgcaaaaattaaatcagcatgcaaatctaagagtcatggccaccgtcctaggctaatgcgttgatcaaattggaacattttagttttacttatgcgctgatcaaaagggaacgagggagttttatatatatgtcacaatgtaaaatcaacattacatgcatcatcataatcccctaatctcatccagtaccacaattacacatgctttcatacaataccaaaagggtgcctactttaacataccttgttaggttgctattcataaccacctaatctaaagtactaccacaattacacataatttcatacaataccaaaagggtgcctactttaacataccttcttaggctgctatcaataaccacctaatctaaagtactaccacaattacacataatttcatacaataccaaaagggtgcctactttaacataccttcttaggctgctatcaataaccacctaatctaaagtactaccacaattacacataatttcatacaataccaaaagggtgcctactttaacataccttcttaggctgctatcaataaccacctaatctaaagtactaccataattacacataatttcatacaataccaaaagggtacctacttcgaggtactttgttaggccaccattcataatcaccaaacaggcacacaatcaacacataattgaagcattcatctaaattttttactatgaaaacactctagaaatttttttaccgatttttccagtgcgtcttggtcttgtaggagttcttctaggccgctatcatcgtatggatcttgcgcatatcccccaatgaccatatcaacatcatcatcgcttgacttgtcctcgtcgatgctaacatctttagcttttcccctcttctccttcatgtcagtttgcgtgacgcttgccttcttctcgaacatggccatgtggtcgctatcatctcccaacatagtcctgtaacggataaaacacagtgacagttaatacaagatgggatgtaaagatgaatctatcatggaatcaaactgaaatgtacttcgattacattatatattcgatacatttttttaaaaagatagtgctgacccatgtaaataagcaatgtctaaattgaagtatagaccaaatggactactgaacgcaatgaaagccaaaagtagagtacatcagtttatatatgcgtggcctagttaaaggatcaaatccagtgaataatagaagtataacaatcgaaaaagatttgcagaaatcaaagtatagcatccacggtaattctcgtagaacaacatcaaggttacctagttaatttaattagctatgaatgacagcctaactatctgtgggtgcagttgtactattggagcaagttgaagcttctcaacgataggtttcagtgttaaaatgaacaagtcaagcaagcaacatacgctggctaggtagctgcagccaacaaagcgagtacgacgagctgcattcaggagtaagtttctttactgatattgaaacaagtcagaacaaaataattaaccatatatacttagtttttttaaacaagatgatcaatcaagcatcatgtcctacacgtcaataatgttttatatttaaaaacagaggtattaatattcatgcattacagtgtcaccacaattttggatttttcatcagcctcttgattgagcaataaagcagtcaaaaaaaactttgagaaataaaattcgcatgttcagtatcaaatttcttacagtttataattgtttcctatactcaataaaaatttctaatttcagaatatacctatgggcaacaaaacagaaaggaatgctttggttaggtttaaaactgcttggatttttgttaacactaatttattttatttgaaacatgtcatcataacccccttctcactccatgccaaattttgcacaaaacaaaatgtaaaacccagctaacccgcattacttcaacattggtaacactgaccgacatataacagctggatgattataaagatacaaaacaccgaataacattaacctaggatattctatgcagtacaatcaaaaaaattttgggatgcaaccgcacccagtgcatctgatctacacacgtcattgaaagcatctctcattgcataaggggaacagattggttgtagggaaaacaaggtgaagatacctttgagtcaatccacgcatactgccgccaaagtccctagctgttgccaccggaatcagaacaggaggtcggtaagcctcctcctccgccgacccctcctgtatcagatccgcgcgcgccgccacctccttgaccatcacatctgccgccttgcaaatctccgatgtcgctgccgcatctgaactggctccacccgccgccgttgcctccgccgccttcttgcaaacctccaaggccgctgccacatctgagccccctcccgccgccgccttttggatcaaaaccgcaagctgatacgcctcctccgccttggctttcgtctcttgaatgaaaaccctaaactgttccgccgctgcctcgaactctgccatcgaggcaaatccttcgaaaggagccgcctccggcatcggatctaaccgctcgcaaccctcccccgctgtatcgaagcgcccgcatcctggtggatggggaactccgcagggagttgcggaagtgagggggagcggcgtggagcggggagagatgtgtggggaggagcacgacggcagtagggagggagtcggaagcttcgaagggtcgctcatctggacgccgccgcttcgacggaatcgatccgggagggggtgagggagcgatggagagaaacgcgagagagagaggcgacggggcgatggaatcgatccaggaggaacgagagagagagagagagacgcgacagaaaaaaaactgggatgcgataaggtttgcgtggtgtgaacgagaggatacgcggtccacctatggcccacacaggatgagatagatgggaagtttctcgttttctgtccagaaatcggtttttttcgggacaaagctctccccccaggattcgtctctttctgggacggagggagtagaccttttaattgtattggctgatctgatgtggtgaaatactattgtcaagtcaaatgaggatgaacatgatagtttagtttcgttatgccaggcgggatggcgtggttaaaagttttaaattttaaaaataagttttaggatgtttatttaaaatttaaacacaaaaaaggttaataataaaaaaaatggccatcctattcatcaattcatgccctgttaccttgttctcgtcaacccatcggcagcacaccaccactacgtaccagctaactcacgatttaattcaacatcgtggaatatagttcaattgcatcaaatcatatcttctgctatctagtagctgtctgaattgaagaagggaaggctgcagcgaaaggaaagcatgatgctcacgttttatatccacacgtcttctaaactgctagtatgtattcataaaaaaagttattttaaaaattatattaatttattttttaaatttaaaataattaatactcaattaattatgtgttagcgacttgttttgttttgcgcatattttcagccttctctaatactcttctctctaacacaacctgctgtgagagattgcccttaaattatatggttctgcagatggcgggtaggtagggatggcagagggggaaattagctgtactatgtaagtaactcctgatcaggattctcggacaacgagggatcaaattaacaggaattaacagttggatcgtgtggcaaggagggcaagcacgtgttcttttctccaacaaaaagttggatgaagattaagatttttgtgacacgtttttcaaactgctaaacggtgcatttcgtgcgaaaactttctatacgaaagttactctaaaatatcatattaatctatttttcaagtttttaataattaaaactcaatcaatcatacgttaataccgcctcgttttacgtaaaaaacttaatcttcatcttcatcttcagaagttttggtcctacgtggcacacacgtggcagtccagtcagcataaaaaataaaaaatggtagggcacttgtcagttctgcttcttttctcggtcaccacatgcgggctctaccttatatatatatattttaatgctgactagactgctacatgtgcgccacgtaggaccaaaaccgctagcattccggagtctgtcaggggataattcgtccgtataaaaagttgagggtgaagaatatctaatttttaaatagagatggataattcgtactgccacaatagttcaagcgtaattcaaactttttcctaaaaaataggcccgaaaatcatgcctctctagcaatagcagtgccctttgcaaaatgttagaaatttgtcatgtcatcttaggtgggctctccttcaattatttgtttctagcgatctgtttcgtttttgtcacgttgcaaacgacctgcgagcgctaggttttgggcgatcgcgcatcactgggccatcgcgtcagcaaggtggacgcgagtgcgcgccagctgtcggggcaaggaagggtatcgtgagggttccattagctgccaggtcaatcagtcacgccagagcattgatagaattgggcgtgtcggaatattagggccatgattgggtatatgttggaggctgtgttttagacataatttccaaagtaatatagctttaggtaacatgatcggttatctcttggagatgctctaaaattgaaacattattacaaaacactatgccagaatggcccgtttgatatagctttttgctggattaaccgatttgcttataggagccgatactcaattagcgcatggtcttttttgagattgaaaatgatcatttttgagttttctataaaacttttatataatattttgttttaaaaaaaaacaaagtgtttaatggtttgaaaagtgtgatcgctatggtctagtagctagaatttgaaaagaacacgaatggccagtttctctctgttttgttttggtgaaatttgactgtttctcatatttgatagttcaatcaataaatttagtcacgatagataataaagcatagtgaatacaatcgacttacatggaagcatacaaatgctctttctaattaatacaaaaattcatgtaaagctcacattgtgcaagggcttggtgaaataataggataaggggtatatatacaataacttttcccggcggaaaagccatcatcccaagccatatgattaaaattgttctttggtggatacgtgaccttgatgaattttttgaaagttcaaaccttgaaaatcttaaatccgagcacaatcccattttgacaggttgattcataaatcatcaaaattctttacaagtgtgcagaagttttagatcatgcatttcctattgaattctgtgatcgcccgttctcatccatataccatctgtttaatctctctcgagtaatctctacctgaaaaaaaattaaacatcaagcacatcattaaatgagaaaaatatgctcttctaatgacccatgaattttctagagagacccttatattatttgaaaaaagatatttaatcagaaaagaggataagaaagaaaatatgagcagaggtaaaaaaaaggcaacctgttttttccaatcggtcctaagtgtgatgaatagaagcacaagagtctggactagtgttccaagaagcatgccgatccaaataccctacataaagaatgaacataagtgagggacacaacttaaatccagattaactagtgaaattctatcatacaaaaattccttacctttacttgaaatcctagcacatagcctagtattgcaccaagagggataccaatcaagtagtacgatgtaacattaacataggcaactatactttgccaacccgatccgatagcgacacctatatataattagaaaattagtaatttcattgttaaattttgaattactttgatatatacttgtccttcaaatggagtaacatacctgagagcactggttgaacactattcaacaaaatggagaaagctagaaggggagcaagatcagcgacttcatctgctaccgccttactttcagtaaatatgtatgcaaggcttccacggaagaaaaggaagagcacaaacaacacaaatcctatcaagaaagaagtggtgaccacattgaaaatggcaaacttagcccttcttgcactcccggctccaagttcatttgccacccgcactctaaaaatgtacatgcattaagtatatgtcaaatttatggttcatgttgcatcagttagatgaaccacgtagtgagtgacagctgagatcgtgaagttaccctattgcagacaaaaatccgatagaaatcatcatctcccaaccgttgatattaaggctacaaattttgcaagtgaaaacaacaatgttcaataagcaaccttttcaattactagaggagacacacaaaacaatacaatgatatacatgatacaatatgatctggttgttgttttctaaactaatatgcaacagattggagtggaatatattaccatatagaaagagcatcaagagcaacctctgcattcttcatataactagtgaggagcaccaatatggtgttgtaccacaattctaaactgaaaaggtaaaagaaaaatgagaataaattaatgagcttctaattatttgtataaaagaacttgattaacaattagcatctaaaatattaactttctatttgctatcatcaattttttttgtcaaaaatttcatatatacatataaacataaccatgttacttaccaaagcatcactccagacgatagcgaaagcttcataatagcaccaagatcagtaaaagcagaggatgagaaccctgtccatgttagagggcaaccaccaaagaagacaaaagcgagctggccaaacacagggatccaaaaggagatgaccatggatcccatgaccccagcaagaccaagttggaacttgactgttaggagtcatgacaagaagaggtgaatcccaagattgaggaaggcaaggtaagtgacaatcatgttcttgctctgcgcttgtaggtacatttggagcgtgaatgcccatatgtaagagaacattacggggatgtaccatagagagatggtgccagcgacagcagagatctcagggtcttgaccaagagcgattaggagtggagttgtgaagatatagaccgggagaaggatgactgcacaacagaagagaactagccatgagcgttgtagatagatgcccaacatgtgatattgcttggcgccatatgattgtccacacaacgtttctaatgcgctcgccatgccaagctgcaatttacaacaatgtgcatatacggttaatttgtagtatatactgtttttatatgcatatcaatagatgacttatagtgcaaattaatatttagtaaaaagaagttttcataggagtgacttgtagtatggtctggttatgttttatttgtatattccgttcaaaaaatctaggtaaagacttttgctattgttgcacagctagtagacagaggtagtacaaactactttaattactgaagaaaaaaaatatatatcagaagatccaacaagaatacacatgaaaaaagacccggcaaaaagaatacatgaggtagatgctatatactccttccgtccctaaatatttaatgccgttgacttttttaaacatgtttgaccattcgtcttgtttaaaaacttttgtgaatattattaagaaatttgagtagtagtagtatatttaacaatgaatcaaatgagaggaaaataattaataattactcattttttaaaataacataaacggtcaaacatatttaaaaaagtcaacggcgtcaagtatttagagacggaggaagtactaattaatgtctggagagaaagccgtgcaagggaaggatggctaggtcaagagtctacttcaaagttttactagtactttgaaaatccaaggaggcaaggtctcacatgattaattttcttcctgcagtatgtactatatccattttttttaaaaaaaaaatcgagcctatagcttcttagctatagtacaacaatgctggacaagatcgaacactctgttttgaacctataaagacagcaactgaacatccattgtttgtctcaattaatcgatgggcaaattaaagcacaacaaaaaacttccagcgcgcgcggcgctgttagtctctgaatcggcacaattaagtcaaaacttaacgtcatcaaagtcagcttttagaaataaaaaacagctagttgccgaaaacacgaaacaggtaaaaagaaagatcaatttgaattgttacaacgtagtaataataatttaaacccaaaactgtgtaatgataactctgtaataataagtaaaaagggaatcagcggcatgacttaccaggatgccattgctgaagcgcatgaggacggtggagacgagggcgtaggcggcgagctcggtggcgccgatgtgtccgatgaacgcctggctgatgacggtgacgccgaaggaggagaagcgggcgcagatggaaggacccgccaccacccacagcttcttgttctcctccaccactcgccgcctcaccgatccaacctcatcctcctctgcatcatcatcttcctgatgcttgtaggtagccggcttaggctccaacagaggaaccgtcagcttctcatcatcacccggcttctccattttgctaattaattagtggcggcttgtagtttgcagcaatggagatggagtggtggtgcttcagattcagtagcaatggcgctgctggaggaaagggaagcatcaaggatgctcaagtatggagctactgatgatatatataaagggagtcgaatggaagtacaggagaagccgtgggttggtaacttggtatggcggagggcagaatcgggaattaacaggacttaattaatcgatgattattaattaatagtgactctagtctagttgatcagatcaatgtatatatccagttgagaatattcaggatcatccatatacatgttgagaattaattagcaatagtaagtggagtaagaaggaagggtgagattcgatctggggttttgtgtacattgtactatgtggcaatgagggcaagaacgtgtactgtatatagctttgctgcctgtagttgtagactgtaaagacgcgaggttatacgtacgcgtacgcggtacgacggcttagggcctgtttggtacagctccagctccaactccatctcttctggagctggagctcagccaaacagtttcagctccactaaaattgagagtggagttgggtggagctctctcacaaaatatattagagttgtggagataggtttaggcaactccataaatccactccagactcaactcctagagttatatttatatttaggagttgtagctgtaacaaacaggcccttatttgcgaatgcggggcgtcggaagaggccacatagagatgctaggtacccgtacctacagggcaccaccagcaggctgcatcgtgaagcacaggaggccacgcacggcggacgtaggcggccggaatagtagctggcccgccgccgtcagcttaattcgtcaataaaatataatggacgtttgtccggcctgcaatcggccactgcatgcgtgatgcatgcgtcgtggtcggtcaatgtccgccgaaattaaacatttattcctttcttcacaaaataagccaacacgtaccaaacgagaatggtttattttataacagaaaaataaaccaacttgtattggatgagggtggtttatcttgtgacagagattgtattttatacaaaggttttttaaacctggcaaaacggtgtgtattttaattttttttaataaagacattgtttaaaaaattatattaatttactttttaaagtcattttaatcatcacttgtgataagggttactctgttttttttatagggacaaagtgttccgaaccgtgtggttcgaacacagcagagcgtcgtggtcggtcactgtctgccaaataagctcccgtctcggtcattcaactcttctcgtcgagccacactagcagtaacaccagtctagcacgcctgcagctaaccatacttatatcctttggtaggttggtcacgtgccgtctatttaggttggtcacgttcttttctcgtgaagctactccctccattctcgagaatatagagattttaacatctccattctcgagagattttaacattttacttgcactgtttgactattcgtcttatttaaaaattttaaaattattatttattttatttgtgacttactttattatccaaagtactttaagcacaactttttgttttttatatttgtacaaattttttaataagacgagcggtcaaacagtgtaggtaaaatgtcaaaattccttatattaggggatggagggagtaacaaatactagtactaagcagtacttggatatacactaaacagcaaattcatgattttttaatatttatataaggatatggatgaatgaattaattataaagttaaaataaatttaaaacaatattaccataaaaaattaaaacaatatcagaagaatttttatatagaaagttttaaaagccgcacaatttaaaagcttgacaacgtgccaccgttaatccgttcatcaattactcgaaaatactggagcagtattatttatttgtttacaatgtaaaattttaatcacaacaatcgtatgtattttgctactcaaattccctatgccattgtgttcagtggtttggatgcgtggcacattttactcttgcttcgttgtgtattacgagaaaaaatactttgtcgtgcattataagagagaaaatatcaaaattggtggtctttatcgacaaactcgggctacttgggcttgggccatgaagaccagccatatatcgcacctaattccatatttacatatatatactatacagtatataaagagaggagaagcttggcttagcttacattaaaaagaacattaaacgagaaaaagatcatgaactctgtttcatggaaatatttttgcttgggacttgaaatatttgaaagcggaatggttttatttttgataataagctcccttctttgttatcctgaaggcagctccttaagcatgtgtttggtttagggatgggttaggatgggatggttttatccctgatttttggaatgggatggttctgtttttgtttggttgaagggatagaaccacccctattttttgtttggtttgagggatacgataggttggaatgatcctatattttgtttggatggagggatgaacatgggatgcttggatacaattacctccacacattagttggtgaggttacctctctcatagtctacaaactacaaaataatatttctacatgatgaccacactatatcaaaaaaatgaaataccatccatatcactatatttgaaaataagctccagcaacttcatttcagcatactggacaagctaccaaataatgaacaatactagcagttccataatcaacccctcaaaaaacaatcacacataattagctcacatctgatcccatttcaatccatacatagagtccaagccaaacataataagaagtttcaagtcgtgcacataatagcaaattaaggtcttacacataatagcaaatttaagtcttgcacctaagagttcactgcctacaacatattggcagtacaagtcatacatgaccatgggcccaccggcaacacataataccaaaagaactacccaactcatctaacaacgctacattgatccaggaaacttctcattaatgaacaaatggacccaatgtatcttgttttcgaaaggaagtccatcaaaagctctaacaatgtgagggttagcaaccaaatgagcatagtaaacagatacgtggatctcctcaaacccaggaaggcttttcaaggtttcaaataaaccatctggcagtttattgtctggctcagcgacctttagtatagcagaagctaacttgtcaccaacactggtgaatgcaccaatcagccc

SEQ ID NO: 62634 - DNA, 14961 bp, Oryza sativa
caacattttgaaacggagagagtagtaattaaaacttaattaatcatacgttattaccacctcgttttgcgtcaaacacttaatttgtcagggttatagataccacatacctaatagtagttgactaaatctcggcaggacccaccacataccatgtcttatacggaaaataaccttcggatataggaggagttccacataaggaaggataagtagagttctacatggaaacgacaaggactactcggattgtatccatattggtttccctagttctacttggacaaggggacacctatgggtataaatacaaggcccctaggagaagaggggacacggaacaatagatcaagacataagatcaacatacaagcaaacatacgctaagacaagacgccggatatcgacttcaaagataagcatggctagtcccctacagtatctacggatactgataggagagacatagcgttgtctttgatctcgccggatgcggattcgagtaggaaggctaccctattgtcgactacgagtcagtacttcagaccgccaagtcgacaacagttagataggctaccccaaatattgtactggtgtgattatggtgaataagagcaacgaccggcttcggccaacagaagtagggttattacctgacaattcaggggcccgaacttgtataaaaatcctcgtccccatctcttttattacaatctcgcatatatcttagtaccaacgatccccatactatgcaaataccggaatcgcgacatcaaacgtcgacataatcttcatcttcatctttgcgtaaaacacttaatcttcatcttcaggagattcaaacaccaccaaagtctctaaaactatctctttggtagtattattcagaatgcaaatatgcaagagaattttatttttaaagcttgctaaccatctgtctatatttggtgatctatgctgaaagatatgagaattacacttctttcaaagataccagcaagcaatcattactatctccaggaaaccttttgtccgaaaacataatctggcaaaaactatcatctagtaaaaaaataaagaggtgttccaccactctttagtgtggacaattttcccttatttgatactagtttagtcaataaatttagtcaaatgtagatacaaagccaaagggtacaatcaattcacatgcaagcatatgcatgctcttccaacaaatgcaaaaaaaatatgtaaaactcataatggtcaagcatttgctacaatagtttcgataacccggtaaaaatggataatttacgaccatatatatataaggttccttcaataacatcacggtttttccatggtgtgacacatggggaaaaacatcattccaagccatttataggttcattgaaggatgatgtcaccttgaaggatcttaaactctgagggcaatcccattagaacaagctgattcatagatcaccataattcattacaagtgtgcagaagttttagatcatggattttcacccggattctgttgtctcccattctcatccatagaccagcggtttaatctctgtcgagcaatctctacctagaaaaaagaacatgaaacacatcattaaatgagaaaaaaaatctagagagacccacatgctatgtgggttaagagatttaataaaaaaaaagataaggaaaattgtgagcaattaacatacctgtttttcccaatcagttctaagagtgataaatagaagcacaatagtctggactagcgtaccaagaagcataccaatccaaatgccctatagaaacaacaaatggaattgagaaacacaatttaagtcccaaattgactaatgaaattttatcaattggctcctcacctttacttgaaatcctagcacatagcctagtattacaccaatagggataccgaacaagtaatatgatgtaacattaacataggcaactacactttgccaacctgatccaacagcgacacctacagatgattataaaatattataattccaatgtgcaatttcaaattatattgatatatatactattcttttaaatggaataccatacctgagagcactggttgaatactattcaacaaaatggagaaggctagcaagggagaaagctccgcaactgcatctgctactaccttactttcagtaaatatgtatgcaagccttccacgaaagataaggaagagcacaaacaacataaatcctatcgagaaagaagtggtgaccacattgaaaatggcaaacttagcccttcttgcgcttccagctccaagttcatttgccacccgcactctagaaatgtacatgtataggtatgtcaaatgaaatttatctgacatgattgattgatcaaatgaaccacttagcatgtaacaagtaagatcactaagttaccctgttgcagataaaaaccctatagaaatcatcatctcccaaccattgatattaaggctacatatggaaaaacaataatgctcaataagcaagtttttcaactgctaaaggaacaacaaagaacaatacaatgatgtacccacaaacatgatctaccttttatggggcaattgcaaatttaccactactttgaatcgttattgcaaaactgccactagaaaattgcaaaaatgccattagaactgtcatttgagtggcatccttgcaatattgaaaaaaccagtggcaaatttgcaaataccccaccttttattgtctaaaccattatgcaacaattgaaagaggaatatattaccatattgaaagagcatcaagagcaatctctgcattcttcatataaccagtgaggagaaccaaaattgtgttgtaccataattccacactgaaaggcaaatgagaaagaaaaaagaataaaccacatgagcaattaattagctctaaacaatatgttggtcgacatttagcatctaacatattgcatatctgaaatttcatatgtatgcataaacacaattgttacttaccaaagcatcactccagaagacagtgaaagcttgacaatagcaccgagttcagtaaaagcagcagatgagaatcctgtccatgttagagggcaaccaccaaagaagacaaaagcaagctgaccaaatactggaatccagtaggcaatgaccatggagcccatgaccccagcaaggccaaggtggaactggaccgttaaaagccatgataggaaaaggtgaagcccaagattgagcatggcaagataagtgacaatcatgttcttgctctgtgcttgtaggtacatttggagcgtgaagttcccaacattggatatcataacagggatataccacaatgaaatagtgccggccatagcagcgatcttaggatcctggccaagaaaaattaggagtggagtggtgaagaggtatatcgggaggaggaggactgcacaacacaagagaactatccatgaacgttgtagatagatgcccaacatgtggtattgcttggcgccatatgattgcccacacaatgtttccaatgcacttgccatgcctagctgcagtttacaacaatgtgcatttaaggtgagcaatttataatgtgtttttatgcatatatagaagataagattacatctagaaattaattgttagtaaaagtctaaaatataaagaggtcatcattacttgtagtaaggtatcttttgataccaaagtctgtgattgagagcattgatagggagaaagcactgcttatggaaatagtcagatatgatcaactccaaaaacaattcctggctgcttggcataaggtttgcagactaagttaaaggagaagaggaggccattaacttgacaatccaaaataggcaccgctcatgaaacacttgaacaaattttataacaataaggacttgccttaggtaaaactgatttagaataagtattatgtctacctagtgcctaatttaactatcccaaaagagtccttctggtggaatgatgtttgtaaaacaagcatccactttagaggaattcctagatgtatcttacataagggaactgcctgcaccttctaggaagatatgtggtctcactagccacctccatgcaatgtatatctaaggctatattcctttgcttctaataaggaggcctctgtcaaagtgtttgtatctactgatctggatgataattttaatctgccatcatctcggaaaacatatgatgaggtttctcgatagtcaaacaaactcctaaacttggaattggatcacactgctgatcagtggaagtatatatggggaaacatgaactatgcctttcagaaattcttctatctgatctttaattacatccgtctagcctccacattttatttggttatggaagagtaagtgcacttcaaaagttaaagtttttggattgctacttcttatgaatagattgaacacacgatatatgcgagatcataaaaaattgctccaccaaagtatgacctagtatgtgtgttatgtaatcaaggggtcattgaaacaatgcaacatttgtttcacacgtccattttcatcttcatgttgagcttcaattggatttagttggaataccgtgatgggaacttaaattatgatggctaaggctaaaaaccaatatgtgggttacagcttcatcgataaattcttaacttctgtctagtgtatttggaagataagaaataacttcatcttgagcagaaacctcccaccttttcttccgggagatatctgtttaagactgagctcctccttttaatatttggactaaatgaggagataaagatcaataaaatatattactgtagggcctccctccctgctgtgcttccttaaaaaatatctagatatataaaaacttggcagtctgctattgttccagagctagctaacacagatatcttacgagcttatttgtacttgaagtcatgaagagcacacaagtatataactaatgcataaagacaatgcaatgattaagagggggtggctgaactaagagtccgcttcaaacattaagggatgctttgaattagtcggatggcccctttctaaacaaaaaatacataggtctcacataatttagttcttacagtacgaattgtgtcttttttaaaaaagaaaatttttttatgtgcctctgaatattttggatcccttccgtgacattaaatgttgcctcatctctctgacatgtctgatatttttttccccatcaatacactttccattactttgaccgttagatttttttttctaacatgactatatgcccacactatccatttctcatagactcgcacttatgtacactttaaaatataaatctcaacttgaaaaaaatacagtaaaaatcaaatcgagcaaagtttgagagttatttgatggaaaatttggaaaacaaagtttaaattagtttaaacacaaaatgtaattaaatagtattaagtgtagtgggtagagaggatagttacgaggatgccgccgctgaagcgcatgaggacggtggagacgagagcgtatccggcgagctcggtggcgccgatgtggccgatgaaggcttggctgatgacggtgacgccgaaggtggagaagcgcgcgcagatggaaggacccgccaccacccacagcttcttgctctccaccaacacccgcggccccaacgacccaacctcctcttcatcttcttcttgcttgtcgttgttgctgccttcgccatgagcgtgcttaggctccagcagaggagccgtcctgcagtcatcatgttcatcacccggcctctccatttctcctagcacagcttggcttagctagctgctgctaactttaattgtgcaggaatggagcgaattaattaatgggaataattgcacttgaggggaagaggagctatcagaattgatgaagggaagcaggttaggaaggctctcagctaccgttttaaaggagattgatcaggtagctgggttgatggctggacttggaccagagagttgagtgagcaagtacctgattgtccctgtggctgctacataaggtgggtaggtagtgagggcaaggtgggaaagtagtagtaacactgactcgttaatcatcgatttaggaatcagcattccagacaaaaggaaggaccaataatatagcgagtatgaaattaattaacagtgactgtcgtcatatatactacagaactatcatccatccaggaatctggggttgtgtgtagtgttaaatggctcaatgcaagtggattgtgttatgtacgtatacacaccagggttcgacttaccgccggtaaccgcgcggttaccgtggttaccgggcttaccgcgggggtacggtaatataaataccgcggtaacctccttaaatttaaataaatttaaaaaataatttgaatttttgataaattttgcacggttttgtacggtttttcacggttaccgcggttaccgcgcggtaaccgtgcttactgccggggcgcggtaactctggccccggcgatttgggaaaccccattacacacaaacggcggagcttgcaagcggcgtacagagccagtaattaacttacactataaagccttaagaagttaaagctattttttacttgtaatatatatatatatatatatatatatatatatatatatatatatatatatatatatatatattaagcacatatacccatatagtgacacaaattaaacatttatagtatgatagataataaataaagcaatttgtaggttgcaatataataatttattctctataaataataaacgataatataattacaactaaaaaggccatagtagaaataaagtggtataaataccttataaataattgaaactataattcaacaatgaattgaaatcgatagaggcacttctgtgagactgtgacctacgtaccttcaggatccaggaaacacagccgcacaggcagggctgcaggcaccggcagcttggctgatggcgtctcgctccgtcgctcggcgcgtaaggaactagggcattcgcgacttggggttcggcgacgagacgagtagacgacgaagcgacgcgcgctcggcgctccccggcctgggcgctgcgctatgatgtgggctgccgcctgggcccccttccggcctgggcccaggcggttgcacaaccggcctaggcccagggcaggcagcggctacgtacgtcatgtcgccggcccggtctgttcacggcagctatagttgccggacgtacgtgtcacgtgtggctgaccggcatccccgcttggcgcttgcatcctcaactcgtcgtggccaccaaaaccaaatgtaggacttcgttcatttgatgtcaaaaaaaaaaacttactaaaatttaagcaacttgtcaaaattttggcaggatttcttatatgctctagttaccaaaatttagcagtaaactaaatgtagctattttttttttgataactttaccaaaatttagtaaagttgaaaataacatcaaagtgaacaaactgtagagttcctcgtaaatccaacgataccacccaatatgcatctaagaactgggaaatgcatcttgacaaaaaggagatctcgctgcaaggacggcgttacatcattacatgtatgatcaggttaggttgtttatgccctgcagttcaggtaatacccacacaagaattgggtttgaaagtaacactagaaaagaaaagaacaaaataaggggaaggccggccgggggatcaaataacaattgattctttttttctttttttcctttttacatgcgcggtggtgcgtgcgcgtcacaccgccctttgaattttggttatcaaatctgcattctttttgttgtaggacttggtgatttaattaaatcttgaatatgcatgcatggagctgtaatgtataggtctcaccataatctctagagaaaatcccttatatacccctacaattttagctaatcccttctatatctctgaattttgtttacctccttgtatgcatccaaaatttgattttgatcccttctatacctctcccgtcagttgaccgtctaatttctataaaatgacaattttacccttttgatgaacatagaaatttataaattacattattgaaaatgtaaaagcttgctgtatgagactattatagttgtgtgtttattgtgcgatacattatctatgacaaaatttatttttagataatgaaataaaaaatatgtatttattttatttttaaaaaagtcataaaaaattaggagcatccatataaagataggactaccaatgctcacgatatatttttatgaatactccgataaaaaaaatccattgtcctattgaaatttcaaataaaaaattctatttattaaatttgttttattttcaaattttatgtcaaaatttcttgcactaattattttgtctcattagtttcgtaaaatgcacatattgtgcactcaaacaaaattttcaattgcttttcaagcatatattcaaacctaaatcctcaagggcataaaagacatttgcaaccaaacttaatagtgaaataaaggaaaatataacgggaagggcatggaagggatcaaattgaaatttcaggggtagagaagggatcaaataaatttcaaggatatgaaagggtttgagtgagtttttaaggctatacagggaatttactctaatctctgtggagtgcgacacgccatcttctttcgtcaagcaaccaatcgtcctaccgaattggctcatcatctatcacgccttccattcctcgtcaaatcctattaaattaatgcttagattttttttaagaaaatcctattaaatcatcattatcatcaattaattaattaattaatcaatgtgccattaactaagaacgtttaattgttaatatgtctgtccgggacgggagatgatctcacttgattttttacattttaactctttttaaaaacttattttataaatagacacttaaacaaaagacaacttcgacattgggcaaccgcgggcgcaactatgacgtccaaatctgtattagtcccactctatactctgagtaggccttccatgcccttcacatagcactctatttatacctttgttctcgtttctaaaagcattaacctggaggtactatatatgcttgaaatgaactgggtatataagttgacccaaatctatctacactctccatgtggagctcttccaccaaacgaacacttgggtctaaaccggaacaagaagagtcacggaccgaaacagactaaatgggctggattttacactctcactccctcatgggttgatgccctagcaactcaccgctacccaacagccaaatttccaggatatcccctcggtgctacggcattgtgcctatgcgtcgtgtccccctccacgggctaacacacacgcacacttgtgtaacacgggttgaagttctaatattacatgtaacactcgagagacaaaatcaacaatagtccactctacccgctaaatggacccacattcacattacacccaacttacacttttcatcatcacttttatgtaaaaatgttaaccaggaggtactatggttatatacacttccaatagatgttgattaaatgtgctagtatcaatttatgatttaggtgtatatatatcatgtgtctgagctataatatgcatgtttaattgcaaggtagttattgtcgacgtttgatgtcgcgattccggtatttgcatagtatggggatcgttggtactaggatatacgcgagactgaggtaaaagagatggggacgaggatttttatacaggtttggacccctgaattgtcaggtaataaccctatatcctgttggtcgaagccggttgttgctcttattcatcataatcacaccagtacaatatttggggtagcctatctaactgttgtcgacatggcggtctgaaggtctgactcgtagtcgacaacagggtagctttcctcctcgagttcgcatccggcgagatcagagacaacgctatatctctcctgatggtatctgtaggcaccataggggactagccatgcctatctctaaagtcgatatccggcgtcttgtcttggcgtatgttggcttgtatgttgtggtttctgttgttttgtgtatgttgattcttccctctcctcctaggggccttgtatttatacccataggtgtccccttgtccaagtagaactagggaaaccaatatggatacaatccgagtagtccttatcgtttctatgtagaactctggtcatccttccttatgcggaactcctcctatatctgaaggttgtttccgtataagacatggtatgtggtgggtcctgccgagatttagtcaactactattaggtatgtggtatccataaccctgacagttatatgcatttgttttttaaaaaaaaaatcttgcatatgctaattatgtttgtttgattaatgatgtaggagtatacatttttattacttgcttaaagtgcttgttttggttgaagggtagctatatttttaatttgttcctttttgtgaatcttggagatgtcaattgtgtttggttcactattcagtagtatttaatttttgatatgtgtttaagcactaaagtgactatttccttgtagcatagacatatccatttgtttgtttgtgtgaattccataattgttgattgtgctcaattcacaacttagtaggatttattttggtgatgcgtttcagccccaacatggatgtttgattccatactgaaatcttgttatggattgttgaacaattctaatgaaatcgattctcttttgtttttgtatatgttggaataaatataccaacttgatccaatatctcttgatattgaataatttctacccaacctaaaaaatgtggtgtattaattaattacacaaaaaagtgggatatacatttcaaaaatagatgtgtgagattatgttgtggtttatgcatattcttgagtgtgagtgcctcgcttagatttgttggtagccttatacactacgattgttctcaagagtaaggaattgaggttcttcgttttgatatgtagctcatgatttgcaccgcatcgtctgaatttcatgatcaacaaaaacatcttgattttaccttgtttagtgattaggtatgttctaatagcatttcttaaacaacatggcccaccttcgaagggtttgactattagttttattaatcatgaaagggatgaatttcattaatcagaggaaggtttttcacctttgttggtttctacatatctagtgtttttagtcatgtatcatataagatctatattttgcatcattgaggctatgatgccaggactactttattggttttagataagttttatactttggcacaatgtagaaaattccatcatcattcaaccagttactttagagtcaacctactagaatggtttccctggctaatcaaattagtaatacatggattgtggagctgacactttggaatttcgagggattacttttttttttgcattggtggaaataattcgttacagataactccattcagtgtggtcaatttttagtcttcacttatgataaacgatcacaattcttagtgacagtgttcgagccatcaggcattgacaagatgtcaacccactctactcacccttcaaaaaagatgatcattagaactaaaagtgatgaaagggaatgcaactatcacatcagaaaaaatggctcccgccattaaggagaataatggaaccgtaggaaagagaactagaaatgtagattgtcttgtgccttgtggaatatagggttccataaagaagttgtttgaggctaatgttttgaaaagtgataagagaaaatgtgcaggtccttctgttggtaagtctaaggcaacgtcaacaagccatagcaataccaaagatataatattcctctatttctgaaaatgttatatacactaatgtatttattttggcatagcttctcacatttgtttcattcatatagcatgtttaattgcattcttcatttgttccatgcatcaccataagttaggaggccatatgcagtgtcaaagcagtttttaatgtttgacgtggacttttggatatatatttgaccattcacgttattaaaaaacaatgcatagttatcatttattttatgtgatttgcttttatcattataaatacttgaagcatgacttacatttttgcatatgtgcacaaattgttttgaataaaacgaatggtcaatcatatgtccaaaagtcagtggggcgtcaagcattaaaaaccgaattgagtaattgcaaagagacctatatctagtctcttggcttgaggttaagttagtttatttctttcccttatgactgattacgaaagtcatttttgtacgtagttcatacatgttaagagtcctaagtattcacatgatcccccatcaagcttacttttgcacattatagattcctcaagctacatgtcagatgaagatatttgttttagcaagttgacaaagacaccagtactgatttgctttatgtctactaaggtgactccacgtggtaaattttaagttatcccctaaacgcagggttaataaatcacttttgtcgataatttaatgtggttacacttttcagacatttctaaggttctaagacatctatgagtaataccacaaaggcatgtaactgaagtagaaaaccatgctcttcaaagggcaaaagaatttaaaacctaataatcctttttaccgtgtaaataatgatatgttggatttttcatggtaatgttactttcatgtgttcattctcatcccgtattgaactttttttctatgtgcatgaggtattatctaaaaaaatgtggatgacaggattgatcttaacttgcataacggtactgcaactatagtttgagagttttggatgagatctaatttgaatatcccatcttgatgtttgatttttatgtatgtttattgtgaatgtgactgtaccaattgaaaaatcctacaactatataaatcaccaatttgtgatagcacattgtttttatgtcagaaacacaattttgtgtgatagcaaataacttgcaagattttcttggtgatgctagaagaattaacttccagcttctgcattatgaggcacatgtagccttacataactaagtttggtatatctaagtggccgtttggtcttatcgaccaatgattcattgaaattatatattagcgaaaatttaaacagatttttttaataatactatggccctaaagttaaacttctcaaactctttttaatctgctacagattgatatctaaatttaggacttactaggagatattggagacatatggccggtcaacatctccaaggtgatgggacgacagatggtggtgttggaatgagatggcgctgaccacgaccagtttgcgaggagggaggtgactacctcggtggggctatacaggtcccaccacacgtgtcgctgcggggtggggcacaccatctccttcgtcaagcaccccaccgtacccccgaacgggcccagcccacagcacgccttcctcgtctcatcaaatcctatcattatcattaatcaccatcattcattcattaattactgattaattaattatcattaatgactgcttagtaataacgagtcattgatttctgtatcaacgtttaagagtacaacaagagaagccagctataaacacatacttccttcctccgtactcgtaaaagaagtcgtttaggacaatgtttaagtcaaaccttgggaatataaatcataaataactctcaagttgttgagttcgaaaatgtaaaaaatatatgaatagatttgtcttgaaaaatactttcatagaagtatacgtatatcacttttcaataaatatttttatagaaacaagaagtcaaagttatgttttggaaaccgtgtcgttgtccaaaacgacttcctttacgagtatggagggagtattgagaagataaaagagtagagactagagagtagaagcagcaggctacagatttatagccagctatagcacagacttcaagacacaatgtatgtatcacatgtgggaccatgtattaatacggtagtatatgtttatagttaactattttatgaattagctattatagatgatttggagttaggccctgtttagtttccaaaaactttttcccaaaaacatcacatcgaatctttggacatatatatggagcattaaatatagataaaaagaaaaactatttgcacagtttgcatgtaaatcgcgagacgaatcttttgagcctaattagaccatgattaaccataagtgctacagtaacccacatgtactaataacggattaattaggctcaaaagatttgtctcgcggtttccatgcgagttatgaaattagttttttcattcgtgtccgaaaactcctcccaatatccggtcaaacgtccgatgtgacacctaaaaaatttttgtttctccaactaaacaggctcttagtagttggctatactattattaaacttgctccaatcttgtttaccgaatctggcaggatgggtgatgatgtccatgatccccttgtagatgtcgcagaagacgatgtcggcgccgggcagccgcggccgcagcgccgccagccgcgccgccaccctcgcgctgtacccctggacgagctcgttcgcctcctccacgcagctccggccatccacgacgtgcagcccctcccacatcacccgcggcgcgcaccccagcggcgccacccccatcaccgccgtcctcctcgccccggcctcgtacagctcctcgacggcgcgggcgacgcggtcggcgaggaggcgggcgaggccggggcgg

SEQ ID NO: 62635 - DNA, 1823 bp, Oryza sativa
accctaagggatcaaactaattttcagtggcatataaaggattctctctatcaagaagggagtataacgaattctgatcagcagatcagaggtctatcaatactactactccatcccagaaaaaacgaattcctagctatgaatctaaacacatatgtgtctaggttcgtaggtaggattggtctttttttttttaagacggaggggatacttttttttgtttttttctcgaaggtcatgctcagacaagaaagggcacgtttggatcctaggtaagggccaccctagccttgcctggcagggctatccgtttggaacttgctccctccgtccttaaaaaaaaaagacaaaccctgattttcgtgcccaacgtttgaccgtccgtcttatttgaaaaaattatgaaaaaaattaaaaagacaagtcacgcataaaatattaatcatattttatcatctaataacaatgaaaatacgaattataaaaaaatttcatataagacggacagtcaaagttggacacggaaacccagggtttgccttttttttttttgagacggagagagtagtaaaacagcctggcttttaggggcgagttagctctgcagggcgagaaaaaccttgctggctagggagagccgatttggctcgctttcgatggaaaatttcactcgcgcgaaaatattgtctgcgggcgacgcggacttctccggaatcgctgatattctctccccaatcaggagacgaactcattggcagcagctcggtctggaggcgatctcatcaacgtagactcctatatttgatttctcctttaggtgtgtttagttcacgccaaagttgaaagtttagttgaaattagaacgatgtgatggaaaagttaaaagtttatgtgtgtagaaaaattttgatgcgatgcaaaagttagaagtttaaagaaaaaatttagaactaaactcggcctttatcgtcagcttctaaccccttctttctcagatacatggtgtgctgtcttgttcaatcgctctgtcaggaagtaggtagagttagaaaagaggatccccgatatcgtttgctttgtgctagatgcagcctttgcgttgccaagatcatttattatgatggtacttgattaaggaattctcttgatttctcatttgtgaatcctaaaatatggttgcacatagctttgaggtacttatagactactagcaaaagaatggctatggaaaaaaaaaccattgcaagattattaacatgaccagtgccttataatttttagacaaaaaaaggaagcaaaataatcatgggcaaagcaagaatttgtgaaggatccaaactgctagccacggcaagactagtaagctggcaataagatggcttagccatgctgagtagggttgaaagtgatttagataattttcgcccgaccggacctttttttttggattcggatagtttcgatcggatatatccggaaattttcgaattcggaatttttttaaatatgaaaacgaatatgatataggttatatccgtcagaatcagatatctgtcggatattatccggtattttccatcggatatccgacttacacataagtctgccatagcccataacccatcccaactaaagaggacgcaaatcaaacttcttggcaaaactgaatttcgaattgaattttatgatactaaatgaactcatatgaaaattgtcaaaaacaaagttgcagaactcattaagatctactaattttattttggtcatttctctatccgagtttcattgaactatataaaatttgaattttaaaatataataaa

SEQ ID NO: 62636 - DNA, 1130 bp, Oryza sativa
ataaaaaataattcccacctaaaagagtaatttatctagggactacaactcctacctttttcatgtcatccaaattgccatacaaaattgtgaaataattaaacaactatgttgcatcattatatattatttggttagcatgcatagctaaattggatctataacatgtaagtgaaaaagaacaaatttaacaatgaataacataccaattatgagaaaatagattgtacctttagtcggatgtaacaatatccaattacctatgtcttttggaaatgtgctcaactgacgaaacaaattaaatcggctgatttttaacgtaagcgctataaaatatattatacattgccattaatttaaggactcagagagttttttaacacaagttttagtacattttggatggaaacagatgaatgttgatatatatggcttccatacctttcatatataaatataaatttgtctattttatacatgtagacagttaaaaatatgaatatatatatatatatatatatatatatatatatatatatatatatatatattaaatttgtttgatgctccatggtgcccatgctccaattatatccaccattcagctgctttaggatttgtgcactcaaaacacaacgtttgaatctgttagcgggtttaacccgataaaagatattcaatagctggtttgtgccatctttccatttatttatccctgcatgatttgcatgtatccatttccatataattatatttatatatatatatatatatatatatatatatatatatatatatatgaacattaataggctacaaacacgttcattcttcgtacacatgcagaagcaacattaaaatccatgtagacattacgatatactaaaatataaataaattttatgattagttacttaaaaatacaagcaacgctatactggatcgcgtgacaactccgataaaattgcagccatatataggacacatacaacgacatttttggactttagaaaataaagattttccttacataagcaacgcctgcccacttgagagatggtcagatggggaaatttgagtctagattcaagacacaaaacaagatgagcctcgcggacacgcccacgccg

SEQ ID NO: 62637 - DNA, 5858 bp, Oryza sativa
actcttttacccattggcatagtataactttcttgcttctaacacatacggctgccgctatttcggagtcatcatcatcatcatcatccgatccatatatgtaacgacagacatgattaacctttctaaagttcttcctggcttctgcgaatctctgttcatgcaaggttaccttctgtgcaagatgtgacaaactatcaaagtcttgagacgagaacttctccctgatcggagctatcatacccttaaaagccaaatcggctaattaggcatcagttaaactcaagctgtagcatttattcctcatctctctgaacctctaaatgtactcatgcacaggctcatcatgcctttgcttaatcgctgttaaatcggacagtttcatctcatgaatcccactatagaaatagctgtgaaaatgcttctccaaatcggcccaactgttgattgatccacatggcaaagaagaaaaccaagtgaaagccgatccagacaaagacaatggaaacaacctaaccctcaaggcatccacagccgatgcttcgctacactgagctaaaaaccggctaacgtgttcataggttgaaacgctatcttgccctgagaactttgaaaagtctggaatcttgaatcggttaggcaaaggaactctctcaaaccacttggggtaaggatgccgatacaaatttctagcatctttcggcttaagcccgaactgttctctcattacatctgcgatcatattggcccatggtcgttgttgaggcgctccttgtacttgttgtggcacgggctcaaattgattgtattgtggaacaaactggggttgagctggtcctcctcgctgatattgaacttgtggtgatggagactgatactgataattcaaattgcccaattctaaaaattcggttgtatattacgcaccaagtgttctggaacaacgtgaggtactaccatttgacctggttgcacattatgaaccaaatgctctgggacaacttgatttgcggtgtgctgccttagctgattgtcaggtgttgacatttgtggataagttttaaatacttgtgcagtagctccccacgccgcctgcacccgccggccgccggcttccgcccgtgcagttgctccccacaccgcctgcgcccgccggccgccgcccgtgcagctgctcccccgccgccgcccatggatattggagaagagaggagagagaaagagaggtggtgaggggagagaagaagaggctgacacgtggggctcacgtgggtcccacgctgagtcagctgccacataggacaaaaccagagtcaaaaccgtcgagggatatagtttgcatggttttgtaagttgagggacacatcatatccggttttacggttgaaggacgattttataactcgaccttcggtgtactttttccccatgagagtattagataagcggcttgcgttggtaaataatacgctcagtgagcccattaatactttacatgtcgatagcccatcaaagaacaatccacttgatctcggacttgcagcaacccaaagcctccttatgcaatatacttataggaaaaagtttcggtccctcaacttgtcatcgagttacaaaatcgttctcgaactgcaaaactggaaacaactcccccaacttacaaaaccaatgcaaactagatccctcgacagttttgactccggttttgttctatgtggcagctgattcagtgtggaacccacgtgggtcttacatgtcagcctcttcttccactccacctctcttcctctctccttttcttttctctcaggtctcagtagtgtagccagcgggtgggggaggcgggagtctagtggcggcagcggcgacgggagacgaggtggcattgaggcgacgacgacgcggcgtcgatgacgagcaggagggcttccctccacgccaccgcctctgccgccgccgacgggtgcgggaccagcacacggtggcgagggaccggcacaccgcggctacaagcacgactggcacactgtcacatcctgattttcgtttcaggatttataaattatttaataaattattaatagaatttatattaaatgatctttaattttcaagtgaagtaaaatgtgggaaataaaatttcttaaatctaaagcatggatggatttaatttttttgttaaattctccatggttaagtcaattctctgaaattttctcggatttttcagagctcaattcttaaataatacaaagaacagttcagtaattatttgatcattaatgatctaagtataattgttaagagcttttcttgtttaaaaatccttaacttataaattgttgtttaaaaggaattattagaaatgattttaaaagcctaaaagagaagatctaattttaatttgctaaatctcaatataaaaaggggccagataaaatttcattaaatactttgcttaattctataattcctagatttttctgggatttatttgagctaaggaagtatttttaataaatggaattgcatttaagaaacaatttaattgaaaaaggttttaaaaagtcttcttttggctttgggccgaaagtcggcccaaaacctctctctctctttccctcggcccagccggcccagtccgccgagccgccgctctcctctctctctcagccgctgacaggtgggccccacttgtcggtttcgtcttcctcctttggccgccgccgcccgcgaaccctagcgcaagccgccgccgtctccttccaaattcggccgcgtctttccttatccggccgaatcgtttgagggaaaatgatcctcgggatctcctctaccttttcttctttggaagcttcgcctaaatcggtttggaaacttgtggattcgatctcgaatcggattcatctctctcctccaactccgaagtttccttcgccgtctccgtcgccgtgggccttcgccgccgcctccttgcacctatttaaggacccccgagctctcctctacccgtcgccaccctcgccttcgcctctcgtcgtcggaagagctctagcgccgtgtgccctagcttcgccgtcgccgccgccgctccagccgtgcgccgccgtcgtttcagccgtcgccgtcgctcgggaagaccgccgtcgggttcgcaaggtcgtcgccgtcctcgtccgccccttcgccgtcgccggagaccgccggagcttcatcgccgtcgtcaacccgaaggtttccgccgcttcctcctcgtcgccgtcgccgtccgttgcttctccgccgcttctttggtcaccggtgagttcgccgcgtcgcgctctacgtcctggtgctctccgttcgcgtcgccgcgccgtcgttcgccggcgagcatgcgagcccgagccgccgagccgccgccgccggtggtgacgtcatcgctgacgtcatcggagtcgtccgccgtgagccgccgtggacccgatcgatctcggccgtccgttttggattggttcgatctcgaccgtccgttcgcgtgaaccgtcgcccgtgcgcccggtccaccgtaaccctagccgctgacgcaataatccttcttttccttttcaaaaataattcattattgcgtcataattcaattaaaatccatataaaggttttaatccgatttaatctttaaaaattcataactaattcatcttaactcagtttaatgtgggtcaagttgcaaaagttgtataaaataaagatctacatattaaaattgtccataaattgaattaaatttatttaattctttttaaatgggctttaattagattaaatcttgtaaaattcataataaattcatatgaaatcagaatgaggccgttcaagtctcataattcatctaaaaatatgatctacatgtttgtttactttttatgtattgtttatttggtttttattagtcttttccttgttttgcgtgttagcttgtcgtttccgtcgttgcgaaggttcgcgagtgcgccggaagtattcaagaagattaattgaagaccgattattgcaaggcaagtcacacagatcctaaacacaatcctttgagcatgttgatcctatatttaaattctctatttatttcaactgtgcatttattttcgaatgtcactgggtggtgtgaacctatccctttgttatggcctgtttgcattgattactttaatccttgataccttgggttattataatttgactagttgagctttatatattggttcagctagatattagatgtgattgcttagccatgcttagaaacattagcacactattgggataacttatgattcattattattatgatggtttaatggtagctcacgatggtcaatcgtgattggttaattaatttcttgccaactaaaacttgataatggtgggttgtgagcacatggttttgagagtcgtgctcatgacaattaaggaccggttcgcgagctactgttgtgaaacattaaccgtgccaaccacaagccagcgtgggcaacggctttaccttttgtatagcatggttcattgcggagcaccagactgagaagtggcggaaataagcccacgggggtcgctggggagtccatgccttgttttataagggggtgattatgatccaggaatggtgcactgtggtgagttgtgttatgcagagggtattgtcacagcctctattcgggtactttccagtatcgcgacgcatggtagacatgatgttgaggctgtgtcttgtgggtacagtggtacacctctggccagagtaaaactattcgaatagccgtgcccgcggttatgggcgagttgagcaatgtttttcgtgattagtcccacacctctcaccataactatggatgttatacctgataataatttgcttagctcctggtttggagattagatctgtacagccgggtatggttgttcaggatggttgggcctgtgcagcatgggtgtgctgttcagtgttgattaaaatttctgattaattactccactatttttacttctcttaaatgttttgctaaatgctgcttttgcaaatgagccaatattacgccatcctttggtatccttgtacacttgcatatttgctgtgtggcttgctgagtatgtcatatgctcaccttgcaataatcaatcaacctcagttgaagaaaaaggatccagaaggagaagacgtttggcttataccccagttgagctgcctgtgggagtggagccggagcttcgctagattttattttccgctgcagttttcttcttggtgaggacttagtgcctcttaagtaagtatttatcgttttagttaatttgatgaatctgtatattaaattgtcaatttgtgtacctcggctgattcctggacgaggatttcatgcacaaataagttcggaaattactagtgaatttccgggcgtgacacacacggcgtcctcgatccgtctcgccgccatggaccgccgccgtgggcggtgggatctggcgctcgcgccgtcagcagtggcggttgtggcagcgtggggggaggccctcctgctccctcgtcatcgccactgccgcctcgtcgcccgtcgctaccgccgcctcgtgtgggctcacaggtaggctgctgtaggccttgaacgcgaacccgacgagcacgacagcgaggttgagatcaaacggcggccacggcgggtcctccccagccaaaccctccccagcggtgcactccaatctgggcttcacgacggactgcggccgtggcgcggtggagggcggaggccaccacagtgcctgcctccaccatgccgcccatcgccggccgcccaggttgtcgcgaccgagaaaattgccttttc

SEQ ID NO: 62638 - DNA, 6074 bp, Oryza sativa
tccggttcaatggttgtgtatgctcctgtagacatcccagcaatgcaccttgtcatgagtggtggggattcgtcatgcgtcgcccttcttccatcaggttttgccatcctgcctgctgggcctagcatcggcgcagatcacaagatgggcggttcattgctcaccgttgcattccagatacttgccaacagccagcccagtgctaagctcacggtggagtcagtcgagaccgtgagcaaccttatctcctgcaccatcaagaagatcaagacggcgctgcattgcgacgtgtgaacccaacaaggggggacttttggcctagtgggagcggctgtggcgatgagcctgagtcaagaacgaaccgcgacataggaagggacctttgctaggtggcaaggaccggacggggcaggtccttagcacagagcaatggtggtggttcgggtattgactcagcctctcccgcctccgttctctcctgtgactggtgcatgttgaagtgaacctgcattttggacgccatgtagcaggccatctttctttctttttcctttttctttttctttttctttttttagggagaagggagtcatctgtgttttttgttggctggctcagggtgttggtgtttctggtttctagcttttgttacagggagatgtgatacattttgtagaagctccgaattgtcgtgctggtatgtgaggttctgatcataggtctgtgtttgatagtctcgagctatcaacgcctggcaaatgcaaaccttgttatgctaaaatatgttttagatcaatctgattctgaaagctgtttacatgtcccactagtcgaagagcagctcggcagtcatgaaatgtgcaaatggaatcacaaagttctggctcactttgcaaaattcaggatgcaaaatgtcaccgtgtaacaattccattttgtacctaagctttccggaccggtatcgtgttgcacgcatcttcctttgatggtgcaatgcttcgtagcctatcattggtcgaggggccacctaagctcagttgtgtggtggcacagatgtacaactggaaggaccatatttctcatccatcccatagggaaagatgttctttaccaaaatgtaaagataagaagagaaatatcctagtctcagggcaaaatttctatgtcaccatctacaaacgtcaaataatgtactggactgttcataccaacaaatcgtttgtgccaatttgacttgcgacgggcaaggccatacaggctacatcacttgaactggatgcataatttagccccctttggccatgctggatcattcattcgacataaatatatagaagttttactcaagcgaggcgctatcttccattgcacataacatagatgttctactttaagcgagacatgattgtactcagcaagccagaatattgttaactaagatcattaggttaccgtgccaggacagttgcacgtacagctattaccatctgcaacaagttcatgatgcttttgctgtttctctcaccaacgcaaactttgccagaaggcctgataattgaagaaatgagccaacaccatcgcagattctcatgtgagcaaatccggtttcctaaggaaataaacatgatatttttattcaactgtagaaaagaacgataattggtttgcataggttgcaccttgataggctgtaaagttaccttcaacaattccagcttcagatattcagccatgtcgtagttcttgataacccggaagagagtagtgattatgtcagtgggagagtagcccaaatcatataattgcttcagagcagagcaagcctcatcaaactttccatcaagcacatttttcaccatattcttgacatgcaacggatgtggttgatcacgcacctggagccaatacagcattactattagctgaagaaataacgcacaaaatacagggcaaaagaagctatctgcaaaccttgaacacattttcttgattaacaaaacggaacccactaactgtagcttgcaagttgttcaaagcttgcctcatgtcaccatcagcagtaaagatgatagcttcaagtccctctggcacgtaaggaaccttggttgtacaagaaaataagagattagataaaattaaaccagcacccatatattgggagcaaatacaaattgtatgaatggtagggtggtaataggatataaacgattgttgtggttcaaaagattaatccaggcacttggaacaaattaactagatgatcaaacattcccagtatccagtatctacatcacagagagaaaaggaagaacttaaaagaaaggtagagggagttgcttggctgcaacattgcaggcaagaaaatgcctagtgctgaacattagaatgaactgaagagccattagaggatgactaacaagatttatgacctcttcactttaacagctagatgtgcccactcagctgggtattttcagtaaaccggtgaggacttaatgatatttgttaagacaaattaattaatcctaataataacagcagataattataggacaagaaacgcagaaacacacgtaaatgcacaatcatagcttcaaggttacagggaagaacaatatatatgtaggtgtaaacatagccatcagaaatgatgtttaactaaaaaggttaataacaattgcagtgtttcaaagaaaccatgaatcataaccagtgctatgagaaatctgtcgatttaagaaaacttaagcaactaggcaataaaatgtatagtcaagtcctcgcatttataagagctatcaatcattaccttctcagctgctaccacaatcatgagtcggccaagaatctcctgatctgaaagccttgagaaccgtacaatagcacaacggctttgaatgggttcaatgatcttagatgaagtgttgcatgcaagcgcaaaccttgtggtgttagaataaatctccattgttcgtctcagtgcttgctgtgctcccgatgtcatgctgcatgtagcaagtgcatgtgaggcaaactcagaaacaactagctatatccttgatatcagtagttatatgcttaaaaatcataatgaacaagtctttaattcataactacttcaacaatcatcagaagtcctggccggaaattgcccaggtggtggtggaagaagctgcactatggcgcttagcagggctttggtcatttaggtcgcaacacccatgacacaagattcagccctagcatccctttttttttgccttttttttcagttttcaccttgtaaatgttatacaactcctcagtcttaatgtaaaagatgcacaatccttgtgtattcacaaaaaaaaatcatctctacgagataatatagctttgctcttacagagatggagcagccactaggtttctccattttcacactgttggtatcactacaatcctactacatcttaacctctagcaatccgtggtgaaattggcatgtctggactaaataaggcacagtactagcaatggtgtcacatcatccgcactagggggtggcattacctgtcagcctcatccaagatgacgatcttgtgcctccccggctgcagcgtgaccttcttctgcgcaaacatcttgatcttgttccgcaccacatccaggcccctgcaaaagcacgaatcaaccgtcagtccgtcacacacccagtccacaccacgggcgcacgccgcacggctacagttcgccaagtcaaaaccacgccacggccgcaccaacctgtcgtccgaggcattgagctcgagcacggcctcgcggtagctaggtccgagcagctcgtgtgccagcgacaggatgctcgtagtcttcccggtgcccggaggcccctgtagaaaacgatagttaaaaaaaaaaaaaggttagaaacgattcgtcgtactgctgcttgggtgttagcgagagcgcgcgcaaggtgttcgaggaaatggcgcttacggagaggattaggtttggcatgttgccgtcgcgggcgatgacctggaggcgggcgacggcgtcggagttgccgacgacgtcggcgacgcgggtggggcggtacttctccacccacgggatgtcgtaggcgtcggcgagggcgggggcggaggagctggaggcggccatggcgcggggcggatgcgcgggagaggggaaaaaaccgcgccgcggtggagggaaaagaggggaaagctgccccgccagcggaggggagggttttttttttttttttcgggcgtgggccgccttgaggagcaaggggcatcatctgttgggcctgaagcccacgatgagcacggacggctgccgtcgagactcgagcggcgtcggccgtacggagtggccaccccggaaatttcactacttagtactatcaaaatatccaattcacagtccttaaagaaatgcccatttaatttgtaaggctcttggattttactatagaaactatgattttctattagttatcactcccatcattctattattagtctaccccacactagtaaattcatccaccaaactatcatcataaccgccacaccaaagccatgtgcttaacaacctccttcagatgctcctagcgaggagcaggctgttggaggagctcatcatcacggctcctatcatggagcaggccgttggagaaactcaccgttgcggtagcactttacttgcccatcacactagagcagccatgaaacagggacgaggagggcaacaccatcaaggaagatatggagatcatcgcccctcgtcgtcaagatgtaagatgatgggttagtcccgcatcagggatactggaacaacttctcgtggcaacgtcctgcgacaaagtagatgacgtcggagcaaatctcgagacaatactgaaaagtgtgcatagtcaagaaggtcactcatgaagacaaaaaggcagtccttgctggtgccagtagcgagtgtgagaaggtggttggtcattcctatgtgctgggttataccggttctctttactcatccaccaacgttgtggtttgtggcattgagctacatccgcaacaacaagccttgcggatggacttgtcaatggtgggggtagatgtatcggcaaacaacaaatgcggtacggaacggagtaattcattgttccgatggccaaatctaaaatccttgcgaattttgtggcaatttctaaaagtacttggatgtcgatcagtgaaatctctctctataacaggactaaaatgtgtcccaatatattactgtaatatactcctacgttttataccacttagtagaaaatatagtataacgtaatgtgttttacgttattctatcaaaaaatacaatatgcaccatggtgtaagttattccctcgaagggcgaaacattcggacaatattttttctagtgataaagtatttcttattaatgataaattgtaattagaatttttcgagcggacacacgttacttcaaatcaatggtatagttttcttggataaaatttccactaccaactactccacatataacgagcatcaaaacgtgaaaaaacaagttgaaaatttttttggtaaggagcaaaaaaacacactttagtttgcgaacaatggactgttatccgtcagtttttttttttcgaaaattaggtttagctgagttgccaactgcttgacatcactggtttctttctggtccaaccccacacggccattcggccatcactgaatagcggaaaaacgagggagcaaatagaaattctgtccagtcttccaacccaccccaattcctccttgcccccctccccctctctctccccagaggagcagcaaggtctctctcctcctcgatctgccgcagggggtcccctcgatggcgacgcctcgctccccgagcacccgcggcgacgcgctccttgactcggcgcccctgctcggcgggggcggcggcggcggcggcggccggcgccgagggggcgcgctccgccggccgtcgctccgcggcgcggcgcggctgctgcggcgcggggggcggcgggcgatgcgggagccgtcggtgctggtgcg

SEQ ID NO: 62639 - DNA, 1537 bp, Oryza sativa
ctatcaacttggttctaaattctgaagatcttactaataaatgtcggccttggtcgatcacctggacctatgtcaatttcttccaaatcgtcggccgacatgaaaccttctccttacttgtcatcgaaatcatctactgtgtccttggtgtagacgtttgaaccctccacgacgccctcaaaataatagcttgggctctccatcttcaattggttgtatatcagaatcggacacttttagaaaatctccatcccaaacttttctagataagcaatcaagaccatccgtctcccaaagagctaaatcggcactggcaacattgactgacctatcggctggcatgatttcaatcttgtcgcctagccactgaatcaagcattaatgcatggttgaaggaatagaacaattggcatgaatccaatcccttccaagcaacaagttgtaggaacccttcccatcaatgacaaagaatgttgtagggatagttttgctgccgattgtcagctctacattcaaaacccctttggtttctgatggattgccaccaaaatctttgagcaccatgtttgtcttaatgagatcctcagcatttctgcctagcttcctaaatgtagcataaggcatcaaattaactgcagccccaccatcgaccatcatcttagacatcagcttcccattgacatagccatttatatataatggtttaagatgccgattctctgtcccttccggcttctcgaagactgcttgttctggtgataaaatcaacttagccgattcttcttcaacttcatcgacatcggcttgcttgatcccaaattcagcaggcaacgtgaaaaccatgttaaccgatgcagtcacaacactttttcctttagccaatctctttgcttcatcggctgcggcttcatcggctgtaggaacttgattcttaacacgtcactcctgcttcagcttcgtcttctttagccgatgattgatttcttactcaacctcctgaaagcgctccctactcctcaacctttgaacccttcttcttattctttgtaaaaataccaaaaggacaccattgagtcttcccgtctttgttgtcttcttggtcacaatcttggttcatcgagcccaattgtcacgtcccaaaacgaccttaaaatataccctttaaattatgcctagaataattaaaatcctagtgaaagcctccaaaaattaaaatgtgcaaagttaaaagtcaaataaggcttggaggatttttgtatatttcctcaaagcctaaaatgtgtaaataaattttagtggaattttcagagcacaaataataattatcaagaaataaacaaagttaaaaaggttttataaaaagaaaaaccctaaaaatcctccttccctctctctcctctccccgcggcccactcggcctctccccgcgcgcgcgccgctgacaggcgggcccgatcgccaccctcgctgacgggtagggcccacccatcatccccttcctcccgccgcatgcgccgctccctccgcccgcgcctag

SEQ ID NO: 62640 - DNA, 2296 bp, Oryza sativa
caaatggccataacttggtcctttgaactcggaattggaccattcaagtctctaatttttccttaagaagtcaagaacccatttttgtgctttgttcctgcttgttatatgaagtttattagagtaaaagcctttttcttcccgttggtcgtgtagacactgcagcttcggaagatccactctacgtggaggtcgaagccgacgtttgggaaagcgagcaaggcaagtcacatcatccttgaacatattgaatcccagtttataaaattattttggtttaaattactgcattatcgctttatttaaattcccgcgttatcactgttttatttagccatgcctatttacctttgttatgaccttattatcattgctattggtattatcaccttgcttaccctagggaaataaaaccccaactagtgggtactctattcatggttccactagtatgaatttaggtagatgcttcgctgattaattaggcaacattaggtggtttcataaccttagactttgggaatgctcatatcatttggacattatggaatggttggactatgtggaaatggacatacacctccccctctattcaaaaccctcaaaatggttttaggctgggctcgaggtgcatggttttgatagtagcacctcggccaccataaggaccggtcttcgggcctctgttgcaaagcactaccgtacttccacatgtctagtgggtaaggcttagtttgtggctcagtctggtcataaacaaaggtacacggatggagatggacgaagtcgaggctcgatggacatctctaggacaaatgaaggctacacgagttgcggcccggtagtcgagatgtcatggcacaaggccggtgtcctgcaactaggggcttaacctttggtacctgtctcgggaattcccggcgtagccaaggttgggtcggactcttgtctatggctaggatgggttgggaaactatgttacgtattctgtccgtatcacgtgatggtatgtggcgcgtggttacacgtgaggaagacgtgttttgtgggtaaagatgtacacctttgatcaaagtataatctattcgaatagccgcgccctcggttgtaggcaagcctagcaatgtacccaagttagtgttttaaattcttaaaacctgcttaacaactaaaatgtggaatggttggcctgggttggcttgggacgagctgggacctgggtctggttgccagttcggtctgaatcatcgtaggccttgggttaaggcaggttcgtgcgggttcacggccttgattaataatattatgtagctctaggatcgtatttacaaaatggccctgagcaactaaaagtcttttaaatgttgtttactgcgaaccctaacccctttattataactcccttgtactcctttgcctttattctgcatccgtgggtgtgtcttgctgagtaatgtggttgtactcaatcttgctcaatttttccccaacccaaaagaggagttcctggaagatgaaggctttggtgtctagcttgtgcctgctgtcaagtgcctgtggtcgtcgccctagtcttccgctgttttccgtttatcttcgtgtgtgctaggccttcgccgcccatgtaataaattatctatttacacttccgcttgtaaaactctgaattgtatcaacttttggtgtaccttgcctcctgggacaaggaataatacacgcacgaatggaatgcccgttgggttaattccggtcgtgacaccaatctttgatgaacagaaactcttgcttgccttagccgattgcttctattatacgatcggcttgaacttcctgcaacattattgcacccaggacagtcctcaatagatggcagcctcataccttcattctagcaaaatctaaagaactcatagccccaatgaggatcaaaaccgccatcatcttcttcataatgcctctcctgctgtttgttacacttcttctgatacttattgataatttaatccgaattcacctgaaaacctcttgcacgacccccatcggctgtttggccagctgtatgcaccatattgacaggaaaaggattaccatcaaccttcatcggcctcttagaatcatcaaatttgattttgcctccctcaatagctgcctggatttgctgcctgaagaccttgcaatcattggtagaataagacccagaattatgccacttgcaataccttctcttgcccaattcttcagccgatgggattgtatgaccagcaggaagttgaatctgtttctctcgaagtagcaa

SEQ ID NO: 62641 - DNA, 4948 bp, Oryza sativa
ttatattgtgggacggagggagtatgagtgtttttaattttttttataactgtttggatggttttgaagcaagcgagggaacatgccatcgacggatcaaaatagtttccaaaaaataatagaaatggtcgttttaaatagagcgtagaaaaaacacaaaaatcagaagagatagattgattaaaacaatatctaagtggttgaagctcaggttagaatttttcaaaaattgcatggttttcagctaatccaaaggaaattcatatgatttttttatagttattcttttgatttcaaatgaccacataacaaaatgttttataagactaaattcctctaaaatttctctaaagaatcctaatttgttcgaaaccctttcgtttggaattaatggagggaatagaacccaataagcaaatcccaacaattaactgacaagtactagagacagacagtcaccaagcagcaagatctgttttatctctgcaagtctgggccggattttggtgggaccttgccatgtcgatgcatgcgcaccctttgcgtcattctcttgagttgatcagagcgtgcacgatggattaatcagagcatcacaatcagccactaacactgctactagcaggctctagttgctacggcaaactactcgccatttcattttcagtgctgattgagaagagcgattgccacgaacgtggaagaggaaaacatgatatgcattttccaaaggagaaaagggcagttgtttgccaaaagcaaaattatttgtgaaaagtgtgctggcaaatacacccactaattaaagttatttgatttggcacaagcaagagtgtgcatgcaaattaatacactagtacattccagatatacatttttaacaaaattgcggatatatatttttttgaatgaaggatttaattttaattcaccaccagtgtttgtaactttaattccgtagaataaatagaaatgtagtatcatgtaaatattttaaacaacaaattttgcgatgcaaagtacattttcagaaaaaaaaaactactgcaaattaattagcactaactaaaaaaaagagatttggagggagagacgtccctccaagaatttttttaacaagaaattgtgagcgtattgagattgaacacgggatcttggggttggaaccacacacttcttgtcactgtactatcaagtgcatctcaattagcgctaattaatacaaagcgtgctgagatagtgagatgtatgagaacaaactccctaatatagtaaataaaacaaaatatttaatgtttagaaaaaaatatcagaataacattatatgatagtgtaattttcaaggcacacgcatacttatttttctcaaataggctttttgagaaataactgtgatgcatggtccatgttttagaaattaaaatatattttgtgtgcttaaaaattagtactagatatttagtatgaccaaaaaagaatgttctagtattaattaattatgagataattcagcgaaggaacggccagctactagttggttggaaaaaaacactgcctctattaaaaatgtggatcagaacatgtctagatttcttatattgggtttgttcaaattcgctatactaaaaaaatattgaattatgtattaaggacacaatactaaaatattttaggacgaatgacgcatcgttttgtcatgcatcgttcagactttgaaacaaggcaccttaacgttacgccaaccacacatagttcctggaagtcctgagactttttcttttttcttgtttctcttattttcaggggaaaagacctgaactgtttgggctaagttacgttactgtgctgttccgttttagatagacaatgtagaagcacagtagcaaaaaaaaaaaaaaaaagagagtaacggcgtgttcgatcggtcgtccggtctgtgtcgatcgagcaaaatcctgaaacggtaggcgatcgattttggtgtgcacgcgcacacaccatcgtcacagattttggagaggagtatgggtggaaggtggaaggtggaaggtgtaaggtgcatgtgactcacataggtggtcgatgacgaggcggccgtcgcagaggcggcccgtggcgcggcggaagaaggcgcgcccctcggggagcgggaagtagtaccccatcccggccgcgatgccgcccgtgtccgtgttcgagtcgccgaacgcgaacaccaccggccgccgcgcgcacgacgccgacggcgacggcgacggcgacggctggtctccgccgtcgtcgctgatttctccggcagccaccgccaccgccatcatcactgctactactgccaccaccgcaacgacgacgccgctactagctgccatattgttgcctagctcgatcgatcacgtacgcgtgcaagtggtggctggacactagctggtaatagctgctttgcttacgcacgatctcgactagctggatgagacaaattaaccgagatgatagctaagcaaagatcgagcagcctggacctggagaaggcaggagccgaggagctagcatatatagcgaagacggggagtgggcgggccccgcacaacaacacgcgctcgcgcacgaactgggatcctcatcatctcgcgatcaaatgatcccaacaccaaggcggtggggcaagctgcagcaattttcacgtgaatttcgtcgcggttttgcgataaatacaacttacagttttagcaagtttctcgctattcatacttagcatattgcctatactttgcaagaatttaaaaagagtaaatatcacaaaaccccagattttggggcacatctatcacaaaaccacatcatgttaactaatttttatcacaaaaccccactctttcttggggcatattgttgcatgccacccatattccgttgctctcctcttgtgcgccgttttgttcgccgttttccgctcatgtcgccgtttccaagattacgctcatgattccacgacgaggacatccatacttaaagcgggaatcccctctgcatcatcactaggcgtgaagaattggcgccaacctaggccatctcctgctacttctctgccctagacaacaacatagtacataacttgatcgatacacaacgaaggatcaaggagacccatggaggaaggagattagccttgttctgaactttgtagtaggtaggattgcttttcccccacttatttattgcagatttggcttgctaaacgaaccttaattgtctatatggatgatgggtttgaagtttcccctttggttgctgaacctgtgataatcttagttggataagacaatattgcagcagattaatttttggctaaattgtgcttttagtcatcggtgattttcttgatatgataggatggaggatgacatttggacactgaatttgttctgtgatggtgctttaaatggcccgatgcatgtgcagaaaaatatggatagaaatatcatttgctacttcaatttggttggactgatcgttgacattggctacttagattgtgattttatctacttcctctatttcataatgtaagtcattctagatttttttacatacatatggatgttagtgaatctagatatatatgtgtctagattcgctaacatccatatggatgtggaaaatgctagaatgactttgtcggtgatatgggaccgggagtatcatgaccagaggcttgaggcagacgcaatcgcccacgtggcctggcaccttcgggaacgtcgggcccgagggtgaggtgtccgccctcctcctgatttcccccgagggggggtcgggttgcgcttgccccggccccgagggccgaggcaccccgaccccttaaggaagtctgcgccacatatatgggataagtgagcacagctgtgctcacctaacagcatttattgcagtctggtcaagcgtgtcacgctgcatgcaacgcagtacagcgcgttcctttatccggtctgtgaccagtcacagaccggtcagatcacgggttaggtggcggctggcggtctcacgcacgccttgccccatcccgtcaagacgaaagcctctaggcactcgtctcaagccggagctagggtgttatctcttagagatggcacgttagccctggtcagatttacaccaggcttcatcctacccattacaggcaaggtgttacacgaagaagggcaaacatgcacgttgttaagctgacgcgtggtggacaagaatgaccggtctggcactggtcgggtcatcgacagacagccacggtcccgcgtcatctctgtcttcgggggaggtgggggtaggtgtgggctgtcccatcagaagggctcccggatggaaacccgtaccgatctccgcccattaaagagaaaaagaacagtccagtttggaaagagaaaggggcatgtggtatccccttgagatataaaaggaggaccttgcccatttagagggggacttttcccttttggaaggctgagaggaaagggagttaatcctttgtaacttgtccatacacaaatccacaaaaacacaggagtagggtattacgcttcgcagcggcccgaacctgtatacatcgtccgtgtcttgcgtttcttccggggacgcgatctttccacatacagagagagcttgagatctcaccctaagcccccggccgaaccggcaaaggggggcctgcgcggtctcccggtgaggagccacgagctccgtcatctggcgcgccaggtagggggctcagtgtgtgttttctgagctgtcacgtcctgataaattcatcccgaattaaaaatcattctctaaaaggaataatagaattaattaaaattcgaaaagaaattggcaaacactaaaatacgtgcaagaaaaattcaaatgtggcccggagaatttttgttaaattctccttggtctaaaaagagccctc

SEQ ID NO: 62642 - DNA, 1319 bp, Oryza sativa
ttcaggggtacatagtgataaatttgcaacaccttgcgttttcgttctcacaacgcagaaagttcagacctaatgttatagtcatcagggctatcatcctatttaaactactatatctccagccaaaccacggatatggtactaaggctccgttcaaacagtacatgattaattgaatattatctattataaatttgataaactgatttatttattaatctttagaaaaaggttctatatagaaatcttttcacaaaatatatcacttagcattttgacaaagtgttatcaaaaataaaaaaaagttatcgtttaaagttacggaaaagaactcagcctaaaagctagctacagcatgccagcagctgttggctgctgcctttgctgccgtaacgtaagctctaagcaccaccgctgcttgctcgccatggaccaagcaaggcccaatgccgaccactacgctagctagcctgctttgctaggcccacaagcaaagaaaccagcccactacctttttctcttatctcttttttttttcatcaatcaattattccgggacgttacatcggtatcatggcctcatgggaactattctccttaaatccttgagtattctaaaacttgagaaatattcaaccgtgtttgtttggatgcaccacaaaaggaatggtttttttagatccacaaaagaaatggtacaggactttggaagaattatagatagagattttctttcacaaggttatctctctcatgtcagaaatctacttagaaacctactgtattaatttattttgcgaaaaaaatattaggaccaaaaaagcacgggttacatcggaaaaattatgttactaagtttttttaaatagaaagttcaattttactctcccgaattatttcattggagtacttcactcctaagcaattttttgggttattttacaccccaaactatttaaaacggttcaactgaccccctatctgtatttctattttttccctctctatatatgtcgtattttatactaaatctaaaaggatcgacagatgcattataacttatctctcaatattttttgaattttttttatcattgtttacataggttggaaacactagaacatatttaaacatcgaggttttaagtttaaagaaagtagttatgaaaatattttagaactttaataatagtgccatctctgccttaagaagtttagcttaaaatacagcttgtataaaagagaaataaagaagagaaatactattaagtggtaaagtgaagcatcattaatagtttatgaggcaaaagggctgcagga

SEQ ID NO: 62643 - DNA, 16269 bp, Oryza sativa
tttaggtgacactatagaatactcaagctttgtgggttcggaggagttgaattgatgggtgcaattagcagttgacccgtccgtttacactgatggtaaggcatagctgtacttgacaactggattgtcatctgtttaaatttgagattaaacaaaaaaggtgaagtacttttaccgatggatcaactggaatccccataagaaattgctaatgggcatcttagtactaatgccttctttagagttttccacttgaatacttgataggatggccaaaactttgttgactttaatctgctgtatctctttagtttagacaagtctcccagaatcagtgctgacggttcagctttctcccctaggatccaactgacaaactagcttctttgggtacatgtcagcttgttgcagaaaccatttcagaagtttattactgtttataccgatacgctttaaaacttgaaagctatatttgatggtgagtatgaaaatgagaagcgcgttagttcagcattgccccggcccggcgaattagttcaacattgccattgcaaggaaccattccacggttgtttcgctttcgtttttttttctgaacttaatttccctatcattgtatcatgtggtgaggttaagctttcgtaaatcgtccatttgcaccgatgattactggaaaaacagaactcgatgtggacgcacgcacccagttgcctcttcttcctcgacactgcaaaacagctcgtattcgtatctcctcatttgcaactgaaatgcgcttccttttctttcctgccgtcctggcatttcctctttcccgtttcaccatatgtttctctacttgcatctagccatagctggatagtactactacagttggttcgatctttataaatcgctgcataatgggaacccactcaactcctgctaaactaggaagaccaatgcaaagaattgctctatggttcaatcggttttacgtacacgaagatgcataattgtggacaataaatggtactactactctgatcctcctaacgctgaactgtaaacattttcctctcagttccctggaaacgtgaactggtggtccacagaaagatatcttaattgtgtactcctttatgtgtaaatgtagccaaatgtaacttcagttgaaatgattaaaagaaaactacagttgtgttggcttcagcaacgtcagaggacatggtttgcagctcgcgacgacgtctacggtttccttgcttggccccgatcgagacacacggtaacggcgtatagtacaaaaacagcgtcgcgtgcgcacgagccaggctcgttcaacacggcctcagggaaagcaacacgcaggcaaagaaagcgtaggaatttcggtaaaactagctgggcggcccgcgcaattgcgcggctagcatcaatttaaaattatttatttttacatatgatttcatttaaaattaacattcttgtgattataataattttatagtttttaaaaggcacgccagtcgctacccctcactcactccgttgtcacatttttatttgcttactcgatctatcactatttctattcattctcttcagaactttaaaaattaggccttatagtttttagagttcattgtgttgttgggtttcgttttcataattttaaattaggccttatagtatttagagtttattgtcttgttgagtttcgttttcataatttttagaaatatcgttaaacatcgccaatttactactctacggcccatccgctgccacctcttttttttgtcactaagattttaaaaatcaaacataattttgtttgtgttcttttttactttccatacgtctcgccaaatcgttagtggctttaccactatactcctctatagcccgcccgctgcctcccctccttattgtcattgagatttcaaaaatcgaacatgattatcattggggtttatttttactcttcataagtcccgccaaccgtcgtgaccatgctgcttaacggcatgcccatcatcactcctcttaatcgtcattaggattctatttggggttttgtttagaggttttagatatcccatcaatcgccagcactctaatcctttgtaggcctacttcttcttcactctttattgtaatttgtcatcgttgtgttctagatggacatttttcttttgaaaattgcatatctttcattccaataatttttattcgtacttgaacttttataatcattttcctatttttgaaatttattttatttgttatttcaaattttaattaatctcatcatgtgttctagattgtctcttatttcaatagtctttattatttttattacaaattttagttatttataaattgtattatagttgggctcttatttttatatttctattttctgaattatttttttattttgaattttaattaatctcgtattgtgttctatatagactatttttttaatatttcttttttatttccaatttcaattgttttaaaattgtgttcccacttgaactctcttttttatgttttctaattttggatttttatttgattttttattttgaattttaattaatatcgtattggtgtcttatatggacttttctttcaatatcgcttattttaaatttcgaatttttgttattttcaaactgtattcctacgtggactcttcttttatttccttttctctaatttcggattttattttatttttattttaaattttaattaatgtcgtattggattctcatatgtactcttctttcaatattccttatttttaattccaaattttagctatttttaaattgtattcttacttggactctttcttttttttctaatttcggattttattttatttttattccgaattttgattaatctcgtattgggttcttatatagactcttctttccatattgcttatttttttaattccgaattttagctatttttaaattgtatttctatttggactcttctttttctttttctccaattaatgtgggaatttctaacccccacagcgaacgtggtacctcctttcaaagctgttttaataatataatagtatttctacttggactcttcttttctttttcttcgattaatgtggaaatttctaacccccacagcgaacgtggtgccttctttcaaagttgttttaataatataatagataatagatagatagatagatagatagatagatagatagatgtttctcgtttttctttcctcacgaaatggacagagtctggtatagcagttccgttgctttgctgctacgcctgtttgcaaaccggccatcgccgtcagcctcttcgtgcatccccagccgattttctcttaagctctactaccttccgtataacccaggctccaactgcaaatcgttgttgatgccgtaaccaataaatcatgcatgagtcaggacggagtactcgcgcttgcggtctgatacagatactacctacacacccgctcaatccaatcaatcatgcactcgtgctaaccgaagagagagtactaatgtgtacatcagctgtgtcgattttttgtgcaagatgattatgttcctcatggccaaattgtccccctttggccctttgtcgtgtacacgtttctgatttatgaaaagagaggaaatctcgtgggatacggacgtatgcaggggttggatgcagcgtggacttgcagcgtttaaacagccaatccctcgaaaagaaagtcaatcgatcgccgtattgacatgttcagctgctcacgcgcgcacggctacaagcagggtcgtcatgggctcatggcctcataggcgcggtcgctgctgcaacctgtagctgcaggtggagacgtggtccgtggaggcggggtcgccgcacgctggctcgaaacgaggacggcgcgtcggcgagaaggccaggagcggctggcggttgacggtgtcggtcggatgtgatgatatcgagaattcgggatgatggctggcacgacacggggattttgcagagaacttcggagcggagtgggcctgcggccacgtcggggctacgggatcttggactgcttgacaacgcccctcggccctcgcagccgaaatattttgggagtacctatacaacattcagaaataaaaattttagaacataactaagtatataattgtagtgtagttatattataactactatgtagcttctgtagctcgagtataactcttaaagaagtgtgatggagcaactggttaatcgaatgagaacgtaagctgcggatttggatttggtgcagttggtagtgtgactgcaacttatacagtccactgtcagcttttagatctggatccaagggccaaaatgcgttcgggtactgtagatcactgtagcaaaattgtttagtattttttacatctgccactgtagctaatggtctggtccattcatcaatgaaatagatggctcctattgcttgcagtagcttaacttgcagtccatatacaaactgcatgtgatcccaattcgtaagctgcaggtcttgaataaggaccccactatgcgcatgttaatttttttccatcttccctcacccgcacgaatctcaaagcatatctacggttttaaatacgaaagtttccaactaacttttttaagcagtaggatagcaaatccaaataacttttttaagaactcatccgagtgatttagtgttttatgaatatatatgtcggtgacatggggccgggggtatcgtgactagaggcttgggtagccgcggtcacccacgtggcctgaccccctcggggggggggggggggtcgggcccgaggatgacgtggccacccctccctctgtctccccgaggggtcggatcgctcccgtttcggccccgagggctagggcgcccccgtttcggccccgagggctggggcgccccgaccccctgtggttttggcgccacgcgtgtgggttaggtgagcacagcggggctcacctaaccgcatttatagcagggttggacgagcgcaccacgccgcatttaatgcggcgcagcgcacgcttatccggtccgtgaccggtcgcggtgtgtgaccggtcacagaccggtcagatcgcgggttaggtggcaacaggcggcctgtcacacgcctcgccccgtcccgtcggaatgataagagcttcctggctctcatccctagccggagccggcgtgctaactcctgcagttggtatgtcagtcccggtcagatccattccaggcttcagcgcaagtacggcaaggaagtcgctggccattaaatgaaggttgaaatgggcgtccaccggaaaagcaggcgagcggggcaggaggtgtgtgctctgcttgtcagaggtcacttctggctgtagactagccctcattgtaaaaagcatatttcccttcttaggcagctagaggcccatgtggtgaccgctgaccagataaaaaggaggcccaggcctaggagagggaaaaaagagggaaaaagaaagaggaaggagggttgggactctggggaatgggttctagaggctgaactctctctctcgctctccggcactctgtattccttcacgccacagatccaccagaacacaggagtagggtgttacgcttctcagcggcccgaacctgtctacgtcgcccgtgtcttgtgcactttctctctcgctgacgttcctcagatcgagggcgaagaacctcacttagcgcccccggccgaaccggcaaaggggggcctgcgcggtctcccggtgaggagccccacgctccgtcatctggcgcgccaggtagggggcgcgcgtgtctttctaagccctcgtcctctttcgtgtgcgccaagcctctcccgctcagcccaatggccgaacgggcagtggcgcacagcctctctccgaacgctagcggtgacgacggggagcagaacccgcgccgtcgggctcgcacccctccgtccccctctcgccgaaatcttgggcggggggaggcgctcggggaggtcggaggatccgcgacttcgccgcccgcgggcgacgggggaggacggcgagacggggcgcgtcgccgcctcgtctacggcgatggcggcacgccccagggcgcgctcctgcgtcacccgcccgtcgtccccgatccagagactccaacccgacgttggctggatgacgtggccgacttggtcatgacggcgcagcagcgcctaggcgccgttgggcggtcctccgccaccgaggcctctggcgcagccgccgccggctccatatcgtcgaggcggagggcgcggcgagcggcggccgttacccgccgttcgtccgccattccctcgtcaacgcctccgacctaagaagatgcgcgtggggggccggatgcccgcctcgatatcgagcgccggcgcgacgttcgtcgcgccgcccacgcaacggagggcgcttcctcgtccggagcgccacttcggtccgggcacgggggccggccccccgtgtccccggttggcggtgccggctgtcgagcctttgtggcgagccttcggaacgtccgttggcccccgaggttccggcccaccattgtcacaccccgaagttttcctcccaagccaaatttgtaatttataaatgaccctaagaaaataccggtgcaaatcaggagaaaaccctaagaaagtaatgcaaataataatcggatttgacatgtggaattttttccctgagttctacatgtcgaaattcattaacaggatttttagtggttttttcagagctctagaaataattttaaccagttaaaattgagcaagcaatattgtaattccagggaaaatcctttttcctttttcgttttcttttccctccctttttcctctttttttttcgaatgggccgccggcccattctcccctttcctttccccctcccccttgctgggccggccgcaggccgaggcccagccaggccgcccgcctccctcctctcccggggtcgccgacaggtggggcccacctgtcgggtctttccccttcctccggccgacgccgcgcccgcaaccgccgcacccgaaaccgccgccgcgtccacgtctccgcttcctccgggccacgtcggccacgcccgcgcgtgcgccgcgtctcccgcgcccactctcctctctctcccgctcgcgcccgcgcccgagatggccgggattcgattttcgaatcccgcctctctctcttcccccactcccccacgtcggccggcgattcccgcctctcccggccacgtccggtcctctctccccctatttaagcatcgccgtcgtcccctctcactttttccccattccgccgtactctctcgagcctcccatcgctctcgcgccgtgcgcccatccgcagccgccgtttccgctactccggccgccgctagccgccgttagggtcgccgccaggccgcgccatcgccgccgtcgggttcgcgtggccgagatccaccccgtccacctctcctccgtcgaggttcgtcgccggagtcctcgttccctcgcactcgggtgagcaccacctctaccgccgccttcgaccatggcttccggtcgctgtggctcatctccctctctctaatccctctctcctccttccttagggcaccccgaagctcgtccgctcgccgacgtcgtcctcccgtggcttgccgtcgccgttcgccatcgtcttcctccgcgccggccaccctcggtgaggcatcccctcccctcttttccccttcctctcctcttagtgccgcgccgccgcttcaagtcgcgcgctgtcgccttcgaccgccgccgcctcgcgtgccgccggtcgctgccgtcgtcggtcgcatgcgtcgccggcaacgcgttcgcgcgcgcgtcgtcgccgtcgccgcggtcggtcggccggccttgagccaagccgagccgcgtgccgccgccctttctttccctctcccgggtcgctgaccagtgggccccgcatgtcggcgccgctcctccccggtccgtggacccgatccgccgtggaccgccctctcccgggtcactgaccggtgggccccgcatgtcggcgccgcactccctccgtgctgacgtcagccctggaatatattgcgcaataaatagtttaaggtttttcttgtatagtaataaacacagtgaatcttctaaaaatcataactaattcatccgagctccgtttaagcccattcaagtctcagtaaatcaagaaaactgtgccgaatccattaaaaatggttttgttccctgtttcagtagtcttatagcctgtttgcaatgtttgctttgtatgtcgctagattccgtctcctccgacgctccggtgtacttcgagatagtcgccgaggttcctccagcagcagagcaaggcaagtcatgcttgtcacttgaacatgttgatcctatattgcaaatgctctattgttttctttcaaataatgcattgttttataatattactatgggatggttacctattgttacagccatgcttttcggataccatgctcctttgttagcttggggttataacatgattagagtttggactaggaattgcttagccatgcttagttcaactagttcacaacggggaaaatcatattaatgtttagactgttggttccaatggtgtagttggattagtgacaccgtttggtgttggttaattaaaataaaccacatggtgggctgtgggtgcatggttttgctggtcgcacccatggcagttaaggaccggttcgcgggatgccctggaagaacttatcgtacttaccacaagccagcgtgggcaacggctggacttgtagtgtatctttcccctagtcgacgcatccaggcaagggtgggcgtgatggagcggggcgggccctgcgacggcctctgtcgcttccggattcacctaggcacgagaggggactgcccgttgcccgctggggacgggggtgaaacctgaggtgtggtgtgcttggctagagggggttatgcgaagggtcctgtcacggcctctttccggtatgtcgtggtggcatgtcggcgcacggaaacgtgtcgtggggctgtgtcttgtgggtacagttgtacacctctgatcagagtaaaactattcgaatagccgtgcccgcggttatgggcggtcaaccagattcaccgtgattagtctcaccttagtgtaatcttttaatttggatagtttaggtggatggttgggcctgtcgcaacatgggttagcgttggacagtggatagttgatgttaattaattattacaactgtttaaatctttcaatttctgtttataaatgctcgctttatgcaaatgaaccacttcagctcttctttgatgattccctgcatcatacccctattccggtatgacttgctgagtacagtgggtagtactcagtcttgctctacttttcccaacctcagagttcgagttcgggtcagatgaaggtttctccgaggagtaggctttgtccgtgccgtcgaggatgcctgtggagtggtgttcccgctgcagttcaagtcgaggcttagctcctgttgtctttctttctttccgctgcatttatgtaagacttttaagatgtttgtaagacgtggatctgaatgtcaacattgtcgtttgtgtaccccggctggtcctggacggggattttaatgcacattctgcttggaattctattcgggaatttttgggcgtgacaagttggtatcagagccgaccttgatcgtaggacaagccaaatggaaaaacctaagagccctctgaatccttttcattgcatatgttctttgcaattggatttgttccgggaaaattgggatctgttcttgtggttcaagggaaaaatcttggtcgctcgtttaagtgagattcttcaaaacgagtcagtctagggttttagtaaaactattgggatttattcgtcagtcagttgggatttgatgggtgaaatgcattaggtcctagctcagtaacatgggttccaaggtatttatgctttgtttgttattattaatatgtatctaatttctcattattttatcgttatgtgagtcggtcttatttattcgctctcatgcaaaataatctatgcataaaattttcgctcttattcgtttcccttatttgagtcttttattgctttatttaaatttggagtctgagcatgcattgatcctacttctttgtcttctctagatggccggccacccacccaaccaccgcggagaaggcatgatcgactttgtggcagagttggcacgcatgacactggtggtgggctaccccaacgcgccagagtacacgacgattccacagctcagtggcgagcttcctcaccgtgttcgcttggaggtccacggctacgtgggtacctgcctagctaacatggtggtcgaggcatctggaggcacagcagatcatgcctgtcaggaggcagcctacttgatgatggccagactacgggagcgccacaactacatcttccacgacacggcgtaccgcttccacccccgtcgagccaacggtgatgacgtcagctccttccgtccgacagctggcgagaacgacaccacctttggtcacatgtgtgctgtgatgaggggattggacaggatgcactcggacctgcacaaggcgaccaaggccttgaacgatgggaagctcatgaggatcgtcgctctgaaggacgagatagcgcgcctgaagagggagaacgctcagctaaagggtcttccagcgccaggaggagtccggatccgcactacgccccgcaagacgacgacggcacccgtgcgcatccagcttgcgcccaggaacccacctccatccgcagctcccgcagcacctccagttccgcccgcagctccggcagttcctgcagctccagctcccgcgtccgctctctccttcgctcccgcatcagccgccaggggtccagccagtggcaatggaggttggttgtctgctactcccagtggctcagagtcaggcagtggcgagacttatctgccaggctccgggagtcgctcagagggacctggtgacgagcaggaggacgccttcgactccaccgaccgcaggagccgttccgagcattaggctcgttttccattagtttatcgactgtctagcttctgcttgttaatttgtgtgtttaggttgcttgtttggggttagtcgacggtcgatatcatgtgcctatgatatggctgtcctaataaggatttttgcttgctctttaagtgttttaattcagatcagaacaattgcagttttaattcctttgtaataaagcttagttcctgagcatctgtttttcttcttttccccgtctacttttccctccagatggtctacaccaggaatggtagccgcgcaacaggcgagggcagcaacggcgaagaacgcgctgacggtgtgcaccccagcagtgattccggcaatggtccgccaccacttcccgagaatccgacccttgcccaagttatggcacatcagactcagatgatggcagccatgatgcagcagatgcagcagcagcaccagcagatgcaccagaggatgatgcagcacgtcgaacagcagcaccagcagtttggtccccctccccctcagtccaagttgcctgagttcctacgcgtcagaccacccaccttctccagcaccacaaaccccatggaggcgaatgactggctccatgccatagagaagaagctgaatctcctgtagtgcaatgatcaggagaaggtcgctttcgccacacaccagcttcagggtcccgcgtcagcttggtgggacaatcacatggccacccgcccaccaggtactgaagtcacatgggcagagttctgccgtagcttcaggaaggcgcaggtgccagacggggtcgtggcacaaaagaagagggaattccgggcactccatcagggcaacaggactgtgacagagtacctccacgagttcaatcgcctcgcgcgatatgcaccagaggatgtccgcaccgacgctgagaagcaggagaagttcatggcgggtctggatgatgagctgaccaaccaactgatatccggggactacgctgactttgagaggctggttgacaaggcaatccgccaggaggatcaacgcaacaagatggacaggaagaggaaggccgcacagttcagggcacctcagggaagtcaccagaggccgcgcttcgctcctgggcagcagggtggacctaccaccatgatcgttcgtcagcaccgcccgttcaaccctagcaactttccccagggcgccagtggcagtcagaaccaccatggaggtcagtccaaccgcggtgcagcttcacgcccaccaatggcaccggcacagtcaggccagcccgcgcaagccaagaaggagattggagcaaaaccagggtcctgcttcaactgtggcgagcttggccacttcgctgacaaatgcccgaagcctaggagtgccgggccaaggtttatccaggctcgtgtcaaccacgcatctgcggaggaggcacaagcagcaccagaggtcgtactgggtacgttccctgttaactcaatccctgcaacagtactttttgattctggtgcgacgcattctttcatttcaaagaaatttgtcgggatgcatgggtttataagagaagaacttagcacaccgatgcgggttcataccccagggaatagctccacttcggttcaattcagcccttctataacaatagaaattcaaagatcaccatttctagccaacctcattcttctcgaatccaaagacctagatgtcattcttgggatggattggctgaccaagttcaagggagtcatcgattgtgcgaatcgcacagtcaccttgaccaacgagaagggggaaacggtagtgtacaaatcaccagactcaccaaagcaaggagtctccttgaatcagattgaagcggaaatcccagtggacaccgtggagaggaatttgaggaaattggaagacatacccatagtctccgagtatccagaagtgttccccgaagacctcactaccatgccacccaagagagagattgaattccggattgacttggcaccgggaaccgctccaatttacaagagaccgtacagaatggcggccaacgaactagcagaggtcaagaagcaggttgatgagcagctgcagaaagggtacattcgaccaagtacttcaccttggggtgctccggtcatttttgtggagaaaaaggataagacgaagaggatgtgcgttgattaccgcgcactcaacgaggtcacaatcaagaacaaatatcctttgacgcgaatcgatgatttgtttgatcaactgaaaggagctaaagtgttttctaagatagacctgcgatcaggctaccaccagttgagaattcgggaagaggatattccgaagacggccttcaccactcggtacgggctatatgagtgcacggttatgtccttcggacttactaacgcacccgcattcttcatgaatctgatgaacaaagtgttcatggaatttctggacaagtttgttgaggtgttcatcgacgacattcttatctattcaaagtccgaagaagaacatgaacaacatctccgtctggtactcgagaagttgagggagcaccagctatacgccaagttcagcaagtgtgacttctggttgacggaagtcaaatttctgggccatgtcattacagctcagggtgtggcagtcgacccatcgaacgtggagtcagttaccaaatggaccccaccgaagaccgtgtcgcagattcgaagttttcttggacttgcaggttattaccgtcgattcatcgaaaatttctccagaatcgcccgacccatgactcagttgcttaagaaggatgagaagtttaaatggacagccgagtgcgataagagcttcgaggagctcaagaagaaattagtatccgcaccagttttgattctgcccgacccgatgaaagacttccaagtctattgtgatgcatcccgtcacggacttggatgtgtcctaatgcaagagggcagagtggttgcgtatgcctcgcggcagttgcgtccacacgaagggaattatccaactcatgacttggaattggcaacagtggttcatgctttgaagatctggaggcactatctgattggcaaccgctgcgaagtatatacggaccataagagtctgaaatacatcttcactcaaccggacctaaatctccgacaacgaagatggttggaactaatcaaagactatgacatgagtattcactaccacccgggtaaagccaatgtggtggcagacgctttaagccggaaaagttactgcactgccctatgcatcgagggcatgtgtgaggaattgcgacaggagtttgagcatctcaacgtgggaattgttgaactcgggttcgtagccgctctggaggcacggcctacgctcgtggatcaagttagagcagctcaagcaaatgattctgaaatagcagagctgaaaaagaacatgagagtcggaaaagcccgggatttccacgaagatgagcatggcacaatctggttgggagaaagattgtgtgtacctgacgacaaggaactgaaggatctgatactcaccgaggctcatcagacccagtactccattcacccaggcagcactaaaatgtatcaagacctcaaagaaaggttttggtgggtcagcatgaggagagaaatagctgaattcgtcgcactctgcgatgtttgccaacgagtgaaggcagagcaccaaagaccagcaggtttactccaacctcttcaaatcccggaatggaaatgggaggagattggaatggactttataacaggactgccccggacatcatcgggtcacgattcgatctgggtagtcgtggatcgactcactaaggttgctcacttcataccagtacataccacatatacgggcaaaaggttggcggagctttacctttcgagaatcatgtgcctacatggagtacccaaaaagattgtatctgaccgagggagtcagttcacctcaaaattctggcagaagctacaggaagaactggggacccgtttaaatttcagcacggcctatcacccgcaaactgatggtcagaccgagcgagtcaatcaaatcttggaagatatgttgagagcttgtgctcttgattttggtggagcttgggacaaaagcttgccatatgcggaattctcgtacaacaacagctaccaggccagtctacagatggcaccgtttgaagctttatacggccggaagtgccgcacacctctcttctgggatcagacaggcaaacgtcaactgttcggaacagaagtattagcggaagcagaagagaaagtcagaattatcagggaaagattgaggattgctcagtctcgacagaagagctacgcggataaccgtcgaaaggagctcacttttgaggcaggagattacgtgtatcttcgtgtcactccgctccggggagtacaccggtttcagacgaaaggcaagttggcaccacgcttcgtgggaccatacaaaatcttggaacgaaggggagaagttgcttatcagttagaacttccatccaatatgatcggcatccgtgacgtgttccatgtgtcccaattaaagaagtgcttaagggtacctgaagaacaggctgattcggagcacattgatatccagggggacctaacatatgtggagaagccggttcgtatacttgataccagcgaaagaagaaccagaaataaggtcaccaggttttgccgagttcagtggagtcatcattcagaagaggaagcaacctgggaaagggaagatgagttgaaagccgcccatccgcacctcttcaccagctcctccgaatctcggggccgagattccgtttaaggggggtaggtttgtcacaccccgaagttttcctcccaagccaaatttgtaatttataaatgaccctaagaaaataccggtgcaaatcaggagaaaaccctaagaaagtaatgcaaataataatcggatttgacatgtggaattttttcacctctcctccgtcgaggttcgtcgccggagtcctcgttccctcgcactcgggtgagcaccacctctaccgccgccttcggccatggcttccggtcgctgtggctcatctccctctctctaatccctctctcctccttccttagggcaccccga

SEQ ID NO: 62644 - DNA, 1955 bp, Oryza sativa
tcctctacgctttactgctctcgagaaaagattcagattaaaaagctgattgtctgtagattgttttaattcctgtaacttattaagtaagtttgttaagtaaggatataatgcattggaaataggtaaggtatggtaatcatggtttttatttatttcaggaggtatgtaaattattcttttttcaagatcaacatcctttatttttagttttattaattgagtccgacgaatcgctgtacaacgaagtgtcataataattgtttgtacaaaccaagtaggacgcagatattcaggaatgttagcattttcttgtataccacaactcaatttttgtaactgttccgggctatatatcttctttctatgttttccctctttaactgataacttattaaatggatttttctccaaagaaagtatttcgtattctataccaaatttgaagattgtttttagttgtcgaatgtagctattccaagttacagggctaatagatttatctacaacgttctttctccactctaacaaacttgtaactgtcagatcatctggatattcgactttgcagtttttctttaactgccgtattgctttttcatagcttttgtattgctttttcatagctttttatggtgtcaatacgcaaacgacgatggaaaaaaatgagtcaagtaaaatatcgaatgaggctttatcattctgtttctcctctataagtgttaaatgtagattgtcaatgagaacctgtttaccgaagaaatattcagtatctttaatgagatatccacctacctttgaggattttcttgggccaattaccgaacatttccaaaagttctggctatctttattgggtagatgatatcttttgtgcaattttaaatcttgaaaagcatattgcaaactttcaatatctttttttgtataactaactcccttgctattaaaataatctgtaaaaataccaggcgttactaaaaataggtgattcttcacgatatgaagtttggcattttttacgtttatagagagtctttttgttgcaattccttgtcttaaccattcaataaacgcttgtcctgacatgatgttggggttaaccatttcttcttccggtaaatcaattactgtaccgttttctatattttcagatatcatttgaatgggtttaactatctctatagtatcgttactacttagattggttgtttgctctgaaggtgtaaataattccaaaacaaaatctgtcatattttcattttttttcgcttcaacttgattttcagtctcgtctaatatgacttcactatttgttgtttctaaatctgatgatggtacagcctgttcaggtttgtttgttaagtctgcctcagtagtcatagtttcaatagatacttttccagcaaagaagtctgggcgatcgctaacattttcccaaatagtttccggctttattttaagtagagtaaaaggtttcgggggacaccatcctgaatctgctttttctgcaatgccaaattgccatatcatcaggtgttgactcaataacattgagcgattgcatttcactaaataatttagggttatccgatggtgcagatataccttgctctaataagtatgcccgaatttgatcagctgtcgatttactcattaaccaaagtccgtctatggtataccaaccatccgcaggacctttaggggtatttatctttaatttatgttgcaataagtagagcaatgcaatgattaattgtttagcaaatgatatagttggacgctgtgctaatttcgttacatcgccaccgagagctaaagttacgctgttttggtctgctttttgtactatttcagatagtattccggctttatccgggtgatcagccattgcatacattaattatgaaaacacttcaggatattgtgtcagccaatcaaaggcttcttgggga

SEQ ID NO: 62645 - DNA, 628 bp, Oryza sativa
ggtgtgcggattatcctgatgccttgcaatttattgagcattttcattcacaaagcccagataataaaacaaactaccataatgtagtggttgatcaaagtttagaaaaattgcaacttgataatttatctgagcaacaacgtcagcaactgattgagaaggttgttgaacaaatagacaatgatattgctattttacctatgttccaatattatcgtagagtggcaattgacccgacagtcttaggcattgatctaaataataatagcgaagttatttatagcaaacacttatatcgaataaaaccaaaggattaattgatgaatcaactaaacggacagcaattgaatgacattatattggtgttgcaaaattttacccattcaacactaaaaaaagatttaattagcttaaatgcctttaagaaagcggaactaacttgcgggattttaaggattgaattaagtatgccttttgtttggcaaacaggttttgaagcattgcaagcggaagtagaacaacaacttaaacaaattacaggtgcaagcggtgttaaatgggtattaaattaccaaattgctacacttaaacgggcaaataatcatccagcggttaatggtgttaaaaa

SEQ ID NO: 62646 - DNA, 564 bp, Oryza sativa
acttaattacctaacgctacctgtgcatttttattctcgataaactcaattttatagccatcaaggtcttcggcaaaagcaatcactgttttaccgcctaataccgggcccggctcacgcgtgattttaccgcctgctaaccgaaccgcttcaacagtggtataaatattatcaatacctaatgcaatatgcccaaaagcattacctaaatcgtagtgatctactccccaattatacgttaattcaagcaccgcattttcactttcatcggcataacctaaaaaggctaaactatacttatattgttcattctcactagtccgtaacaaacgcatacctaatacttcagtataaaatttgattgaacgttctaaattccccacgcgtaacatagtatgcaaaattcgcatagttaaatcctcattagagttaaaaaattgtgcttattatggcataattctgccttaaaatcatttttcacgctttgtactttatgtcacacgatcatagttctgaaacaaaatatgatatagcctgctatgcattgtaaccgatgctcttaat

SEQ ID NO: 62647 - DNA, 770 bp, Oryza sativa
  unsure (1)..(770): unsure at all n locations
gattttccaataatgccgacaatgccgcacataattaaaaacctctctatttagtagtagtcgtagaatttaaaaaacttgaattagcttgtaattgttcaaagaaccatttcacaataaaatcgaaatgcggaataagttgagattcctgccataattcagtttggtttgatgttgtaaaagtatctatgaaaaataaaatagcggctacaatcaaaataccgcgtaatgctccgaaagcaatgcccaatactcgatctgtcgcagataaacctgtggtgttaataattttacttagtaatgcattaacaatcccacataaaattaatgtgataataaataagatagccgcctctataccattacgtaagtattctgaattttgaaaataaactgaatcaatttcatttaagtgactgctcaaatnagaagagacgtactcgcgacaaagaagcagaatccatcctgaaagagaaagtacttcacttataaatcctcgccaaagactaactgagatagaaaaagcaattaagctaatgataattgtatcaatcataaaaaccccaaaaggcgaatcgctatattttacaaaaaaagaaaacgtttgcgtagtgcaaaaacaataaaaaacgaaacaaatatgttacaaaaaaataataagcggtttatttctgcaaattcttagcaaaatccaaccgcttgcatatatattatgcgggctgataaccaacatcttctaacgttgggttatttgcgccgagtttagccag

SEQ ID NO: 62648 - DNA, 1255 bp, Oryza sativa
attaagtggtattgcacaatctgattcagtgatttggaaattatcagacgctgattttttgcttaataatgcgttacgtaaaatggtgcttgataatgatattgataccaccaaaaaattattattagaggcagatgccatattagcacaagtgccaaatgataaagtagcagacatacgagaagcgattagaaatgactgggagctactagccaatatgaatgtagtggatcaaaatagcttgatgcaacaactaacgacattagcaaatagcttagatgatttaccgatgctgtctagtgggcctacagaagatgatccgattaccaatagcaaagtgagtgattcgatcaatgattggcaacaaaatattgaaaagagtgcaagttcattcttagaccattttattcgtgtcactgatcgtaacaaagcagatgccaaagtatttattgcaccgaatcaagaaatttatttacgcgaaaatatccgcttgcgtttacaaattgctattttagccgtgccacgtcagcaaaatgaattatataaacagtcgattgatgcggttagcacttggattcgtagctattttgatacgcataatgagaatgtgaaaaacttcttaaaagaattagatgatttagctgaacaatctgtttatattgatgcgccaaaccgcttaggaagtttagttttacttgaacaattactgaataaaaccccaaaagcgatcgataaaattgaaataaaagctgaaaaagcgttgcctgagccgacagacagtgaagttaaaagaggtgaagcaaatgcagaagctatcgctgaggatgaatcaaccgaagcaaatcattcagcagttgaaatggacgtagaatcagaagcttatccatcatctagatcagccgagcaaacggctcaataggagaaagttatgtttagagtgctgtttttaatgctgttattgcttgcaggtttagtcgcaggcccatatcttgctggaagtcaaggttatgttcgaattgagactgattcgaaagtaattgaaatgagtttagtaatgttggtcgtattctttattatggccatgtcaatggtttatattattgaatggaccatcattcgtttttttcgtttaagtaaaggctcatatagttggttctttcatcgtaaacaaaaacaagcccaacaagaaaccttggaaggcttaatgaaattccgtgagggggattattctaaagcggaaaaattgtttagcaaa

SEQ ID NO: 62649 - DNA, 10849 bp, Oryza sativa
gttgtgaactaaacttctgggcaatagcattaatgcaagacctgttcctaagttactctccattgacaaagcttttactgtcgtagtacttcttctcactggcttctttcttctcgttccgtttctgcaaaagcaacgccacagactaaaaatgaacaaaaccacagcacatcaatggaccagaataaataaatgcaaactacaccaagtccccacaccaaacaacatgttgctgagcgtagttatagcatgaaaaaattggtcccagagaaacagataaatatttaaagcgcatatgcaaagggcttcaagaaaacactaacacattatcacaaacatcggtttataataaatcatgtacacacatcattaatatgaagtagacaacaggcaaatcgcatttatttgactgggattatgtactttactacatgctgcatgcaccaaacagaaaaaccagactccaccagccaatttgacgtagcaccaatataccatgttacatacctggtaggcttcatggttagcaactatcctccttatgatagtactagtagtgatgtctaaagggctctccagcctacggtagatgcccatagcccttggaacagcatatggatttaaatcatcctgataggtgcacaagtaacagttgttaatgatcaatgctatacatctttatattctaagaaaatgtattgtgtaagtaaccttcataaagtccatattctcagcaattgtcccatgaacaaccaacgaaatattaaatgtggtaatctgcatagaaaaaggaaattagctacctccagccacactgcaaagacacataccctgataatcataagtaacagttaagggtatgaatttcagatagtcaatttcaatgataatattgcatacaaatacataatctggttcttaacatatctaacggaaacttagactacatcaaattaaacttttggaaccaagccagctcctaaacttttagtttatttgactgacaaaattaacgctacgtgcaaatcgtgcatctgcaaaaaatcatggataagcacaaatcagaccatatctgttaatctgtatctaaaatcaataatagctgtgagcaaggcttttgctggcgtagcataaatatcatgttcaatctttgaactgtgcatgcatagctgtgccatgttcaatgaactattactagcagttgcatcaagcaattcctactacagtaagagagcatcatgataaagtagaacagaaaactaaccatatctttcgaaacatcccatggagcaccaatgatcacttcatcaacataacggcaagccaaaacactcaaacttctctcatggaggttcatgattgggcgatgtggtcctcttgttgaactggcaaatacagtaaacaccaagtgcccccaaaaacagaatgttatgacgacggaattgagtagagatgctatgcttcaatacaaatacaacctgactataaactaagatgcaaaactgaaaaacagtacaagcattgtaacttggaaaaattgagacagtgaaaaaaaaaaccatcattattaccttatagtctggtctgtgtgaatacccacaagcaggaaatctccaagctctcgagcgaggcgcaatatctaagtagaagaaactataaatacacaggaagtccaaatcactatgtcttagaaagatcatttcagtttgcacccttgcaataagaaaaagaaaaggaaaaggaaaaccacaggtaaaaccatacaaccaacaaatgcatagccaagttgctctacatgctgagacagacatttgacattgcgtttacctcaacatgtccagcatggaatagatcaaatgcaccatctatgtacactatccgagaatctggacctggaccctgcataggtaaagctgacagtcaacagaaagaataagtggccgtactcagcaagtagttttatctagtgaatagtatcaaatgtaaacagcttgaaataaatgataaacgactaatgcaatgattaattaatagttgagcttagcagcatgttagttcttgttggaagttcaaggatataacttatattctttattaatataacctcagaacaaatctaagttgtgaaataatccatttgtcgtcaggtcattcaactcaatgtttactagataaagaatgcaaccaaacaacaaatgtctttcaaatggcaaaagtaatagtaaaatggtaacaggatcctgaaagccaaataactcgtgctctactgtttaaaggcaaaaaaaaaaaaccatctatgaggcatttttatgctgtcaatgtttaattcatgccttcaaaaaatatgatatctcaaaaaaaaatgacattcaaagttttacatgagcagttcagaaaatgatcctccgtgaaagaatgtaaagagctgtaccctgctatttgagaactgaactattctccgagatgtaggaagaaaatgagatatcctagttccacttccagatccactatcatcaattttctggccatgcccgtgactgaactgcctttgtagtgaagagtggttgtgactatcagaagctgatctctctctaacacaaagaagcattcttcctgtagtttatttactagaaagatgagctgggcagttagcatgaaaataaaacctattcatgaccataagcaatttattgatacagaagggaattatgtagttaattgtctggagagcttaatagcttatcagttcatcatatgataataaagcaatagtttgaatgttttcctaaagtaccacttcaggacaaatcaggtgggcattgatcttgtctacaaacaattatttggttgacctataaataattgtaatgttggaaattgctatggtattgagccaaagaaataacttgtaaagttgtagtacataacaaaaaccatatattcccttgcgatggaagttttaggttaaatttcactatgagtaaaaactttaatgattaaaacagaaaagaacagaatcaataccaacaatgtctgtcgttgacactccttcggttcttttaatctgcttatatcgaccaacctttttggcaagagcatatgcatcagtaccatctgggagcagacaaggatcatcgccatgaatgatataatctatattatactcattgaataatttattcataaaatcttcagttatggcgtaaggtgcatctggaatgacatcgtgcacccattttacagcacggaccattatcaacctgtatatcagaaaaagaaacataaaaaaatcattccaaataaaatggtttttttaagtagaaaatatgagtatatgataatacataatacattcaaagaaacaaaactgcaagtctaaaaggacaaaaatgcccaaaattccatacggcctggggtcacacgtaagattggtaacacaactaaaaatagaaagaaaaaaaaaccaatatgtgcagtaactcctaaactggaaaaccagacacaatgaaagtcagtaaacaacaaaagaaaaccagcaaaaataacaaatttatagtgttgctaaactaccatgatgatgattaaatgaggaaaaaaaggttgcagcgcctaacatctaaaatgccacacataccatgtcatatgtgagcagcttgtgattatcaacaagacaaaggaaagcaaggaatcacttagcaggtacttaaggcaaactaagcagaaccaaacctgcaagtctagtatggtttatcgttaggagttaataagttttttggatttgtatgaatgtacagaccaaaaagtcactgtttagtacttttcagcggagcaaaccttttttttttctgtgtttctccttcaggcacccaaaagaaatagagctaatctttttggttactgcacagatattgaatccatactctcaaatgaattagagaaacatatgcagctcatccaccaccaaagttatcagaaacttggtccgacgactaactacaacccacatgtcacaacatttcccttagcaatttcaaagtttccagatagaattactggactagtgctcaaattaagaccgacggacacatatatgatgtgtggggggaaaacgttgcatcttcaaaaactaatctgaggatatccctataaaagcgctccactagtaacttgtattgtgcaacagtacattgaacgcaactaaagagtcgaaactgaaacaaatcagcgtgtgatacaaattaagttatgaaatagtaaaagcagtaacatattccccatgattaggacagaatcagtgtgcagctgaaattgaaacagaagataggaagtttgatgcaacagcttctcagctaacccattaaaccagcaaaagatcgaacaacccacaacagttacccccaagaacttgaaatgtccacagaaaactgcagaactagtgcacaaattgaaactgacgggtacatatgtagaggagaattcactacctataaggctaatttgccattttgcctgaatcattattaaagtgcacaaccagtatcaggcaacagtttggtaggattacatcgtgcatcattcaagattttttttaaaaaaaaatgacgaagggtatggagtgaacctctcgtggagcggcgtgacgggcgggcccttgttggcggtgatctcgtcgtcgctgacaacgccgacgatgagctcgtccccgagggcgtgcgcctggcgcagcgcgttgcagtggccgtagtgcatcatgtcgaagcagccatccatgtagacgcgcacgggacgtcggcgtccgcggcggaacctgcggcggagcgcgtcgacgggcggcagggcgggaatggcgacgggcccggcgaggtggagcgcgaccacggacgcccccagcacgatcccgccgatgacgcatgccgccaccagcttggcgctgctgctccccgcccccgcctccataatgaattgggagattgagcagtgcgagaaggagagagacaggaaggaagagggagattggtcgtgcgcgagagagcgtgggaggagggatctagggttagggattggggcgcgagggtggaggaggtatcgccattcgaggggagggcgcgacgcgaggagatcagggagatgcgggaggggagaagccgcctctggttctctctcttgtctctccgagctccgcgagagagatgagagatgaggggattcgctgccacgtgggaccgacgagtcaattagcggggcccacatggcggtgtgacgtggcatagcagaagaagttgccaggtttggcccacgcgtcggggagggagctgtttttatgtactctgtactaatccacgtaaggcgtcgaaaataaatacgacattagcatgaggatgagggtttatggattggttcagctaaccgtgttaaagaatgaacgtcaagaaattcaaccgatggacaacgatatgtgtagctaaatatacttgattgattatgacgttggatatgctcaatatatgctgcttcagttgcagccaggagccagcattagggcatagggcatgtacaacggtttttattagtggtctctttctattactatgcaagtaaatttgatgacatggaagaaagagaaaggaggagagaaaaatataattgttatgcatgacaacggttgagagtcgactcttagcatttattagagtaaattttgttgcatggtggttaaaaaaagaaaacaagagtaagaaaaaaaatattttgatacattaatggtagagaccatattgtctctaactgttgtataacgttagattctatatagtgtagagctcatatagtctctatctttgtacatgcccttagatgcgatgtgagcccccattccgtatgcaaagatatctcaagtggaggatctcaaaacctgaaaatgacactttttgtacgtctttggttctgttttctacctcaaacatgctacttaaagaatactactatttctttgcaaaaggaaaattgaacttgataaccaaagaatacaagtataattcagctcagtggctaaaaagttctctccctgagacaagtatgagtgagattaattccaacccaatggtcagagaccacatcaccatacggcaaactaactacgaaatcaatatctttggaagccggtccaatctgggaattttgtgtggttgttactaaaacccagcttcttcttcttcctccctcattcacaggcatagcgttttgttttctactcatttatggcgtcgcgcttgtatgccatgctacaaacacgaaacaccagcaaaatatcatgcgtgctggcaacagggtaacagcgaagaagaaacacagtgattagcataaaaggaagggctttttctacagcaaactgaatttacaacatgttaaaaaacgagtacactacacaaacaggatgtcagcaaaatacagacaattccgtccaaactgcggtcaaagcgccatctctgcttgaagtttggtcagttcagccaaatcattggctggttgagtagtcgtaactctcgctgaaggttccatacttgtcctctgaggtggttcaggcagatcattctcgagctcttcctcctctagatcttccagctctgcttctagctcatccttcatcagaataaataaataaacaaaaaccaagtcaagcatcttatgaaaattgacaccgtgcctgtttaaatgcatacatgtatttacatctccgtggaatggctattttgaattacataacttgatcttgcaccacttgttaactgacaccaaaggggaaaaggaaatatgagcagtacctcgtcaaaatcagcagaagcgccaattggtgttgcaagggcctcctgtatctgcctcatattctctgtgtgttcatttgcctcttcaatggcattttcaatgtcatcgatactcctgtggaacaatcgtcgttacttaccagtttatctaagtacatgttattttaaattaagtttcaacacattggctacatctaagctagaaagatatattatgtattcataaatggacattgttgctgaatttaactatgcatgctgtaagtttgaaaccatatttaagttcacattgtgcacacaagctcaagaagacactgctaggctagtaccttttcgcgtcatattactcaatttcagaaaccatgattggaaagaagagagcaaacacagacttacactgactggtgaatagctttgacagcagatgatccagagcgcaaagcatcaacagtatctgtggttgcctttgcactctcaagcattattatctagcataccaaaacagactacttcctgtcaattcatttcaaccttcgagaatatccaaatgcttcaaaattcaagattaatatgcgcacatatctttcatcacctgatcatgaacccgtaattggaagtttgctagctgctcaatctgtgtttcatacaacttctttttctttagacattgaattgcagctgcaacaaacaggaagttgtttgtcatttaactaagagaaaagtacattttattattttaagtccctgaactctatcaaagcctaaaattcgtccctaaacttcaaaactggacattattcatccctcaactctttaaaccttaattaacaaagtcatcacaagcttgagaaacatttttttcaacattaaggaaccataagttcataaccatatattcagggaatggtatatccacatatgcaagcatactaacccacaatttttctcccatcttatacgtgaggtatggattatgtgcaagacatgaacatgggagattggtatttgaccaaaacacaatggtcacatattgcacaaccaaacatatttgagaaaagttgtgaaattcttcaagtgttaatgcataatccaaaaaaaaaaaaacaaccttaggtacagcaaaattatcacaaaattgtaagacatgcgcagtatgtttcttgacaaacaaataagtttcttcgacgaaatgcctaccgcttttgttcttagcttttgtatagtccttagctctttcgacttctgcagaagcctttttctgaaggaaacactctttcttctccagcatttctagagtctacacatttatatcgtattaaaaataaacaactgcaaatggtaaaaataagatagcaaaataaacatcttcggcaatattcataactcagagcaacttaaatttatccagttaattacctagtatcagttcgtcaacatataagagaaatgtcaactttatttcagttaagtttattatgagaaatgacaactttcttcaacaatacagaacgtttattatgagaaatgttgctttctgacattaagtatgagacagaatacagtaatataagtcgcagaggctgcagctcagacaatacatcgacctaatttgaagtttatttttccttttcgatatatgattaccactccggtcatttttttgtgtgccaaaacatactttatatcaatgccatcagaagtgtcaggatcaaatactttcttttattatgtccttaaaacataaggttctgtcaaaaaattgactaggcaattcggctgaccaaacctcaaattcaactaagtaaaatcttctagaccaatggtaggaaatggtcaagataaacagatatctagttttgtccatgtcaaaaaataacttaacagtatttttatttcatactttcttctagaagcccattgggaacacgaaacattcacatttctgcattcaatataagatgaacaaggttgcttcataagattgtttccatatttacttgggtgatgcatagtaatgaggatctgcattacttccaagtggttaattcctaattctagagtctacacctttttattaacaaaaactaattagagatatctccaaattgtgcttcctatcttgttgacagttgcttaacacgatacccctatagcagatagatttcttctgaggaaacttaagtaaagaaagcagcaatgaaaactagcaataataagcaaaaggaaaagggataaacaacctcatgaagcctatccaaagtggggagggcagaggaggcagcctccttcttcttcttgctcttgggctttgatagcagtttcttcagcatcttcttgtaacactcacttgatcttcaatctcgggtgacgatagcctgtgtgggaataaagaggtgaatgatgaatgtatatagcctctccagtaggattgaagattaagagaggggaaggggaagcaaagggaaaggtggttggaagcagattccttgagaaaagtaggaaggaaaaggcagagatggccaaggaagatagagaagggcatgtctggttgtctacttatgaaaaagaaaggatgacaatatggtgaggtcactattttgagatacatgcttgactttttgtttatgacaacttatttttagaaataaatatatcttcagagacaaaaaaaatgaagttttgttcgtacaagcgtaaaacaacataattatagtgctcaacactgtaaaacctcgaatttacaactagtggagattttatgcatagtaaaagatgaactgaataaagttcatgtcaagaccttcagcaaggcccttcccaaaaaaaaaaaagatttgcttcctccggttcatattataagtagtttgactttttcgtagtacaatttctttaggtttgaccaactttataggaaaaattagcaacatttatagcaccaaactagtttcattaaatttagcattgaatatattttgataatatatttgttttgtattgaaaatgttagtatatttttctataaatatagtcaaacttaaagaaatttgactaagaaaaaagtcaacgacgtataatatgaaatagaggaagtaatagtaaaaggactgagacaattctgctgtaagtagtaaagtacaacggttttatttagaagacaaccaacactttgagcttatcagaaagtgtgtattaggtatgttggattaggtttgccttgcagcctagatattttggcatgatgttgcgttcacgattcaagtggttagttgttcgtactttacataggtaatcttgacaacagttgtgattttctgtggtctgcatcctacacaatactttataagtggttgacctgctgtttttccattgcatgcagtgatgattaaaacttgttaattgaactttttgccattttactaatgtgggtgaactgcagcttcctaaatttgccataaaactaaaagcaacataaagctgtattattaatccatttttttaaaaaaaactgaaggatctaacttctgcaagcaagtttttttttacaacttctagatgccccagctactccccctgttcatctgtttggctgcaaaattagctgagggacggctctcccaactcccaggtcccaccataagaagagaacagcaaacactgacgaatgtaaaaaaaaaaaaaaaccaaaaccaaaagggaggtagctcaagaataggcatgcaagatggaaatgcaaatctgaaacatccacatggtattcccagacctaggcagtatattaacgcgaggaatagaggggggaaaagaagcataccaaccttgaccttggctactggctggctaagtggctagcaccgcattgagtgacggagccgtacagccgcacaagcctgaggcctccgctgcgccgcccgcggaagaagaacaagtccggtccggatgcgctgttaacaacctcggcgagtcgccctagaccctagtgcactggctggctgcggctccgactcctcttgtctctgcggtggcctgag

SEQ ID NO: 62650 - DNA, 5220 bp, Oryza sativa
tttcctgcgatggattgaagatgttcaacaaccacttcctgactatcatcatcattccccaaactatagctagcaaaccccttttttgcaacttcaaggttgcattgcactgcactgcacaagccaaagggggtagagaggtcagtgtctttccaagctgacctcgtgccagtagctccccacactagcacaagagaacaagagacaacaggtccctctgctggtagaaaaggactagtccttctccttgggggcaatggcaatgctgggccctggggacaagaaaagattgggccctttgcttgctcgcttggacccttgaagccttggaggagagagaacatgagaaagagggaagcttttgtagtagtagcagtagaagaaagaagccaatgccatgcatcaccccatcatggcaagcaggcaaaggtggtctaaaggcattgttgggaaacaaatttaaaagcctgccttctctccccactctgcctgaccccaatcccaacccctctctcactccacaacaccataatgagtgtaaagtagtgtaagtataaagaagcaagtgattcatttgagggtaattgcatcatcaggtggatctattttccaacccttgaatgaaagtgatgttcaagattgccacattggcacataaccaactttggaaatgtgactaggaagctaaatcagttactactacttttaatagtgaaatatggcattggttggttggaaatgcaggtgcccagtgccaaaaactgccactctttagcaaagtaaacaaagtatcaatgtgtagtaatctggcagtgaataaacaacaatcattcagacatactactattttgcataaagctggtaggccaataagatgcagacaaatggtagacaacgccagcattagaaggaagggaaaaaaaacatgtgaaactaggaatgttaccaactcaaggcaaatcccaaccaaaacattcgtgatgatattgtaatgaagaatatgcaagacaacgacatccaggtaaacaatgcccaagaagcctgtttggcttaggttagctaggaacaaaaaataaatagcaaaactagtggagtgggatttcttgatggggatagtcaaataagaaaatcaccagaatctcaatcgtgtaacgtaacctttgtgataaagaaacatggaaccaagctgatcatacaaaaaggttatactggccgaagtgtccaggaagcaagacttttaacaagctaaataaccatcacggacggaaaggtgaaaatgatgttaaaaagtaaaaccatgtatatccagtagatgccggatacaggaataagtgaattccataataagattattgtaatgcaaaaatgttagaaaagtgatacaccaatgtctaaatgagcagtgtaggtcagtggtttcaaatatttcagaagaaaagaattagcaggatttagatggcatgaactaaaaccactaacatcctgactttctagtacacaactactgtgctacccatcattagttcattgctgatgatttggcattcagaaggagcacccatcaatgatcaccgaataataagaactcctgtgccacccaacaatctaattgaactcactaaccaccagatatgatcattttgtgatcatatgaatttcatgtcagtaaggatccttttgcgtgttcccccaaaacaatgtcagcaaggattaagcactacaaaattgcaaaataaactaaattggacagaatggttaactggagcatgaacagaataaaagctaaagctaagttgcacattagtaactaccactgtgtggagatctgaaaattagtgatcagaatttttttttatttttcttttctcagaattgaccaaattgagcagctaaaagaagcaaaaggactaggtaattgcacctaagtaagatcaagtgatacttcagctctataaattccccctcaatactaacgtcccgaagcctgaattgggcgccaagcagaggcagtgagaaggcacagatccttccatccgagcttcagagcgccattctcctcaataagcgtgtatccatcggaagggaacatcccaagcagcagtgcagcctgagcagcagcgcttccagcaagcgacgacacacggaagcccgactgcgcaagcttttcgcgccagctcccaaacttaacatcgccggtgcgtgctggaccgcccacggctagcacattgcggatctcccgcgacaagagttgttgctccacgacatgccgattcgggctatcctcgctgtaactcgcatcaagcgagtcgaacagtgccgaatagtagtggatggcctccacaaaacgtgccaggaaggagcctgagtggctcagatcctgctccaccattgttacaacctttggcgccaacctgatttgtgtggtccacagagtcaagatcagtacacaaattaattatgattctgttcgacaagaatgactcaactagcaacatttagaactataaatgataacaataagttctcaaggacacctaaattggttgccttgccttcatggtttttgcaagtacagtgggacatatctattgcagtccactactatgtgatctctagtatgaactgtgtatagattgcagccatttcaatttaataatcaacattggtggcacttagaactagaaagctgagaccttttggcatgaaaagttggtcatgatgataagaacttttagctcgttcatagtgatccacaaaccaaatggaggagaaatctttcccacttctcggatcaccaaagaccatggagaagcttgataccacagaaccactagaaagttgcaacctttctaagcctaaaaagttggccataatgacatacttttaggccagtcacaatggctagtgtcattgcacggctacccaaaatattataccatcttctctcaaatgaaatcttttatgaaacaatccccacagtggaggggtttcactttgacgtttccaagactaagcaaagcatttaattgatacaagttgctgggatcatttgtacccaaaatccggcgcggcgcgggagaatgcggaggtcgcacggcggaggcggacgcaagagatccggtgaatgaaacgaatcggcctcaacgggggtttcactctgttaccgaggacttggaaacgacgctgacgagtttcaccaggatgaaactctttccttctctctcatccccatttcatgcaaataatcattttttattcagtcttacccctattaaatgtgcatgacacaccagtgaaacccccattgtgactggccttagggctccaaaacgcaaatctttttttactcctccttaatcatcctatggtgatctagggctagtactactaaccactgatatgatgatgcatagatagagtatactactaggtcacaatgtcaatgagaagtatagggtgtaaagtagccatgattccggggggtcccgagttgacaagggaagagagaagaaaagtgtagtacctctggatgagccagagcgtgttggagtcggagccggtgacatcgtagagggagtggcgcagccagtggacggcgacggcctcgcggcgcgtgacgcccagcttctccgggtccagattcccggccttgtcagccaccgggcagaactcgaacggcaatcccagcgtgtccgcgaagtccgacagcctcttccccgtcgcctccagcgcctccatggacgcccccagcccggtcagcctcaccctcggcggcccccccggccgcgacgccaggatgtggaacagccccggccattggagcccctgcatgatgtccaggtcgatgatgtgcaccctctcctccctctcgaacgcctcctggatcgcctggttcgccgtgaagtgcgagaacttcacgaacgggctgatcccgttgaacacctggaacgccgccgccacgcgcccgtggacccgcgcgcccgccggggacgggctcgggagcggcgcgtacagccccaggcacgagctcaccagccgcgccgacatggcctccgcgaagtaggccgccacgcgctgcgtcgaggtgccgaacggcgtggcgagctccgcgatctccagcagcgcgcggtgcgcctcgtccaggttgtccgcgttcaccgactccgcgcactggagcagcagcgtcagcaagtggaggccctcctcgtcgcgctgcttccgccgctgctcctccttacgctccttggcggccgcggcagccgccgctgcggcggccgcggcggcggcggcggtttcctccgcggtggggggcttcggcgactgcggctggttgggctcctgctcctgacactgaggctcgcgacgccgcttgtcgggctgcgctggcggagggggagggagcgcggcgaccgacgtgggtggtggcggtggcgccgtggcgtcgggagggaggagagcaggatgcgacggcggcggcggcggcggcgcggggtcggagttgaggagagagcggaggcggagctcgaggatggacgcgaggtcggggttacatggccggatgatctcacgcacgttgtggatgagctgcgcgacggagaccgcggcgccgctgctggcgatgatgtcacggatgatgccatccacccaagccgtgctgggcggcccaccctcacccgccgccacctgttgcggcgccggcggcgcgggcgcggcgaggtccatgtccgtgtggtggaacgccgggagctgcgtgggcagcgcggggagctgcgcgctggcagacaacgtcggcgcgcccgccgcggcggccgtgacatcggacaggtcgccggtgacatggcggcgcggcggtggcaggtccatgtcggaggcggggcgcttgcggaccatggcggcggcgaggtggtgttgttcttggtggtctaggtagaggaggagatggtggtcggaggggagaggaggcagcaaggaggtgatggcatgagaggaggaggagggagaataagaggagtgggtggcggaggaggaagaggaggggaagaggaggagggaggaggagcccatctacaaacgccaaggggaagaggccgtgggcatggcgagcggacgggcgtgcgcgggaggcctaacgcttgtgttgggtggaatttttatggaatttggcgcggcgcaagcgaggcgatggcgcgaagggggagtaaagaggaagaggccgagagg

SEQ ID NO: 62651 - DNA, 7119 bp, Oryza sativa
ttttgaagttttggtgtgtcatatcgggtattatataaggtgtcatatgagatgttcagacactaataaaaaacgaattataaaatctatcagtaaacaacgatacaatgatacaaatttattaaacataattaatctgtcattagcaaatgtttactgtagcacaacattatcgaatcatggagcaactaggttaaaaatattcatctcgcaaattagtcgcaatctgtataattatttatttattagctcatattgaatacttcatgtagattcactaaacatggtctatatctaccacggatacagtagtatacgtagcacggcagcacggaatcaagtcactctgccagcagcaacagcagctgcagctgcagctgatgagcctcaaccgaatcgtaaagctactccctggcattgccagatatacacagctatacgtgtacacatttatatactgctactgtgtggtgtgtgcatctatggaacagaaacagaaagcttttcttttcttctttgttgttgcaggtgagagagtgttgtgcgagtgtgtgtggtgttgttgttgatgtgtgtttgttgcagtgcaggctacatggggcaatgtgccaccctgtttgtttgggtggggcctccccggccgggctaagctaggctaggcggctcccggatgggcatactagatctgctcatttccatgctacagctagcgttatactcgcctactactactccacgccagcggatgagtacgtaccattcttcttcttgggccatctcgtcgtgcttgcttctcgccttgctacaaccatattccatcatccatgatagttctttgatccattcgtgttatcgtgtcctgttctcttagccaggcatttcgctgcgtgactcaagggttcgctcggcttgaagaacacctacagaatccaaattcctaaggatcctcctctcttatgagtgtctctcggtctataggaacgcgggcccaggaaaagtcaaaggaatgcgggtctattcccctcttccttctattcctttgcgcgaaaacccctccacaactcatacactctaacggtgtgtatatgtgtaggaaagttttttatgtgatgaaaagttgagaacgaggggaaactaaacacagcctaagtatttctggctatatatgtgaatggtgttggttgctgaacgaattttggaagaaagcttcacaaaaattgaggcaaatgctcattgatatcctactagtaataaaagtcacattcattcacaacgtacagtttgtttcccaggagttttgtccgttacctgaagtacgatctctgactttctttttgcgtacgttggcacgagcgatccgggtatacggatgtaaacgtagtaataataataacagatcaaacttttctcttttctttctcttctcctttttatctcatcggttcattgctgacatcacctaactgcactagctcaacccccccgccccaaaaaaaaaaaagtttcagaaaagccggagggtcaaacgctggtgcggtaactttttccgcagtcggggtcaaacgtgtgactgttcagtaaaaaaaaaaaaagggaattggccacttggaagctaatcgatgggggcttgaccagccattagcgagcgcgattagtgcgtaactttcacgtttaccggggcggtaactttacccggttgagaagacagccgtccttatccacaccggacagcctggcaccagattaaacaaatgtaggtggaataaaatacagacctctcggttaataaagtaatgttttcctactaatgagtctatagtttctctcactacaggtaataataaaataaaatactctactatacatttttttggcataaactccaggtactgtatgcccgtgcagttccaatccatctctgatcatgcaccgtcctcttaattttgcgtaaataattcactatattattgccttttgtttggatcaacctctctcatatcaggcactagaaataattgagggataatgcattgttttttatttttatattctattaggtggtataaattttccatccgaaaatataaaaactacgaatctgaacaaacattaaatatctcttccgatgatactatatttttatatttttgggacgatgggagtactgcataacagtaatcccatttccctcttaatataaagcagaaaatcacgaataaataatcacaggataatgcggcgtccttttcatctgtctgccgtttcaacgtgcgtaaattaatttggtcgtgcatggcctacaccaagtggtggctttcggtcaccacctctctctctctctttcattctctctctctctctagagattcttttccattccaacctcgctgccctgaatccaagagaagaaaggaaagtacactgtgaaaaaaaaaacattccattataacaagaagaaaaaaaaaagagttgagaggcaggaaaagaagagcaaagtacagccagcctcctgcaacatgttcagcagctgtgcttgtgcgcatgcatggtcgtgtgtcctcgtcctcatcctgcattcactcaaagattttccattttgtcttggattttacaaaaaaaaagagacatgttgattttacttcagatttaaaaactagtgaaaattacacagaaattagtacttgtattatatatatcagttcatcctcatcctgcattcactcaaagattcttcattgattttacaagaaaaaaaaagtagacatgttgattttacttcagatgtcaaaactagtactagtgaaaattacacagaaatttgtactgctagtatatcagtactgcaaattgtactccaaggcagaagaatgccgccaataggaagagtggaattttttaattagtgggggtggtttcgagataacagtaggatcaagcatgtttaccgaggtggtaaaaaaagaagcattgtttgtgtggtgtgatgaaagagaaggcaagaaaaaataatactgtaataataaagaaagggaaaagaaaagggaaaaaaaaaaagcaaagctttgcaattaatccatttggcacttgagcccttgtgtgggcttaagcacatggggtggggggcacatatatatatgcggctttccccctagccctccaaaacttgctctccatgccctccccgtctcactgacggtggtccccaccgccccacgctccccccccgtgggccccgttcgtcggcgaccgaccgctagctccggcgaccccctccccgccgacgagatccggccgtctccggtgagctccccccccccactctctctcctccccggcgcgcggcgcgttgtcccacgagaaacccgcgtaaccgctctcctctcttgcttccttgtggcccgtgcgccaacgcgcaggttttcttggagccgctcgtcgtggctggggtggcgccggggggaatggaggcggccggcgctcgcgcgggcggtggcggccgggatctcgccggcggcgcgcctcggtgaggtcaggatgtggctcaattctctcgtttggttgcgaaggtctttctgttctttttttctctctttttgtttggtgagtgcttgagctgaagtcgtggctcgtagatttagaggaaagttaattctgttttgttgtgagttagtggttggtgaattagttggggaaaacgtctgcattttttttctgtttggttcagagcgagaaaaattcgagatttttggagagctttgtgtcatggagagcagcaaccagatgtggccgtttcttttgcttgcggatgtttctttttttttgggtgagaatagagaggtttttttgcttgcattctgcaaatcttggggttattttctgttttgctggattttcctttttgttaggatagataattagttgtcgtcttccgtgtgaattggtcaggtcagatagccaccttagaggttatttttttcttgtgttgaatccaaatctagaactagcagatgatagtagtaatgtactagccggtgctttggtacaaagtctaattattcctctgttttagatgaaacttgatggtagaaatgttttggatataatttgtttcttgaggcaaatgcttttttggatcaagttggctaagaagcagaaaccagtttggatgcccaggctagcagaatcagccatgtaggcaaatatttttttgttggtatcaacaataaaaaatgattgcatatgattactaacggaagatttggaatcgttggtcttagtggtacaaaattttagttgtttacttgattctgaatacgccaaagctgggggaaatatatatttttccatcaaatcaactctgaagatttttttagtgaaataaatgtacctattaagacgaacatgcctagatgagtccattgtttaactctgtagtggtatctgagctaaaattatgtatattgtttgctctgttcttgatccagaaatttagtgcatttcaaatacgctgtgctcattttgctatttatctcaaaatattttccagatgtgatctgtgatctgtccaacctttgtgtactcgggctcattccacagttaacaaaaaagatggaagatttacaagattgtgactgcaaaagccttgttgctgttcctggttctgtggttctgcacctctttaggctgtttaatcagcaggataattcctggcagaagtacacattagcctactttcttttggtcaggaatgagtacttctctagggattcaaggaagcattcagatgggaagaaccaacttcttgactgctgtgatgattcagaattagatttggatgtgctgtatgctgatttggatagtaaagaactggagcttaagttgcagaaacctgttgtcaagactcaatcaaaaggtgactcaagtgccagtggatcaaatgattgcttctttcctggccttcacgacgacctggctcaggactgccttgcttgggcgagcagatcagactacccatcgctttcttgtttgaataagaagttcaatttgttaatcaacagcgggtatctgtacagactgagaagaaaatatggcattgttgaacactgggtgtatctagcgtgtagcttgatgccctgggaagcatttgatccttcacgcaagcgatggatgaggctcccaagaatgccatgcgacgagtgcttctcttgtgcagacaaggaatcgcttgccgtcgggacacaactgcttgtgtttggccgtgaatatacaggtcttgctatttggatgtacaatttactggcccgtggttggtcccgatgcactccaatgaacctgcctcgctgcctctttgcctcaggaagctttggtgagattgctattgttgctggtgggtgtgataagaatggacaggtgctgaaatctgccgagctgtacaattcagagactggtcattgggagactttgccagacatgaacttgccgaggaggctctcatctggtttcttcatggatggaaagttttatgtcattgggggtgtgtcaagtcagagggattctttgacttgtggagaggaatacaatcttgaaacaaggacatggagaagaatacatgatatgtaccctggagggactagtgcctctcaatctcctcccctagttgctgttgtgaataatcagctttatgcagctgatcaggcaacaaatgtggtaaagaagtacgacaaaggaaataacacctggaacatagtgaagccattgccagtcagagctgactcttccaatggttggggcctagctttcaaggcatgtggtgatagattgcttgttattggtggccatagagtaccccgtggtgaagtaatattgctgcattcttggtgccctgaagatgggaatggtggtgctgactgggaagtgctctcggtgaaggagcgtgctggtgtattcgtttataactgcgcaataatggggtgctgaattacatttctttcggtataatccgtatatgcctcttgtttagcaacccacccatttcttgctgctgcttagctaccccctataatgacctgtaattcagaaaaatgacaccccccttttcgtggagctctcaatgaaatgtttgggagagagcatagagcattcagttcagtttacctggaacttcttttaactcgttcaaaatttgttcttcttgtccagtatgaaatttatgcagtattctttattcatcatccttgctggaaagtgtgcctgttttattgtcctgagttcaatcacatttctctctttcctgattcatgtctgcaccatgcaatatctgttgttctgagttcaatcccatttctaccatcttaccctgattcatgtctgcactgtgcaaatgtcggtggtttgatgaacccaccttataattgtgcactgtcagatgtttccaatgctcagctgtccttgttattagaaatttcagagtggtacaattggcggtaaaaagctacttttgctaccttaccagtacactctctggaagtgatttctggcaatatgtacaattttcaggttctgtgtacttctataagtcagtggcatgaccaagtttatcagtgtaacagtttgacccgggaccttttctatccttttttttcgtgattcttcggctccaattttttctacttcgtttacttcacggatggttttaatctcatcatcgaacacttttggcttttagggcccacttgcaagcgacagacattgaactgcaactctctctaaaaacatgtccatgtccatgtaaataaatgtgaatgggttatgaatactcctacatattatctgacttgtgctttgttgaaatctcactttaaagagttgacgaagcaaacggtggtagagtacgatccagaaagcatatttgacatattcaggccgggcagtttttttttctgaatacgtcatacgcacagagacggatgatggccacgtacatggcctaacaaacttcagggttcagatatcttttccaggatttcggagctttttgatccgttccaaacttgtccaaaacgtcagtgtccgtagagacttggagccacttgaccatccatgtaatgcaattgtgtgtgt

SEQ ID NO: 62652 - DNA, 1239 bp, Oryza sativa
caggtacgggctcaggtagctcatgttcaggctctcacctgcacgtaacgtttggtgcatacacattgcaaaccaagtataattaattatacacaagcttaaaaaaaaaacataacgcgtgttccaatatatgctcaaaactacttcaaacatgcatatacttagtatacagcagggttttcaatttccaaataaggtttttgccggtggtgaccaaaatttccaaaatcatcaaaaatttgggttttttttgaccgaaattatttaaaaatttgattaattttgaatgaatttgaataaaatttgaccaaattcacaagaaaggcaaaaaaccgaaaatttcggatgagatatgtgctggtggggggcaaaatttccgaaatttcaatccctggtatagagtggttttccggtttgtgagaggttccgatccaagagccaccaccgtattttctagtgaaaaatttagtacctattaatactcggatactaggaatataaacatattataaatagcagatttttaaaagaatattttagaaagaagataatatgcgtgcacatcttttatataatgagaaaaccgtgtacaatagaatatcgaccaaaaatgtagtgaaatttatcttgcttgttgggtcccttgcaaccaacatgggagtaggaacagttgcatgcatcacctcaagcagaaaacagggcaccagatcagctggctgggaactccacagtacacaaactcaacagacaattttgatggcagcaatcaagcaatacagcaacttgaattgatctagcctagttaacaatgcaacaccggcaggcgtagttgcagccttgcaggaaatagactgccgtcataagcggtgaccatgtaatgtatgcacggttagcatcagttaccctgttaaaaaaaaagaatggattctaatatcttgaggggatattttctcgtgtacttttttttccaaatttgatataaatagtttaaaaaattctaaaaaaaagttgacaatgtagagtagaatgatatctactggtacaccaaaatcaagttcaaatttgctctacacatcgagaacaaaaagacaaatttagatgtgaacaggacactactattcatatgctaaatttatcttttttatatctcaacatgtgagttaagtgtgaacctaagattttgtgaagttgtatagatatgttgtactccctccgtcccataatataagggattttgag

SEQ ID NO: 62653 - DNA, 3537 bp, Oryza sativa
tgtggcaaggccaaggagttgctcaacaggatggtcgccttcgttaacgtcaccggcgcgtgatctccgagttcgtggccacgcgccattgtttgcttttgggtgtgcgaaaaattttcctactttgatttgatgaactctgctatgttgtgattgaataaatgagacaatgagtgatttttatggttgttgactctgtatgtgttaatggaatgcacgaatttccaacatcttcatatgagaaaattttgagctgcaagcctgcaagcctgcaaatctttggaggagaatgagagtgacagggcacattcacgatggagatgatgatgcggttgttggaggagaatgagagtgacatggcgcagccgcaggtcggcgacgtcggcgacgccaccgactctggcacggaggtggccaagagcccggtgtccatggcgagctcgcacctcagcatgttgccatcttacccgggaagaggggagagagaggagagataggagagttgacatgtgggcccaagggcatttttgacatttcacgcgatttctctttcctccccacctggaaattattattttaatgggtgcggtgtccaccagcaaatatccaacttttgagagtgtcttcccctaaaagtcacttcgcgcggtgtcccacagctaaaaccacgaagtcaagatgtcctatagcaaaatttgccattgctttttgttcttggtgctgagttgctgcagagaatagttaacaaagcttgcttcttaggtctgttgaccaagccaattaatgaacttgatgagaggggtttcccagtaatacagtatgctgatgacattttaattcttctcaaagcatcacagagagaggtgttctgtttcaaggcattgttgaattcttttgcacattctactggcctcaaagtgaattaccataagtcctatctctacccaatcaatttatctcatgagaatgcagtgctttttgcaccataggcacaatccttttacttatttgggtttgcccatggggacaactaggccaagggtagtggactttgcacccttggtagacagggtagagaggagattaacagcaagctcacaatttctgccacaaggtgggagactcacattgataaactctgtgctttcctcaatcccaacatactacatgtgttctttgcagctgcctgtttcagtggttaaagctattgacactgcaaggaaaaatgcctttggaggggaaacaacccaacttcaactagaagatctcttgcttcttgggatctagtgtgcagaccaaaggataaaggtggactaggagtcatcaatctaagagttcagaatatagcacttctgcttaagcatctagtcaaattttacaaagggcatgatctgccatgggttcaactgatatggaactcttattataactccaaagtgccacatttagtttggaataaaggatctttttggtggagggatatagtggctctatctgatgtctttaggggaatctcaaactgccatatcaggactggatcttcagctcttttctgggatgacatttggaatgataagataagaagcaatgcttttccatctttatatatggttgctttagataaaactatctctgttaagcaaatgggttctactcctcttgaggattgtttcttactgccattgagcaccccaagcttatggagaattcaatgttctagaggaggaatggtcctctctctctttgcagaacggtaatggtgatgaatggtctttcatctggaactctgataaatacatagctaagaggttttataagctcacatactcaaatgtgcatgtgccaaggccttttgtctggatctggaaaacaaaatgtgtaatgaaaataaaagtttttgcttggcttttatttagggacagacttaacacaagagatatgttggatagacgagattgtgcaaaggaaaacgatgacctcacttgttaattatgcttgaataatatcagagagacaagagagcatctctttttcttctgcccgttcattcaacattactggcagcatttgagaattgcatggaatcctgacctagaatttttccagatggcggttttggctcgcattcagttcaatcagagaggtttcttggaaattttcttcattgctgcttggcacatttggaagcaaaggaatgggaaaatctttcgaatgagcttcgctcgttcagttcctggaggactttattcaaagccgatgttcttctgcatttgtgcagaatgaagaatccactaaaacagattgtttttgattggttacaaacagtgtaatcctttgatcttttgtttcccttttgttctcttgtaatttgtaaataactttttttatttataaaattacactgcgaggcaaagtcctggcagtatttccagtcaaaaaaaatcatatataactaacatatgcatgttttaaaatatttttagattgtaataaacatatgtagttacctcatgctagatttaaaactgttttaaattctaataaacaaatgtaattaccacatgcattatttaaaattgttttaaattctaataatcatatttaactaacatatgcatgatttaaaattgttaaaaactctaataatcatatataactagcatatgcatgatttaaaattgttttaaattgtaataaacatatgtaattaccacatgcatgatttaaaattgttttaaattataataatcatatataactaacagatgcatgatttgcaattgttaaaaattctaataatcatacataattaacataagccatacaacaattgaattatatgaatattcaatacatccaaaacaatttacatcgtctacacaacaattagggcaatacatcggcggtgacggttaaccgcacgtactttctcctcactactgttccttccttgtgatcgctgcgtgagtaaggaatgtcttcgtttgataggaggatgctagggtcaaccgtcatcgcgaaaggaggttgcccctcaaactgatcataatcctcgacagtcttatcctcgactccgacgatttttcttttgcctaggagaaccacgtggcgcttttgctcatcgggccctttccccttctttcctttgctagacatgtccttcacgtaaaaaacttgtgttacatcattggcaaggacaaaaggttcgtccgagtattcaaccttgttaaggacaaccggtgtcatcccactgacatcaatcggtacgccttcactagtttgcctaacccattggcactagaacagagggacctatagaggtgcatagttaagttcccatatgtcctcaatggcaccgtaatacatgccaattgtaccatcgtgtctcatggcattgatacgaacatcactatttttgttcgtgctctttatgtcttgggctctcgtgtagaatatgtacccattgatctcatattcttggaatgtcttgatcgagccagataagcccctctgcaagaaagccagttattggttaat

SEQ ID NO: 62654 - DNA, 3441 bp, Oryza sativa
agcacatcagctaggtgtgttcgagctaaagaaaatgcattaccataatgggcattggaaataacattttccaactcaccactcctgatatcccatacataggcatccctaccagctgtactggcaacagtatttccatgaggtgccacgctccaaacccaatctgcatgcatgaacttctgaacacatttcatttcggatctgtcccaaacacggacagtcatatcccagctaccactgaaaatcctcaatgaatccaaggcaagacaagtcacaggtccttcatgcccccaaaggcgaaactcaggactctggtcagtgccattcccagagatgtggaaagggtaagaattaccttcaacagccctccaacaatgaataaaggcattggttcctgcagtgaccaaaagcctagtgtcagctgcaatggcccggatggtgcaacaaagtgggcgggacttatcaatcaaaagcccttcctccaagtcccacattcggatcacagagtcattaccaccagtaaatatcagatttactgatgctagaaggaacacagtgcgtacatcctcactgtggtcacggagaacatccacactgaatcttcccatgaatgatttacttcgaaactcccgctccacaaataatgttttccaagacttccaatctgaagttcctcctggaaccaagggcccattgagggtgactggaggagtaggaatcccccacctttcacagtagaacttcttccacccctgatgatctgtggctagggtatgcagtagggtggagacgcaagatacaatgccaagttcctttggatcgaggtgttcaagcacttcacagaccaatgcggatggcaaatcagtgaagcaccatgagtcacactttgaggcggtctcaccatcacttgtttcaacatttttctttgggtcggaaagtaattcataactgcacttctggttattcaatgtactgaggctattccagtgtttagctttcccgttgtgagaaacgggctttgcctggacgacagtgccttcagtgacaatgcatgaacgattcacagatgaagagtctcctcttgctgttttgcaatcaaagtccataaaattatgaaatcctacctaaagatggatccccgccagcagatcccgaatccaatcaaatcagaaggagaatacctgaaaaaaaaaatcaaaatcttcagcttaaacttgacaaagtccaatttttatggttaacataattggaacagccaaatggcacaaggcttataagagtaacttccaatcacagatctaattcctctagaatctgacagccaactcaaacaaagaggtgggttggtacttgttactaacatggtcatataaatcagtagcaaacttgcctatcagaaaaggggacgatttataataaacaaaccagtgattctaaattaactcccacaaacttttttcatagagatgagaaagtcgatgctacggaagagggattattgaactctgaattcgcaccaaaattaatagtaaattcggatcaaaacaagccgaataagctaagggtggctccaataagatcaaagaaacctccacaacacgtcaacctagaaccttcgcaccgcacaataatcaaatcaccaaatctgagattgcatgatcatatacatacaaaaagtaaacctaataagcagatcaaaccgggaaatcttagcaacctgcgaccaaattcgaaacgtagggaacgagatctaactcttcaaaaactaaacgagcgaggaatctaccaccgtgccgcccttaattcgaagtcaaatccaacgcagcgctgggcgtcgcccgcaacgcgcatggaaaaccccgaaaaatcccgcgaaaaaacgcgcataacatacttgattcgtcgcgcaaatctacgtcccctacccaagcatgcttgaacagagagcattaccagatccagtaatcaacacaatcgatcagggaaagaaaaatacgaggagaaaatttacctcgatccgagcctccgatctcgtcgaattcgctcggagagatttctctttattcggttttttgggggaaaagaaaatttcgcgatttgggaacccacgcgctgcggccgccaggaggagacgaggatcacgagacgcttcgtctgcaccgcccgtgccctgagagcaatgtacggcccagatcaagtccaacgcagcctcgcttccgatccggaccgtccgtgcactgcacgcagacagagcagagtccgtattgggctcgaatccggtgagccttgatgggccgggatcccatggcgttccaactcgcgtgctcttacgtgggccgatatttaatgacccagataagtggtttctactgggccgggctttgaatacccaaaaaagtagtttctactggagcgggctctcgtattatcgtgcacgtattgtctagaaaatgtctattttgtttccttcaactatagctcaagtcttatttcgtccctgttcttcatccgtgacggttggctcgatgccaatacgccatcacctctactgtctactgagttctaaacagtccctaggatcggcttcttccttcttcttttttttcgcgggtaggatcggcctcttccttaggccttgttgaacaagttctaaaaaaatttgttaaaaacattacatcgaatctttaacgcatgtattaatattaaatatagataaaaaaactaattgcacagtttacatagaaatcgcgagacaaattttttttagcctaattagtccatgattagctataagtactacagtaatccatatgtactaatgatgtattaattaggcttaataaattcatctcgtggttcccaggtgagttatgaaattagttttatcattcgtgtccgaaaacccctttcgacatccggtcaaacgtccgatgtgacacccaaaaattttcttttcgcgaactaaatacacccttattttccatgagcatgtatcctgaattgccaaatagtgtgcttcgtgaaaaaactttatatataaaagtttcttgaaaaaaagttaaataaattcatgtttcaaaattttaatagtcaatattcaattaattaagtattaattgcccatttcgtcttacgagcgggctgattagctgagtcctactgaacatagccggaagcgaaggacggaggaggtacagctactacctccagccgtccaggcggtccagcgtacgtggaagcaaacaagagcaagaaaacaacggcagacgtctcaaaaagagcaccgactggtaccagacacacacaaccagaaaatggctcgagataagtacaagcgtacagcctgctcgaccatgtgtgctcctcctcgttcatcagcctgtgtagcgtgtactactccctccgtttgacaccgttaactttttagcatatgtttgaccg

SEQ ID NO: 62655 - DNA, 2497 bp, Oryza sativa
caacctgcagaccacgagaaccaactaaaagaaaatactccttgacaactgcattgatggctgaattgctcacagtgctcctccaaacaatctcctctgacacgttgaatttcgagaccagcttgaaatcatttgcagtgacatcaaacaatgaatcattcccactgaaattcccgaatgtgtaagggaagaaatgcagcctgaggcagtagttccccggcagcacgctgaagttataccaagatgccgtgctaaagaaacgcgcggaatggtacaccagtccgaagatttcattgccattgctgctcccagcctgcgacgcagctattccagggctgcttaaggtaaaattcagcccgggggccatgtcgccgatccatctccggccgccagcatccacagtcgcgtttgaaccacagctgagaagcaaatccctcccatgaactcccaacaggtgcaaattagcaagcacgatgcttgcaactgccagcgcaagtagcctcatctgtaacaatcaccactccactgccagattttagctcttgcaggtctcatttagactagagcaagcatctgcaccctagaaatcaaacaaacggaaatcaggattcaaccgctagtgctaccaaaaagtaccgagatcttttgtggctagatccatattatatataaacaccgaatcaaacaaacagaatgaactgtttctgctcaacgattcagtctatgcctagaacacatagcacgaccacgaaccattccaaacagcaatcgagcatctcgaccaaccgacgagagagagagggggagattcgcattaccagcgaacgccgaggaagaagaccgcgcccgccattgcgggagatcagtcccgcccctccgctaccgtcacacgccgcgggagggagaacaccggaggggaagcacagctgcacaggaggcggagccgcgcgccggccaaacagagcggaggagcagccgcccgcggccgccgtctcaagaagcagcagatcggcgcgagttgctggctggcggcggcggcggcttggagaggcggacgcggtagcagcaggcagtggcggcgtggccgcgcgcgggcgcaggcggcgatgggcggctggggtgaggagcaagagaggtgcagtggagtactgcagtgcagcaagcaacagtgttggatgtggatctgcggttcgtgggctcttcttttggtcaatcgaaaggatggttattagatcagtggagcatgtgtgtccatgtagacaaaaataaaattatagaccatctcaaaaagatattgttataaagttatgtagaaactagatggtgctaatttaattggaatgctatgtagcactaggtattcgggaattagaattgtactatcattaagaacgataatatatgttttgttttgttgtttattatgcttttaaatttagtagactgtctaagtaaatgtgagttaaaatgaataatgtgtacttattcggccacattgacatataaatccggccatcctctatttttattatagagtcattcctccgttcatcttttaaaagagaagatggcataaaagttagtacaaaagaagccaccgttaaagctctagtcgattaggatattattacccattcgttcaggttataaaactttttagcattgtttatattcatatagatattaatgaatctaggcatacatgtatatatctagattcattaccatatatatgaatgtgtgcaatgctagaaagtcttataatataaaacggaggaagtagaatataagaatttccattaatacatgtaggcaaccaattttgacaatagtggtaaaaactaaaccacctctctattttagcagtataaaagtgtaacaaaaggttcaaataaaatatttctttctcaaacgaagatattaatgaagtgcctgcctccaaagaaggctcgacgatagtgagttagggccagtttagttctcaaaaattttccccttcacctatcacatcgaatctttggacatatgcatggagcattaaatgtggacaaaaagaaaaaccaattgcacagtttagctataaatcgcgagacgaatcttttgagactaattaggccatgattagccataagtgctacagtaacccacatgtgctaatgacggcttaagtaggctcaaaagattcgtctcgcggtttccaggcgagttctgaaattagttttttcattcgtgtccgaaaaccccttccgacatccggtcaaacgtctgatgtgacacccaaaaatttccttttccccaactaaacacagccttaggagttaggatgcctactgtagttgagtggagtagtagtattgatgtagattttggttttttttattcactctgctggatacttgatgtcgacttgttaacaacactataatggtaacaacatgcaagctttcattgtgatgagggcgataagcaattgcattagctagagggctgcaggaat

SEQ ID NO: 62656 - DNA, 3010 bp, Oryza sativa
atcaaaagttaatgagacaggagaaattgtaagactaaagttagctgtaataggcaatagttctgtacttctgtaccagcactgtactgcaagatatgcaatttttattcaagatttctggtgcggatagttgactaatcatagtttacaatgtcaaagtgtccaacacaaactcatgattatttttagtacgccgtacacattagtcgcttttacttggtgcaatcaactgaccaagtcatctcagactagttcctgatcaaccaatagacaactgttggtttgttgggcaatccagagatgcgaattgaacatatagatatgcatgccatgcccgataagttgcttcgtgcaaaaaacagaagacaggcaatttcttgctcatgcaaccactattatcctttaatcctgactcctgaacttcacttcttcatgaagttacttctttaccgcaccagattcttttccttatagtacaccctctgaaaactgtaacaaaaaaaaaactgggtccatcattgtgattgaaaaattttcaccacttacagttcaacaagactgtgagggtctcagatgtcagtgaaacccaggaaggcaggaagataggtgtactggcatgatggatggttcaacaatcacatagtaaaggaaagaggcgaaaaactattttgtaaacactgttcccagaaagaaacggtatggacgtgaaaaaaaaaagcaatatcataagatgtaaaagacaacaaaatacctcatcatgtgcatctttcaggttgcatgcatgaaatttaatggcaagaaggtccagattcagaagaaaatgatgggaaggccagaaggcaagactataagagtgaagatcagctgcaattatatacattctcttcagatatttcacattttcaatctcatagtggacaaaagatagttactttttgtaaataattatctaatctcacaaacttaccaaaacgaacaatacctttcccagcttcacacaatcccgatctatattagatcctgatcacatacagccctagtgaaaaggtcttggccattataagaccccaatagtaccaagctaccatatcagaaatattactatttgaatatttgagttgttccataaatcactggcatgagaccacaatctagcacattgatgtaacaagttttgtccaagtacccacccgaggaacgaaaccttgctccaccatttgcttcaagacaagatgcgcgtcgtctaaacagtttacactacagagtccatctatcagtaacttgaatgatgagaaaccgggcctcatacgttctgccctcatcatgctaacaaggccctttgcctctacaaactttcctgagctcaaaagaccatcaagaagtacctgatatgtccctgaattgggatagcatcccttaggaaccattgacttaaacaaattgaatgcctctgttaccctttgttctctgcaaagaccagcgatcaaaatattgtagacaactgcatctgcaacaatatcctccttctgcattctctcacaaagctcgaatgctttgtccacctgaccatgttgacagaggaaattcatcaatgtagagtaggtcgtcacattaggcacgcaaccttgcttcggcatctcatacaacagcgaaatcgcatcgccaaatttgccgaactgacacaagcccttgacaagaatattgaagcagcaggtgtccaatgtcactcccaaccttgacgcgctcaagtagacctcatggacaacttcgtactgcctcttacacacaagcatgtgaagaacatagttaaaagtcttggtcgacggccaacagttatacccgggcatcgcaaagagagtctcgattgctttctcgggatggttcgccacattgccgtacatcttgatcagcctgtagaagaactcatcagaaaacctgaacctctcagctcttgccctggccagcaactcctccacatcactgaacctcctgcaggatgctagcctgtcgatcatcatgctatagagtgcctcattgggcttgtaatcccttctatcacaagctctcttgaaggaactggtaataaggctaggatccctgatgttcgcgaagatcttgagcaattcgttgggggaaagccaatccttgtggtccaacctaccgatccagtatccgtcgtcgcacaccgcggagcgcagcctcaagaacggcggcaacgatcggcgcgccacggctctcgacatgctgttggctgtggcaagaacaagaagacatgaacagtgtgggtttgaaaggcgggcgcaagataagcgagggaggagagggtggggggggtgaaggagtagtaccttggctggcgggaggtgaacggtgaaccggagttggggtttgaggattcgggcggccggcggcgggggaggaagaagagaaggaggcggtggttgccaccgcgggcgacagcggcgatgtggtgcgcggactggaccaagatggtgggcctatggtgggccttgggctctttcttaccaaaaagcccaagtacgatagtttttttatagtttataaagttttgtgctgagctattatacgaagtgaccgcgtggcctaatggataaggcgctcgcctccggagcgggagattgtgggttcgagtcccatcgtggtcgtttttttctctttttcccatcgtggtcgtttttttctctttttcccatcgtggtcgtttttttctctttttttctcttacaatgtttttgaacgttgaattcctaacaggaaaggattcacatggtggtaattacgatgtagtactacattcagcaatgagcctctctagactctactaggaatatgcatgcaaatatcttgatagtttttacaaagtaaagatataaggggttgttcaaatttatgtcaatttaaatcttattatttttttaagttatcaaagatgtacatatatttagtccttgcactgtgtttttaaaatcaactactaattccatttcaa

SEQ ID NO: 62657 - DNA, 519 bp, Oryza sativa
  unsure (1)..(519): unsure at all n locations
aatttgaaaatccatagttttaacgtttccagataggggtatgaagggatttttcagcatatataatctaaagaattttacgatccttgcattggaagtatcatcactccatctgttgggtcctaagtaattaagtanctgtatttatctgaccaatccaggcaaagaaaaggggaagcaggtggtggtggtgcagtagttccagggacacagaatgcaatccagattgtggcacaagctgctctctgctttgacaatagacaagtaagttccattctcttctcttcactttgaatttcatcatagaacatttctatggatccagagattcttactgaccaaaaactatgcagaatgaaagtgactgagtgcgtggcatgcatactgtgagatcaatgcaaaaggcactcttcagtgaaattatattagttcaaccaattgggatgtataatggccttgaaacattaatttaattagggtgtcactgtgtcactagtgcaaaataagcattgaccttca

SEQ ID NO: 62658 - DNA, 2864 bp, Oryza sativa
aaggattcctttggaacgcagcacctcacgggaatcccgtaagcaataagaaccagacaaaaattcccgcgttgcaaaaagaaagtcaccaccagtccggacggatctccagactaaacgcaagcgggagagagaccgagagagagatgcatgcaaataccttcaccttcaagccgatccgaaccgagaggcgcagggcggtggaatgaggccccgaggcccgaggcccagcctgctcgccggaggcggccccgcgcagcgtggagaggctagctcggcgacgggaaggaggggaggtcgaggcgggcggcccgttcgccggagcccccgcgggcgaggcggcgacagagaggcggcggtggctccggctggctgcgcagatcggaggagagagagatggcgagagaggagaggagaggagagggaaggagagtaatagacggtggcgcaacagtttggtccatttttacttctcgggctttctttattttcgaaattaacgtcgctgtcagttactcggaccctacgtacagtacagccatgtaggggaatttttgaaaagtcaaatttgtactccctgctttgggactagattttaatcagcaattactatagattttgtatcatagatttaacgttaaatttgtaagaaaaatatatttaaaactaagtatcgtaaaactataatataaatttattgttgaagttatctagaaactacatattttgaaggagcttaaatttctagtactaatgttatgttggtgttataaacattgtagttttgtgattaaatcaacactaaatttataggttttgtgataaatttgctacataatccgtagttttgtcatatttcatcttaaatctgttttgtgatagtttgatcaaaatatcttgatcaaaatagagtaaatttactctacttaaaaatttaatacaaatatagaaaaatataagttatgcataaattacatttagtgatatcgcaataaatgatactcgtatagttttttaagaagacaaacagttggttttataggtttaaaaatatattttgtgagcaagtaataaaggtcaaattttgataataatgttctttccattcttgacatttaaatgaataaagaatacacctagcgtcccgggtttacgtagggattcaatcgtagaaacaactttatgtatttccaaaggatctacagtttgcttgcgagcaatatctacgcaagaatatatttttagcttgccatggcaacgataaataaactgataaagccatcaaatttgtgcaagtcaaagctccacaattctgccacgctgctcctgcgattgcaaggcgccttcctcacttgttttaccttgccgaccgattcgtcagtgcaattatgtgtggtgctgcctccaataaacacaggtctctctgaattaaaaatacagtaataataatctaccagtaagtacttcatcagtaaaaatactaaacaacaccaggaatacgattcgaatcagttcctaaatacgatagtataatgattcaaaccaattacgaatcaaatctggatacatcggtggatcaagtgtcagtattttgtcggtgaaaaccaaccataaataaacacgaagaaaaaaaaaagaaggatgatgacagaagcctacaagtataaacgagcactgctgggtcggttgattgattgtttcagattggcgcgtgcgcagagagagagatggtcaacactttcatgccaagagattttgagattgtacctaacaattcctacttaaacgtcagcacttgaatttcttttccatccattacatctgtttcctcctctttttttcttctctatttatttatttctgggaatcttctgttcttgctctctgattgggcttcagctatgcatgcacttgcaagagtatagatcgcatcctgcctaacttgctgcaaatcactcgtttttcatttagtttttgatggatctttgtgcgtttggaggaactgcaatcaaggagaaaatttggtcaggctcaacagtttcagtactagtagtggtactaatggtcatggggcagaatggcagatggcccacctcagaaacagtacacgtcttatgatgggctcattgaaatgatgaaatgttcaatgttcagatcaagaaaatgattgatgcatttgataccgaagttaggtaggaggaaacccagccaagccgatgatagccacgttttcagtggcgaccaggctgaaatgagatgggttaaaaatgaaggcgaaagcagccaaaacctgaactttccagcaccagagcaccgttcagtcacctgtctgattcctgcagcatgtgctggtctagattgatgcacattgtgatgaccctgttgtcatgtgcagtggctaaccggctgttcttgttggcatttgcaaactgagcaccagttcatcagcatggacacatgtcccagcttctctgcagtctgcataagcccagggatctgtggagtctggacatctgtcaaggtaaatctcagcttagatagaacaattagatgtaaataagcttcttttccatggaggctccatcatctccagcttcgttcatggcgatggcgacgatgggttcgcccatgacacgtcgttctcagatcccctgttgctgcctgcacttttgtcaaaccattagtatgacattgcaactactagctctaaaacactggaggcataaacagaaatcgccttaccaaaggatttatttttcagtttatgtttcaccagatcaaaagttaatgagacaggagaaattgtaagactaaagttagctgtaataggcaatagttctgtacttctgtaccagcactgtact

SEQ ID NO: 62659 - DNA, 2734 bp, Oryza sativa
gcagaagtacacattagcctactttcttttggtcaggaatgagtacttctctagggattcaaggaagcattcagatgggaagaaccaacttcttgactgctgtgatgattcagaattagatttggatgtgctgtatgctgatttggatagtaaagaactggagcttaagttgcagaaacctgttgtcaagactcaatcaaaaggtgactcaagtgccagtggatcaaatgattgcttctttcctggccttcacgacgacctggctcaggactgccttgcttgggcgagcagatcagactacccatcgctttcttgtttgaataagaagttcaatttgttaatcaacagcgggtatctgtacagactgagaagaaaatatggcattgttgaacactgggtgtatctagcgtgtagcttgatgccctgggaagcatttgatccttcacgcaagcgatggatgaggctcccaagaatgccatgcgacgagtgcttctcttgtgcagacaaggaatcgcttgccgtcgggacacaactgcttgtgtttggccgtgaatatacaggtcttgctatttggatgtacaatttactggcccgtggttggtcccgatgcactccaatgaacctgcctcgctgcctctttgcctcaggaagctttggtgagattgctattgttgctggtgggtgtgataagaatggacaggtgctgaaatctgccgagctgtacaattcagagactggtcattgggagactttgccagacatgaacttgccgaggaggctctcatctggtttcttcatggatggaaagttttatgtcattgggggtgtgtcaagtcagagggattctttgacttgtggagaggaatacaatcttgaaacaaggacatggagaagaatacatgatatgtaccctggagggactagtgcctctcaatctcctcccctagttgctgttgtgaataatcagctttatgcagctgatcaggcaacaaatgtggtaaagaagtacgacaaaggaaataacacctggaacatagtgaagccattgccagtcagagctgactcttccaatggttggggcctagctttcaaggcatgtggtgatagattgcttgttattggtggccatagagtaccccgtggtgaagtaatattgctgcattcttggtgccctgaagatgggaatggtggtgctgactgggaagtgctctcggtgaaggagcgtgctggtgtattcgtttataactgcgcaataatggggtgctgaattacatttctttcggtataatccgtatatgcctcttgtttagcaacccacccatttcttgctgctgcttagctaccccctataatgacctgtaattcagaaaaatgacaccccccttttcgtggagctctcaatgaaatgtttgggagagagcatagagcattcagttcagtttacctggaacttcttttaactcgttcaaaatttgttcttcttgtccagtatgaaatttatgcagtattctttattcatcatccttgctggaaagtgtgcctgttttattgtcctgagttcaatcacatttctctctttcctgattcatgtctgcaccatgcaatatctgttgttctgagttcaatcccatttctaccatcttaccctgattcatgtctgcactgtgcaaatgtcggtggtttgatgaacccaccttataattgtgcactgtcagatgtttccaatgctcagctgtccttgttattagaaatttcagagtggtacaattggcggtaaaaagctacttttgctaccttaccagtacactctctggaagtgatttctggcaatatgtacaattttcaggttctgtgtacttctataagtcagtggcatgaccaagtttatcagtgtaacagtttgacccgggaccttttctatccttttttttcgtgattcttcggctccaattttttctacttcgtttacttcacggatggttttaatctcatcatcgaacacttttggcttttagggcccacttgcaagcgacagacattgaactgcaactctctctaaaaacatgtccatgtccatgtaaataaatgtgaatgggttatgaatactcctacatattatctgacttgtgctttgttgaaatctcactttaaagagttgacgaagcaaacggtggtagagtacgatccagaaagcatatttgacatattcaggccgggcagtttttttttctgaatacgtcatacgcacagagacggatgatggccacgtacatggcctaacaaacttcagggttcagatatcttttccaggatttcggagctttttgatccgttccaaacttgtccaaaacgtcagtgtccgtagagacttggagccacttgaccatccatgtaatgcaattgtgtgtgtgatgttgccaccctttggacattttcttcctactgacagatcagcatgatgagctgcagacgccatggcatacgtacagcttcgagctaagatctcatttctgaaatatatttgagttcagacaatttttgtgtatgatttggtcaagtggtttgttagttcgttgcagagaaaaatttgatagactgatgacaactcagagatgtgaatcgtgcagagcttatctttgaggctttgaacatcttcatttcgagatatttacacccagatcgagaagcaatacgctgcctatcttaaacatctcctcgtcacaaaaatcaaaca

SEQ ID NO: 62660 - DNA, 675 bp, Oryza sativa
cagagatcaacaaaaagcaaatgacaatgaagtcttcattattaacccaagaacgttatggacaattgttgaaaaaatgaaagcatcaagtaccttttacggatgttatcgttgggagagatacaatcttgtttcatgcataattttattatatcatcaacctccttcctagataactcatttaagtcacgaatctgtgcaggataaaacagacagttaatgcatagttgcactgaaatcattatgttctgctaaatgttcaaatgaactcctactgtggatcaataattcaacctcaaactttagatttagcacatactttcaaaacttgaaatttccccaataataaagcatacataatgaacaggtaaacatattcgcatcggataccttatttagcaacatatatttttcttcagctactctttccatagcaactgttattgagtttagaagatctgaaatcagttgtagtgttggttgctgctgaccttcagtagtatcatcatacgaaatctgcaagttcaagaagctgattatgcgaacttggatatacaaaaatgaaaatatcaacaaacagttaacagagaaattgcatgcagacataattttatatgcaacccccacaaccacttgacaataagagaaattgcaaaggtaaattgggggccatat

SEQ ID NO: 62661 - DNA, 548 bp, Oryza sativa
tgtgggtgttatgtgatagagccacagatatttacaacatacatgctgctaatcagtggacatctaagttcttgaaaggttggttcctctaccaactggtaatgaagagcttagagttccgcaatacggcagtagtacgagcacttgctttttctctaggggtggagcaactagttaatgggatattgactaatgggactatatttttcttttagcatattcagtggtagaatctatgtttcagtgtcagcaagaaggcatttcaaccatcaataagtttggtgttcgtgattatattttctgatcctatgcataaaaaattgcatatatcagcaagttactgctgcttttctagatctacaacataagattgatgtgatcttgaatgggttgagatgtctttcgattatatatatcagcacattgttgttaccatgtatatggcaaactgtcttgatccattttaaactatcttggctttgtggtttccttttcagggatctagctagtcttgcttccttgttatgtagagttgcttcgtcccttgg

SEQ ID NO: 62662 - DNA, 2025 bp, Oryza sativa
  unsure (1)..(2025): unsure at all n locations
tgggaagcaatatgtccaatgggttggcactgctgctgcaacggagagacattgaaagcaaccaagtgaggtctcacactgcttttctggtgatgaaattagcctgcactggaggggaaccatatgtccataggttcttagaggctaacattgttcatgagctaattgacatgatgcagtgcaacatcaacgatctccaggattcagcatactatgcccttcaccagattatctttgcgaaggggggatcacttgtattacagagatttttacaagcaggaaccattgaaaaattggttaacttgcttgaccgcaagtcttcaaagacaaaggaactaacaatgcagcttctggtagacattgcggtggtcggaaccaaaccttgcatcgaaagaatgctctcgtcccaaatcatcgagaaatttgtggcactcgagaaagcaggtgggtctttcagtggagcggtatcaagatacgtgcaggggttgaacatgtgcaagaacgtccagtctgctgagagatcagtcatgaagcaacagattctttgaggaaaagtgnnaaggnaaaacagagataagaggtcatgatctggaagcaagtctagttgcctctgtggaagcttgcatttctgaaaaaggagccagcagcaggaggaaaaagtagaaaaaatttctgccaaatgcagcaactttaaaagtatagacctgatggcgcctgctgcacacttagataatttactcaaaactaattcaatagtgagatttcttcacaggttcaactttatagtgtgtgatcgttgggtcttggacgtaggtacatccttggtcaggattttagcaatgaccatccaaggaatcgtaaacatcatcaaaccaaatgacacctgaagaagatcccatttatatgtattgcttttcagaaatccaatctgatgtatatgatactgaaatatccttgactggttataccatctatgcaggttgacaaccatttttttttagtgcaccgtggcaatcgtttcgctacgttcgcaaatcatttcatgggtccaaatgcattttcatgagttgcaaaaacactttggataatgtttggaatgcatagaattttctggatcagctagagttaagcttaatgtttactaaatgttaaacttccgttaaatttccacggttttcctatatgactatcgggtgaaattcttttcatcagtcatctgtattagttgtagctattattgcagagatggatcacatcacaaccactcatcttgcagttgcattcctttcagatatagatcctctatagcactgtggtgtagtagaggtggctgacatatgggtctggatctatacgtcagtgtcagttattgccccactagtactacgtacaatccccgctgattcctttttttttttgccctcgtcattaggtttgcttatgcggaagtgctaatgggcgatcgatcgcccggcgacaagggtagcgatcgatcgcccggcgacaagggtagcgatcgatcccccttccccctccctccctccacctggtttccttttttggcaccgcattatttttctattttagtaaatttatgcacctaaagtttatacacctcaagtttacacatctaaagtttatacacctcaaatttacacatctaaagtttagagaccaaaagtttataagtcaaaagtttatatatccgtttcaaattcgaatttgaattcaaatatttttttatatatagtatttctatacatctaaagtttataggcccaaagtttataagtcaaaagtttacatacccgattcaaatttgaatttgaattatatcgggattcaaatttgaatttgcattcaaatattttctatatatagtatttttatgcatctaaagtttatatactaaaatttatagacccaaagtttataagtcaaaagtttacatacccgattcaaatttgaatttgaattatatccgtttaaatttgaatttgaattcaaatattttctatatataat

SEQ ID NO: 62663 - DNA, 3125 bp, Oryza sativa
aagacgaacaatcaaacatgtttaaaaaagtcaacggcgtcaaatatttagagacggaagaagcatatagcacaagtcaagatttatggttttgcttatacatgtgcttataagataaaatttaaattttaagatgtaatttcatggtcgattttttttttcattgtaagtatattcataaatatttgcttttgaatcgttaaaagggacgtatacctataaattatactattattaataagcagtacaggtaggcataaccaaagcgaaacacattgaaagcgacaattggctgagacacacaaaaatccaaaccaaaataaagatcatcacgatccaactctatgtgaacggtcaaaaacaaacaagatattttttgtggaagactacaagaaatacaaacaagtgtagattgtcctcacgagactgacagctagggcgttcacagtgcaatgggttggcattcagcccaaacgatccacgtcggtgaagcgaggagaatctactggtatcatcttttcgcttaggttgctaatcagctaatttgaatttttaaccggtcttatcttttcgcttatactgcttatcatccaaaaattgaatttttaacggtttttttcaatgaagtttatttttcagcatttacttttagatcactatgaaaacgtatatacaagttttattcacaaattcttttcatttgcaaatatgtcattatccgtgaataagccaaacaatagggctcaccaacctgaagacctcgcgttcaaaaaaggtcacgagttctttggcaaaatcaaggacgcgtaggatgaggagagagcgtcgccgctgtgccatggagcaagtggtttctccattgttccttagcgcgcgcttgcccccgatcccatattcaccgcgagatggaggcatgccggcgacgaggatgggagcgaggttggtcgattgtggagcgacatcccaagtgtatctcgaggacaacaacgatgatgcggaggttgcgtcgccttgaactgctcgttgcttgccggtattgtcccgatctcctcgtcccactccacatccggcgtcgccgccccgctccacgtccaacgccgtcaccccgtgcctaggccgtgccgcccctcggtctactccggtcgaagctcgtcggtcacgccaccccctcgatccgtgtcggccagagctcgccggccacgtcgctcctcaaggagcagccagatccgctcagcagcggaccatgccggcccgacctcatcgtcggagagggtaggggagtggagaggcgaggaagacgaggtggttctgttgcccgtgtttatatttagcagcagcatttctcaggggcaagcgccagcgccggcgactagtacgacgaggaggaggttgggctcgcgatggcgcacgtcgtgacgacggtgtgcgacaccaaggcgcggcggcttcaggactttgcatgggcgtgatggcaaagcttcgaggcatcgacggtgatcgcggccgtgcggcttcgatgcgatcgatggaagagatgggggaacatgaggtctcactgacatgtgggtctcatgctgactcagctgccacgtcggacaaaacagggtcaaccagagtcaatattgcctaaggatcttgggtgatgtcatatatccgattttttgatttagggacgattttgtaattcggtgaaaagataagggatctcggatatacttttccctatcccagtaattttgacccggctaaatttcacccatagtgaatccccatagtgaatttcaccctagctaaaccgtataacaataataagattacaatatccttcacccattgcaatgcacgggcatttttctagtataaaaaaacagaagagataaaagaggaaaagagatatctatcttctaactattcacctgtgttcgagagaagaggaaaaagataggattaagaagatacgtaaaacgaagtgagctattagcatatgattagctgattattaactattataaattaaaaatgaattaatacgatttttaagcaactttcttatataaaaaaattataaaaagtaccatttagtagtttagtaagcgtgcgtgtgaaaaacgaggtacttttctactctatccatccatctcaaacccacatacgtctcttctcgtcttctcctcgtgttacacatgaaaatatgtagtttaaattagtgaaacttagatacaattgttggatcgaaaaatagacgtctgagattcgtctacgctaccatgagtacttatgagtaaatctgtgagtaaaatttttactcgtgatgacgtgaacattccactttttcaccacttattttcccgaacaatcttgctctattgctgctgttgttccacccatgctgttacgcctatataagccagagaaggggagagagacaaccaggggaaggtgaaggaagagggcaacatcaaaatcttctcagatttgtatttgctatgaggatcatcgcctccctcaaggataacccttataaatgacactccagcctgagctgttttgacgctttgacactccagtagacctgacatcacgcctgacgagagctgaattggactatctacgcaacatttgtaattcggtccaagaaagccttcaaattatgatcccacgctactaaaaaatcattttcgcctatggccgaaaattgatttttgcaggcgaccaaccgctctgcctacgattaaaggtcagtgaaaatcaaaattttagaaccgttctgtaagtcacccacctaaaaaacctaaattttcaggccgacaaacttcttttggcataaaaataagaacagcatatcatcacagctcaatggacaacagcatcacagatcaacagctcaagaagtgaggggaatcaagccgaggccgtcgtctccattgctgcaccgcctttgccggcattgttgctctgccgaggtggccggatctgaagagccgaagacgacgagccccattagatctagatgtcgctgccctccccccactactgccgacgtgccaccccttgaatctggacagggcagccaccctctccccgcaccgttgccgtcggcgagccctcctagccccactgctgca

SEQ ID NO: 62664 - DNA, 1018 bp, Oryza sativa
ccaaatttgcaaaatttttacaaaaattaatggctttgtaatgcttgttgcgtaaactctacgcttaacattcgccggtggtttatgttgaccaaaacctaagattgcttctggttcgctgtctgcgtaagcaatataaggtttgatatccaaaataggcgtaccattgactaaatcaacactaccaagttttaactgtgcttttccatgatgtatttcgatcgcttctaatgcgactttagataacccgatcggattcgggcgatgagtggcacgagaagcaaaaacaccaatacgttgattacctcctaaacgtggcgggcgaacggttgaatgccattcccgtgcggggagctgatgaaattgaaaaattagccataagtgactaaattgtgccaaaccgcgtaccgcctctgcacaattgtagggggggaataaagtaaggtttccttttccttgagccactaaattgggttgacgtggcacagaaaatttttcatcatacgggctttcaataacaccaatcggatttaacactagaggttgtggattcgccataaaaatgcactttttctattataaatcaaaatcaacacgggtattttatactaaaatacgttattttatatctttttatttaatccattattacttttatgaataagcgttctattttttcgaactggtttatcacggcaagaccaaaaacgttacctttagcgttggcttcaattatggttggatctgcattagctaattgggtggggcaatttgattgggtaacgaacttattagccattatcactactatgctgttacaaattttatcaaactttgcgaatgattatggggactatgttaaaggctctgatacgcaagagcggattgggccattacgtgccattcaacaaggtaacattaccggcgaacagttaaggcaagcggtcatattcttaagttttctgtcgtttatctcaggattggtattaaccatttatgcctatcaatctttacaaga

SEQ ID NO: 62665 - DNA, 10072 bp, Oryza sativa
ttttgtggaccaaggaaaagagtttttttttcaatggaatattcccaaggaaatccatgagaataaaatagaatggtgtttgcttgcgcaagcatgcttaattaatttgttcagtaaattcgaatggcaagaaaaaaagattgcagtcctggaaaagatagtggaagtaccaaatgagcatttttctcaaacagcaaatttgtgccctgagattctcacttgtaagataactaaaacaaaagagtgtgtaccttatccatctttccttgcatgtcaagattcaaaacttgagagtgatcatctccaaagctggttcatgaacacatatgctctgctccacgactccaccagcagggggttctggaacaattatagaaaaaagatgggttgggaaattagtaacaagtattgaggatacaaaagagacgtgcaataataaggcatagtcgcacagagccacagaagtagtatgtcaccaccttgccatgctcgtttatttgttgttagtgcccagcatgctccctaatctcgtatctccacaacaggaatatgggagatgatgtgccagtccttcccgaccctatttttgtaatgcctactcaaggtagggttgtaactaatcaccaaatgctgaagagaagtaaggtgttgtatggagctgggcaaggatcgaaggccagtgcagctttgcatataaagcgatcggagcgcggagagttgtctgagtgactctggcagcacggtgagcatagggcagctcatcaagttgatgtgccggagtgaggtgagcccctgcatggactccaagaagggtcgtaaggacaggcaagatattgatcataaggtcctctagagaacctaacatccccagtccttctggcagcttgtggagggcaagacagtcctgtatacttaggtcttcaaggttggtaagatgctgaattccctcaggcaactggctcagatttctgcaactagaaatatccaattccttgagggaggtgagatgatttaccacctcaggcaactccccttagattgtcgcattcaacaatagccaacttctccagggatgtaaggagcatgatcgacttggggaggctagccaatagtgggatttctttcagaactagagtttgcagagagcggaatccccccagccactctggcagcatggcaagaactgggcaacccgagatacaaagatactggagggaggtgaggctccggatgatctcccctaattgccttaggtcactggaataaattgacaaggattcgagcccggtgaggttctgcagcacttcccaacctgacgatgatccagccattcctcctagttctaatttcttgaggtgaggggaatccacactaaagcagatggatgaggattccttgtcaagaggatggagcggatgagagaagctaacttgagacagcagctgctcgttgcttcgttccagtgtcaagctatccaaatatggtgggaaacatgggcattacttcagcttaggacaatcactcatgactagagtggataggaaagggaagcagtgctcaacttgttcgtgatcaatacaacagggctttccttcctccccacttactaatgcaggtgagcttgtccacaactccaccaaattaggcattcctttcaatacaaaagtattcaatgaaggcaaccgtgcaagtccttgcagattctccaagtttggaaattgttccaatacaagtttagtcagttgagtgaaatgaggtggatcaatttgctctaacaagctatctgaacaagaggattctctttgcttcatcatccaacgtgagaaatgcttacctttgtaattatagatattcagcttcttaatttgtgatggtggatcaagaccattgagcacacgcagctccttttccatatctaataatggctcttcttccagactatccgagcacccttctgcaccatttgaagaccaatccaatgtcaaattgagtataccactcttttccttcagggaggctttttctgcatcatctggatcctctacatatttaataatttttatttccagatcattgtcggttaacaagttgaggtttcgaagccctgatattgttgcatgctcgctactgccacctataacaaacaaatgcagcctttgaagatgagttagctgtccaatccctactggcaggccacccaaattcgagcatccttttaggttcaaaacttcaagcctctctaggttccctatgccctccgataactctagcagcccccagcagttttgaaggtctatgtattccagggtgctcaccaatgtgaggcattgcggtagtctggtaatttcggttccactaagtgtcaaagtgcgtagtttatgacaagcaaatgaactgaacaagttgtggataccctcaatctgtgctaagttgatggactgtaagttgcaaagcgtcccaaagaattctgaccattgttgcctcaaagagcgacaatgcataatgttaagcactcttagttttttaattttacatatggagtttggtatctccctgataccactgccacgcaggagaaagctttgaagattatgacagtcaccaatggactgaggcaaactttcaagatccaaaagacatgacaactctagggttctcagcttcttaagcttaccaatagactcaggtaatgtggtaagtgccctgcaatatgtaacatgaagggcctgcaagttccagcaatgtgagatttcttctggaaaggctcgacagctagcgtgtgagatacgaaaatagctaagatattcgaactttggtatcaatggaagcaacaaattagtagcgcccatactctccaaaataatagaacgaacatggcaccttttcttgattggcttgttgagtgcgaagttgtcaccagaaatatagatagcatggaccttgctaaataacttcacttcaatattctcattgcacgaagccaaagataaatatctgcatttttgggaattaccaatagttgcattctgagaatgagacaccatttcaccctgtaaaatttgccgagtaaggtcaagaaccaggtcatgcatcttgcatatttccatttcatcatactcatctacctctagatcttggagaaagtgcactttcagaagagaatcaaagcagtcatttgcaacatcctctacttgttcaatctcattcattggattgatgaagccatttgctatccactctccgatcaactggtgtttgtagatcttgtagcctttaggaaatatagagcaatatacaaaacattgcttcagatgatcaggcagatgaaaatagctcagccttaatgacgcaaacactctatcttctatatcatcaacattccacatgttactatcacgtaaggcacaccatgcatctactgttttcttgttacggaggacacctgcaagaattttaattgccagtggcaccccaccacattttttaataatctctcttccaatttctacaaattcagagggcagaccttttgcagctaaccttaaactttgttgaaataaattccagctgtcctcatctgacaagaaagccaacttatatgtacatgtagattccactgcctccgcaactccctgatcacgagttgtgagcaaaatccggcttccaggtgatccactcttaagatatagcatgaatcgttcccagtcatattgattcttgtgccaagcatcatccaagacaagtagaaacttattcccattcaactcgtttgaaattgcttcaaccatctgttggtcggtacgaagatatgatgttttctttaaaatggcttcatacagcttgccgacgagtttgttattatcaaattcttgtgacacgtgaacccaaaatattgagccttcaaaatgctcttttattttgttgtcatgacagatgtgtgtggccatagtagttttaccggttccaccaagtccaacaattgaaactattgagattttctgttggtcatctattaacttacatatgatcttgtgcttctcctcatctcacatgtatttttgagtcatcaacattgcccaataaggatggctcactgataatcttgtttttatgaacattatgatcgattggtatagcattcaatatagtattgacatcgcctctttgctcgacaattgcagcaaatctgtttttgattgtctttatcttgttggccattttgagttgaaacatggctagttttggttttgtgcgcatgtatttgagcacagcatacttgtcacgatcattatctgtgtcatgtttctcagactgaagatgaaattcatgtaccaaatcttcaagatcgtaagcaaaatctttcaatttttttagccaattagatggtggtttattaccaattgcattatcacctgctacctgtagcccgcttttgatctcctcaactaaatcttgaagctcctggagatctttcgtaacacccataagagaactatactctcttattacaagtggtgctaacttgtctcccacaatcttaaataatccatacagcagcttccatgcccatatgtttgaaacttggaagcttctctttggcccaaatcctacatattaaatttcagaatgagatgctacatactgaatttcaaatgattcaggtgcaatattcgtaattattttttatgcaatgaaaactaacgctagtatatgtttgtatgcctgattgttattttctttctaagttcaaccatgttttacacgtgcagagcaagatagacatataaaagcgtaacagatgacgcccggttaatggtacctgatatggaaaaataggtgttaagcctttgccttctcttcgttgaagttgtgcttcttcgatctctttgaagatgcacttgttttgttcaattgttcataacatcatgatgaaccaagaggtacatgtatgtgatatattgaggacaggttctgatgtatatacaagaaagcaaactagtaaataacggaagatagatgcccatgaaagcttctagcacacaagaaccatcagtaagttgtgtttctattgaattgtaaatatccgtacttagtagtactgtagtagagtactagctccctgagaagaggcagaacaatcccctgagaaaagctgaacaaaagacaaaccatttgcaaaagagattagtggtggagtagattttggagaacacattatcttaacataaaaacgcgagaaatttagttttgaaggatacaaaagctgaggtaattaaacacctgatctcaggtcgtctgacttgatcctgcagtatcccctcactgtcccaagcaacacaaataacacctgtttcttgggatttagttgcagagtggtggtggttctggcagctccattcattagagctcccttgtcaccttaaaatgtgattagtatccaccaatttgggttggtgtagtgctgggtgagttggaaacacatgcccacaacatataatataaatcgaatatccaccaattgcagtttaaatacagaaagctggtgtggaaatgtcactttcgaaaccactctatggcaagccagtcaaagaaggacgatcctcacaaaaatcatagtaataatctagttttgcttagctgttggtagtcagatgggggctgtatgaggacagcgatttctagtttggggctgtagttgcaagttgcagatcgaagtatcgaacaagttgagctcccccctaatagatctagtctgggcgggccagggagagagagagagaaaggtaggcgtgggggatcagggatgcgatacctaacctcgtcgtggagatggaagacgacgaccgcgcggctgcatcgttgggccatgcgtccgcggcagtatgcggatgggataggagccggaggcgaagggaggggagcaagccgtgagtcctggcggcggcaaccggcagcaacggtcgcgcaagcggtggccgaacgattaacattggaatctgggttattttacattctactagcatagttttagagaacttactttgtaaattaaccctatataaaattatttcagaattagaccattatctcgatgttagtgaccctcgccaacgtacaatgtctcaacaccaacgatattagtattgacacccttatcccccccaccccccaacagtcaagatgtagaggatcagtgccactaaagagattatcatcgaggacctatttataaaataaattttttaaaagaggttaaaatgtaaatattctttcttcaaatcggtttttaacataaataggcttgcaccaatagactatttatcaatggagcgggcttgccatgtttggtgattgtagtgcaactttcctgacctctttttattgctatagtgcagccttcatgcgcagaccatagggtcaatcaaactcatgcaaggcccaaaatgacgcaacttgtatacaatggatacagatcatctgcagtatagtattacacactgacatgtgggccttacagaccctcaagcccatatgtcaatgagtggtactgcgggaaatctcaattggtatacaattaagtgtttttattgtagtacaaattttaagtcacatatgcgcttatatttttttaacagaggaagtaactaacttcaaaatcaggtgagtgacaatctcgtccacttatcatgtatcagcggtcaaaataatgagtagcagcaaattagctgcttcattgatttcaccggtcaccatatgcatgtgtgctctgttccaccaggagggtggaaaatgagatgaagtttgggcctgacatacatgcaatgaaagatgacattagtgataacaatgtaataaaataacatacatgtatggacaccttaatacgaccacgatcagcggaatgttgtgacctcattgtcttatctctaatatatatcctaatttccaattacctaatatctacatctgacaaatgtgggagaggatgtgctagtccttcccctgaccttgtaacacctactcaaagcaaggatgtaactaatcagcaaatcatataaagaagtaaggcattgtatggagttgggagaggagtcaaggactaaaggccaaggtatctttggctagaaagcggttgtgtagagagtttgcccaagtgattctagtagcatgatgagcacacgggtaggaaacaaaagttggaggtgttggagcgaggtgagcccatgatggagcacgatgtattttagagagcatctcgagggcacggctttcttgtatccacgggttttggagggggggcttttaactatttgccactcttatgagtggtgcttaacgatttgccactaggttcacatgtcatagacacatgagggcccacatgttatagacatggtgtggcaaatcgttaattgccatgtcacaagagtgacaaatagttaaatttccctttggagggaggtgaggtgttcaatgccttcaactccctccctcatattactacaacgagaaatgcacaatttaaccaggaaatggagatgtaccgtcatctcacgtgccactccacatactttcggtagattcctcatatgcaattcaactaggttaggaaatggagatgtaccgtcatccaacgtgccactcctttgtctcatcatccacgtgatgggcaggaacctccataactaacaatttctaacacatgaaatcgatcaacgtgatgggtacgaacctcaataactaacaatttctaacgcatgaaatcgatcgtgttttttatggtcatgaactataattagcaacttgtttttttttgaaacaaaagataagcacactagcctctcaaatgaaataatagaaaaaacttgtgctgagtgttggtagaaaattattattagcccttcttagaaagagttgtaagcagacaagaactaatctaatgtatagagcagtggcatttgccctcatcaatttttctctttagtcataccttaggttctatgtcatgtggggcctcaaggcctcggtatagagtggtaggtcgccggctcccactattttcagaaatggttatagaacggaaatctagatgacacaagaaaaacctattttcaaaaatgattagaatggaaatcagatgacacatgaaaacaaaaaagcatatagcaagtgcaagaaacaaaatgaatatgcgttaggattacattaatactggctagaatagcttagctttcttttgctctagatgaggcttgcacctacacaacagtgcaaattagagtacaagagcatgttaggttggtgcctgaagagcatgcctgacagaaatgcatcattgctgctcatcgatggaccattggatagttttgctagtggcctcgtatcactgatatccaaactagcttgtgctcataaccgtttctttggtaaacagctcgtatttctggaaaggcaagctagccgtccaaactacgctcgtaatcgtttcttagaagccgcacgacaaacacaacacacccaccaaacctcaattcgaagtactattagcacttcacaacgattttcctgacttaacagtaatagcaacgatttttcttttcatgctaaggccccctttgatttgtaggataagtgtaggaaatttgaaggatttcaatcctatgaaaaaatttcctacgaaaccctttaaaacgaaggattgaatcctatactatcctttaaaattcctatgagatgggtaatcctatagagattttggaggaaagttagcaagaggtccttggaaaaattctttttgagtctatctctctcatccgattcctgtggtccaatcaaacggtcattcctgtgtttttcttgtattttccaatcctctgttttacattcctgtcagaatcctgcgttttttcgtattcctctatttttccattcctgcgattcaaaggggcccttaaatgaatgaagacaaacaatggaccatagatttctcaatatacaggaagtgagaccatgaatagctgctgcaaaaccatattagatatacaaacgtcatatatgacagaaaagaacaatatttgaacaccatgaaaattgctgcagtgctcaaaaacttgccagaacaaaattgtggtggcattactagatgagatcaagcaacacaggaggaaaaaaatagtccatgcaagcctaacaattgtgccatatgtatatcaatataaatttctgcatcaataccatattaccatgatagaacaccaactagcattttcatagaacaaggacaagttagcaaacaactacaaccagcggaacaaaccttacagtaggctatagccctatagcctacctaaacagaggttttttttcccaatccttaagagacacacaactcccactacttgagtggtaaaaaagtttattattacaaaacaagtttatgattatgaatggcacggccattctggtagttgcgaggtatattgttagtccagagttatccacggtgcaagtatatgcctctaattgagacaaatatacatacctctaagaatgcaataaatgccacagaaatttataatgaaaatttccaattctatttcaacctataaggttagttttggtacttccttttatggggaggtatacaaggatggttgaaaacctcaaacagtaaatgtgatcgaaaaaagcattttaaaagagagctgacataggctacaatgaaaatagcacacaaactcttcgcaaatcatctgtacaagattatcacatcaatatgtgtacaactaccagaccaaataagtaaaaatatcaaaaagtagcaggccatttgtttaaatcaaattaagcatcataatctaagctcctaatctaagcaaaccataaagattaacttcaggaatgggcactgaattcagaattaagtgttcatacgcatataccagatagaattgcaacttgcatgattgttattagataagactaattaaatttatagaagtgcaactgttgatcaacagaccacatatgtgcaagtgttgatgacatattccgcataattattactcgatat

SEQ ID NO: 62666 - DNA, 764 bp, Oryza sativa
ggggaagcaaaagggcttgaatttaacttaccttatcgcttgaaaaacaatcaattagactttggtttaaaacaacctattaatttaaaaattgcttatctaaatgttggcttaccgattacaaatattcgagcaaaagtctttggacattatccttatacgccacaacacccattaaaattagaacaactatcaatgaatttattagatggcgctttgcggatagaacattttgccttaccacaaactaaagtcgcttatcttcatttatcacaaattaattttgaacaaattttagctttgcttaaatatcaacaaattgagttgaaaggacgtgctaatgcaacttttcctttttggattgaaggaaaaccttgttatgtatgtaatggatcaatggcacaagcggttagttctaggctaaaaattgcccctgaattgatgcaagctatttcacagagtaatggttattctgaacgtttattagcatatttgctacacgacacacgcattactgatttaactagcaaggtaaatattaattctgaaggcgaaatggcattacaagccaagttaaatatgcaattaaatcaacaagcacagacgaaaattaactttaactaccatcatcaagaaaatgtatttaaactatggcggacactaaatgctggcacttacgttgaacaaaattttgaaaattcaatttatcaaaaactggatcgcacaaatgaataaaatactgttattaatgggtaccgagctcg

SEQ ID NO: 62667 - DNA, 8229 bp, Oryza sativa
ccctctttttggaaaaaatttagaagcttgctcgggcagctggaggaggaagaaaacatatatatatatatataagggtgggactttagtcccggttggtgttgccaaccggggctaaagatcccggggatctttagccccggttggtaacaccaaccgggactaaagtcccacccttatatatatatatatatgttttcttcctcctccagctgcccgagcaagcttctaaattttttcaaaaaagaggggaggtcatgccaaaatttctagtgaatttattttggtgattacatacaaatcggaggtgcctaaaaggtttgcaacttcatcctccatcctccaaggatcaatttcaagggtatctacgaactataccagctggacaccctcgacgtctctattatgagttgctggattttgtaagtatcgttcagttagatttcttattacgtttcctttaattaattaggtccttgtatataagtagactatatataatatatactcccttttattgttgtagaatggagattcaaagggcccgacggcagggggttttcgatactggattcatcgaccctcggaaagtaaacgtcgcaatgctcgaccagtatccgcaagccacagaggacaatctcgtccatctcctgaaggcgcagcattacaagacgttcatactgttgccgtacaacacagagttagtttaattttactgtcttcctataccaaatttcattcccgtacgaacatgctaagtgtttcatatgtaatgcatcccacgcacattgcagattccactgggtgcttttactcttcgacctggagacctgcaccgtcaacgtatatgactcaatggataaaaaagagtctacgtttgacaaggttttcgaacttatagacaggtactgtcataagttcctatgttaattaagaatcttgttatagttaattgctactacgaatcatagctttaaactccatgtagggcttggtatcggttccgtcatttggtccgcagcaaatggagaaaaagacttaggcggaagttcaattttcttgtgagtacacatgctctacatttatatttctccgattcaaatacatacaagtgtatattaattagatctctcgtcgtttgtcatttatttatagtgcgcaaagcaaaagcagggaactaacttgtgcggctactacgtgtgcgagtattgccactgccttgcagaccaaatcatcaccacaagagagctcaatgtacgtacaaataaattcaaaatttcattacgtatcgatttgttgtttaattactaattaatttcatatattcatatagtttattcgcatgagggataacctgatcacacacaaggaatttatcgcggcggttcaagaacaactcatgggattcatcaacgaacaaatccttgatcccaagggtgaattctactacgacggaaatacaattcataggtccttagcttctaagatatcaactactactacgtcgaaatcgtagctagctaggacatataaaggattgtaattaatacatgtctatgtttctatatgcatgtgtacacatttctataatgtaaatatatattttggtcatatatatatatacatatgcatttgcataacatatatatgtataaatacatatatattatgcatgtacatatgtattgaaacatatataaatataatatatatatatatatatatatatatatatatatatatatatatatatatatatatatagtaaatttgtttggtgctccatggtgcccgggcaccattgttgaaattgagtacatacccaattcaaatgagtatgaaactttttcaattcaaatgagtatatatatatatatatatatatatatatatatcgtcatataaatacttctttttgacgaaaaaagataaagccagtctacgaaaaatacatggattggttgggccaaaattttcaaaagccataaaagatatacaatgaaagagagaaaagtgagtttgtgtatcttgtggatcatagttaaccttgaaaactctatggagcaatcaaataacatattggtaaagaatcattcgaagaacttacgaagcactctacaatatgcatcgacacaccgtgcagtatagctaaatccaatgtataaattgaactctaagaagctagcattcatagagaattatctgtaaggagtttatacaaactatgatgatgttctctaaatccactgagatgagaaaccgaatgtatggacatgaatgaatttgtgtcaagaaaaagagaagtccactatgctcaccagattcatcaatgcatacacaatcataattaggaaactatgtacaaacataccttatttccttttgctagctctaaatcctcaaatttatagcagcataaactgatctgtaaacccgtgcaccctagaaacttgataaattctcagtcaagcacctgtagcaagcctcatttgccctgataaccactcaatttatattagcccactgctcactgaagcactgaatgtacgtacattgtttcatctttctaccagaaattagtgccgatcaaaataattagttactctctccgtttctaaatatttgacaccgttaactttttagcacatgtttgaccgttcgtcttattgaaaaacttttgtgaaatatgtaaaactatatgtatacatataagtatatttaacaatgaatcaaatgataggaaaagaattaataattacttaaattttttgaataagacgaacggtcaaacatatttaaaaaagtcaacggcatcaaatatttagaaacagagggagtatattgttaacgaccaaatttcataaattctatcattattggcatcggagatgaagatcagatcgaagtggaatccaagatgaagatcgttgcggaaacagagtaagaatcggctgcagtccaaatcggctaaggtcaggtcgacagagttcgagtcggacggggctagccgatacagccgattagccgatatagccgattccgataatatgactcggtgtacgtcatcgggttcaagttgatgtgtttcaagataattgccacgcatggatagagtcctgggaaggcaattgtatctattaattagggtattctatgtaatttctttagagatatgtttgggcaaaagtctgccgtaaagacttatggtatcttagagtttgttagagataatagtcgtgtctattatggacgtatcttgtaattctcgggtataaatagacccgagccctatgtaaaaaagaacaacacatccaatacaatctcggcgcatcgccaccctttatgctttacttttatttcgacgagttcgtgctctcgggttgagctgcatcggtttctgtcggtgacatgggatcaggagtatcatgactagaggtttgaggcagacacaatcgcccacgtcgcgcctgcttccggcggaagtggaggtaggtatgggccgtcctatcagaaggtcattcggacggcaaccatacaagtctccatctgtttatgaaaaggtggggtaagtccccacaaaaaaagagagaaatggtgcatgtggtatccccttaagatataaaaggaggaccttgcccactgagaggggggactagacttttccagattagaaacccagaacaagggagaggctggctgatactttgtagctccttcatacacagatctcccaaaacataggagtagggtattacgcttctcagtggcccgaacctgtatacatcgcctgtgtcttgtgtgtttcctgtctcgcgagccttccacatacagagagcttagaatctctccctgagtccccggccgaaccggcaaaggggggcctgcgcggtctcccggtgtggagccccacgcttcgtcatctggcgcgccaggtagggggctctgcgagggattttctgagctctcgcactctttcgtgtgcgccaagcttttcctgttcagcccaatggccgagccagcaaaggcgcacgacctctccccgagtatgagcggtgacgacagggagccaaacccacgccgtcgagctcgtactccaccgccccctccacgccaaagtcctaggcgggagaaggcgctcgagagggccgaaggatccgcgacttcgacacccacaggaggtggagaagggcggcgagatggggagcgtcgcctcctcgtctacggcgacggcagcacgccccagggcgcgctccaagctgcgggcgcgctcctacatcacccgcccgtcgcccatgacccggagtctccagcccaacgttagctggacgatgtggccaaattggtcatgactgcacggcagcgcctagatgctggtgggcggtcctccgccaccaaggcctctggtgctgctaccaccggctccgcatcgtcaagacggagggcgcggcgagcggcagccgctgttcgccattcggccgccactccttcgtcaacgcctccgacccgggaagatctgcgtggggaaccggatgctcgcatcagtatcgagcgccggcgtaatggccgacgtgctccccacgcaacgtagggcgcctcctcgtccggagtgtcacctcaccacggacgcggggatcagccctccgtgcccccggttggtggtgtcggtagtagagcctttgtggcgagccttcggaatgtccgttggcccccaaggttccggcccaccatcgccgaaaaatatgacgggagcgtcaaccccgccgagtttctccaggtctacacgaccgggatcgaggccgccgggggtgacgacagggtcatggcgaatttctttcccatggccctgaaaggacaagcgcggggttggctaatgaacttgccacccgcgtctgtccactcttgggaggatttgtgctaacagttcaccatgaacttccaaggcacatatccgcgcccaggtgaggaagcggacttgcacgcagtacagcgaagggatgatgagtcacttcgctcgtacattcagcggttctgtcaagtccgcaacaccataccatgcatccctgcgcacgcggtgatttacgcgttcagggggggtgtgcggcacaaccgcatgcttgaaaagatcgcctccaaggagccccagactaccgcggagctttttcagctcgcggaccgagtggctagtaaggaggaggcatggacctggaacccctccggttccggtgtggcagcttcggccgcccccggatccgccgctcagatagggcggcgtgacaggaggaggaagaagaggtcagcccataccgacgacgagggtcatgtcctcgccgtcgagggcgcttcgcgggccacccgaaaggggaggcctgcgggaggcaaaaagaacgaggccggcgctcccaacagggagcgcccaaccggcaagtggtgcaccgtccacaacacttcccttcacgacctcgcggaccgccgtgcagtcaaaagtttggctgagcggacgaggaagtgggaggaggagaggaggcaggagcgccgagagggcaaatccccggcggttccttccggtaatcggcgaagtgaggccaagcagaaggcccccgccgaggacatcgatgacggcgatgatgacctaggtttccaagagcttggggccaccattgccaccgtcgatgggggagcgtgtgctcacgtttctcgccggagcttcaaggccatgaagcgagagcttctagccgcgacccctactcatgaggcgacgtgtcgggcgcggtggtcggaggttgccctcaccttcgaccagaccgaccacccaccgtgcgttgcccggggagggcagattgcgatggtggtttctcccaccgtttgcaacgtaaagttggggcgtgtcctcattgatgggggagcggccctcaacatcctttcccctgcggcctttgacgccatcaaggccccggggatggtgctccggccgtcccagccaattatcggtgtgacgccggggcacacgtggccgttaggtcacatcgacctaccggtcaccttcggtggatccgccaacttccgcacggagcgggtgaacttcgatgtggcggacctcagtctgccctacaacgcggtcctggggaggcccgcgttggtgaagttcatggcggcggtccactacgcctacctacagatgaagatgcctggccccggtggccccatctctgtccatggcgacctcaaagtcgcgctcgcttgtctggagcagcgcgcggaccacctcgccgctgcatccaagcccgagggtggcgacgagaggcttggcgcttccgcccccgccaccccgaggcaacggatgatcacaggcgacgaggtcccggtcaaggaggttgccctgggcgacggcccgtccaagaccacacggatcggtggtcttctggacggcaaataggaagacgcgctcgtctccttcctgcgggcaaacgctgacgtcttcgcatggagaccggcggatatgcccggggtccccagggaggtgattgagcaccgtctcgccgtgcggccgggcgtaaggccggtccggcagaaagtgcggcggcaggccccggaacgtcaagccttcatccgcgaggaggtggcgcgacttctggaagccggattcatccgtgaggtcatccatccggagtggctggcgaacccggtggttgttcccaaggcgaacggcaagcttcggatgtgcatcgactacaccgaccttaacaaggcatgtcctaaggatccttaccccctgcctcgcatagatcagattgtcgactccactgcggggtgcgaccttttgtgttttctagatgcatactctggttaccatcagattcgcatggctagggaggatgaggaaaaaactgcgttcattacccccataggaacctattgttatacgacaatgcccttcgggttaaagaatgcaggtcctacttttcaacgtactactcgaatttctttgggtaaccaattaggacgtaatgttgaggcttatgtcgatgacttggttgtaaagacgcgcaaccaggaaatgttactctcagatctagcggaaacttttgagagtctccactccgcccgcataaaactaaaccccgataagtgtgtgttcggtgtacctgcgggcaagcttctagggttcttggtctctgcccgaggcattgaggccaaccctgagaagatacgggctatagagcggatgcgcccccccagcaaacttagggatgtgcaatgcgtcaccggttgcatggccgccctaagtcggttcatatcgaggctgggagagtaggcgttactcttatttaagcttctcaaacgctccggaccgtttacctggacggaggaagccgaaaatgccctcacccagttgaaggcatatctaagctctcccccagttctggtcgccccggagctagacgagcccttgttactctacttagcggcgaccccgcaagtagttagtgtggcattggttgtggagcgcgatgagaacaattctcatttcacgcttctccaccctgtgccgacttggcccgggagagagcagggaggagaggctcccgagccgaacggtggcccaaggcccccgacgaccggagttggccctctgcccgcttgtcagacggtgctaggagcccccgacccccaggaaggccctgaggccactgtgggaaggccgcacctatcgcccttcgaccccgaggctaaccctgtgctgacccgacccaggaaagagtagggagaagaggcccccgagccgaacggaggcctaaagcccctgacgatcggagttggccctttgcccgcttttctgatgacgccaggagcccccgacccccaggacggccccgaagccactgtgggaaggccgcccctgttatcctccgaccccgaggtcatcagcacagaagataagtgcgccccgcgaggctgcttggacgaagagtgccccagggatgcggcccctagcgaagaggatcggccccaccgaaaggtgcagcggcccgtctactttgttagtgaggccctccgggacgccaaaacccgataccctcaggcccagaagatgctttacgctattctgatggcctcgaggaaactgcgccattatttccaggcgcatcgggtcacagtagttacgtcttaccccctcggtcaaatcttgcataatcgagagggtacaggacgggtggtgaaatgggcaat

SEQ ID NO: 62668 - DNA, 9175 bp, Oryza sativa
ttgtagatcgcgtcgagggctacaagtttgttatttagtttgtcttcattagagttcatatgaacaagttatgaattatttttaaatataaagtctttagactgtcctatttgacccagatgatattcaaatccaagtttagggaccgggtgacacaactgaacaagttggaggacctaaacgagtgatctgcaagtttaggaaccgggatgacacagtcgaacaagtttgagaacctgaacggtcgatttacgagtttagggaccaggatgacacagcagtacaagtttagggaccggtgatggactttactctattgtatatataccccttatcctattatttcaccaagcccttgcacaatgtgagttttacatgattttttgtattaattagaaagcgcttccatgtaagtcgattgtattcactaagctttattatctatcgtgactaaatttattgattgaactatcaaatatgagaaacagtcaaatttcacaaaagaaaaacagagagaaactggccattcctgttctttcaaattctagctactagaccatagcgatcacacttttcaaaccattaaacactaaaaacaaaatattatataaaagttttatagaaaactaaaaaaatgatcattttcaatatcaaaaaagaccatgcgctaattgagtatctgctcctataagcaaatcggttaatccagcaaaaagctatatcaaacggaccattctggcatagtgttttgtgataatgtttcaattttagagcatctccaagagataaccgatcatgttacctaaagctatactactttgggaattatgtctaaaacacagcctccaatatatatccaatcatggccccaatattccgacatgcccaatcctatcattgccctggcgtggctgattgacctggcagctaatggaacctcacgatgccctttctcgtcccgacggctggcgtgcactcgtgtccaccttgctgacgcgctggcccagtgatgcgcgatcgcccaagccctagtgcttgcaggtcgtttgcaacgtgacaacagctaatggaaccctcacaatgccctttcttgccccgacggctggcgtgcactcgcgtccaccttgctgacggcccagtgatgcgcgatcgcccaagccctagcactcgcaggtcgtttgcaacgtgacaaaaacgaaacagatcgctagaaacaataattgaaggagagcccacctaagatgacatgacaaatttctaacattttgcaaagggcactgctattgctagagatgcatgatttcgggcctattttttaagaaaaagttcgaattacgcttgaactatcgtggtagtacgaattatccacctctatttaaaaactagatattcttcatcctcaactttttatacggacgaattatcccctgacagactccagaatgctagcagttttggtcctacgtggtatacatgtagcagtctagtcagcattaatatatatatatatatatatatatatatatatatatatatatatatatatatataaggtagggcccacatgtggcgacctagaaaagatgcagaactgacaagtgccctaccattttttatttttttatgctgactagattaccacgtgtgtgccacgttggaccaaaactgctccggagtcgggtggccggggtgggggtgggggaggggatgcagcacagcatgcagcaaggccgggcaaacatcccattaatggactacgtatagaaagctttagtaggataagaaaacattggcagcacattaggtggtgttcttttcttgtgaagatgaagataaaggttatgtttttttacataaaatgaggtgatattaacgcataattgattgagttttaattattaaaaacttgaaaaatagattaatatgatattttagagcaactttcatatagaaagttttcatacgaaacgcaccgtttagcagtttgaaaagcgtgccataaaaatcttaatctttatctaacttttgttggagcaaagaacacgtgcttgccctccttgccacacgatccaactgttaattcctgttaatttgatcactcgttgtccgagaatcctaatcaggggtcactgttacttacaaggtagtacaactaatttccccctctgtcatccctacctacccgccatctgcagaaccatatataatttaggggcaatctcacagcaggttgtgttagagagaagagtattagagaggactgaaaatatgcgcaaaacaaaacaagtcacaaacacataattaattaattattaattattttaaatttaaaaaataaattaatataatttttaaaataacttttttttaagaatacatactagcagtttagaaaacgtgcggatataaaacgcgagcatcatgctttcctttccttgcagccttcccttcttcaattcacacagctactagatagcagaagatatgatttgatgcaattgaactatattccacgatgttgaattaaatcgtgagttagctggtggtggtgtgctgccgatgggttgacgagaacaaggtcacagggcatgaattgatgaataggatggccattttttttattattaaccttttttgtgtttaaattttaaataaacatcccaaaacttatttttaaaatttaaaacttttaaccacgccaccccggctggcataacgaaactaaactatcataaactatcatgttcatcctcatttgacttgacaatattatttcgccacatcagaccagccagtaccattaaaaggtctagttttaaaattaaattttgtaagagttcatttttaaattttaaaaaataaaaaggttcgaaaaaaaagttcatcgatggccgacacgagacggcgactcgatgtcgatggtgtctcccatgcaatgatgtaacgttttccttcccgtgatctcctttttccgggacgcattggttggcatcgttggatgaggaatcattttttgtagcaaccactttaattaatttggcagtgagccagtgaccgtgacgcagatacatgaggatgcactgatgcagcacagcagcgaggccggacaaacataccatttatcgatgacgttgataccggtaggccacatcgctgctactacttatattactccattcatccaagaaaaaaaagttaaattctaattgtacttaaaactgatgaagataaaagttacgttgatgtatataaaacgagaaagttattagtatatagctaattaagttttaattttaattattatagacttaacaaaataaatatattaatattttaaagtaacttatgtatgaaattttttgtcgcggaagcgtctagtataaactggtcccatgagcgcgagtagagtggccagcgacgtgatcgctcctctgccgtacgcccggccgtgcttcatgatggtggtggaggtacgtggtggagattacctacagtatccgtcggaaacagaatacgtatgacttttaaaagagaaagtacacgtgattgccctcctcgccacatgctgacatgcattatgtttacacacaacccctgcctgaatcgatgatagtattcccacacacaagataaggataaagaagataattaagtattttaggtaaataagatggtattaatgtatgattaattaagttttaattattaaaaaaaataattaatttgatattttagagtaacttttgtatagaaagttttcgtacgaaaagcgtgtcactagtatccaaaattttatccaattttttttaaagaaaagaacagggcttgtgtaattgtttattaatttcttcccacactgccctccctacctacccaccatctgcagcaaccacagggccaatcatgtacttcctcgctcgatcgtctctggcccagccattaaacggtagatggggagacctgagcatcatcgatggatgattaattttggtctttttcaaatatgctaaaaatgataaaataataatatgatattttctagcaaattaacacgttcttttaggtgtccttaggtcaagccacgttttaggagtatccctaacaaaatcactcttatagtaaattttgccaattttaaaaactaactttaataatgttggagtcatgacttaattctatccatcgagactaatagcgtcactaacttttttttctttaatttaatttgcacatcgattaattcgtacaaatcatgtatgtttgatttgcctttataagagttaggctcgatataaaaaagacataaaacgtatcgaataaaacgtatcgaaggaagaaaattatacgagatctttgcctcctcacattttttccttcttgagaaggggatcatcaaattattcaactttcaatacactaattaatatttgaagcaggctcttcatctaatcatccaccccttaatcatggcattttcttcatgcaataattatatagtgtgctctttctttattcttcttggatcttccgtatgctatcttcttcgtgctacctctgttagctagcactgcaacaataacaaactcttaatggtacaaaatatacaaataaaatgtaaacataccttactttaagttatattacaaatcatcttgtacaaaatgcatacataaacaattaactatttacaattaattgatagttaaccatacatatacattgttgtaactgcagataggcatggcaagcgcattggaaacattgtgtgggcaatcatatggtgccaagcaataccacatgttaggcatctatctacaacgctcatggatagttctcttctgttgtgcagtaatccttctcccaatctacctcttcaccactccgctcctaattgcccttggtcaggatcccgatatctctgttgtggctggcaccatctcactatggtacattcccatcatgttctcctatgtctggggattaacaatccaaatgtatctacaatcacagagcaagaacatgatcgttacctacctctccttgctcaactttggactcaatctcttcctatcatggctcatggtggtcaagtttcaccttggccttgctggggtgatgggctccatggtcattgcctgttggatccctatatttggtcagctcgcatatgtcttctttggcggttgtcctcaaacatggacagggttctcgtcctctgcctttactgatcttggtgctattatcaagctttcgatatcatccggagtgatgctttggtaagtaacagttctgtttatgtacacatatgaaattttgtataattttgatgataccaaacaaaaggcaatatgttatatctaacctagtgttaaccaagttctttcctacagctaatttggtagctcattgattcattcttgttgttcctttgcctttcagtgtagaattatggtacaacaccatattggtgctcctcactggttatatgaagaatgcagaggttgctcttgatgctctttctatatggtaatatgttaatatatatatatactattgttgcatactagtttagaaaataatagccaaatcatgttgtatcatgtacataaatttattgttttgtgttgatcctttagtacttggagaaattgcttgttgagcactgttgttttcacttacaaaatttgtagccttaatatcaatggttgggagatgatgattgctattggatttttggctgcaactgggtaacttcatgatcttacttgttactcattaagtggttcatctgactattccattatgtcctataaatttgacttatacttaatacatatacatttttagagtgcgggtggcaaatgaacttggagctaggagtgcaagaagggctaagtttgccattttcaatgtggtcaccacttctttcttgataggatttgtgttttttgtgctcttccttttctttcgtggaagccttgcatacatatttactgaaagtcaggaggtagtagatgcagtcgctgatcttgctccccttctagctttctccattttattgaatagtgttcaaccggtgctctcaggtatgattattttatttgacggacgattatatcaaaataatttaaactttcactttgaaattacaacgttttctaactatctataggtgtcgctattggctctggttggcaaagtgtagttgcctatgttaatgttgcatcgtactacttgatcggtatccctattggggcaatactaggctatgctctaggatttgaagtaaaggtaaggtcctggttgctattgtaaatttcattaggaaatcttgggtctaagttgcgtttctcacttttattaattggttctatagggcatttggattggaatgcttgttggaacactagtgcagactcttgtgcttttattcatcacacttaggactaattgggaaaaacaggttggctttgttatcttttttgctcatattttttgttatcttgtatttaattatatctttttcacataatataagggtctatctagaaaaacatgtgggacattgaaagagcacattttttttatatttgaatggtatgctccattgttttttaggtagagattgctctcgagagactaaatagatggtacacggatgataatggaagatcacaaaattcgagaggaaatccatgatctgaaactttcgcacattcataatggaattgaaagagttcgagatccttcgaggtcacatcatccatcatccatgaaccaaacgttaatcacaaggcatggatgatgttttttttttcctgaagtgtcagatcaaggaagaaccacgatgttagtgtagtaaccttgaatataagccccttatccttttatttttagcacgacgcagcatatgcttgacctttatgtgttttacatatttttttgtatttgttgacaagagcatgtatggctatgtgcttgcatgtgaattgattgtacccattggattttgttttctacctttgagtaaatttatggattcactatcaaatgagagaaaatatccacactaaaagttgtgggtcgtttgtccctttctggaataaattgctttgtaaaatgattccagttttaaatagcagaaaatatgatttgatgcatttgaactatattccacaattattctcctctcctgcaaccaagattttttttagccatttgacgcgctttatcgatatcaaaacacagttataacgttcactacaacgtttagcaagaagctaatgggttcaacccaattacaagaattcttcaaaatgaaagcatgatctagataatttatgtgctacacaatttgcctctttattacaatgttaaatatggagatattctctaaatcaaatctaagcatagggacattggcctactctgacatcatcttaaaaaaaatgaagaaaaaaaatgctgcgtgggctgggccgaatagacgattgaacaacaggccgaagaaaccaaaaatggtgtagcctgaaggtgaagctgtcaagcacccaaatggcggcgccggtgaggtcggtcctccccgtcgtcctcctcggctgcggcggcgtcggccgccaccttctccgccacatcgtctcctgccgcccgctccacgccaaccaggtacctcgtctcgtctgacccgtccccttcctctccgattcggtgctctcatcgcccatacttgtatagggcgtcgccatccgggtgctcggcgtcgccgacagctcctctctgctcgtcgccgacgacctccactccaacggcttcgacgacgcgctcctcgctgatctctgcgccgccaagtccgccggctcgcccctatcttccctgctcgctcgaggtatccccattctatttcgttattccttttttctttttttagaatattccatagcttccttgggtaatgaatactttgtcatgaatttgcatttgtacacgtgatatttaaagtaatggatggttggattgtgcaattttcagggcaatgtcagctattcaacaacactgaggctaggaggaaagtcattgacactgccagcgttctagggaaaacaactggtctgtgatccttctccctatgcagaatacattgcgcgctaagtttttgaattctctggaatagaaaccagtggggaaaaaaaaggaatctttgatatgctgtatgattgttgattagttcctttttttaaaaaaaaggagtgtaatatcttctttggttcttatcttatgatcctttttgcaggtcttgtactagttgattgttctgcaacttatgatactgttggcatgctaaaggatgccgtggattgtggatgttgtgttgtattggcaaacaagaaaccgcttacttgtgcttatgtaatgtcctccttaagtcttccatccagtattttttgtcattttgacacataagttcatgcttaccaaatgtgttcctttttcatgcaggaggatttcgaaaagttggtctccaacttccgtcgcataagatttgaatctactgtatgcatacgccactagtaattccttcatttcactattaaatgttattatacttttcccccaatcttaatgaaatttggtcggcgtttctttcgccgacccagcaaaaaatgttattatatttatttttcatggaaatccattcatttatttgatctggggttgtatgatatgactgtggccatatgattaagcacagcctttttttttggcaatttcttttattattacaaatgagttgagggtctctgctgatatttactattcctactcttaggttggagccagtctgcctgtaatagcttctgtgactcgtattattgcctctggagatccagtttctcgtattgttggcagtctgagtggtacacagttattattttatttgtttgtaaaaggtgtctgttttccaaatagcagagcaatgtacacttccattcctatgattctgcaggtacacttggttatgtgatgagtgagctggaggatggaaagaaatttagtgaagttgtgaaaactgccaagtctcttggctatacagaaccaggtctaaaaatttattcattcattggacattataacatcaatgtgtactcagtattcaattccttatctgtaattacag

SEQ ID NO: 62669 - DNA, 7352 bp, Oryza sativa
attcctgcagccctgcaagggagactgtcgatcgtaacatatgcacttcatgtcggcctttgggagcactgataagctagttcttcttgagctgtcttgatgcatcaagcagcacatggaggtcgctaattaattggtctgttgggctgcagctgatacttgagccgtctcagctgcttcctgctcagctccactggcgtcactgggcacatccacgaccatcttggaaacacggaacatggccaggtggatgtcgcctgcaataaaatgcaaaagaggaacaagcacagactgatcacaacgaagaagagcaggcaagagatgctgcgagttgtatgcagtctgaagagagtgaggtgagctaatttgtagcagtaataactaataagtagtagtaccaaaaatgaggaggctaccggggtcgatgggagtggggaaacccgggctgaggcgcctctcgttgatgtaggtgccattcgtgctctccaggtctgttaccaacaggctcccctctttcttctccagccgtgcgtgcgtcccagaaactgctttttttcatgccattccattccatttcatttcatttgcagcaacttagtaagctacatatgtctgatggattatggagagagcaatgcaagtgaatgaatgtgctgcatatatatatgctactacctgttgcgacagacaggacgatgtcagcctgttcaggaacacgacccaccgtcaccgccgcctcctgcacacacaagacaacacattcattcatccaagagaacacccggctgcagctgagctagcacggttacagcatggatatccagagaatttctgggaaggtagaaacaaagagagacatacggatgctatctggaagccgccgggtcgtgcgacgcggtacccgatatgacgccaatcgccgtctcctgcaattcaacaacagcaggttctgtttgttcaggtggacagcaataaactcacgaatattgctgctgtgttctgttttgcaattttttcttcagaccagctagttaaagttggtaagatgacgatactatgattaagccggtaggcaggcacaagcatgagccagttcacaagggatatcgacattgcattacaagtatcattttcacaagtattgaaagcagactaacctgcaggctcaagaacccatctttctgaagtggcggaagaagacgcgctgtcagtgccactggaagagcacctcagcgacaaaatggaaatgcttcttctgccactcccgttgctgtttctgctggttagctgactgacgaactgcagccgcggctgctgcagcttcgccccattggaggcgtagctgctgctgcaaggaggcggcagtgacaagcaggaggaaggcctcctgggtgttgggctagagaagagcaaggaaggagtagccactgctgcttccatttgtgtctgtgatttgtgctcactgctcagcagtggcagggaaatgcagtgccttgctttttttgttcgcttcttgatttctttgtggatcagtggagatagaattgaggttgtttgtcctgtgttcaatgctatctctggactcatggccaatcagttgctcttcaccttcatctgttggtggtcgaggttcactgcttggtcattgtcggattctcccgttgccctacggtcccactctgcttgtctgcttctgctgtactgtacacaaataaattttttttctcaaacacatttttaagagtaattttagatgaaacaataacactcctccaaatttcacagaaaaaaaaaagagtactccaggattaacattgcagtaatcttttagcagtgcataaataggaaaaatgcataatgaataatttagcttgtttgagtctcaagagaagaaaaaaaaaacacacgatgaatattgtatctggttgagtctctagagaaatttagctcccttagttattctccgaagagggtttgtttggatgactcacctgcatagagaaaaacttgagaataaaggttagttaatcagtgagagaaagcgaaggtgtattcgaactcttcaagcaaaatttacacccattggctttggtgtgatgtaatgtaagcttcatccatagtatcagtatattcttttagcggttttacacatttttcttacaatatttgtttgtttctctagacgtgcaatgcaacacagtatacaacatagaagcgttagtatatttccatattattactccagcaggaaaatattcaatacaagcgacatctgattaagcagttcagcaacctacaaatttcaaaaacaaaattaaacatcctcgattctttcaataaataaataaatttcaaaaagaaaaattaaacaccctacatcaggccaggtcagctaaaagcccaacacgcttggggcctaatgctgtctgtgcttgggccggcccactcaggtccacttccggacccacacgccagactctctcgaggaaaaaaaaaaagaagtaatcgtggttagcaacctgccccttgttccacaacgacgaacaacatctcgccacgaggaggagggcgagagcttacacgagtccgaaatccccaatccgggatcccctgcttctcttcgcgccaaggtaagatctctcacggatctctgtgcttggcagcgcggatcgaatttttgtcattacttgtcctaatttttgttccggggtgtctaatttgggtccgatccgatcagatggcggctgcctgggcggcggcggtggccgtgatgctcctccttgcgcaggtgtcagcggcggctccggtgatggggcctgccttcctctgggcgcccaataactacgggtaacttgttgccacagcgtttctctttttcatcgtttcaagcctgagatcccttttgctagatatgtatgaatgtattaataatgttaacgatttttagtgaactctgctgcttcacttagaaaaggttgcaatttggtatagcgagtattgacataacacataactcttcatgaggtgcatgcgatttactgctcttcttttcttgaacgaatagtgcatatgcagttcgttcctcatgaaacaggaggcttcatgatcggataattagtttcctttgtatctaaggccacacccttgactctagccctgtgtgccatagatgatagaatcttcttgggcattcccaggagtgatcctcgcgttgtctcatggggtccagatcaaccacattcctttgaaactgcatcctcaagaaacgcccaggggtcttccagctagctccacaaggtggtgggctagatgacctgggttcgaagcctcaccccttctaattatttgatattaggtccttccctaatattcgcgtctttttttttcgaaactgcatcctcatccatcattcagtacagacaatcaatatggaggttttaaatctagaacaaccatagattccatagttggaggatttcggagttctcaacttatactgatcaagcagttaccttgcacagttgcccatttcctgctactacttcacatcagcgctccattttgctgcggagagtaaatgtataatttctttcgtcaaattccaatttatatggtggagggtggagtagggtggttgagagaaatctcagttggaagtgggatactggaaggttgatgagaggaaaggatgaaacccatacccatttagcaccctttcatttttggtcatatgatctggtatatacatatcaaaaccttctagttagaacgaagaacagagattgtcttgctgcttaggttttgtgttacagatttgttcagcttttctaacatgctcactcctatttgtgttgatattaggaaagtaaagtagggtatcagttaagacaggcctccattttgtatttgattttgcacagtgcacactggaatatcatggcttgcttcaaaaaacattaccttcttagatttttttagctcagctagggagcatttttatgtttttttttccatggggtttgtagtaatgctgcacacttatgtcttaagcatgctttccttagtagacaggtgcatccgtgcatgtggccgttagatatgctgtctttcttgcatggaaacttgcaatccaattgaaatcctgctaaaaattagtaatagagctccatggggctggctctaaaaaaatgattttgtgtttgcttcagctcttattttatatggacaatctttggcctctaattgaaaaagatcttgaaactatgagttccattaaataggctatggcgagttcctgagcaatatgttatccttatctgagataataagaacattaaagcaatggagtaatgcaacttcatcactgattcttgcctagagcatatgttgcacctggtctgtactgtagatggcaatgtcatgcatatgagggtcacccatttttgttggtgcctcacattttcagttacttgctggctagattgaaattaccagttcatatagaaaatatttgctgaccttcttgtggttattttaatcaaagtttagttgtataaattacattttatttaccttgctcgccagattctcttctgatgagactaaagaaatggtctactatcagacagtatccccaaagagcttagtgaaatctgttcttgaggaaggtggttggtcaaacttggtggtgagttgagttccccccacgtcaattcacaaacaactgaccaatttcaattgcagtatctgctcttattgtgcacaaactcaaacaattcataacattgtgattttattttagtgttcaagggaggatcatgcaaagagtgttgatgttgcagttctttttcttggctcgaaggtacttattgactcccattcatttggtactgtgaactagtgtttaggtcttcactggttgcaatgtttacataattattgattcagtccacattgatcaaaaaattggaatacattttcttcatagtgtttctgatagacgataataatcaatactaagaggccataacatttccaaattctcttgtttgaatctgtatgtcaaaattattgctagatcaagtaatttatattatgatgctgtttcaatttttcaatgcttcagttgaaactgactgataacttattgttcctgtagctacaatcatcagacatttctaaagaaaagcaagctgattcaactttagtagacatgctgaaggtattcataatcactcttcttttgtccatcccccttatttgtatttcccctagttgttatataactgaaaaattaaagatttttaaatgcttataatatctatgctctttactagaactcctttgcaagctccgagttttccatggcattcccctatgttgccatgtcagatgatgacaaattggagaagtcattgctatctggatttgctgagaattgcaacaatggtcttggaaataatcatatcacctacacagacacctgttctgtaagtgaagatctgaagaaacatcacgacatggattccattcatgtaagtttttatagttcttttggtacttcttgcaatttctcttttccatttattgaccacatgtacattccagggattggtggcatcacaaactaaaaagaacccaagtggacagactgatctggttgtcttctgtgatggtggtttcaaggataacacaaaatcagaaggttaggtcaaagatgctaggttggtcctttcacctcaaatatacaactgtaccttaatgttatgctaattttttctgtaggggagttactttctgagctggttactctgctgaagaagtctggagctaaatatacaattctttatgcttctcagccctatggtttgctagagagcccttcaaacctgccgttaggcaggtacctcgcagagaagactaatactactaaacccggccgtggaaaatgtgatggggagtgcttagtaaaatcaactctgctagaaggaagctttgttgtaagttgtcccatggactgttttttttattggttactttcattctgtcatgtagacttaagcctataatgttttccaacaaaaacagtataattttagaggtagttgacttctcttattgactttactgcaaaattttatttctatatcactatttgttatcctagaattattttctcacaatagttcgtttatgatatgcagggaatagtgctgctaatcatcttgatatcaggactcaaatgtatgatgggaattgataccccatcaaagttcgatgctcccccggaatcgtaagcccatttttaagcagatctgaatggaaactcaaggcaaacacgaggggaaaattgaatagctgatgtagcaggtctgtactgtgaatatagttagtttgctacttattgccttatgtattttaatgagccaactgcaatttgcagtcaatttttggtggaatattacatttcaaaacgtacacgtgcaaggcctgatttgtaccatataacactgcctctagtgtttgctgtgtgaataagctggaattaaaacctgttttggaataagatgtcacagttcatcgaataaaaccttgcgatatatttcattattttcatatataccgtgttattgcaattgaacaagtccctcaggaatatcttttctggaattgcattgcatttgattctctgtaggttaaatacagagtcttgtactcttttgccaggtgaagatgtttggttattaacggtcgtcgcttattctgtaggttattactattcgagactttgtggtgctagcctagcaccctatcatttatcattgcttgttcatcaatcaaccccgtaatatttcaatcatatttcacgatccattactagcctgattgggacactgattaaggtactttacgccggagggcttttcttcctttagctggtgatgttactgtcagggaaaccttattgctcaagtgatcacattactgagatagatagcgattgctatattaggacaaaacaaaaaaaaaaggactacacgactatgcactccctttctccctctggggtctttgtatatatcttggcttagcactgaagtatacctggaaatttatggcacctacataatttgcaggaaagtgatcacgaaattgcatggcgatgtcttcttcatgttatcctggccagtatagaaggaaaagagtgaatcgcaagataaatattatccctattgttttacttatacttatttgtatcacatagcaaataaaaaataatttaaggataaagcttttaatatgtgtgttctaactatgataaaaagggtaccgagctcgaattcgccctatag

SEQ ID NO: 62670 - DNA, 14956 bp, Oryza sativa
atactggattcatcgaccctcggaaagtaaacgtcgcaatgctcgaccagtatccgcaagccacagaggacaatctcgtccatctcctgaaggcgcagcattacaagacgttcatactgttgccgtacaacacagagttagtttaattttactgtcttcctataccaaatttcattcccgtacgaacatgctaagtgtttcatatgtaatgcatcccacgcacattgcagattccactgggtgcttttactcttcgacctggagacctgcaccgtcaacgtatatgactcaatggataaaaaagagtctacgtttgacaaggttttcgaacttatagacaggtactgtcataagttcctatgttaattaagaatcttgttatagttaattgctactacgaatcatagctttaaactccatgtagggcttggtatcggttccgtcatttggtccgcagcaaatggagaaaaagacttaggcggaagttcaattttcttgtgagtacacatgctctacatttatatttctccgattcaaatacatacaagtgtatattaattagatctctcgtcgtttgtcatttatttatagtgcgcaaagcaaaagcagggaactaacttgtgcggctactacgtgtgcgagtattgccactgccttgcagaccaaatcatcaccacaagagagctcaatgtacgtacaaataaattcaaaatttcattacgtatcgatttgttgtttaattactaattaatttcatatattcatatagtttattcgcatgagggataacctgatcacacacaaggaatttatcgcggcggttcaagaacaactcatgggattcatcaacgaacaaatccttgatcccaagggtgaattctactacgacggaaatacaattcataggtccttagcttctaagatatcaactactactacgtcgaaatcgtagctagctaggacatataaaggattgtaattaatacatgtctatgtttctatatgcatgtgtacacatttctataatgtaaatatatattttggtcatatatatatatacatatgcatttgcataacatatatatgtataaatacatatatattatgcatgtacatatgtattgaaacatatataaatataatatatatatatatatatatatatatatatatatatatatatatatatatatatatataagaaatttgtttggggctccatggggcccgggcaccattgttgaaattgagtacatacccaattcagatgagtatgaaactttttcaattcaaatgagggtatatatatatatatatatatatatatatatatatatatatatatatagagatagagagagataaagaggtatgtgtgtgtatatgcacatacacatatatgtgtgtgtgtgtgtgtatatagagagaaaaatacatatatatatatatacacacacacacacacacacacacacacacacacacgcatatgagtgtgtgtagaaaacaaaaacatagagagagagagcgcgctctctatgtgtgtgtgtgtgtgagagtgagagagagagagagagagacacagtctatagatatagagagcggggtgggtgtgtgtgtgtgagagtgagtgggaatctctatatatatatatatatctatatatagagagagagagagagagagagagagagggcgagtatgaacataaacacacacacacacacacgtgtgtctctctgtgtctgtgtgtaagggcgcgcgcgagcgggcgcgcacacaccccctgtctctgacagagacagacacaaacacaatatatatatatatatatatatatatatatatatatatatatatatatatatatatataggaaatttgtttggtgctccatggtgcccgggcaccattgttgaaattgagtacatacccaattcaaatgagtatgaaactttttcaattcaaatgagtatatatatatatatatatatatatatatatcggcatataaatacttctttttgacgaaaaaagataaagccagtctacgaaaaatacatggattggttgggccaaaattttcaaaagccataaaagatatacaatgaaagagagaaaagtgagtttgtgtatcttgtggatcatagttaaccttgaaaactctatggagcaatcaaataacatattggtaaagaatcattcgaagaacttacgaagcactctacaatatgcatcgacacaccgtgcagtatagctaaatccaatgtataaattgaactctaagaagctagcattcatagagaattatctgtaaggagtttatacaaactatgatgatgttctctaaatccactgagatgagaaaccgaatgtatggacatgaatgaatttgtgtcaagaaaaagagaagtccactatgctcaccagattcatcaatgcatacacaatcataattaggaaactatgtacaaacataccttatttccttttgctagctctaaatcctcaaatttatagcagcataaactgatctgtaaacccgtgcaccctagaaacttgataaattctcagtcaagcacctgtagcaagcctcatttgccctgataaccactcaatttatattagcccactgctcactgaagcactgaatgtacgtacattgtttcatctttctaccagaaattagtgccgatcaaaataattagttactctctccgtttctaaatatttgacaccgttaactttttagcacatgtttgaccgttcgtcttattgaaaaacttttgtgaaatatgtaaaactatatgtatacatataagtatatttaacaatgaatcaaatgataggaaaagaattaataattacttaaattttttgaataagacgaacggtcaaacatatttaaaaaagtcaacggcatcaaatatttagaaacagagggagtatattgttaacgaccaaatttcataaattctatcattattggcatcggagatgaagatcagatcgaagtggaatccaagatgaagatcgttgcggaaacagagtaagaatcggctgcagtccaaatcggctaaggtcaggtcgacagagttcgagtcggacggggctagccgatacagccgattagccgatatagccgattccgataatatgactcggtgtacgtcatcgggttcaagttgatgtgtttcaagataattgccacgcatggatagagtcctgggaaggcaattgtatctattaattagggtattctatgtaatttctttagagatatgtttgggcaaaagtctgccgtaaagacttatggtatcttagagtttgttagagataatagtcgtgtctattatggacgtatcttgtaattctcgggtataaatagacccgagccctatgtaaaaaagaacaacacatccaatacaatctcggcgcatcgccaccctttatgctttacttttatttcgacgagttcgtgctctcgggttgagctgcatcggtttctgtcggtgacatgggatcaggagtatcatgactagaggtttgaggcagacacaatcgcccacgtcgcgcctgcttccggcggaagtggaggtaggtatgggccgtcctatcagaaggtcattcggacggcaaccatacaagtctccatctgtttatgaaaaggtggggtaagtccccacaaaaaaagagagaaatggtgcatgtggtatccccttaagatataaaaggaggaccttgcccactgagaggggggactagacttttccagattagaaacccagaacaagggagaggctggctgatactttgtagctccttcatacacagatctcccaaaacataggagtagggtattacgcttctcagtggcccgaacctgtatacatcgcctgtgtcttgtgtgtttcctgtctcgcgagccttccacatacagagagcttagaatctctccctgagtccccggccgaaccggcaaaggggggcctgcgcggtctcccggtgtggagccccacgcttcgtcatctggcgcgccaggtagggggctctgcgagggattttctgagctctcgcactctttcgtgtgcgccaagcttttcctgttcagcccaatggccgagccagcaaaggcgcacgacctctccccgagtatgagcggtgacgacagggagccaaacccacgccgtcgagctcgtactccaccgccccctccacgccaaagtcctaggcgggagaaggcgctcgagagggccgaaggatccgcgacttcgacacccacaggaggtggagaagggcggcgagatggggagcgtcgcctcctcgtctacggcgacggcagcacgccccagggcgcgctccaagctgcgggcgcgctcctacatcacccgcccgtcgcccatgacccggagtctccagcccaacgttagctggacgatgtggccaaattggtcatgactgcacggcagcgcctagatgctggtgggcggtcctccgccaccaaggcctctggtgctgctaccaccggctccgcatcgtcaagacggagggcgcggcgagcggcagccgctgttcgccattcggccgccactccttcgtcaacgcctccgacccgggaagatctgcgtggggaaccggatgctcgcatcagtatcgagcgccggcgtaatggccgacgtgctccccacgcaacgtagggcgcctcctcgtccggagtgtcacctcaccacggacgcggggatcagccctccgtgcccccggttggtggtgtcggtagtagagcctttgtggcgagccttcggaatgtccgttggcccccaaggttccggcccaccatcgccgaaaaatatgacgggagcgtcaaccccgccgagtttctccaggtctacacgaccgggatcgaggccgccgggggtgacgacagggtcatggcgaatttctttcccatggccctgaaaggacaagcgcggggttggctaatgaacttgccacccgcgtctgtccactcttgggaggatttgtgctaacagttcaccatgaacttccaaggcacatatccgcgcccaggtgaggaagcggacttgcacgcagtacagcgaagggatgatgagtcacttcgctcgtacattcagcggttctgtcaagtccgcaacaccataccatgcatccctgcgcacgcggtgatttacgcgttcagggggggtgtgcggcacaaccgcatgcttgaaaagatcgcctccaaggagccccagactaccgcggagctttttcagctcgcggaccgagtggctagtaaggaggaggcatggacctggaacccctccggttccggtgtggcagcttcggccgcccccggatccgccgctcagatagggcggcgtgacaggaggaggaagaagaggtcagcccataccgacgacgagggtcatgtcctcgccgtcgagggcgcttcgcgggccacccgaaaggggaggcctgcgggaggcaaaaagaacgaggccggcgctcccaacagggagcgcccaaccggcaagtggtgcaccgtccacaacacttcccttcacgacctcgcggaccgccgtgcagtcaaaagtttggctgagcggacgaggaagtgggaggaggagaggaggcaggagcgccgagagggcaaatccccggcggttccttccggtaatcggcgaagtgaggccaagcagaaggcccccgccgaggacatcgatgacggcgatgatgacctaggtttccaagagcttggggccaccattgccaccgtcgatgggggagcgtgtgctcacgtttctcgccggagcttcaaggccatgaagcgagagcttctagccgcgacccctactcatgaggcgacgtgtcgggcgcggtggtcggaggttgccctcaccttcgaccagaccgaccacccaccgtgcgttgcccggggagggcagattgcgatggtggtttctcccaccgtttgcaacgtaaagttggggcgtgtcctcattgatgggggagcggccctcaacatcctttcccctgcggcctttgacgccatcaaggccccggggatggtgctccggccgtcccagccaattatcggtgtgacgccggggcacacgtggccgttaggtcacatcgacctaccggtcaccttcggtggatccgccaacttccgcacggagcgggtgaacttcgatgtggcggacctcagtctgccctacaacgcggtcctggggaggcccgcgttggtgaagttcatggcggcggtccactacgcctacctacagatgaagatgcctggccccggtggccccatctctgtccatggcgacctcaaagtcgcgctcgcttgtctggagcagcgcgcggaccacctcgccgctgcatccaagcccgagggtggcgacgagaggcttggcgcttccgcccccgccaccccgaggcaacggatgatcacaggcgacgaggtcccggtcaaggaggttgccctgggcgacggcccgtccaagaccacacggatcggtggtcttctggacggcaaataggaagacgcgctcgtctccttcctgcgggcaaacgctgacgtcttcgcatggagaccggcggatatgcccggggtccccagggaggtgattgagcaccgtctcgccgtgcggccgggcgtaaggccggtccggcagaaagtgcggcggcaggccccggaacgtcaagccttcatccgcgaggaggtggcgcgacttctggaagccggattcatccgtgaggtcatccatccggagtggctggcgaacccggtggttgttcccaaggcgaacggcaagcttcggatgtgcatcgactacaccgaccttaacaaggcatgtcctaaggatccttaccccctgcctcgcatagatcagattgtcgactccactgcggggtgcgaccttttgtgttttctagatgcatactctggttaccatcagattcgcatggctagggaggatgaggaaaaaactgcgttcattacccccataggaacctattgttatacgacaatgcccttcgggttaaagaatgcaggtcctacttttcaacgtactactcgaatttctttgggtaaccaattaggacgtaatgttgaggcttatgtcgatgacttggttgtaaagacgcgcaaccaggaaatgttactctcagatctagcggaaacttttgagagtctccactccgcccgcataaaactaaaccccgataagtgtgtgttcggtgtacctgcgggcaagcttctagggttcttggtctctgcccgaggcattgaggccaaccctgagaagatacgggctatagagcggatgcgcccccccagcaaacttagggatgtgcaatgcgtcaccggttgcatggccgccctaagtcggttcatatcgaggctgggagagtaggcgttactcttatttaagcttctcaaacgctccggaccgtttacctggacggaggaagccgaaaatgccctcacccagttgaaggcatatctaagctctcccccagttctggtcgccccggagctagacgagcccttgttactctacttagcggcgaccccgcaagtagttagtgtggcattggttgtggagcgcgatgagaacaattctcatttcacgcttctccaccctgtgccgacttggcccgggagagagcagggaggagaggctcccgagccgaacggtggcccaaggcccccgacgaccggagttggccctctgcccgcttgtcagacggtgctaggagcccccgacccccaggaaggccctgaggccactgtgggaaggccgcacctatcgcccttcgaccccgaggctaaccctgtgctgacccgacccaggaaagagtagggagaagaggcccccgagccgaacggaggcctaaagcccctgacgatcggagttggccctttgcccgcttttctgatgacgccaggagcccccgacccccaggacggccccgaagccactgtgggaaggccgcccctgttatcctccgaccccgaggtcatcagcacagaagataagtgcgccccgcgaggctgcttggacgaagagtgccccagggatgcggcccctagcgaagaggatcggccccaccgaaaggtgcagcggcccgtctactttgttagtgaggccctccgggacgccaaaacccgataccctcaggcccagaagatgctttacgctattctgatggcctcgaggaaactgcgccattatttccaggcgcatcgggtcacagtagttacgtcttaccccctcggtcaaatcttgcataatcgagagggtacaggacgggtggtgaaatgggcaatcgaactttctgagttcgatttgcactttgaaccacgccacgctatcaagagccaggccctcgccgattttgtggcagagtggaccccggctcccgagcccgtctcgatccccgaggccagcacggacccctcgcagctgcctcacaccgcccactgggtgatgcagttcgacggctccctgtctcttcagggcgccggtgcgggggtcacgttgacctctccgagcggagacgtcctcagatacttggtccgcctcgactttcgagcgaccaataatatggcagaatacgagggactccttgccggactaagagtggcagctggactggggatccgctgcctcctggtgttaggcgactcccagctggtcgttaaccaagtctgtaaggagtaccggtgctctgacccgcagatggacgcctacgtgcgccaagtacggcgtatggagcgccattttgacgggattgagcttcggcatgtgcccagacgggataacatgattgccgacgaactctcacggctcgcgtcctcgcgagcccagaccccaccgggcgcctttgaagaaaggcttgcccagccgtcggcgcgacccgaccccttaggggagacggatgcgcctgaccggcccccgaggcctgtcggagtccaggcctcgggacccgaggggagtgctcccaactcccttagattgattgcttggatcgccgagatccaagcatacctcacagataagactctacccgaggaccgcgaagggagtgaacgcgtccatcgcatctccaaacgctacgtgctggtagaagggaccctctatcggcgcgcagctaatggaatcctcctgaagtgcattcctcgggaacaaggcgttgtgcttcttgccgatatccatgaaggcgaatgcggagcccactccgcctcgcgcaccttggttggtaaagcttttcgccagggtttctattggccgacagctcttaatgatgcggtcgacctggtccggcgatgtagagcgtgtcgattccacgccaagcaaatccatcagccggcccaggccctgcagaccataccactttcgtggccatttgctgtctggggactcgatatcctgggaccgtttaggcgggccccgggcgggtttgagtatctgtatgtcgcgatcgacaggttcactaagtggcccgaggcttatccggtcgtcaagatcgataagcactccgcacttaaattcattaagggcatcaaggcccggtttggagtgcctaaccgtattattacggataatggcacccaattcactagtgaactcttcggcgactactgcgaagacatgggcatcaagctctgcttcgcctcacctgcccaccccagaagcaatggccaagtggagcgcgccaatgcggaaatcctcaaaggccttaaaaccaagaccttcaacatactcaagaaacacggcgattcatggatcgaggagttgccagcggtgctctgggcaaaccgaactacaccaagccgagcaaccggggaaacgcctttcttcctcgtctacggcgcggaagcggttctcccatccgagctcaccctgaggtctcctcgggctaccatgtattgcgaggctgatcaaaatcagcttcgcagagatgacctcgactacttggaagagcgaaggcggcgcgcggccctccgagccgcgcgctaccagcagagcctgcggcgctaccatcagcgccacgtccgggcccgatcactctgcgtcgacgacctcgtcctacgccgcgtccaaacgcgttctggattgagcaagctttcaccaatgtgggagggtccgtatcgagtggtcggcgtcccccagccgggctccatacggctggccacgggcgacggcactgagctgcctaacccgtggaacatcgaacaccttcgtcgcttctacccctgaggggggggggggtcgggtgtcaggtttcgggctcgggccaacccccctcgggcgtgcagggttggccgggggctacaacatatgcatattcttatttctcttatatctgaatttctataaaagcagtttcaatttcctaaaggctgtatctgtgctgttttttccttttgaagaatcttgacttgaaataggtcactcgtgctcaatcctgccctcgggggctcgggtcggctaaaatcgccaaacggggcccagaaccgagccgtgccccgaggcgtggtgaactccggggggggggggggggaatcggcaaaaacccacaatcgggtcacccataaccctcggtcaccacgttcccggcctggccagtctcgacatgtggatctccccaggcactagcccgacccgcgccttttgaggaccagaacctgggcacaagcccttattcaagctaagacacaaaaggaccacggcacagatcatcctcatctcatactcacagcaagatgaaattaacacaaaaatttcttcatttttgattacagattaagttgatctatacaaaaaagaggcccgaaggccttagaagaaagaaaagaagaaaaaactgaagaatggcgggggtctgggggctcaatccgatgcgcccggatcgccggcctcgacgtcactgtcgtctgcaccaccggcattgccctcctcgtcggagttgggggcgaacgcaagccgaggggccgagccctcgaagctgtcgacgatatggtcggcggcatcccggacctgcgcgcgcgcgcggtcctcggtcccaggagggaactcatccagcgccatccatggagagaaattggggtccctggcctggtaactcgccaggacgagctccaccgctccttgggcgaggtccctcgaggatgacttaattgtcttctcgagctcctcggggagccgttggagagccccggccatcttcgagaggcgctgggcgaggcctccctggttggcggcgtactttacggtccgccctctccagaggcccacttgccgaccggcgcaatctaggcgggagacggcgtcccaaagcatgccgggccctacctcgcctgccaagcggagggcttcgacctccccgacggacgagtccagcgcgccctgcagatcggcgatggtgcgttcggcagctgcgaggcgggcggctaagtcgctttcgcccgtggccgtcccgccgctgcgcgccctcgcgtccagctccttcgcccgcgcctcgagctcagcggcccgttggttcagtacggccctctcggcgcgggcaccttccagattgcggcgcgcctgctcctcctgcgctgcctcgcggagggacaggttgaccgccagctgttgcgccgcggcctcggccccctcgagagctcgctcccgttcggtgagcgcgtcctcgcggaggcggagcgtgaactcttcttcggcgcaggcagcctcgtgcgccgccagcgttgcttcccggatggtgacggcggcctcgcggtccgccagatccctctccacgacgctggcgcgctcttccagcgccatggcgcgagcctcaagggcctcttcgcgccgctgggacgccgcttcggtctccgccgcccgctgttctcgggcagcggtagcgtcaagcaccccctgggcggcgtcgagcttcttccctagctccgcctcccagctcccgtattgaaggcggagggtgttctgcgcctcgttcatcacggtggtggcaatgagggcagccccccgttcctcctccacttccttggcgatctccgccagcaccttcttacgagtttcaagctccgagacgtgccggcggtgagccttacggcccacctccaccatggcctccaccgagcgtcgcccctcttcgacacgcgcccacgcggcgtcgagctccgcccgctctgcctgcaggacctccacctgggcacttaacccatccaacaccgtggtgtttgcggcggccaaggcctgcagaaggggctctgcgttcagtagggcgatagaaggcgtggggaagagtcgccttggagaggatgccacgcggctcgggccgccgatggaagtgccggactcggggatgtcccccggacccggttggtcctgagcgtcgcccgagggagtgtgcccaagcgacgcgcccgcagcctcgtcgccagctgccccagaagttgtcgcctgagcgtcgcccgagggagtgggcccaagcgacgcgcccgcggcctcgtcgcgagctgcctcggaagtcgccatcgcctcgtcctggcgaaatccgacttcctcccgagcggcttccccggcctggcgggcccgggcggcctcctcccgagcggtttcctcggcctggcgagcccgggcggcctcctgggcggcctcctcggcttcccgtaggcgatccgcggcctctcgccggtcagattcccgcctgagggcctctgcggccgccggatcctcggcctcagactggccggacttgggatggcgggagggacgcgacgggatctcgctgaaacaaaagaaaaaaccagaagacgaacaagatgggtgagtgaaaactcgcgttgagaaaatgaatacagccacgatgggtgagagacaaacctgcgagggggtcggttaaacgaccactttggaggggaaatgaggtttccccgagatggttctgtctccccaatcttacggggccgcttcttcttgcgctccccctcgggctgcgatgttggcgcggccccctccgggcgcctgttactggcacgcgccgccccgccccctcggggacgagatgggggaggtgttcctccctgcttcctcttcccccgggcgtcggcagggcggctgctccccgggcccctgtcgcgggacccagaagcacgaccccctctcggggtagattgttcccccctgcggctcccgcctgcgccgtcgtggccctttggagctcgctcctctgaggccccgaccgccatcataatggtcaggatggaggcgcggtctggatcgctgcagagggggaggattccttggggaatgagggccgcctctacggagttgagattcagcacccgttggaccaatatcttgaagtcctcaggagcccagtcccatctcactccctggtgggtcctcgtgaagtcttcgaacccggtgtactcccaggcgccccgagcgcgtcgctggagcggcgcaatccgacgacggaggtagtcgccgtacaccatggcccctgtgagcccctgggatcgcaggcccgccaggcggtcgaggacggcgtcatagccatcccccagatctaccggcgcccgccagctggaggcctgcaccgggggctggctcggaagtcggaggcgcgcttcgtcggcgaggggagtgtagaaccagtcgctcttccagtcgtcccacttcttgcggagggcgcaggggatgtagcggttcagcaccggcccccgtggctggaagtagcagccaccgactaccgatggcggcgacaccgactgcacggtgaagaaccaccggaacagccgaagagatgggcgcaccccaatgaacatctcgcacagatgcgcgaagatggccaatgtcatcaccgcgttgggggtgaggtgcgccatctggagatcgtagaactccagaacatccatgaagaaagaagaaaatggtggaaccagccctgccattgcaaaggggagaaagaagatggaccgccccgggtagtctggcgccgggcgtccctcgcccagcgtgactatctcccggccggtggcagattccggcatgaagcggcgcgacagcccagcctgcctctcgctcacgatccgggaaggcggcagcacgctaccatcgagcagagcggaaccccgtgccatggcgccggaggaagagaagattaagagcgagcgcgtgtggcgaaggtagggcacaggaaagaaggagttagggcgcaagcagcgaaggcaaggggaataatggcgaaaggaaggaaacagatcccttcctcagtgcctttatactcttgccaacgctgtgcccggctcctcgcttctcgcgcccactatttcgccccctcgtttctcgcgcccacgcttccactaatcccattcgcccgcttgcggcgcatgaggtggatatgcggttgtggcagtcgagatagatcatatcgtgcgcgcgttaattacgctcgccgaccgaagcgacgttaccatatctccagacgaaacgaatcgccatgtccagattcgtgtgctactcaagtaatgtggcagtcttgaagagaccgctcattgttgacagccgagttaccattgccgatgtgcgtggtttgtgaccgttgggtttctgcccaattgtggagaccggtcccacctgtcaccaggtcttaggagtggcgtcacgcccgaccgtttcccttaaagagggcgatcgccctggcataacgccgggggctactgtcggtgacatgggatcaggagtatcatgactagaggtttgaggcagacacaatcgcacacgtggcctggtacccccgagggacgtcgggcccgagggtgatgcgttcgccctcctcttagtccccccgagggggtcgggccgcacccccctcggccccgagggccgagcgccccgacccctcgtgggtttttgctccgcgtgtatgggtt

SEQ ID NO: 62671 - DNA, 4726 bp, Oryza sativa
ctggtcacctatttgttgcttcaccgggaagtcttttttgtggatgagggtgtcatgtcctgtcttcctgaggcctcctctttgcacgtattgggcccatgcttcatctatcgctagttgaattggggtccaatcatatgcgttcttatcaattctggagtttaggtagtgacatgtactccacttaggtgttatgaccagaaggatccaatgggcactgcggcattaatatagtgaaagttaattaagtactgaaggaatgtgtcatgctattgtgtatatttagataacacacttactattgattataggcgcacataatgtactccttgtctcggcgggaccacaaggtgtcgtagatgtagttgaccattccttgacggtcattctggagatttgtgacagtgaccacttgtggatcaaggaaggcaagttctggtgcattcttctgataccattgccaacttaacctacacacaggataaacgatcttgtaagcgagttaatccgattgttattaccagattgagttgggcgacaatacttacaaggagtagcacttaaggaggcttgtgtcaaccgctcggagcctgtagaggtcgaatagatccttgaagtcgacgacgatataatttgttggaccaaggaatggctttccatcgtgctctccaaggatattggtagctttattcggcttcctggcgttagatttctccatgtagtatgcgtgaaggtccttgcaagcggtgcccattgcggcaagcacgtcatctccaaccaatggcatgcctagttggaactcctgtggagtgacgtattttttcttgacctctttgcccttagtctcttcctggccctttcccagatctagcttccttggagctagaagcgaggactgcacctttcctccccttcctctcccctttgcttcgggtttatcgagagtaattctctgaggggaagagtgtgccttcctgctcttcttcatcggtgtgggttcatgaatcgccttgctgtcggcctccgttcggtcctccccaaaatccgtgtcgtactgcaattgcacatcgtaagattgtgcatgacgatcttgagcaggaggggctgaaggagcagaggcgggtctctttggtggacgaccgcctggtgcagtggttggcctcgctgtaatcttgatctcaatgaggtctttgggccattggatgaaggtaccacgggcatttcctagtgagaggacctcgtcattcggtggatactttagtgggaatagctcatattccggcttcatcgagtcgacttgaacttttgcacagtcacccctgagttgcgctccatgcactcttgtctctggggtcggcttgtacgcaagtccctcggctgctggaaccgtgaaggtcggcatcaccctaactgtgagggtgcagctcgttggttcctgcgatagattaatcaattcttttagaatattatatatcatatggactcgttaagtctttcatgcattgtggacgaaacttttaccgttatgtggtcgacggcgctgtcgaccgatgttggattttccgccacctcagttgatgcgcaactgctgcgtttttgggtgggacttcctaactcttcgtgcgcagcagcagtggcagcctgggggttctgttgctcttctcggatctcttgcctaatcttggccctcatcgactcgagcttttcgtcgaattcagatgtcagctcagctcttatcgacgcccggatcttggcttcaaggcgtgcatctttctccgccttgttggaagtccgcttcttgtactgccacgcgtagtctggaaatccatacttccagggaacagaagacccaacgccccgtgtccgtccacggtgttccttgttgcccaatgctttcgtgaggaggtcgtcctcacgtctttgagagcaggcctcttgcgaggcttgttgctcggcaactaactccttctgcattacaatttagtggggttaaataaactgcacgatgggaaacaatgcaaacatctagtttgactagacacttactatagcttcgtatactcgttgatcttctgcatttggcatgaagattgtgccatcatcattcttctagtacctggccctggcccagttcctagcccaagggtgtgggatatcaccaaacacgagcggtgtgcacgattcctccgcttcttcatcctcacgctgccattcctcttccttaccggcatatccggcggtgccaagccggtgcggatgctggtttctggtctggagcaagcgatatgcctcgcttctagctctggactcgggggtcgacttcttcgcatggaattcctcccagacctgttccgtgatccaaggaaatttctctcttggatctggattcgccgggttgtagacgaactcgccgactagcttagtcttgaagttcttccaagcattgcccataaccttgaaagcagcgcgcctgagacagtcctcatgctccgcaggataatcaaagctctccttgaacgttagccaaacaatgtccttctctacggccggcacgagcttgatgtcatcttgcagaatactgaatttctgcctccctatgaccccgcagatagacctaaatcggctcaatattttccttggagatgtcggcaaccctacggcgtccaccgctgttatgcggaaccgttccttagggattttgttccctgtcctaggagtacgtgcccttgaggacccactagttgtcgtcgacattggttcgccttgctgagacatcgtctacttttttctaaataacgaaaatacactattcagtgcttcaatggctaagaatccaaagttctaaaatctattagtcacataaataaactaaattgcacatctcacagtaataaaatgaattgaatgtcacataaaaataaattaaattgcacatctcacataaataaacctaatgtcacatcacatctccttctaaatttcactaagtcccaagaatcctaataatcctaataattccacatatcatcaagtcctaaaatcatacattcaccacatttcatctattcatccgaccacatttcatctattcatccgaccacatttcatatattcatctattcatccacatgggcggcgcgatggaggactaacctgagcacggtgagaatggccggtgtggcttggtagcgggctcggtggaggcggcgcctggctcggtggagggcgtcgccggtcggtggaggcggcgctaggctcggtgcatgcggcggggtcggtggaggcgccgggctcggtggaggcggcggggtcggtggagggtgtcgccggcgaaggatgacgatggcagcgaaggaggagttggcggcggcggcgccgggctcggtggagggtggcgccggtcggtggagacgccggtcgggcagggcggcgccgggcgggcagcgtcgggctcggtgggggtcagcgacgtgcgtcggtgaggacgcgggaggtgacgacgaggaaggccgacgccggtcggtgtagaggctcggtggcggcggcggtgggctcagtggcggcggtggtgggggtcgtcggtgaggaggcggcgtcggtccgaatggagggcgacggctgcgggctcggtggcgacggcggcgggctcggcgatggaggatgacggcggcgctagggttctaaggaggcaggaaattgtagcgggacttagaaaaattttcgatccgatctgagaaaccctagttatagtagagtgatgagtcatctcaatcgggctttgccatagggcccgtcacaaatgactcatctgtgatgggctccatactaatgcccgattgagatgacattcaggcccgtcacggatgactcatttgtgacgggccctaagataatgcccgatagagatagattaatctctatcgggcttaaactaaggcccgtcaccgatgactatttttctatttttcccatcaagtctttatatttgtgagtgcaaaatatatagctgctatataataattcaatttattagtcaaaatatattttcggatagtaaatgatttcaaatcgaaatatggtcaacaacaaaattgtagagcttattaagatctacaacttttattttagtcatttgtctatataactttgttcccaacagcttgaaattgattttgaaaatatgacaaatctaaacagcatttgtaaatacaaaatgatttcaaatcgggcgttagtatagagcccgttacctatgagtcatctgtgacgggccctacggcaaagcccgattgagatagattaatctctatcggccgtaaactaaaggcccgtcaccgatgacttatcaagatctacaagttttattttggtcatttttctatataacttttttcccaacatcttgaaattgaatttgaatatatgacaaatataaacaacatttgtaaatactaaatgatttcaaatggaaatatggtcaacaacaaagttgatcctctcatcaggatctacaacttttcttttggtcatttgtaataaaacaaaattagccatattaatgactacacatatcaagtctttgcaataaaacaataaaacaaaatacttcattcattacaatagataagtacaaatgcatcggtcacaaggttatgccttccgtatgatctgaacgagcatatgccacatgctcttggggatcatcgtcaaggtcaatgtgaggtct

SEQ ID NO: 62672 - DNA, 732 bp, Oryza sativa
ctgcagcccggcatccttggtcgggtaggaatttcatggttatttccagggattttggccctctttgtttaggcttaggcttattggcctagacttttaagtcagtttattgacttatatgatttataagccagtggatttaatgtcctaagtttagtggtggagtcatacatctatctcatataagccaaaaaaagcttctccaacctagcttttggcttaatagtgttagagtggcttatggcttcaaaaaagccaaatgaaaaagctgcttgtttgttttggcttaaactttttgacttataagttggcttataagcctaaacaaagagagcctttacatcaaggagctcatttttcatacaaatcaaggaaaaaaactcatgtgtaccaaaggaagcttatgtttgagttcaaattggtccaactacactgatggggttgaaagaggtcaaaggccctcaatggtttagctggctgcggctgttgctgttctgtagctgaagtaaccagcaatagagctctattgtggttgtgcagctgcaggtaggtaagttgagtactacccccaaacgaggaagcaacatagtagaagttagacggagatgataagtgaggacatctgcttagtagtgcccaactagtggtggatactaccaagcttggaggaaataaatctcgagttccttatgtttttaaacatagggaagagaaaggagaaataagacatct

SEQ ID NO: 62673 - DNA, 12788 bp, Oryza sativa
aattaattaatcttttaacttctggtcagcatgtatccatgtggagttgtcttcttccactgctaaacatttactgcctcttctcctgacttactccctccatcttaaaaaaacaatctaaatgatgacataatacaatatagtacaacgaatatgaatggtcctatccagatccgttgtaattagattatgtcacatcttcataattgagttttttggatgaataaagtatcaacttagaacagtttgccaaactacaatctcgcttcgccaccatcaaattcagggagctctttttcgtttcttcttgaaagagagggctccatgtctgtgagccataaactgttgcttcagacacaaacctgcacaatcttctccttctgaatcagctgttctctgaacaatcgatcatcaccaccagggctctcactcgacaagacaggatacagaaagaaagaacagtgctgctgctttccttttattggactgatccatccatgaatcgatcgagtcgggagaggtatgacgacgatgattacagacaattaacagtggggttttcggttcctctaccacctaatttaatctaccagctcaccaaccattattacaaccaattttgcatgcatgccacaaaaactgacatgaacaactcaagatacgaaccaaccaaacgcaaacaaaaccaacaccattgttttttgtactgctatgcatttctgggcttcttttgtttttcaccttcagtcgaacagctcccactgcgtcgttgcaggagcatcgaacgtctcccatttggtcgtcactatcacattctgcaaccgcgcgttggagatcttgagcacatccagcgtctccacgcatttctgcaccctcttcgcctgccaaaaaaagaaagaaaaaggtctcgttatctgatccatttctaggactaatatgcattgtgttggtgtaatttaagattgttttcttgtcatctgtaattattatttgcacttggttgtaataagaggatcgtgactgtagcttttgttgaggtaaaggtcggattatcaattattgaaaaaaatggaaaggaaaacagtgtgtagatagtacttggaatgtaagtaactgttcatgagtgggtcacatcatttccaaagaaaaagttaatggccttttccattctaatcttgaggtggcatcaggagatcatcacaggtaatgataaaagcattttctctttttactctctaacaaacaagaacacccaggatgcctgcacttttggtctccgtctactcttgttgtgacctaaccagaaatgggcaatcttttgcatcttgatctttcttttcttgtcatctactctttgcacaacaaaagcacacaactttcctcaaacttggtacaagttcagttgcttaagggctcagctcacactaaagagcgatctagatgcaaatagctggcatcacctaacattttcagcaggaaaagggcttctaggtagaatttcttgtgtgcttttttccttttatttttatgctgaaaaggcaggataagcattcttgtgtgcctggaccatgtgttttccagaaagaagctaatgatcctgtgactgtttcggggggcaagtaggacactcacccacccatgataggtgacacagacagctacagctccttctcatgaaaacttgtactgattgtcatgccactgcttgctacaatcctactcaggtaaaccgacagccccaagaacgctcaagccggtgagaatctaaaaagactaggttctttttatcttcagtcttctaatttatatcctagattctataactacaaattcttagaatctattacgagaatctaaactgtttggggagctggagatttcaaggagaagcgatagttgtcagaagctactctaaatgtaaccatagcatctctcattggtaccaatggtactgtaccaaaaacctataatgatgttcttgattctaatgcccaatgctaggctctttgcaaacaggagatgatgcaggtgctcacctgaatgttcttctgggaagacgagtccccttcagcgtgtatgctgtccagcttcacagcaagccgcatcagcagctcgatcagcgtcgtgatctgcacctcggcgaccttgctcccacgggtgatcgacttctcgatgctccttacctggtacaagaaaagaaaaggaaacatttttctcgtctaatcagcatcagcatcaggatcagatcatatcatatcacttctgccaaaatgagtctttcagaaactaaagctgagtgaactctgctttagtacagccaatgatggaagtgccctgagatgcaggggcacatccttgtcagggattgaatttctgtccctgctttggtatggcccggtttatgcaacatactaaatgaactcagggaccattgccttgtgcaatggatgaagaaatttcaccgctgcttcttcatggccagaatcgatggacaaccgtgcaatgtagtatcaatttggtcacctaatttcttggacggattactcaactggccatccaattcaatgcaccatgccaccattcccctccccatgcctgcctgtctgaaccagcacagattcagaccataactagccccctaaatcgttcaagcttcatctatctatcctactacctccattccaaaatagtataaacatttcaacaacgtgttgtgtttttgaaaatgtatctcaacatgcgaaaatacttacattttagaatatggtgataaccgatgcattgaccatggaagaagaacagaagaaacaaagaaagaaagaaagaaagaagcagggtttgttttaagtttggtcacctgatcggcgagcttgtcgacctccaaggcgatggcgccaatggcgcggttggcggtctcgatcttggcgctcttctggcgctcgatgtagcgccgctcgacgctggtcgggtcctcggcgaggtagagcttggacctgttcttgacgccgcagacgtcgaggtagtcggcgttgccccgctccttgcccctgtacgtcagccgctggtccgccgccggcagcccggtcctcgccgccagcagcttcttcagctcgcctgccacaacaccaaagaacagctgattattcttctgaaattcttcctacatgctcttgggacatggtggattggatcattgctgcagctactggtcaccaacatttgccaacgttattgaaaccgcgtgtgaatctgtgatcaatacactgacatggtaatggtggtagctctgtactttctttgcctggctggtgatgtttgacagtgatgaggttttctgtggcacgtttggccatttggggaccagatatcagtggtcaactctaccgttctgagatcgtgaaaaaatattttaaaaaaaaaagagttcctccattattttttatgctccagcctccaggtaaagttaccaactaaatcacaaaaaaaaaaaactaaattcctatcatatttccgatgctacaccgtgtcatatttcttttcacgtggtgaagcaaatactataatataacaagacatcgccaattaaggctaaagctagccttattaattgggtcaacaaacctcgacaaaattccaatatcatctagtaaaacattgtttcaatttaaggtttacttcttagctgactttaccctgatcacgaccaaaaccacccgaaccttataaaaaactcaccgcgcgatataaaatgcgagatgaggcgagaagaagagccaacaacgtggtgcgcacgacgggcgacccgtagcgatttccacatctcgctgcagtagacaaacagtgagcgccggagacgaagcactcaacttcacacttcccagaggtgtcggtgcaacgggacaaacgatcgcaacgtgcccctgcctccactccaggctgcccctgggccgtccgattcggccgcccgtacacgtggacccatctgcggcgccagaaactagagagagggagatccaccgtatccaacccaagccccccacccccccccccccccaattgctgccattgtcggggaaaggcaagcttaattcaggcagcatctgctccggcaaagtggaagcaaagcaaagcaaagcagagaacagttcaaagagctcactgatcgggtgattaattttgttaattacttcattagcctcgtaatctgcattcgcctgtacttccccgtcgcattgaaccgcccaatgccgggatttcacggaaggaatagcagtgctatggctcgagaaatgaagtcgtgtcagtaatttttttctctgtcgctaatccagagcacgggttttcgaagttaacgcagcaactgtgacagtaaaattactagcaaaaaattgttttatttcggggtattttcaggaggaaaagcggtcaaaatttaaattacgagatggccgcacaagacagaatgattctgaagccgggaatttcgcgctgcacggagcaaagaaatctcggcgcctcacgggctcgtacgaaattattccgtggattttgtttctttcctttttaaaaaagagggggaaaaaataaaggggatgtctcactgtcctaatatcgcggcggcattaattcctccacgcggcacggccggaactcatggtgaattttaaataccacctttgtatttaaatttgatatacttaactcagtttttttttattttaactggctcgtagtacaagccacgattgccagccagcacgggttttaaagctaagtgactcgaggtcaaattttgacccaaaaataaaacaaatttatgccggctatgttaaaataaacattcgcgcgggatttaaaccgaaataaaacagagctgcttttgcttaacttgctgggtttactttccggagaaagaaaaagaaaacatgagtgctgcagtgcaggataatctaaaaaaatgaaattaaagaaaaaaaaactaatcaaaatttcagtttcgtctcgtctatggaggaaagaacaccatcaagaacaaaaagaagaaaaaaagtttaaggcgtaattaagcacggttacttaaccaaagctcacactttaaccaaaggtgagaagaaagcgagaggatcgagagagagagaaatcgctcactcaccgaaggaggcaatggaggagacggcgacctcgtgccgcgcggcgccgtacttgacccgcaccttgatctccggcggcggcggcctcggcgggatccccatccctcctcctccgccgccgccaccgccggggccctcctcgcgcgcctgcacgaccatcccgctcgggcgcacctcccacccggccctctcgtccccggccgccgacgccgccgccgcctccgaccacccgctgctcgacccgccatccgagctcgaccggtgcatcaccgccgccatggacgacgacaccacaaaccccacccctctctcctcctcgccaacaagaacacaaccacttagtgcggggggtttggtgcagtagtgcgcgcgcgcgcgaggtggtggtggtggtggcgtgagggaggaggcggaggctgcacgcgcgtgcgcgcgctcgcggcggaggaggaggaggggaggagtgggacgcgacgcgcttcgttcgttcgttctccgatcgatcgctttgtctttggctttctttttcttcttcttcttctctcttgggtttgccggttttatatggagacgaggcgatggattggttgtatttggtggggttttctttcggcggatgtacgctgcagccaccgggcgcgcggccccgtggcgggagagaacatggtcgcgttgccgtatttgcttccggggatgggcgccggtctacgtaaaacctcatggtttttgccgtatcactttttattcgggtcagttccgcaggttaagtggtgctatgttatctgtatatttgtttactctgaaaaaataattagtcaaaaattgtttttccacatcgcaggtttcttctaaggacttatttttaggtcagtttcgtaggtgtaatggtgctatattatctgtatatatatttactctggaaaaataattagccaaaaatttaaactattcgtatcaagtctaaataatctaaccatgttaaaactacactcgtatgtaattattatatgcgcgaataaccggttaaactacgctcatatctttatatctttctatacatttgaaaaataattagctaaaaatataattgttcgtgtttaaaaaacctatcaagttaaactaatcacatatataaattttacatgtgtgttatttaatagtgctaagttggattcgatttaatttatcaatttctttctgacgcatatcggacgaattgatggtgtatgatactaagaacgtggactgccatgaggctaggcggtgtcgtgtactttttgtattgtgtattattttaagtcggtgagctcatttggcgcattcaacgtaatcggtctaggtcacggctaacacacggtggatgacatgttagtaagacggatttttggcttcacacgttgacgtagcaagatatatatagaccaattcatcttcaaccatattcgagaatcgatatggaatcttttgagttagatgtatgtcaatgtatccatttactttttccatcatctagaagaaacgtattcattttctttagaacgtatatattttgtctctttataatactttttttacacgtagcgtggttaaagtattttagattatacaactgagcgtagcttagttagttaggttccttgtagtcgaaactaactttttaattttgacttctaaacttggtgtgggtgcttgtatttacggttaactattgtttgagtggtacgtgttatatatacccgtcgatagcaaggtgtctatcgtaactttgtcgatctctctctctcactgttacaacagctaccagctgctgggtgatcacactgatcactgcgctaaccagtaaccactgtttaatgatgccagcttgcttgcatctgcaggaacctggatgcacatgagatagtgtacagtagtattattattgtatgactatgcatctgtaagtgtacgtacgtagatcgtaattaataccgagaagcttatatagctagcttgctagctaaactaaacaaggcagtgatttgtactagaactgtagatcaatcagcagctgggattaactaggatggttaattcgattatattgctcgcatacatgagtggtccatgcaaaagagagggattaatttctcccgggtcactccctcgagcttaattgcgcgatgtgacacctgccggtaacgtcatgtgacgcttaacgacatgcgtcgtcgtcccaatcgaaggcgccgtacatcttgtctcgcctcgatcgatcgaatatatcggctcttcatcagcttaaggatatgaacaatgtatttactgctactgtcttaagctcaaggagtattaattgttcactagcttgggcgcttggcaacaaaatgatagctagggacttcatcgatcacactgctagctaccattctgcagctacaaaaaacggccttgatcaaggccaaattaagctttgtggatatggactgcatggatgcaggcaaatagcagtggcccttgcctgacaacgcatatatgacaatgctgtgcccatttgtccattagcttagctgacagtctgaaacttcaggctcggtttcttccagttgctgtcatcctgcctgttagagaagtacgtaatgtatgcatctggcataatgcttggagaagtacgtaatgtatgcatgccccctgtttagaaaggaacagagtcattccgaagaagaagaagaagaagaaaggaacagagagagacgaggtgactgttgctgttggccacaccacactggctgactccgctgactgacactcctaccttacatgggctcacttcctgtcggcccatttactctggcctactccgagctgtacgtgggctgctgcaacagtcactctgggccggcctggaacaatcatgtcaaacaacaagttcgaaccaaagcgtctctttctctgcgttcgacttcgaccgatgttttcttttcttttctcctttcttgcgaggacgcgttaactgttttttttctctctttcttcttttttctttcttgcggtggacgtgttaaaatgttttgacgtcatgggagtacgtgcgtgcaagctccatcatttaatcttcggctgataagccgtagctaaaattaaaattttaaaacttaacttcataggctgtttttaatgttttgttattttattttactttttcattagctttaatttgagatgatatacatataaaagtttcaacataaattatttgttatcgttgataagcgttgtcgcttataaagttataatcagcgtgatgtataccgggtccaatggctctactacggacagagatcctcggtagtactgcacctgcaatgctgccgctaagtcctacatgttagcggcagctactaggtggcagttgtgcaaacaatccccactaccccgatgtcgtcctaagtcgcttacggatcacgataatataatgtctcgtattttcggtgttcaatgacttctattagtgcttatgtttgcccaatctttgaaaatctttggatcccgtcatcccacagctgattgtgagactgtttggtacagctctaactcctaaatttagcttcaggagttgggtctggagtgagctgtctaaacccagctccacaactctagttcattttgtgagagagctccacccagctccactcccagttttggtaaagctgaaactgtttggctgagctccagctctagaaagagtgaaactggagctggagctgtgctaaacagaccctgaatgtcttctcgctcttttcctgattggtgtcattgttcagtttttaccgtctgttggtcatgtgttgtcggtgaccgactattgctaccgctgtactgtccggcaaccggtacattgtgcaggaccgcatgatcgatcaccgacaaccttcatctctttagtcattaatcgctctaacccccatcattctacgaccccatttaatccccaaatcagagatgcaacatagcaacagtaaccagatcacatgcatgcaacaccaacctgcagcctgcactcgctgcagcagggaccgcatgcagaagccgcttgattctgccactgtagtccagctctgcagcttcatttctctcgtcggtttcctgattatttgtgacagaagaagccatagcacagcttgatacagtcactctgactcactgccatgctgttccagggctggaagttcagtgcaacttcctgtctcattcagcctgtgaaaatgttctgatgaacaaaaatcaggaattcaggattcaggtactttcttgagacatcaacaaaatcctgaattttctgatgcagtagcaaagcctaaagattacacgtctcacagtgtcacacactacatgccatagcattatttatgttacagaggggtgctgataattgtgttctccaatggtccatggcacgcacactcactcacacacacactgacagagaggaaagaatcatcaaactaggagcaaccgaggtaattaaaacggaaattaccaccctaatggtgctggtaattaatcatcaacggccctctgataggcgggcccacccaacgccgacgagccgaggcgtcggctcacggcgagccgagccggacctccgactcgcgccgcgcggcgcgcctggcgcgcaccacgtacgccacggcgaccgcgacgccgaccaccgccaccgccgcgacggcgcacgccacgccggcggccacggacacggatctgcgaggcggcgccgacgacgccgacgcggtgatggtggcggtggctctggggatcgccgacgcggcctccggcttggcggtggcggcggcggcattggaggcgtcgagcgcctccgggagctcggcggcctcgggcttgctgccgaagaaggaagccatcgccggcgtcgcctcggtgttcccctcgcggaagtcctcgaggccgtgggactccgatccgacggcgaagagcgccacgacgcagagcgcgaccagcagcgggcggccgagatctcgccggcgggacgccatttgcttcagcctccaagctgcaaacgcagttgaccagcgtaattagcaaaccgctactacaatctcaagctgatttgagcagaagctaacgtgcaataattctgcactacacaaaagcactctttcttcctcgttgagatctactccaagattcagatttttttttgctcaaattcagagcgattatgtgaattgtcccaggagagcagatgataagacaaaacgagctcaaaagggaggaaaaagaaagaaaacaaaaggtccaatccacagatctaagtaccaaaagaagctgttctttttgcagtgcagcaagctaatgaacccaattgcacaaagcaaaaaattcatggtggataaagattcgttttgttttctcctttgcgtgtgacacatacctttgcaatgcaacctaggatagcctaatgtgtgcgagggagagagagaaagcagatcagagagcttgttcttcctcggcagaagccacttgaaggttcagaggagcacaccctgatatatatatatatatatatatatcaaagattcctcctgttatcctctccctctaattgctgtgagcctgtgagtatatatggctggagagagacgcaatgtgcatgagagagaagcagataaccaaaccactcgtgaggatctatctactatctatctagctagtaagtatcctgtggcagtagggctcactgtttcatgcgtggtggagtgaaagctaagcgaggctgagagcattgtttgccatgatgccgccatgcttttttgcttggggccttgtggaaaagaaaacgaagaacacagtgcgtgagagcaagagacagagacccacattaggtgggcatgtgagccttttactaacctttgtctgcttgcttcgatctacttactgactaacactgctgtatgcctgtatttcgcccgtgtgaagatgctgtacacatgtactcttctctcatgttgtgccaatttgtgatgtactctccagctctctgcttatcatcggctcataagtatcgacaattacgtacgtatctacgtcagtttaaactgataagggaagacggacaattcactcacgctttgaaccgtaaaagcgtaattcacggacaatggcaatcaggtgagagcggcgtgcatgggaagagaagcagctcatctctcgtctatcttctgattgattagatcatgcgtcgtgagtcgcctcttcttttggctgggcatcatcatcgatcacgctttcttggcgtttggcagtccaatcacggagctcatcaattccctgctttgttgagatctgcactcactctctgctgcatctccatatgcctccggatttgcagtgcattgtacgtcagttggatcaatcgacaaaggaaaagatgaaaattataagattgtgacaaattttcgagtactggagtacgtactggtagcacatgcatgcttgggtagtcgtagctcgttaaactagcgtttaattaattagttttagctagccaagatctcggagttgatgatgaatggaggaggacatggagacagataaaagttggtgcccctcctactaattaaccaaattaaagcacattgctagtgatagctttgcttttagtagtagttggagtggtaacaatattggattggcatggtgaggcagggaatctaacttgtaatccctccgtcataaaaaaaaaagcaaaccgtggattcccgtgctaacgtttgactgtccgtcttatatgaaatttttttataattagtatttttattgttgttagatgataaaacatgattaatactttatgcgtgacttatctttttatttttttttataattttttcaaataaaaccgacggtcaaacattgaacacgaaaactagggtttgtcttttttttgacggagggagtagggttcttgctgccctggtccattgccactgccagaagaaagaaatggcacaaaatggtggccttcgacagatgtcagcaagttcatcggttggttgcattgcccctgcatgggactgacgattagttggcaccttttgtacactcctacctaaccccaataaaaccataaaggtactactcatcatatggcaatatggcatgatgaatcaagatcaggacaggcaggttagttacagtggctttggtaattaactgtactgactgcccttggatatggtgattgaactgttactaattactgcaatggtaacaccatctgcaacaatgtgctactaccagctatacatattactcctatgtaatatgtagctacgacatggagggaaattgcatgaatggttgatctgcattagttggataatcaatcaaactacgttcaccagaggtcgatctactgaaagtctgaagaatagacatgaggtttctgctaattcatcttcttctccagtgcgatcgatctaccgtggcaatggcttctggtcaccgagagtggatgaacagttgtccagggctgtgccgtgcatgttcttttggtgatgagacaagtcctcctgtctgtacgggaatctggggaagatcgtcgatcaggtaacgtcaaaactgtccgtcctggtgtgc

SEQ ID NO: 62674 - DNA, 5941 bp, Oryza sativa
acgccctgggtgcgccgccgctaggaaaggagggaagagggagcaagggaagagaggctgaggataaggataagacatacggttgagaggaggaatgtgtttttttagcgcctgagatttattttttatagcgactggctacgagaaccgctcttaggctcttagccatccgccagtaaaaatcgtgttatttttacaagtggcccttttaagatgatcgcttgtaaaagtaaattttcacaagcggtttctaatcagggacctctgattgccctttttacaagagtttcttattttgtccgccaaaagaaaataaggtggagccaggaataatcattttttagtagtgccacaagccaccctcgaccacggagcttcatcttccacactgccgagctccggcgaacgacggtggccggccgcctctgtctccaccatgaccgtctccacgcacctcgcgagcttgcccgtctcgagcaccctgtcggcgccggtgacggcacacacgctgacgccccaccatgcgttcctttcggatggggaactataaaggcgttactatatatttgtattcctttcggatgcagaccctctttagtgctcatgatatagtagcagtagttcaggtgtacgtcttatggtctcagtgtctgttattatactaatggtactgtagataattctcattgattcctttatagtgcccacaacattcatatcactttttaagtgcccacagcattcatctcactgataaactaaataccttcatatcatccagagatctatcaacctccattacgtactcggagccagaaagctaacaagggttcaactgcagccaagttcctgaggcattagctgcgtacttgcatagatagatgtcactgtaggttcccaattatgtgtgagcgtggctatcatggattaatgacatgtctacgccctgaaatgagcaccccaagtctacaagagcaagtttaatactcctacgagggaattaatgggatcccacaccataacaagaaatccatgtccttgtgcatgcaactgcaaattaaaccaatactacaatgaacaacggtgttgctgctaacaaacaacactcaatgccaaattgccaatagtgatgtgatcatgtgaaatacaaaacttgtccatgcaattgcaaaccaatactacattaatgaacaacactgttgcctgtatagcaagcaacactcaatgccaaattgccaatggtgatgtgatcatgtgaaagacaaagtgacaaacccgggatcccattgattccctcataggagtattaaacttgctctttgagacttggagtgttcacttcagagtgtagacctgtcactaaggatatggattttttttttcacctaggtgcaatcccacctaatcatttacatgtgacttgaatagatatggaaaaatatgaaagaaaaaaatgatagtattgttcacaatggcacaagtctatacacaatcgagcaagcctaaaatcaatatataatcagaaaaacaaaaataataaaattagactgtaaacagtacctatctagcacaaatagaacttgttattttctcgatgtgcatgtttgcatagtggtttatatcatctttatctaccttgtcaaattttatgaaatatttatttaattacataggtgacatagatacactatgttggattgcatctacatgtaaaaaaaatacttttcccgcatgcacaacgacaaccctcctgtgtgcacgttacgcggaggttgtaaattatttccattttcacgtcaaaggattaattttttaggttaatttgatcgatgccattgtgacttaatcaatttaaaaaaatattattattattcacgatattaataggatatgctactaacattttacaaaattaaaaccatatatcgtcgtcacgtacttttacctttttttaattcacttgaaatgacacgccaaccttagccattttgacacttagccagacatcatcatcatccctgacgaacggtgaattggattatctacgcaacatttgcaattcggtccaagaaagccttcaaattacgatccgacgagccgccctcggcgacggcctcccgcaccttcgccttccacgccaccgagctccggcgcacggcggcagccgcctccgtgtccgccatgaccgtctccacgcacctcgcgagctcgcccgcctcgaccaccctgtcggcgccggtggcggcgcgcacgccgacgccccacccggcgacgagccgcgcgttcgtgtcctggtccgaccactgcggcaccgccaccatcggcgcgccgcacgccacggcctccagcgtcgagttccacccgcagtgcgtcacgaagcacccgacggcgccgtgcgacagcacgcgcacctggtcgcaccactccaccaccatgccgccgccgtcgccgtcgccgtcgccgtcgtccctgtcgtcgctgcgcaccacccacaggtacggccgcgcggtggcggcgaggcctcgccggagctcctccttctgccgcctgctcaccaccgacatgctcccgaacgacacgtacaccaccgaccccgccggcttcgcgtcgagccactccatgtagcccttctcgtcgtgcctgtacaggtcgtgcgacgctctggcggcggcggctgcgccgccgccgtcgagcgaggtggcggccgggccgatgggtaggatgtcaaggtcagggaaggaggcggcgaggacgtcgagctctagttcctcgacggtgttgacgagcaccatcggcggcttgctgctgctccggcgatcgatgtccagctgctcgatcgtcgtccggacgccgtggaacgcggcggcgagcctggtgtcggcgaggtcggtgaagaagctggggaggtcgcggatcgccatcggcgggaggctcggcatgtccaccgtgaactccggctcgccggcgtgctccgtcacgagctcctcgagcccgtggaggtagtggtagtacacggcgagcatggtcgccggctggatccagtagagcacccgcgggatgccgcgctcgcgcgcgacgtcggccgcccaccacatcaggaacgcgtacacgacgcacgtcgcggggcggccgcgcgcggcgaggcggtccaccacgccggcgaacgcctcgcggccgacgcgcccgaacgtctccgagtgccgccacgccgcctcgccgtcgctggcgaacagccggaacccttcgtcgtagccgtcggagtacgggacgtaggagatcccgccgccgccggcgtcggcgtcgtggacctcctcgtcgggggcggcgagggacgggaacatgcgccggtgcgccgacacggcgacggacagggtgacgtgcgcgccggtggcgcgggcgaggcgcgcggcgagggctcgggccgggttgatgtggccctggccagggtacgcgacgacgaggaagtgctggcgcgccatggccggagttggggtagcttgtgttcgcgacaaagacaagctttgggtgttgagagatgtagcctgcattgcctgccagtatatatggctgttcttttacacctaagtggccaagtgtatgcgtgtaaatgtgtgataagtagttgtgaaaaaattgataagatttaacaagatatatcatgatgattaaatcactctgtaaacatataaatctaaattcgatctatctcttctctgctattataaaaattgaagatgtttttgccgatactttggtacatcatccatccgtgtatgagtcagtttttaagtttattcgcttttgaaaatatagaaggaatcgtataagaaatctctttaagaaaaactcacatgctaatcggactcctaattgcagctcatgactttctaacgaaaaatatatccaagcgaatttaacaaagtgaatttcaccttaattaaccaatataacaataataagattaaaataatattctccaattgcaacgcacgagcatttttttctagtagataaataaaataaaaatagcaatcctatttacggtccgagtttattaattttatctatataattatcgaatgaatttacataaaaatagcaaatcctatttacggtccgagtttattattttggtctatataattatagattgaatttactctcatatatttttatcgacttatatcatcctaataattattaccaatttattttcattttttctataggtatttaagttatgcaaatgactggtgcgaatgcactagacactagtgtagtaaaaaaccttgtccatgtggctgcatggtgcatgttactagtactagccagtagtataaaaagtcacacctcgtgatcataaaacacgtggttttagatatttagatggttttcgaactacaactttatcgttaatttctattgcaaattacttttagaaactcggctagtattatatatgaaagtagtattattttgaaataaatttaaatgcacgattttccacactccaatcagatttatgtttcttcttcttgtttgaaaggaaggacatctaaaccaatatgtttttaaccagacaccataacattcaagatctttatgtaacaacagtaggtttgatgatctatgagtggggtaaccaattcttgaaataaatttaaatgtacgaattttcatacatccaatccaatttatgtctcatgtaaaagaaatgacgtataaaccaagatattgatgtaattgtaacttaaaattcaagttttttaatataatggaattacattacattttttggaaatattcaacatattggtgcaataataatacaaggtttgatgatctgtgagtgggcctcgttaatttaagagcactcttagtttgttgtgtgcttgcatgtcatacttttaaagttacgtcggtattatgaatttgtgatgcatccaatgtgttgcatttaattttattcttccagtgaggctagtatttatcaagctggcacctgtaccttaaacatctgtctgagcaaccacccataccccacgttgtctctggaggcaacacgagcaaaacccacaaacgccaccccccatctcttctccttctttctgaccacttcccgcttcaccattatccaagcgagccaatgaaaatccgtgcagccatagtgaagacaacggcaaggcttctctaagccgagttgggtggccaccacaacccttaagctggaagagggtgcgggtcgtatgtggctagatctgacatcgacgcacccgattcatcgcactcatggtcgaatccatcaccccggcatcggggttgagagcggcaatgatgaggcagcaggatgtagagtgggtagccttggaggcgaggcagtggaatatggacatggaaatgaggcgaacatcttggaggctcaaaggcaatgtgcgaccagtggcaaggcgaggaggcgatggggtgatgctgcaccctctagacccttggtgagatgttggatggtgcactctcttccgtagctagcgtgacagaagggttggtggaggaggcggggctgacgacgccgtgcactagatcaatgttgaggaagggtgggtgtgcctatccccttggaagatctagctaaaatgatttcttttggtggtaggcctaagatgctgtcagtgtgatgcatttgcaacactagcatgtggaggcaggaggggggttgttggtacaatggtgtttacgtgctaatggtgggaggctggttgtggagcttggagcagcagaacatcagggtggccgacatgtgaaaatctagaacggtcttgttggggcgacaatgatgatgcctttgggagtcattttccgtcttgggagcattgtcaagacacctctcccttcctaacaggacatcatgatgaaatacttggagtctcctagagaccaggaggga

SEQ ID NO: 62675 - DNA, 30719 bp, Oryza sativa
agagggatctttttttgctcccaccctctcggtgttgggtggtatggttgtagctccttatgctagcggcggctggtcacgtacgcttagctattaccggtctagcgctagtcctttcctcagctgtgtgtgcaggcgacgtcggtgtgtggtggtggtggtgtatctatttttgtttttccaaatacaactttttagggttttagagttgtcatttttttcgctctattgaatgaaacatctgttgcctgttaaaaaagacaaaatttgctatatgacaccgcgatttcgcgattttacctgttggacatagaaaaatcaatctttggggaaatacattatcaaaatatggtaatttactgctagacatcatacctattaaaatattaatttctagttaataaaatagaagagagaaacaacgtgaaagtaaaaaaatacaactagacccacttgtcatattgtttctcttccactctagtgccagcagtggtaccttttttttacctttaaccatttcttcgtttcggaatttttctaatcatatataggatgtagtcttgctcgatcaggaccctagctttattgcgagccaaaacggctgcgctattctgtctttattaaccacttggctcagcaatatcacaagccacccagccatttacaaactctgggagggggtccaaccatatagcagattgacccaggtcccagctccttcccacttgggctaaattatgagcacacaaattacaaagatctagaaataaaagagatatcaaccctgaaaactctaactggggccgtgtttagttgcaaagtttttctttaaactttcaacttttccaccacatcaaaacttttctacacacataaacttcaaacttttccgtcacatcgttctaatttcttccaaacttccaattttagcatgaactaaacatacctagatgagaagcttttatttctcggaaaatagggttgcccgttgcttgatcatagtcctgactcctgctttttcagcgccgtgaccagcaatgccgaatcggattcaattccaatatcaactataagggctggtagtactggcacagcgaggcatgcatggttcagcttcggcacacaatgcatcatgtactggttccattcgtcctgtcccagcaaagcatacagcatccactatgatcacgtcccacaaaaccccatcctccaactttcgttgcttccaacttcctggtaggaatcatcaaagtttaagcttcaggttcccctccgaaggttgtgacgagcttacagtctcatctttttcgcttatatttatacttatcagccaaaatttaaatttttaaccttgaatttgaagttgattttgggattttttttcatcgaagtttattttaatttcagtttttgcttttaaatcattattaagaacatgtatataaaaattttattcataaattatttctcgtttgcaaatatgatatttgtcttatttccaaataaacaaaacgatgggaccttaatctccctcaccattgatttagttcgatgtaccatgtgctcagatttgtaattacaacactgcatgtgttaatataaaagaaacaattcggagtcggttaggtgaaaactggtacaggttaattcaaatgcgaggccacgtcggcatcatgggtgggcgggcgtcctcgccagtcgccactgaagaccgaacgcgtgcagcgggcggagagatgagatattagagactaggatttggatcaggtgcagtttcatcgtcggatacatatcgaacggcctggatcgagcagctactgtagcgcaggatactgttcacatagctactgtagctttagatttggaccgttgattataaaaatggacgctccacgttgtgtgcagttgctaacgttgtgactgcacctgatcccaattctagagactattcagttcacaggattttcaaatcacagaaatagaaaaaacgtaggaataatgtaggaatgcacgtacaaaacaaaggattggaacacatgaatttttcctacatttagctaaacaaaagaggatggagtgaatgtttttattcctatggaattagtacatttggaggatttgtggaggattggcatagtgttcctatgaaaaattttcctttgaatcctagaaaccgaatgaatgaatagtgcttattccaaaggaattgagtttcctttaggaatccttcaaaacgaatatgccaagtgggtttagggatttttttttggtctttcatgtcatttttctctcctatttaactagtaggaattaatattttaatatatgttgtgtccactgtcaattgtattccccagggatcactttttccatgcccgttggaatgttggatcatcaatatccaatgtccagttgatatactactccggccctgtttgaattgaggaatattttttaaccctccctcaaatagcctaaacagcctaaaaagatctaaaagggtgagctattttagggctatttggaaataacccacccaaaaaaactatcccacccaagatgtgctaattggggttatttcagatgaggcccactgaaaaaagtgtttttttctctctatctctctccatgtgaaggtacattaaaggttaaaaagctcttaaaataacccttggatccaaacaacttagaactatatctatgtacttaaaaaatagctttcaaaataactcttggttagttctccaaacagaacctccgtcccatagaaagataactctagctataaatctggacacatttcataaaaactaatcatagctacgatttataggacggaggggtggatgatatgtgcattcaataggtagaggacaaaaaattgatatagatggaacaaaagttggcctgagatatgatatgctcattttggcatggctctggcctgtagatttttgtttaaaaaagactttataaaattaaagttgcttgattctcttattttaatctatggataaaatgtctcacgtaacaaccttaatctaacggtagctctaacttcaagattttttttagtagactatgtacatctgatgattaatatggatattttttattaagaaacagtctattttactccatgaaatatttcatcggatctaaatgatctatggactcattttaaaccctaaattattaaaaatgattcactttacccgagccacattgaaatagcgaggaggaagataaggcctagtcgcggacatcaactcgtggagacgtaatcggtggatcttagtcggcgtgttagctgttagaacatctaacctgcttcccattataattaatgtgatacttttcaaatatacacatataaactggagtaagttattactcgaacctaaaccagtataagaatctttctctttgtctccttacaacaattttgcgtatatcttggtgccgatgattccatactctacaaatatcgttgtcggatataacccgtcgccttaaacaataggaaaaaataagaaaaatattaaaaggtactcatgcaggtgtcgatgctacaaactttcaatgcaaaataccacttatatatagagaaacaaaaatgagaaagtgttaggaagtaaagtgaaccctttttaatgcttttggatggagggttaatgtttcccgataaatagatcagagaagtaaaatggaccatttttttcattaagacataagtatacgaattgaagtagcctagcgttttcagtccggcacttatggtccatgtgaaaaaataaatataccccgcgtggagggggctggttatgatttgttaaaaattgttgttgttcactcaataagtaaaataaatagtccctcctttttgcttgcagttaaatatagaccatgatacttaaaaaattaatttatgaataaaacttttatacaacgatttaaaagctaatataaaaaataaattatgataaaaatttaaaatcaacttaaaattaagatttaaaaatttcaattttggtttagatgaataagctgaaaaacaaacggtagaagtctactaacagatgttttttaacgaacagcactagatagtgttgttcattgaatagagtaggaaaatattacaagactagcactcaagaaaacaatagccaggaacgaaaaaagaaaacatcaccatcacgcactgacagcgcctacacacaacccaggagaggctagcaccgggccagccgtcactaagcatgaccgaccgccgctagaccaacaacgaagttatagtcggtccgcccaaaaccaaaccctaacagacaagcaccacactcaactctatccacgcctttgggattgaaggagagagggtgagagagaagaatagaaccgctatcccccacaagacccgccaacatggtcaatttgcaaaagctagggtgccgctgcaagaggacgaacatctagagagatcacacacaagttatcggagagacgttttgactagggggcctcctagatgatgtctctagggagaaaagcgacgataagtaccaccaccgccgttcgtcgaggtctcaaagagaactaggagaactttctgctcgacagccccactagaggaagagggacaactcgacaacgcccccagaaggccggagaacgacactcggaatgtcgtcgttgacggtccagcaaggccgggctaggttttcacctactgcccatcccctgtcatccgaagctatcactccatcgctccaccacccgtcatccttcgatagtgcgtggacactattgaaccgacccccctgctggccaacctccgcatgcctatgttccatacccaccatcaccggcttccctgctgccacgacgctagcctccctgccgtcgccgcgttgacctcccacgctgtcggtcgggccgacatcccttccgtcgcccacaccaacctctaggcaccaaccgtgttggcctctcgcagctatcactgactctcccacggccgctaccgctgtcgtgtttctaccgcgccgctcggccatatctgtcgcagggttccgcaggatcgctcaccgcaccggccacccgccaccgtcggtcatgcctcctcctcgcgctcaccgaccgctcctttgcagcctcccggcgaagacgccgctgggacgtcgaagccggctgaggggggtggatccggccgccttgccccgatcccctctgcctcgagccgcctcatgctacctccacttccatcgtcgacaagtccacaccggtgaccgagttctgaacccgggctagaggcattagatctggccggccccaccgttgttgagctcgcctgggagaagtgaggatgtgggagcaaccgcctcgtagcctgtgcgtatctgccaccgcaccgccatgacagcctcgccgcacgccgccatcttgctcagccttacaatgcgcatgcgccaccgcaccgtctctctcgcacaagggatagctcgccaacgagaaaagacctcaccacgactatcatggctcaccgcgcggttgtccagcgacttactccgacaacggcgaggtggatggccgagggaggggtgccgcagcgacagctagggtttttttagccccaagccacccgcgcggggaacaactcgtgggagcgtggaaaggttcgcccataggccctgctgacaaatttacttgacttactgtttcttcttattttctagtcatccaaccttcaacaataaaatctacttcctccgtcccaaaatataagtatttttgactatgacacggtctccgagatgctattttaaccaacaatatctataaaagtaagatattttaaataaaacgagttgcatattatgatagtttatttaatgataaatctagcaacatcaattttacatgattgatattttttatatttttgctattaatagttaaagtttaaaatgtttgacttgttactatgctaaaaatgcttatatttttggacagagggagtatgtcagctactttgataatgcaacattgaaaactatatttggctgacacacacaagcagccaaaccaaacaaagattatgacgatccaactcttcgtttgacagtcaaaaaaaaagaaagaaaagataattttctggagtaagtgagtactacagtctacaggtacaactgtgcgagtgagtacttctttatggataaagagattggcatgtgacgagtagatgagtacgagtacaatctcgtcagaacacgcaattgttcaccgtaccaaacacttggagttggtgagaagtatttgtgtctgtgtttaattaatatacgttgagatcacggcgaccggcggtggtggttggctcgattgatactactccatctgacatcgtagttatatgaactggtgcttgtttaaattatatgtcaaatttgattttggatttatatattttgaatgaagggagtagtaccgcgtggttcattttaatatggcacgggtacgcagcacaaaaggatctacctttgcccacccaggttgaggcattttccaatttccaattatctttttttaaaaaacaatttccaattatcttcaggtttatttacccgatgttctggttcattgcctgacgtgtacgtggatgctttgccctcacccgttcacatgccatgatttttttttcattccctacctacacgaagctcaaaacaaatctcactagcacaaaaaatcgttttcccaagcaacaaaaaatcatttttttaggtggagaaaggcctgcctgtaagcacaagttttcgcaggaggcatctccatcttcgcaggcgccatagccacccgcttgcaaaaatattttgggcgaataaaaaaaaattgacaccaccccaacctcacgcgcgcccgccctacccacctctatctaggggtgaaaacggagcggattcgatcggatagtgctgataccatatcctaaaccatattttttaagcgaattcgaagcgggtatggatgcggatgcggagcggattgtttcggatgtcggaaatagtgcgcaatcagttcgaaaacggattaaatttatcggatgttacatgtatatgcaatcaatgcaacatcgagttagcaatccaaggaacaataatacaataatcaataaatgacccatcgtaataattatacgattaagtgctaaacaacatgaatacatgatgtccataatataaaaaatatagctacatgcgacgataaaagccttagactaaaatatctatgttttttttgagaattacacagtacaacgcagacactcacaacacacgcgcactcacccctatgaacacacgcacacaaaccctacccctatgagcatattcgaagattgggctggcaaatcctggagagattgacagagttaccacaggagccgggtacgtcgcctaccactgaaaggacaacaccgttaaatcatggaaagttcgaccactgaaaggacaacaccgttaaatcatggaaaattcgctcccatggggagtcgaacccaggacctcaggtgctactgaagctcttttaaccactaggctacatgcccttttgtctaaaaaatctatgttaattgatgaatttgggcattggatataccaacttatgttatatgcaatagatagagtggttatatatgttgataatttcggattatctgacaaacggcttatcggataatccgacaaaaatgtcggataatccgcatccgccatattttagagataccatatccgcatccgcatccgcctcatactatcctcattcgtatgcgacagatttctaaaaacccataccatatcctcgttttggagcggagcggatgggatattatccgatccgtttttacagacggatctcttaagaggtccgcctgcaaaaataaaggtatttttgcaggcagatctctcctacgaaaatctattttcgcaggcggacgataatctcgcccacggttgtcattttcataggcagccatttagctctgagaggcctacccgcatggaaaaaaatgtcatcgtctataaaaatggttttttaagtagtgtctaactgttcaaattacataaaatgatatagtcttcctctatttttaatatataacgtgattgactttttaatatatgtttgaccattcgtcttattaaaaaaatatgtaattattatttattttgttgtgacttgatttattatcaaatgttatttgggcgtaacttttttataaaaatttaccaaaaagttaacgatgtcatatatatatatatatatatatatatatacacacacacacacacacacacacacacacataaaaaacgaaggtagtactaaagtttttttttatgagagttcatcgatagatgtacagcaaaatcgtgttggatatatggtttcggtcggtacataagtttatgacaaacaaatggtgaaggcctaagatccataggagtagtgggctgctctcctccttccagcccagcaaagaaagaggttcggcgcagcatcacggtcgtcggctgccccaaccaggcccagtggaagccaccgccgccgccggagaagacgagtcccgggcgggcgcaggacatggcgccggcgtgttcaccgtgggcgtcgccggcgatcgagttctctgtcccggctatctttgcgcgccacccactggtagtgctcttgccgcttgctcaccgccggcgtgctccggaatgacacgtcgtgtttgtaacaggcccagtgtggatagacataggtaaattcactttgattgaacgaacttttatagcagactcccactcatgaggcccagtttagtttccaaaaagtattttctaaaaacatcacatcaaatctttaaacacatgtatagagcattaactatagataaaaacaaaaaactaattgcacagtttgcatggaaatcgcaagatggatcttttgagcctaattagtccatgattaaccataagtgctatagtagcccacatgtattaatgatggattaattaggctcaaaagatccatctcgcggtttccagacgagttatgaaattagcctttttatttgtatccgaaaaccccttccaacatccgatcaaacgtccgatgtaataccaaaaaatttctttccgcaaagtaaacagggcctaaatttagcccatgtgcaggccaggccaccagcccaccactcccactgttgttcgttcgttcctcgcgctatcagagcaataagtttaatagtataacccaatgttagttccaattcatcaatctaatagtctattaatgcaatagttggttactatactattaatatattaatatatgatcccatctatcatacacacattgcgttttgaagtctgtgctatagctggatacagatctatagcccgctactcttctgtcttttcttttatctttttaaaatatatttatagccctgctattgtacgtgctcttttatctttttaaaacatatttatagccctactattatacgtgctcttttatctttttaaaaaatatttatagccctgctattctacgtgctcttaccgccgtgaatgcgagccctgcgacgcatggcgacaacacgcgcatctctcaccgatcccctccttccctctcccgcggcacgcgcgccaggtgaaaagcgccccgcgcgagtcgctgacgcatgggccagagcgtacgtgggccccgcgtgtcggtgtgatcggcgggggcgggaacggccgcggcgcctccacgtagcgggcctccgcgcctttggatggcgccccgcgctgcatggtctcgcgggtggccacgtggaggcgttcgggggcgtcggatcttgccgggttcgacggctgggatcgcgcggcttaaaacccaaaccccacggacgcaataaatgccgtcgctggaggatgggtttccatgtaacccctctatctctcgtacaatcatcaaatagccccttttccctctccacttagacaacgtaaggactatattgtaaaacagtaagggtacatatgtagagtacttgtatttttaagggggttttttgtgaaatatacatgtggagttaaagccaaaaagctctcatggtccatgcttcacgcaagcagcaaggacgagaggagaggacagagtggggaagctgaagctgaagcaagcggaggagtgcacgcgaatccctcctcgccggcgagaatgcaggagcaggcgacgagctcgcggccgtccagctccgagaggtcgtccagctccggcggccaccacatggagatcaaggaaggcaaggaagcgccacttcgatcccttctccttccctttcttgatttccattttactgttcctctttcgggttcggattctttggttgattttcattttacttctgtttcttggaagagaaattttttttggttcttgtgtggtatgggagattgatttggttttgcaggaatggagagcgacgaggagatagggagagtgccggagctggggctggagccgggcggcgcttcgacgtcggggagggcggccggcggcggcggcggcggggcggagcgcgcgcagtcgtcgacggcgcaggccagcgcgcgccgccgcgggcgcagccccgcggataaggagcacaagcgcctcaaaaggtgcccgcctttatatttactagagtacttttgatagttcttccctttgtgtttatgtgtacaaatacagttgttgttttgcttataattgttcatgagattaaaccaaaagggctgtgatcattggagtaagttgtgtatggctatctatatttaatacttagtggttagaattagatcatattggattcgatggagattaagatatgaaaatagttaatgcttgttgagcttgggctcatgcatggtttaagattaaacaatatggagcaagaacaccgaatttgcgatgataatcgatcgaaacggcgagatcttggagtatgatgtgttgattggagtttggagtttaggagtgatgaagaaaagaggggttgaatttaaatcctgatgaaatcgatggggttaggttacatatctctgtaaagcattgctcctagctagctagctttcatggtgagttggacgcagtgtacgatcgatgtcatgtgtcgcatgcgtgctcatctagatagttaggttgggaaacaagtggatgggaagagaacagttgtgggcacatcatatatgatactattgatatctcactataaattgccccccccccccaacctatctcattcagtgttgcaaatcgcaatgcatgctatgcagccaattttgagcttttgatatcaatgggagtagtgttatattcttgtaaaaaggaaaggagtgtcacgttatgtttgcatcagtataatataatgtgcttccattatatcaacagtttgttaccacatgaaacttgagttagttatctcagtaacatcaacagtatgactgcacactgatacacttatataaacacataatattgtaatggacaaatatattattttagctaagactatactatgttaacctgccgctgtttattgtaacaatttgtttgaattaacataataaacttcttgttttgccatcccaaaggcaggtgacagctttctttgtgtcgtatttgaactctatttttgaattggttgtcataataatatgaattgtatgatagcttagagtatataatctatttttttcaattgtttggtcctgcaattgtaccacgagagtatggccttttgatttgcctactgtaacttctttgaaattcaatacaatgatatacaaatcttttgcatattcctgaaaaaatctattgtaaaaattgtcaatctccaaatttctattctttggtcaactcgttttaaattaatacatttgtgtacattttagtttagaataaagatatctgtgtacattgttagtaatgtaggattggtgtcaaatatggtttgcttattgtgtctataaatattaaggttgctgaggaaccgggtatcagcgcagcaggcaagggagagaaagaaggcatacttgaatgatcttgaggtgaaggtgaaggacttggagaagaagaactcagagttggaagaaagattctccaccctacagaatgagaaccagatgctcagacaggtaaaattcctaattctaatgcatctttttcgtgtggtacaagttttacaagtttaaatagttgtttcctgtttatttttcttcttttaagcaccatagaaaatgattcctcagatgaaaaatgttccggattccttgtgcagatactgaagaatacaactgtgagcagaagagggccaggtagcactgctagtggagagggtcaatagaggagaagatgacagcaagtagtagaacactttatgctcgaatatgcttctgggtttgaattgatcctagaacttggaacttaatttggttggattaacccagggaaaaaaagagaacttttacggtacattcttcttgaagtatatactaccagtatatttgatctaacggtgtaaattcatctgatatttctcccaattattctgcagtataaattgaatagggtatatttatctttttatctatttgcgtgaggggtaattttgtaaattcgcgtttctcacctagtcagatctggccttttgcgcccagtcaaagcgattttttcttgaagccgcgcgcatgggcgaccgccgtcgctgactgcctctgcgagcacgccgcgccgcgcggccgtcgacaaccacaatcggcgtcgccgccatcgggaatcgattcgatttccttccccctttcttcacccaaaacctagttcttctgaaaatccccaaatcgggtctgcgggaggcggcaccagcgggctgcggaggtttgcgggaggcggagggcgacgagaagtttgtcctcaacgggttcaccgccgcgaatctcagcttcgatggcatggcgacggtgaccccgaacgggctgctcatgttgaccaacggcacgaaccagctcaagggccacgccttcttcccggcgctgctccagttccacaggacgcccaacagcatggcgatgcagtccttctccacggccttcgtcatcggcatcatcagcgcgttcgaggaccagggcagcggcagcccggcggcggcaggtggcagcggcagggcggcataattagcataactaatgtaattagcatggttacataccaatataactaatgtatgaacaattctgtgactactatccattcaactcccacgttctagtcttccagagaaggccttgaaagaagaatgttcagacagcacaattttttggagcaatgcagtatagagttgggctgaaataaacagctgttacaagctcaaattacaaagcaaaaaattgctcaaattacgtggatcacgagatccagaaaaaaaagaaacgaaggaattaaaattcacccgatggaaataaatctctattttaaatgactaaacaacccttttaagatttttaacaaataccaaatctaccctattatatactggtagtatatacttacattacaatgtactgtaaaagttctcggaaagaaactggggtaattaaatgggaaatatactaggttgtgcagatggtgataatataccaaactacctgatgtttaggactatttatgttacataatccaatgttcagaattccgaaatgtagtgttcgatttgcgttacatttacatgacatttttgtgacgaatgcatgcacagtctacactgaacttgatttcccttgcttctgcacagttttgtgagttcagtaattgtcaatctctgtttcattttcacctttgctttggttgcatttttcacccaggctgatgcgtactagtgctcacagttagcagaacccatgaatttccatgcaattatcgcgattaacacacgaaatttgccggttttttcacgcatttaacgtcgttttaggctttgataaatccaaagtcatgctggaacagtaaaataaacatcaacggtcaagtgtcaatttaaccaggccccctttgaaaaggtctctcgtgcatatgccaaaatagatctgaaccactcacagatgtgtcgacacattttaggatgattttagtcagatttcttcttcattttaatcgataggcatgtgttgacacgtcttgggatgattttagtcaaatttcttacgatgtgaacatcactaaaccgtgcatgttgtttttttttttaccgtcctccctgactctcacaaattttcactcccttaatttcaaagtgaatcaacttctggctatgtatctgatctatccaactttttaaaaaaaaacttctgaatacaaatctaatctatctacctgaaaaataaattaacttaaattttgcacaatcagaaccccacacatctggtgttggcaggtgcagccctgtgacctgatacctctttcatccatccattcctccccttgttttgatcccaaggaactcaagctgatggcgtgtgcttgttctagatcagttacaattttgacattaatctcttggtgttcttctctttgtctgcttctgccacctttgaaaggttccgtcatcatgcaccagtttctttgctaaatgttctttgctttgccatcatcatgcagaaggggtcaatcatgcataaccagaaagtgatgctactggctaggaaaattgcaatcaaggcctctaataataaagaaatcaacttgcaagaacagcagcagtcaaacgtacagacagcaacaagaacaaagaaactgtcactacctagaggggagtagaagctaccttaaaaaaaaagtcacatttgaataacagaaaggagaagagagcagcaaagcatgttgttatggtgtgcataaaaaaaattaaaaaaataacccaggggattatcctgggagagagaaaatttaacgaagcaaacaaacaaaggtggttgacctgtgaagcaagagaaagggatgaagatttgtccatggccgtgctgtaacctgagactgtgcagtgggccccacatgtcaggccccaggcttttaatgtgagaggtggtctccatttattagtgccaccaccttctcatctgatgtcttctccttgacccttcttcttcttcttcttcctcctcctgatgatcaaccagcataaaggagaggcttctggttgggaggttttgcagttctcttaccctcttctgttcatgaatcatgtgcaatgggtgttggagctgtagaagcatggtgatgattttggtgtgattatgtatatatatatctgggtgattggtggtgagtagttgttcttgctgctgtggtttcttgatactttgcttcagggacaggccatggacagaaggaaccaagctcctccggtgagtagtcttactttcttttttttttcttctctgtatttgttttgtgtttttctccatgaaattgttgcatgtttctgcatggatgtgccatcctaggattgatttttttggtcagaaattttagagggtttcatggctctgtgttggactgaatttttcagcttgcttggctggtgtttttgtgttagaagaatagaagatacaccatgccttgtgctcatcagtgtgaactgtgaagttgttttggttgatcagttcacatagagttcctcagagcactgcatattgaaagaacctgaactgtttgtggataggaaaatccatttcatacttcaaattgtaaattaattaggtcaacaaattactgggtttgcatgattgtatcaaagcaactttctttttcttcaagggaaaatctcttcaattagccgtgcaaactccaaaattagcaggatggtaacactagatttgggaatagttgggagtgctaatcatttattagaaggttagaaattgaaacaacaagagacatggtcccccacagggtagttcaactgtttctgtaagtagctgttgtttcatgacaccattgtctgtcttatgttcttgtctcatcattctaggtatcattcaccaattagcagtcacttttaagaaataaaaaccaggatttttcatccccgaaaataaccaaaattatgacacatacgcatccattgcctgaaaaacattttgcctacctcacattgttttttttctttccaaacacgcaaaagattatacgcgacattgttgcactacaaatttgcatgcaaaattgcaatatttgtgtagctacccgaactccttttcttgtcttgtgaagttgtgattgcaaaatgtaaattatgtaaacaaattaccaggtttgtatgactgtaccaaaaccaaaaaaaaaaaaaatccccaaatggcacaaaaattataacacacacatccattgtgtgaaaaacattttgcctacctcacattgttttttttttctttttcgaacacgcagaagatttacgcggcatttttgcactacaaacttgcatacaaaatgcaaaattgtgatattttgttcagctacctgaaactctcttttgcttgtgttgtgattggatataggttgatagctcagcatgcttgtgcagagtggagagatcggtcgccggcgccgccgcggcgaggctgatgccgagggcgaaggcgtgcgcgcagccgagcctcagggcgtccatccacccgctcaagcccaagagatcgccggggcgcgaccaccgcggcggcggcggcgccggtggcggcggcggccggcagtgcccgctcatcccgggtctccccgacgacctcgccgtggcgtgcctcatccgcgtgccgcgaggtgatcactggaagctgaggctggtgtgcaggaggtggtcccggctgctcgccggcaactacttctacggcctccggcggcggctgggcctcgccgagcagtgggtgtacgccgtcaagcgcgacggcgaggggcgcgtgtcgtgggacgtgctcgacccggcgcggctggcgtggcgcgcgctgccgcccgttccgggggagtacgccggcgccgccgggttcggctgcgccgtgctcggcggctgccacctctacctgctcggcggcagcgacccgcgccgggggccgatgcggcgggtggtgttctacagcgcccggagcaaccggtggcaccgcgcgccggacatgctgcggcgccggcacggcttcgggtgctgcgtgatgggcaaccgcctgtacgtcgccggcggcgagggttgcggcgttggcggcggtggtggtggtggcctcaggtcggtggaggtgttcgacccggccaagaaccggtggtcgttcgtgtccgacatggcggcgtcgctgatgccgttcgtcagcgcggtgcacggcgggaggtggtacgtgaaggggctgggcgcgcagcggcaggtgatgagccaggtgtactcgccggaggcggacgcgtggtcggcggcgcacgagctcgatgccatggtgaccgggtggaggagcccgagcgcgtcgctcggcggccgcctctacgccgccgactgcaaggacgggtgccgcctgcgcgcctacgacgaggccgccggcgcgtggagcggccgcgtcgacggcgggcagcacgcggggagctcccacgcggtggaggcggccgccatggtcgccctccacgggaagctctgcgtcgtccggaacgacatgagcgtctccgtcgtcgacgtcgccgccgcaagcccgcggtgggagacggtcgtcggcaaggggcagatgaaggcgttcgtcgcgaatctcctctccgccatcgccggcggccgcggccgcgccaagaaccgcgtcctccattgccaagtcctcgaggcctaagcttcacattcacacagtgatcgattctgctgctctcatcaacgttcagaaatcagatttttcttttttttcgtgttctctgcacattctattgtggcaaatacatctgagctgaagaactccaaagcatgatccgattaatgtacagtattttttctctttttttttggggtttcttgaactttgatcggtgtacagttcgtacagaaatgggagttgtccggtgaaataatcatgaaaagatctgggtttcttttgggtcgttgttgctgaatcgtcaaggaaagactaggcaagtttgtgaatgtgctcctgacctgacaagatgttccaagtcagttgcagtccatgaccacgcagtgaatgcgactgacacatgacgaggaagaaactcttctatggatgatttttcgtaggatcatatgatatcatatcaccgtcgacgtctcgacggctagtattctagaagtgcgaaaatgactgcacgaaatgttctaaccattaacaaaaatactcccttgggggatgatatgatggtgaaatcgtgggtgcatgactccaccaactaggatttaaatccgtgtgttagcggataggggtgaaaatggtcacggaaattcccaatcgaccgagcgccgttttcgaccattaccctttttggctatatataaattttgttttttctaatttctttctaaatcatagtgatgtcgatattgagtagtttaaatgataattatgatcaattaccggttaaatcaaatgtcgtttccaaagagatggtacgattccgaccattttcacccctaagtgcatatgcggagtatgagtgtaattttgcatgtgcagtggtgtgtatccgtcatgtaattaaaaaaaatactccctcggattttaaatttgagagaatgtcaactgctagtaccaccatacaaattataagagcttttttttttaagcacagacgtaaaatgcttgtataaacgcacacgcgctcttccctataaacaagaactatattaattttacagtctagaaacctaaaagttgtttcaattttcttgtgtaatccaaataagtttcgattttgctatatatttatcgataaattctgtcctaaatattacagtataatcgtagtgtaacttttatacaattacaccgtgacttttatgtaactttcgtgtgattttgaatagttggatttgcttcatgattcgtgcaaataaggaagagaaaatcacaacatgcatataggtgaagggattcggtcccacgacctccgattcgtggaaatagcatgataccgttgggatttttaaaaattgcatacaagtaatattctagttacatgtactgtatttatatacattgttgggttctcatctatccttattagagcaggtacaatagtagactataagccatctataaacacatttcgagaagataaaagatgagagagataagcaacgggctacagatttatagtcagttgcagcacggactcaagatgtatgtgtgtatgacagatggaaccagatattaattatgtagtatatatttatatgtaactattatatgaattggctattaaatcgcctgcagatgatttggagcccatggtaggctatactattaaacttgctcttatctcaggcacaatatcttcccagcacaccaactcattcggcccatttgacggaggagcggaagtgaacaaccgcgccacgccatggggcgaagcgagtcggcgtccgcaggatttccctctccgcccgtgccctaaaccgctcgccgccggcgacgttgcgcccccgaccgcgagtgggccggcggcgatgtccggccccgtcgttcccctcgcctggacggctcaagggccctgcgagccctcccctggctctggcccgctccccgtttccgccgccgctagcgatccgccggcgccctcctcgtcggtgcccgccggcggtcgtgagccctccgctagcgggctgccccccgcggtgactcctcagcttggggtaatgacctttggtttggcttgattttgatgtcctcttgatattgctcattgttcatttgaggtatagcagtagaatgattttgcttgcagcaattatgtactttctccgtttcatattgtaagactttctagcattgttcacgttcatataaatcgtggacaatgctagaaagtcttatattgtgaaacggatgaagtattttattaaaaaaataagtggacacgtgtacctggatatttctatgttcaatatacacgaatttgatctttcggtgtcaccaaaccaaattattccttgacagtttgaacattgttagtatttttgttgtccctaaagtgaacatctttcttatttttattttaccatccatgttgtgtaggatcatgatcaaggtggtttacctaactgtgtgccaaaagtggggatgacctttaattcagagaacgaagcttatgatttctacaactcctatgctagaaatgttgggtttagtatccggaagaaccacgcaaatactagggcggatgggagtctttgctccaaatatttcctgtgcagcaatgaagggcagccggtggcaagcactacccagccggggcggaagaaacgttcttcaacaagatctgattgcaaggctcgtcttcagttctatatttcccgagaaggtatctggacagtgcagaaggttgagctcgatcataagcactatctcgtaagtcctgataagtcacacatgttaaggtcccagcgccgtttgacaccgtcatatcaacagatagtgaatgaaatgcggcaagaaggtattacagcagctgatatgcaaagagtatttcggcaatggtccaggggagctgaaaatgtgcatcttctgaagaaagatactcagagaaagtacctccaaccaagttatgcacagaaattgcttgagtatttgaagaacaaacaaacagaaaatccttcatttttttatgcagttcagctgaatgatgatggtcgaatagcaaacttcttctggacagattgtcaagctattgtggattatgcttgttttggtgatgtcgtgtcttttgatacaacatttgaaacaaacaagtttgaaatgccgtttgctccatttgtggggactaaccatcacaaacaacccattttgtttggagcttcgctgatatatgatgaatcttcagagtctttcaattggctgtttcaaaccttccttacggcaatgtctgggaagcaaccggcaacaattttcacagatccctctgctgaaataataaagtctgttaggttagtgtttccaaactcaagtcaccgcctgtgtttgcggcatatctgtcataatgctgttaagcatttgaatcacgtaatttgcaaccatccagaatttctatctgattttaagagacgtatctatgaagaaaggtctgtaacgttctttgacttgaagtggaaggaattggttaacgcatataatctagacggcaatgattggatgaataatttatatgcaatgcgtgaaaagtgggctgctgtgtattcccgtgactcattttacgctgacatgatgacaatccaaaatgctgaaggcacaagtgatgcattgaagaattttcggaggaaactctgccttccagaattcttagaggagtatgagaagtgcataactagtttccgccaaaatgaactagaagcagattataattcccgtcaaaccagtccggttccctatgttcctgatttgcctatgttgaagacggctgctgagtcctatacaaggaatttgtattcgcattttgaagaagaattcaaaaaattgttcactctgtcttgttcgttgctatcacaagacagaacaatcagtacttacaaattgacacctttaaattctgaagaagaagcatatgttgtttttaattctgaggatacaacagtatcatgttcttgcaggatgtatgagtgcacaggtatgctaccatattggttatgtttccaaaacgtaaaagtttgattttcttgctataatcggagattgcatgtttttgtaggtatgctatgcaagcacgcgctgcgagtccttaactacagcaatatttttacattcccctcacactatgtttacaaaaggtggacaaaatatgcaaaagccggactatttggctgcagaaacaattcccaaagcggcaatggaagttcgatgttaagatgtgcgcgtatatctcaaaagatgcactcagttgctctaagatattcgatgtcagaaaaggcgcttcagtttttggaaagtggggtagataagttgacatgtgaagtagaaaatttacttagtcacataaacttaaatggaaatggaaatgataccggtcaatcttctggtttttgcaatggtgcaatggcagaaagtttaggccattcagaatcaatgtacagcgaaggggcctaaccgcctaacctgcaaaaatactagaaaaaagtgttctcaaggaggaaaatggaaatgcactgctagaaggagaggcacctacaatcaactgttattttctgtttatgttaaattcaaatctcagttcttaactgtgtgaggcactactccaaaaaggaaaaaaaattcaaagagaatcatgttggtctcatcatagatagagggcatccaattctctagttgctgtagttctcttaactttttctcctctttgttcagggatgaatcatacataattctgggcatatcatcagctctccatctacttggagttaacttcctaccacttccgtcttcgtccaaagcgaggcagagtccataaaactctagttcggtgatttgccgatgttgtttcgccatctgcgtttgaactgctgtgcttaatttggtgatccgctagaaatgcactcaaaatatagcagcgtaggatagttctaaaaatgtccgatatgttatattttaggacgaagagtacatgtaaggaacaagtgcgtaggagcagtaacttgtttaggagtagctctgcacaatgaaaatagtattctggttctctgttgcctttctgcctatatacagtactccctcggttttttaataggtgatgtcattgagttttaaacatacgtttcagtttcatcattcgttttacttaaaaattttatgcaaatcatgcttaaaagactttaagtgataaaacaactcacaacaaaataaattgtaattacgtaaattttttgaataccacaaatggtcaaacatgtgacttttgaaaaaagtcaacggtgtcatttattaaaaaaatctgagagagtatttatttatcttccaaaatgtgcaatgtgttagtttcgaattgagatccactgcagtcctaactgtggctgcgagttaggaactgcacatcatctcagtcatccatttttccagtgaacggtctagatctgatgctatagtgctgctgctacagtagttctgcagtttttttcagatgtgaacagtactttgtagattctagacccttggatttgcatcaaaagttcctagtgtgactgctcacactaggtgttgcaccggatccaaatccgttagtttctgttggctatcaaggtcgctgttgaccagagtctgccgctgcgtgccctcagcctaggtgcagctcgcgccgttggatcacttggtcgaagcgtgtccgtgtgccacgtcatcgtgtacaccacaccacaccagcttcgagctctgattggttggctgacgtgtccgtctccacgcctatttattcgctcttcccgcgcgcgtcccgcccggcgacggcgacctcaccggcgtcgacgtcaccggccgacgacgacgagacttcagcgatgaccaccgcccagccactccagcacgagcatgacccgtccccgccggagccggacgccgacgccgacgacgaggaggaggagtcgcgggtgtggtcccagatcaaggccgaggcgcgccgcgacgccgacggcgagccggcgctggcgtcgttcgtgtacgccaccgtgctctcccaccccaccctcgccggctccctcgccttccacctcgccaacaagctcgcctcctcctccacgctgctctcctccacgctcctctacgacctcttcgccgccgcccacgccgcgcgccccgacctccgcgccgccgccgccgccgacctcctagccgcgggcgcccgcgacccggcctgcgcgggccgcctctcccactgcctcctcgactacaagggcttcctcgccgtccaggcccaccgcgtcgcgcacgcgctctgggcgcagggccgccgcgccctggcgctcgcgctccagtcccgcgtcgccgaggtcttcgccgtcgacatccacccggccgccgccgtggggagcggcgtcctcctggaccacgccaccggggtggtcatcggcgagaccgccgtcgtcggcgacggcgtgtccatcctccaccacgtcacgctgggcgggaccggcgaggccgtcggcgaccggcaccccaaggtcggcgacggcgtgctcatcggcgccggcgcgaccatcctcgggaacgtcaggatcggcgccggcgccaagatcggggccgggtcgctggtgctcgccgacgtgccgccgggggccacggcggtggggaacccggcgaggctgctgctcggcggggaccagcgcggcggcgcgccggccggtgaatccatggaccatgcctccttcatgctggagtggtcggattacaccatttgagtaggagtggcatcgtacggactacatttgtactactccttagccatgtgtttgtacttgcctgtaaatgcaagtgtgtaagcagagttagcttgtaaccacctgaatttcgtcgaattttaccaattctgctgaatcccatcgaattataccaatacgcgccctgttgataaggtcgaaaaccgagcagttactgtcggttttgtgaaccttttgcttccgacacatgtactgaaaattcacctgtaatttcgcaaaagttccttaaaatttcggcatatgtgcttttgatttttagactttcttttacgagtagggccttctgtgaatccggcctgtaaaaccgggcctagttttcacatcggaagctgggcctatgctaaggcctggcctacagatccagcttcatttctcagtctgacactgggccccacctgccagtgtctgcggcttccacggactgagctgcctcgcccgcctccgagcagttggggaagagaaccgaagcacaaaccctagcggcggcgcagctcagccggggtttgcggaggaaggggaggggcaccgcccgcgatgctcgcggcgtcggctcggcgggtggcggccgccgccgccgcgtcgtcctcccattccaggctcgccaaccagctcgcccacgcgctgaatccgcaggtgaggctgggcgtcaaatggcacggcttggatttggccatcttttttggtttcaatctcatctcccccaatcgggaatgctgcaaaacctagcggggtttttttttttttggcgttgtagctcgggcgttcggtgatggatttgacgatataatgggtgatttttttctgtacgtgattatgctttgtagaggtggatccatgaccggaacaagaaggcgatggagttggtggccaaggggtggagcgccctgcaggaggttgatcgcgtcatcgactacgccgaccgcaacgacaagcgcctgatcccacttctcagggtacagctctggatgattcgtctttgtcatttgctccatttattcacgatagtctaagtgccctagaattaagccctaagtctaggaaatgaaactttgtgttgcagtgttgaatggtacttaaccagctaacccgattgtttggacctttattatttccaatcgttcatttgccaatgtgtaccaagtaccaattggttcttgccattgccaattgaagtctggagatattctgtgccgaactgtcttgctaatctttacaagttgcacaccacctgcatatagtgtagtgcgtcagctattggtttggaccaatgttttttttttacgttctgttgtgtaaatcttctcgatgctatgcattagggtgcaaaggaaaattttgagctggctctggagatcgacaatatgaacactcatgcgagattatggcttgccaagatgcatttcaagtatcatgttcctggagcttgtaaggccatgtgggttaactttcacttctggcaatgttagtattgcacagctttctttgctattatgtcttacaagttgcatcgtggtcattttcttatttcctattcattcttattccaagaacctgcaagcacattgcaaaagctagcttagtcactgcttctattgttgttttgaggtaattgaagaattatttttaagtattgttgttttgaggtaattgaagaattatttttaagtttaggtagttccttccagtggcgggtttaaaattttatcatgagcctgggcaagactaacaacaaatgaagtatatacaagtctatataattcatataccattttagcgtgagcatttgcagtataagtttgtgttaagcatgttttctgctgtgctgtttcttcatacggccttgccagtgactaagcaaggttattaggcattaatcaattggtgaattgctgcatgctcctggtggagcctaggccatttgcccatggtagccggccctggctccgccactgcttccttctataagagcccacacaaattgaacatgtcagtaggtgttgttttctttttttatgtaatctgtaggagttgatatggctcccaaagaaaagatgctgacatgtattttccgtttaatgtgtttctcatttactcattattgggtgcacatccaattgactgcatcaaagttcactaccacagcagttaaagctggcaaaaactgggttacaaaatatttgagattagcatcttgacttaacaaaaatagttagtaagtgtgctgcatggatcagctcaggtaggtagttaagttctagaggaattctctctctaggacttctcgttgaacattatttaatttgctgcaagcacagaacttactgttgatagatttgcacacgtatctttcgatagtcaattctctcttcacttttcatgggtgcagtggtgctgctctgttggttgaagctgcaaacatgggtgatccagatgcacagtatgaacttggatgccatttgagaattgaggttttcatgctctgttcgcacttttcccttccacttaattgattaaatcatgcagttttatgttatgctattgagcaattcattatacagattgattcacacagacattgcattactttaattgatggtttacctttgtttctcttgtagaatgactacgttcactctgaccaacaggctttttattacattgagaaagctgttgaccaggtttgcttctctgaattttgaacacatctttccatgtatgcttcttgctgaatcttctcaattacacttaatgcttgattgcagttgcaccctggtgctttgtatcttctaggtgctgtatatttaactggagactgtgttaagagggatatagcttcagcaatgtggtgtttccacagagcatcagaaaaggtagggatttctcttggacttgcttgtgaatagaatatcaactcaaacttgattttctttgttctgctcaccacctgcagggacactctggagctgcaattgcatatggatcacttctattaaaaggtttgtacaaaagtaaccctctagtgcgtcatgactaaggagcaaatcacatataactatttgttgtggaatattggtcatttggctctctaaagctggcggtgaagctatgtatcccaccattaaaaacttgttagctgattctatgaaagttaatgttaatagtattatcccgaagctcattcattttgtgattgttcaggtgctgaagtgcctgaggttattaccaggttcaactcaggtaagagtccatcaactggaaagatgcgaaaaaggcccatacagcaggatccagtgaagctagcaaaggagcagtttcaaattgcagctgaagctggatgtgatctcggtttgcgatggctgaagaggcttggggattatgaaaagcagcaagaacaaccaaagcaaatccagcaatgaccaccttcgaaatgatttgcttcacttcggcattgctctatgttgacatgcgtttgtcatacacactatacaggtagaacgtcagattctcaactgtaatcatgtaattgaatccaagcactatgtaaattttgatatctggcccaactccttgaaaaggtagacttgagttgatcccctttctctacaaaggatttttatcgtaccagtccttatagagttcgttactttgttttttcactttttctccccaactgtctactggtataacctgttacatgtcccttaattattccccggtgtgtcagaaaagtgtttaaattcaagcatacatgaaaaaactggactttttccgtttgtcaagtactgtcacggctaaggactattatgaatcctttttatctctaaggattatcctgagaaacccccaaaattaggcctctttgtaatgtaggaccttttaaaatcttacggaaattgagatgattcctattaaaacccagtaaatattttgcggtcggaaggagctcttatatcatctggttctcctattttagcctggtgaaacttagagcatctctaacagcctcttcatcctactcaccaaaccaaaatttagcaacttgaatgaaaattacactccaacaacatctccatcccactctctaagccatccagatgatcaaacttcttccttcacatgccaaacttggctagcctatttgctatccatgggtcccaccacctcttattcacttttccttcgttcgggagtagcgtgaaacttaggccatctccaacatcctctccatcccactctccaaatcaaaattttagcaactttgaacaaaaattacactccaacggcatctccatcccactccaagccatccgatgatcgacttcttccttcacttgccaaacttggccatcctacttgccatccatgggtcccaccacctcctattcatttttccttcattcgggagcagcgtggccgagggggagagccagtgtccggtagcagaagctcgatgatggtgagatctccaacgacccgatggaggcaagggacccggtccactcagactggcaagccaacagcgagatctctagaggcggcggtgccccttaggagaagtcggagaagaagcagcacgccctacaggaccaccattgctgttcgtcggcctatcgttgccactgcccttgcggacacgagcaggaggtctcgcgttaaccattcgcccgaaaccgcgtcgtcatcgtcctcccgaatccacgtcgccgccattcgcccgaatccgcgccatcgcttcgtcactagcccatccacgtgcggcctccaccgcctatgcccgagacaatgaggacggtggcagtgacctccactcccccacccccgcacggcctccaccaccaccagccctgcgcggattcagccggtggtgcgacagagaaaaggaagagagagaggaggggtgaaggagaaggggtgaaatagtaaagaggctggcaggtgggacccacttttagtttggatagtgtaatagaggttgttggggtgaaatgtaaattagactaccatttggtttgtcaaactgaccgaataggcatttggagaatgagatttgaagatgctcttagttggcccaatatgtcatttacacaagacaataagcactcaattttttgatataaaaagagagtatgcgctcctcattgtttgcttgttgtcttactaatgtcatttcaagattttatcgtagttttatctttctttaaacctccaataacataaatataaattttgtgcccataaactatggcttattaactgtagatcaaacaattggaccatattttaaagatgttctagttgtgcacttgctaataaaaagaaatatactctaacgtagatccattgtttcgggagatatttgattcctggtttgagaaatacaaggtgttatatgcaacttgcaatcattggccttagacccattacatgaaaaatcttgatgttttggcctccacgtagttactttggactgttttacccactggagttgaatccaacacatgagccataaccacacgggataagaatctatactaactagttcttactacttattcttttatttgaccctttattgtctttttttattattatattgccttttcctcctctttcattctagttatcattcttctttctttaacctttaacttgaaagactcctctttatcacaaatcatcaagcagtcatgatattttagggaggacatagtgggagactttgttgtagatgaataggagcattaatgggcagtacaatgatgtggtggagggatggatgctgatgtaatatacttgcatgttaaactttataagttagtgagtatcaattttacagtaagatatgattagtggtgccacgtaaatgtatttaatatgcgtaaagatatacacttgaattatataagagtgtcgacaagactaaaaataatcacaaatatagcattactactctattaaaaaataaatgaggttagattttgggacgggggggggggggggggggggg

SEQ ID NO: 62676 - DNA, 5844 bp, Oryza sativa
gaagtgaccgcgtggcctaatggataaggcgctcgcctccggagcgggagattgtgggttcgagtcccatcgtggtcgtttttttctctttttcccatcgtggtcgtttttttctctttttcccatcgtggtcgtttttttctctttttttctcttacaatgtttttgaacgttgaattcctaacaggaaaggattcacatggtggtaattacgatgtagtactacattcagcaatgagcctctctagactctactaggaatatgcatgcaaatatcttgatagtttttacaaagtaaagatataaggggttgttcaaatttatgtcaatttaaatcttattatttttttaagttatcaaagatgtacatatatttagtccttgcactgtgtttttaaaatcaactactaattccatttcaaaatagatgacaccattaatttttctcgtaatgtttgatcactcatcttattcaaaactttaatataaacatgtaaaagtataagttactattatattttttatttgatgataaaacaagttaaagaatagataatatttatagttttaataaaacgaacgaccaagttatgtgaaaagtcaacggtatcatacttttgaaataaagaaagtataacatccatactactataaaagacaatagtgatggtggtggctttatcaccagcccagcaccactacttttgcacattatgtaatagtttaatagttggttgaatcaaatgaacaccatatatattttaataagtatggacattttacccatagcaaagcatgggtattttgctattaaagttataatatatgctcacctaagaagcatgaaaatgagtgtttgtgacgaaccgcatcctacgatgtcgagattattatcatagtgaggctagctctgtaatagatggttgaatgaacttggccaaacttctcttcttcttttttataaaatgccaagtcccacctcccatggtcgatacgtgtcctagtgtgttagcattggataaagaaagtatcttcataaataactcaaacctctactgcataaacacacacaaagctggggtttaggtgctatgcatatcgctcttcctttccaagatatctgtgagaatgtgaccccttctcactgcacagccgccacacccatcaatcttgggcaattaaaagtcaaaaatttatgcatatccaggataatcactagaaaatgggacatgacctaatagcattatgttacgatcgcaggcgtcacccgatgagaaactgatgatcgaccactattagacatcgggttattagaggcgatccaaaaaccccactagagatggttttgtgaattgtctatgcacgtgcgtcattgcaatctgccttagacatatttcaacaaataagtcagaaaaacctacccacataatctacttaccagagatagtaaaaaaaccgccttagacatatgtcttgtcaatacaattatgaacgaggtacaatattatattatatatatttacagacaattatgtcctatgaggatttcttatttaatatttatggttttatggatctatcttatgactatatctctagaattaattagtactccacctcaaacatcatgtcctagctaggcccgttcggtttatattattgagtggataaaattgacatatattatttacttaattatagagatagaataaatattttaaaatataaacttaaaaaatatcatcctaagatataagcattagtggctatgattttagacatacatttatccagattgatagctaaaaatagttatattttaggataaaggcagtaccttaaaacaagtggtctaaacaatccaatacaaggatgcatttttgaagcgttgagcgaataatccatttgcataatccagcgaatatgttgttgtatgtatcggacattgacaatattatctgtagaatatagctttaatctccaatttttatttaaaaaatatgttatatttgaaaagataatgaaatttgtgatcgtgtttggattcaacccgagttcaaatcctggttacaaatagaaacatttacgcttagaatcgacctatagagacagggtcctcgtgtattagacacaggttgcctgtttggtagagctctaactcctaaatttagctccaggagttgggtctagaatggagttgtggagctgcctaaacccagctccacctctctagttcattctatgagagagctccacctaactctgcttctattttaggtggagctggagttgaagctgtgccaaataggcccttaattaaggcacgattcataggggatagctcctgtcatcctgtgcaggggacctgcttctatggcctttcttgaatccaaatttaggtatttcttatttgaaataccttgggtaggtatttaatttcccttaaagccgagggtttctttaaaaaaagaaatgaaatttcgatattttgatagtattgtttttcaatagaatttttttttcatgttttcaatctactcactcctattcagagaagtactgacagcaatgtttaaccccacctaacccaaaatcactaattttttgtactcaatggagtatcttgctagattttccaattaagcacataatcgtacatgcatgcatgtacattccacaaaggatgtatacatgcatactccaggagtattagtgatgtcatccgcagggatatggaactgtcacttcttcagagacttcagtgaaaagtaacacttgtttaagaacagagatatcctatatccaacgtcgccgcaggtagtggagtttacagaaatcttttaacttgctagtggacgcacgacgcatgttggggcgaaactgcgtatgaaaattttcgttatcttccccaaattttccacccatatcgtgcaggtattccacagaccaaggatacatatattatgcatatttatgcacgtgattacactgcataaacaaacagttagtgggactgtaacaagacaatcaagcaaaaataggttgtgtcttacgtaagagtaataattaacacagacacagctagctcgtattgtggtttaattgtggattcctactcaaactacacacaatgaacagattaatttggagtagtagtggaatgcagtgaatataatcatgtactacagcagtatattatgcaagtagtccacttcttcagggttcaggggttgccttttacgcctgtataaattggtactcttgcgtagtttacaagcagctcaaaacacttagctagctagctcacaaaagcatcagagttaacgtacactcatctagctagggaagaagaagctaactaagccatggcttctcgtgcatttgctgcagtgtttgcagcagtagcacttgtagtgtgttcttcagtcttgcctcgtgctctggcctctgacccgagccagctccaagatttctgcgttgctgacaaactcagtgctggtatatatatacaaactcatttcatcaatatatatgttgctacgtgtaaattacagggatatgtcaggtgctaattaagtcacggtattgataacaaacttgttattcgccgtttaatttaaacggcttactgcatattcttttcagcatcatgcagttgggtacgttttattataacaacataacttgcagcaacccaactagccagcccgttggaccatatatatatttgtcaaaaatacagtaatgaaatgagaacaaaaatacaccatcaaatttgtgatgagaacatttttgagactgtatacatttactgcaccacatttttcatcagaaaacacttaaattttccaaggcatggtattttaccagcatattgaatcatataaggaacttcacgtatgtatcatctcggtctttaatttgcaaaattgtaatgcagtgtttgtgaatggttatgaaactttgactacaaaatccaataaatttatagtattatgatattacttttcaaagaaaatctacgtataccattccttatgtttttaaaacaatcatttaaaaaagatattttttatagtttttgagatggtactaaaaatttagaactgtaaaatttctctttgaaaaaatattaatgatcaaagttttaaatgtttgactaaatcttatcataaatgtcaaagaggtttgaccaaagtattaatctatgaacaataaattgcaaatgcagtgttcgtgaatggtttcgtgtgcaagaacccaaagcaggtgacggcgaacgacttcttcctccctaaagccctcggcgttccaggcaacaccgtgaacgcacagggctccgcggtaacccctgtgacggtgaacgagctgccgggcctcaacacgctcggcatctcgttcgcccgcatcgactttgcccccaacgggcaaaacccgccgcacacccaccctcgtgccaccgagatcctcaccgtcctccagggcaccctcctcgtcggcttcgtcacatccaaccagccgggcggtggcaacttgcagttcaccaagctgctcggccccggagatgtcttcgtcttcccgcagggtctcatccacttccagctcaataatggcgccgtcccggccgtcgccatcgccgcgctcagcagccagaaccctggggtgatcaccattgctaatgccgtgtttggatccaccccgcccatcctcgacgacgtcctcgccaaggcgttcatgattgataaggatcaggtcgactggatccaggccaagttcgccgcgccaccggctgcctctggtggtggcggtggcttcattggcggcggcggtggtggcggcttccccggcggcggcgcgccatagacggcctcattctcgacgcgcttagcaatgcatgcaaaggcggcgtcgtcgtcatgcataatgcatgttactatcttataaaacctttattacacatgtaagctgcgtgtctacgtggcttgacacgtaggatacatctcgatcgtgtccaataatctggtgaaatcgcatcagtgtattatgctaaaaatgttacacctctttatgaaataataacaaagttggatatttatgtgctgcctatgcacaggaatagcaaatatgattggagtctggcagaaacgtaggtgcaaaacttatttattcccttgaaaatacagaggttcagcaacatgaccaactctgaactcatacagagtgaaactgagctgctagacacgccgtttgatggacaacacagatgacaactcaagacatctagcatccaaaattgcaataacggccggacatgtttatttcgaatgctaaatgttacagaagaatagatcatgagaacagtgctaaatttgttccttttttggtgatctagttagcaatggcttcatgttctgttatcgcaaccaacggagattcccagggtaagtaggactcgaggagctgtagaggccattccatttgtttcctttgaatattgcaatctacaaggaacagtagcatgcaccccttgttttccaaacctgcaacactatgaccttgacaacacaccttttgagctgcgatcaagtcaagaaagatacgttaatgtttcaatatcagcaaaggtcagagataaaccatatgcttagcaggtgtgaagtttttgaatcaggcatcaacagtgtagttgggcacaacatagaatttcctaaacgctatttgcaataagctaaaacgaacctggggacagtgccgcgtcggcgcaagtcatattctgttgcttgtcgaagggctctagcaaatgctttgaaagttgcctcaataatatggtgtgagttttttcca

SEQ ID NO: 62677 - DNA, 6304 bp, Oryza sativa
cacgggccacaaggaagcaagagaggagagcggttacgcgggtttctcgtgggacaacgcgccgcgcgccggggaggagagagagtggggggggggagctcaccggagacggccggatctcgtcggcggggagggggtcgccggagctagcggtcggtcgccgacgaacggggcccacggggggggagcgtggggcggtggggaccaccgtcagtgagacggggagggcatggagagcaagttttggagggctagggggaaagccgcatatatatatgtgccccccaccccatgtgcttaagcccacacaagggctcaagtgccaaatggattaattgcaaagctttgctttttttttttcccttttcttttccctttctttattattacagtattattttttcttgccttctctttcatcacaccacacaaacaatgcttctttttttaccacctcggtaaacatgcttgatcctactgttatctcgaaaccacccccactaattaaaaaattccactcttcctattggcggcattcttctgccttggagtacaatttgcagtactgatatactagcagtacaaatttctgtgtaattttcactagtactagttttgacatctgaagtaaaatcaacatgtctactttttttttcttgtaaaatcaatgaagaatctttgagtgaatgcaggatgaggatgaactgatatatataatacaagtactaatttctgtgtaattttcactagtttttaaatctgaagtaaaatcaacatgtctctttttttttgtaaaatccaagacaaaatggaaaatctttgagtgaatgcaggatgaggacgaggacacacgaccatgcatgcgcacaagcacagctgctgaacatgttgcaggaggctggctgtactttgctcttcttttcctgcctctcaactcttttttttttcttcttgttataatggaatgttttttttttcacagtgtactttcctttcttctcttggattcagggcagcgaggttggaatggaaaagaatctctagagagagagagagaatgaaagagagagagagaggtggtgaccgaaagccaccacttggtgtaggccatgcacgaccaaattaatttacgcacgttgaaacggcagacagatgaaaaggacgccgcattatcctgtgattatttattcgtgattttctgctttatattaagagggaaatgggattactgttatgcagtactcccatcgtcccaaaaatataaaaatatagtatcatcggaagagatatttaatgtttgttcagattcgtagtttttatattttcggatggaaaatttataccacctaatagaatataaaaataaaaaacaatgcattatccctcaattatttctagtgcctgatatgagagaggttgatccaaacaaaaggcaataatatagtgaattatttacgcaaaattaagaggacggtgcatgatcagagatggattggaactgcacgggcatacagtacctggagtttatgccaaaaaaatgtatagtagagtattttattttattattacctgtagtgagagaaactatagactcattagtaggaaaacattactttattaaccgagaggtctgtattttattccacctacatttgtttaatctggtgccaggctgtccggtgtggataaggacggctgtcttctcaaccgggtaaagttaccgccccggtaaacgtgaaagttacgcactaatcgcgctcgctaatggctggtcaagcccccatcgattagcttccaagtggccaattccctttttttttttttactgaacagtcacacgtttgaccccgactgcggaaaaagttaccgcaccagcgtttgaccctccggcttttctgaaacttttttttttttggggcgggggggttgagctagtgcagttaggtgatgtcagcaatgaaccgatgagataaaaaggagaagagaaagaaaagagaaaagtttgatctgttattattattactacgtttacatccgtatacccggatcgctcgtgccaacgtacgcaaaaagaaagtcagagatcgtacttcaggtaacggacaaaactcctgggaaacaaactgtacgttgtgaatgaatgtgacttttattactagtaggatatcaatgagcatttgcctcaatttttgtgaagctttcttccaaaattcgttcagcaaccaacaccattcacatatatagccagaaatacttaggctgtgtttagtttcccctcgttctcaacttttcatcacataaaaaactttcctacacatataaactttcaactttctttaaacttccaacttttttcaggaactaaacacacccttagagtctataagttttgaaggaattttcacacaaaaaaatagaaaaaaaaggggaataaacccacattccttttacttttcctaaacccacattcctataaaccgaaagacactcataagaaaaaaaaatccttaaaaatttaaattctttaggttttcttcaaaccaaacaaacccttaaatcacacaacgaaatgcctggctaagagaacaggacacgataacacgaatggatcaaagaactatcatggatgatggaatatggttgtagcaaggcgagaagcaagcacgacgagatggcccaagaagaagaatggtacgtactcctccgctggcgtggagtagtagtaggcgagtataacgctagctgttgcatggaaatgtgcagatctagttgccacatccgggaggccgcctagcctagcttagcccggccggggaggccccacccaaacaaacagggtggcacattgccccctgtagcctgcactgcaacaaacacacatcaacaacaacaccacacacactcgcacaacactctctcacctgcaacaacaaagaagaaaagaaaagctttctgtttctgttccatagatgcacacaccacacagtagcagtatataaatgtgtacacgtatagctgtgtatatctggcaatgccagggagtagctttacgattcggttgaggctcatcagctgcagctgcagctgctgttgctgctggcagagtgacttgattccgtgctgccgtgctacgtatactactgtatccgtggtagatatagaccatgtttagtgaatctacatgaagtattcaatatgagctaataaataaataattatacagattgcgactaatttgcgagatgaatatttttaacctagttgctccatgattcgataatgttgtgctacagtaaacatttgctaatgacagattaattatgtttaataaatttgtatcattgtatcgttgtttactgatagattttataattcgttttttattagtgtctgaacatctcatatgacaccttatataatacccgatatgacacaccaaaacttcaaaactttatgcctcttgatctaaacaccccgatagatagatagctcgatactattactactagaaagggaggagaatcatatgctacaagagggatgcacgaatacactgctaccataataagggtactactacgactccagcagcatgtgatgcgtcattatggagattcaaggcgcctgacattgcatactagcgcacttaataactgtgcgaatgggggtgaacccttgtacgtcaccgcctcaaaagctagagaattagtagtagatcaagtattaacatgcgtagaagtagaacacatcgagttatgatgcggatacacactacagtggcatctaccagtcatcacagtgtttgttggtgtgacctaaagctttggttaataaccagaaaccgcagaatgtcgctacacatgcagcaaccattgatcgatcgcattgatcagtagggccgtgccggcaggaggcaagggcactagtagatctatccatccatctatccctatagctgcgcgaagaacgcgcagcggtatttattagtgccgaaaattaggtgcctaatttattaatcacttttttcactaacataagcacggcattaggctgcgattaattaaaaccctttttatttatttttaacctcctgcttctccgtgcagacgtgttgatggatgggtgctatactactacttctaggactaggagtactagtagcttggtaggcaaaggcaaaggaggagcttgcagcttgcagctgcagcagcaggaggaggaggggggatactgtactagggcaaatggagatgtggatgcatgagaaaacctactaccacaagtggaaagaaggggaaggggggaaacgggaggggagggggggaattgttccatcacatgatgctcacatgctgcatgcccgcatggtggtggtgtggtggtggcgctagctaagctaaccaaccaaccaacccgcggtccttccctcttctcagactcactcacccacggcattttctcgctctcctctcggctaatagcaggtacaatataagattattagctagctataaatatattttaatgagataaaagatgagagagaagcagcgagcccagctgcaacgcggattccaagacgcaatatgtgtatgatatatgtgaccatattaataatatattaaataactattatataaattagatattaaattagctataactaaattggagctagtaatgagttataatattaaagttgctctaataagagcttggtggtgttgtttgccttgatgggtggaggtggtggtggcggtgacagcggtgcgggggagctgggtggtgggggcccacgtcgctccaccctcttctcttctcgcctcactcctactgttcctgatagatccaccaaccgagcttttgcctccttttcttccgttgggggtggcccccctccgccatgttttggacgcttcctcctcctcccttccttgcctgtactgtatacacaccctgtcttttcttttctaagattgaaaattgtgtattcactaaaaaaaatatttttgtgatcacccatgctcgcttcagttgagatttgattgaatgacaaataaattgaaacagtatgattatttagcaagggagggagtcatagttggtaatatgacaaaaggagtcatagttggtaatatagcgcagcagttatattggtttttataagtgatatactttgtggtaaacaaaagatcaagtgcatccgtgcacagcagtataatagcaccgtccaataatatagtagtagtatagtaagatgccaaggaatgggatggtgaaacaccgaacagtagcagacaaacgagcaagggtatcaataagaaatgtttgactaacagctcggtaaaacagtgctggttttcagcgtgcctgtgcaccagtgcatatgtcgagtgagcgaggccatgaaagagcaggatttgacacgagttcgggctctgtagggggggcagacaaccaaagtggaagcgatccaaattttcgcttagatcgcggcgaagaagcaagaaaaccggtggcatcctttaactccaagattgttgtaggtgcgcgcgccggtggcggtggcaccggtggttccacgttaatccaccccatctatctatctatctatccatccattcatccatcatccccaattccctctcctcgcactcccccatgtgaccatcgccagtggcaggtcgcgcttaattattcgtggccccatccttcgagctccagggtcccccccttccctccccttttccctctcttctccaaccctctctttgtctcacgatatcgatagcgtctcgcacgcagccgcggttttcgccacacaaaccaaaagccccaggtgcaacgcagaaaagtgttatattacattgcaactacacctcttctcgaatcaatggcctgggacttgggatgctgcgttagttaatctgtataatctaaggttttgatgcgttgccagcaactgaaaccgttaagaaagcatatctttctttctttcgcctttgggtggaggatgggtaggaagggtaccttttgtgctggccgctatcgacctgaggagactttataaattggggagctcataagaaagcttttttaggctcgtccgcagatacgccttagatcttcaaagatcacagcgaagtattataatgcatcaactgtagagaaagatagcaggaaaaaatattagtagtggtatgatcatagataggtagcccctgatctaggggcaagattccatgtttggtcagtaccattaagcaagccaaccaaaaccatcactattacacgttttttaccg

SEQ ID NO: 62678 - DNA, 662 bp, Oryza sativa
aaaacgatttttataaatttattctagtataaaattacacattttggagtttaaaatgttttataaatcctgtctagaatgccaaatgcttgcatatctatcagacaatatattatcttgagttggggcctcatcgactacccaaaagtttattataaacaccgtaaaggcttattggcgattaaaaaaatatttttttataaaatttttatatgtattcttactatttaatagccaatactaaaaaaagtggtgaaaacatattaaaattaacttcaaattaagttaagtcaccaactacccaaaaatttattataaacaccgtaacatcttattggcgattaaaaaataatttgttttaatttttttatatgtattcttactatttaaaagctaatactgaaaaaaaagtggtgaaaacatattaaaattacttcaaattaagttaagtttcaaacttaaattttactttgacttattatttttttatcctttaagaccaccaacggggctcttgattttttttattacccatatatacgtgcagggacgtttgagattagggagcgtaagcagtgcggcgacaagtactaccactacagccaccaccagcagacgaccgagcaacaatacggtgggtactatggcagcgaggaaggcga

SEQ ID NO: 62679 - DNA, 985 bp, Oryza sativa
  unsure (1)..(985): unsure at all n locations
atattcaaagtactgaaacaggacgagttttaattagcgccttgccagatatagcgactcaaccagatatgactgcccaatgggaaatgcaactgaaacaaattagccaaaaacaagtctcttaccaacaatttatgcaccaattaacgactaaattacccgagctactgcatacagaccgacaaaaattgcaaaaactcaacataattacaccgcttaagctacctgctaagcgaacacatactaaagcatcaataatggctgatgaaaaataagtcaaatgtggatggtggaataaaatttacttgcaaccaaaatgcataatctatatcataccccccatcgaaaatggattttaatcttgaaatcacttactttatcgcgtacagaatagagaaatcaaatgttaaatgtactcacaattatttatcttatcgttgctataatattaatcggttttgtgcttatgcaacaaggtaaaggtgccgatacaggtgcttcatttggtgccggtgcttcaggaacggtatttggttcagcaggttcagcaaattttttatcaagaacaaccgcttttttagccactattttctttgcacttagcttattaataggcaatttaaactcacataaaacaggtaatgtaagtcagtttgaagatttaagtggtattcaacaaaaggtagaacaatctacaaaagttgaaaatcaaaataatgatattcctcaataatatctaatcaaaaaagctctnnnnnnnnnnnnnnnnnnnnnnnnnnnnnnnnnnnnnnnnnnnnnnnnnnnnnnnnnnnnnnnnnntcgctcagagcaccaaatacaaaaaacgctaatcttatggttagcgtttttttcatttttatattggtttttaaacaaatgatgatgttaattgcattattgactgtagatataaatttctttacaaaaaataaattatacttgcttacaaggaattttggttatt

SEQ ID NO: 62680 - DNA, 12781 bp, Oryza sativa
acagatgatctgtctcatctagtatcctgcttgaagcacaaacctgccttttagttaccatggcaaccctgaggccttctttggataacaaggcgacatgttatttcctacttattagactgcttctcaattccaacttatgtttgcaactttgcatatatgacattcctctctttatctgtttcaagagaaataggtccagcacattgggaggtctgactatctctatagcataagctatacagttaaggtggcccttgcatgagctaatagaaagatgtgcctgcagtgatgtacccatgcatatgcgttgttattagttgtaacctaggttctatgtagctaacctgctaactccacggtacaaacatgtgtcattgcatcttagttggaaatttccaatcacatatttctgctcccgtatgtagcatccgtctccgctggcttttgttaacattgctatataccatctcagttaaaaccgcagcatctttcctgccactgaaggggtgttttagcagctactcaagaaattatttagattgatttttggctaaccctgatttaattgacaggtagctcgagcaaaggctgaacatgccatgcaactaaaacaacgacttggtagtgccttgaacaatggtgcaggatctagttctagtccactgatggttacacttccaccaggacaaacagctgccatgatgcagaattcagctgcaatgccaatatttccccactatcaaccactgcatccagcaacctcacttcctgccacatctagtgctgttggtgatgagcccaaaaaaactgcagcagctatggcagataagcttgcatctttgtcagctcctgagaaggtgctctcctccattttctcgtcccttgctgctgaacaagcaaggaatagtggttcgacttctggagatctctctgcaggacctccaggctttgagagcaataagaagcctaggcttgacaaccctattcatgtgagtgacatgggtgctcccccattctttgggcaagtaccacaggtgcaaccacagattggagcaacagctgctcttggaggcacacagccaccaacacaagcaaaccaagcaaccggttcatttccaccacctccacctccattaccacttatgccacaatttgttcaaaatactggaggaatgtttggaatgggaccttttgggatggtgagtggctctgcgccgcctccacccctattgcccaacattatgtcagcaggttttccaagactaagcgcgcctccacctctgcctctgcctacacaacctcagaaccagagtcagccccagcagcagcagtctccgcaggcaccacagcaatcgccgacctcgacaggattttttcaaccaccaggtgctggcttcttcccaccagtgcaggttcagcaatctccatctgcccaacggcaatgatgattctacaacaattgttgggctataaaggaagcaccttgtgctaactttgtatattaaacaataccctgaggattgatctgatagttggcgagtcctgcgtcgtgaagcaggattaatgcttatgaattgggaagatttgtaggataggcttgcggcttatgtgatgtacaactattccttttggtctgaggagttgttcaactcttcttggttatgtgaagttagttagactttacttttgtttgcatagccagatcttatttttagtcctgaggcaaacaaatgttggcattacattttttacttaaagaggtgcccaagtgaaaacctttttgggctcctctatggtagaacttacctttggctctgttagtttgctagagaagccatatatccatagatccttacttgaagttgtgaactgcaaatatttgtcatgttcaagtttatttgtttatttattttttattcaaaatgattgctatgcaagtttgctgttttccattctttcattcattctgaggatgtggctgggttgttagctcagagtaagggaggataattcaggggaggtgaagtctgtaccctgcattgtaaatacaagtacaacatgtcctctttggcaaggttattattgttcagtaatcctgaacaaaaacctcctagcttgtcacagtaaaagtacgccggtaggaacatatatttgctgggtgcttcaggtatatgaacacacaactttgatatggccaccctgagcaattgtggatcaggaatacagactgttatttctgctgattcttgttccagtctaggcagcatggtcccaggaaatagcccattagcctgtgaaatagaaatgatttggaagaagtgacagatagggagaaaaaggaagccaaaaggagcccacaagtatcattcacatactgatctgaacaacggacaagaaattgctgttagttccccaattgcttattctcggtgaattgaaggatacagcagattaagctagcttacctaacggccggaatgtgagtcatccagctgattaagctacaagctactaagctagcagtttagtggaactaatgatgaaactagcgagacgatcttaactgtagtaaagaaagctgggttaaaactatctacaagatgggataaatcataaaactcatctgcaaaacttttgctaactaaaacggagagcagaatccaggaagaagctgaaggttgccgggccggatgcttctaattgtgcctgggattgaagttggtcccggggttgtgcttcatgctggcgtcgaactccaccttgggctcgccgttcgcctgatgaacgccattgactcggaaggtgttggtagccattgccgccggcgccgctgccgtgggctgctgctgctgcagcagcaacctcctgctactcctagcagcagcagcagctactgcattgttgttgccgtcacgcaacaagtcggtgccgatcgttggtgatgcagcagcagttacagagaggagaagatggagcaagaagatggcagcgaacacgcggtgcaaagccttcttcttcatggtgatgatgctttcttgatcagccgtgatgtggtggtagttgcagtactgtgtgcgtgtatggcagttgagcatcaagggggagcaatgctggcttatatatattgttcttttaacttgtgttacagatacagactagcttgattgcagtagcagtaacatgcagatgcaatgtgcaggcgcgctgcttccactacttgggaacatgcagagaacatgccacacatttccctgtaaattttagcttctgtggaatattttgttaagaagaaaggagtcatgcatcaagtgggtctggaacatgccaccctgagacctcacttttgttttgcagacctcaaatagtagtgctgtttctctttgactgaaaaaactccttttccttgagattctcagataatctagtccataaaagtgcttcacattaagcatatgatccataattctttctagggatatatgcgtgagtgccgaccatgtgaaagatgcttctatttgactaatagcatctcttgccgtcaggccggcagtatacgaacaactaaatacaacacgttcggtcatgtgatcagatcagacattcgtttttctttcaagagtacactcaggatataaaagaatctcaataatgttgtatgcttcagattcagatcgggtagcagctcatcgtgcagagtacggctgatcggccgcaaacatatcgtacacagatagcactgtccacggtttcagaatcaagtttttagacccgggcaagcctaacaataacatcagaaattcagaattcattccttccttcctctcttaattttgattttggacagtatatatattcagttcaatgcttatttcagaagaaaattatccaattcagtaatgaacctacatttttgtctgaaacattcgaattgtaggtctatatttgcaaaactgaaacaatgttgaatactatgttaagaataattcttactaatgggatgccctggttaatcataccaagtggaaataccatgatgcatccagtactacataaaaatgcctgtccacatggaagaggctggccatggaccatctgtctcctaagtaaacatgtttgaccataaactaattgccaagtgaaatgctgagcccttcaatcattgcgaagttcatggccacttctacttgaccgtaattgtagatggaaatatggaatcacatggataacgcatttcttcatattacaggaacatcaatgcataccaaatacctgaatctgaagacagcttgagtacatgactattattattatgtcattgcagttttcatagtttcacattttcccacaggcaactgtgtaccgcgaactttgacaatgaggtagcaactattgtcaatgttttaaatatgattaaatataccaaattcaaatgtaatgagcgatactatcttttttgttttttcgttttttgactagcaaagttcagccaccaccaactcctctcttcaatccacataagtccacagatttgatcagccattcgtcaggcttaacttccaagttggttctagctcctgtcaatcattctaacattcttggacttccatagtagatggcatatggaacatgggacattagaagagtggaaatcaacttgtctacatttctaattgtgtcacatgctcattgtatgactgcaaaagggccttctaaaatgaataggaccatctgcggtctctgaacttaaaattggaatgttctaaaggtctgcaaggagctttaaaattacctacacaatttgcaccatggatacacattttgtggcaagaatcgtttttgagacaagctgaagactgacaagaacaatatatgtcatcagagtcttgacaagctagaagcaaaaacgctagacattcggcaggagacgtactgaatttatatgcagaaaagcaaccgacagtaagttcatacagtctcacagatcatgcatgtggttagaaacaggccaatcttgtacaagtggaatatgatgaaacacctatcatttaggaaggttcagggaataaatatcaaacaaatatgcttcttttacatgattcctgtaactaatgcatacattggtgtttgcgttttcatgtctagaaacaaagatgctttagtcttgcgaaatatacaaattttgatgatattcagccagagataagctaattcgctgcgcctcaaaaccggaagctcaccaagggggttcggagttttcgactccgagcccccttgggtctctggggcaccgtcggatcaggcttgtgtggtccagattgagtagatccactccacggcgtgaggtgtcagcgacttgtttgggccgtggtgttgcttgctgggcttgaggtccagcacggacacatgtgtaggcccaacctcacacttcattgcatttaggtgtgatcaagatttgactttgttggttataaaacagtcccgagtttcttaaattttggttacatggatgagccgctacttcctgtgatggcatgccacatctgtatactttccctctggtaataagtatttggcgtttgggaacatcatttgtccaaacctttctcgggcaaactttcaaactaaatatttgagttcagatcaatgatggttacctgccaataaccggttactttttccgaaaccaccggctacaatcacaaaaaatgaaaaatgcatctacaatagatcaaaacaactgtacaattaaaatttgatgtttaaatttgaatctagaatactccggccagcctagagaaatattgacgatccacgagcctagaaacacacgatcgatgactaagcctagaagttagaacatgagatgcactttcacttggactatgagttggatcgacacatgcaagaatattgtgttgcgttaaagcagcaacattttttgttgaatgttgaattttccctttattctgaacgagaacagcaatatttgatgaatattcgaatacgactgaactgtttgctgttgcccaagtaaacatttactaaataattagactcttagttttatttcaaacatcgaaggggatgtagctcaaatggtagagcgctcgctttgcatgcgagaggcacggggttcgatcccccgcatctccagtttttattttttttaaattccttttcttttgtctaatttaattttatgtttttctctaatttaattctatgcgcttctaaattcttgtctaatttaactatgtactttttaattccttttcttttgtctaatttaattttatgattttttttctaatttaattttgtgcgcttctaaattcttgtctaatttaactatgtgctcttctaattttctagtgccatattttgcctctaatttttggtctaattttaattttatgctcaccttattttgtatgtgaatgtgagtatgtgacacgatgaattcttttgccttttttggtttaatttagttttttgagcttctaaatttttataacaattttttatgggattctctttagtactttcctttagtaacagcggctgacagcttggttccatcccacatttcaacgacagctgctatagcctattccttccgtaaaaaagaatagttcatattcgttgtttttagggtaggtcatattatattataggttttttttatagtagaagtacagggctacaagtgcagtatggtgctatggatatcctgcctgccgtatcgtatatagttcatccccactaaatatagttaatgttatttctctcttctcttattaagtcatattaataagagaagagagatatggtttaaattttctcttctttcttctctgcaatctcaattatctttaggcttaaaatttataagtattaatttatttttattttaataatcatattatatctttgcatattatgtaacttagttcattttccacagcaacacggcggggttttcatctagtttatattaagaactcatccaacgtgaattccgttttcaatgcttgttttaaagaaagattcgatgagtgcattttttttaagaacacgataagtgcagttgctcataacttcacgctgaaaaaacgttggcactttgcaatctccattttgcattttacaaaaaatatgtcaataaagagcctgttccctttgatgtcattttcaatcatatcttttttttacaaagttatcaaaaaaatatctacgtttagtttgttgtcaaatttagtcaatacataagaaatcatgccaaaattttgataatattaccatcttgctaaaattttagcattaacaaaacttgataagatttattttagctataatctgaacaggcccaaaaagtaaaaaaggcaaactttttgaatataagtataaaaacaggttaatttattcattccagtgaagagtctaatgccttgtttagtttccattttttttcaaaaacgtcaaatcgaatctttgtacatatacatggatcactaaatatagataaaataaaaaactaattgcacagtttatatggaaatcgtgagagaaatcttttgagcataattagaccatgattagctataagtgctatagtaacttatatgggctaatgacgaattaattaggggcttaataaattcgtctcgtggtttctagacgagttctgaaattagttttttcattatctaaaaacccttttcaacatctaatcaaacgtctgatgtgacacctataaatttttctttccgcgaaggaaacaaggcctaattaatgttgcgttcgtttatcccatgggcgaagcatccgaagcctcactaaatctgtgtttagcacatgcgattagcatcaaccagcccagaccgaagcatctcctcctcttcttccactgtgtgactcgcgcagtgtgatgtgtgtgacacgctgtgacggctgacctgacgaggacaggcgaaaagaaaacttgttttggagggagctttgactttcccatttcacttcatcagtttccctcctccattttcgattcctcctctccgcaatccaaacctcgccgaattcatggcctcctcggccttcaaatccaccacccgccggaccctccaccccgccgccgacgaccgcccgccggctcgtccccgcaaggccccaccgccgtgcccacgccgctcccgcagcgccagcgtcgagccccgcgcccgcggcatcggggagtacgccgccggcaacacccgcaccaaccctctcttcgacgactccgcctctccgccgccgccgcagccgcaggtggatacggaggctgctgggtgtcgcggcggggaggcgagacgggagagggggagggaggtggcgcggaatggttcgtgcgccggcggctccgggagggcgcgctctgtgtccctcgcgccgcggggccggggcgccgactcgtcgccgtcgtgggggaatggtgatggaggcggtgggaggagggcctccagggcgccgtcggtggcggtggacctgcaaccttatcggggtgacgaggttggtttctgatttctcagcggactgggggactgggaagtctcaagaaaaagaaaactcaaacttttttcttaccactacttttgcaaaactctatttttttttttgcaataggaactggaaagaaatatattggagtactttgtaattctgatatcataccatatacatgtggaatgaaaacaatctctctagattctactatatgataatgaacaaaatctactgttttttttttcgttatagtaagtagaaagattcatagtaatctagttcacttggagttgtcactgtagaagcgcagagaaattgagactcggtctttgcattccatctccaccaatcctttgctcgcaagttctgttcttgctaaattcgaacagagtgatgcagaaatcagagatatgtcaatagaatttcagttttgggagagtatgcattcagtttcgagctcagtagaggtcagaagtgatcattcacttgtactagtggaccataggctggcttttttggttcagtgaccaaagtggtacatgaataggttgttgagttgtattaattgatgcaagatattaactttactagcaaacaagtttgtaagctactatgcttttttattaccaccagacatgccaacacatggctggaaatatccattcagaatctagaagtgccttcttaaaaaaaaaaaatctagcagtacccttgtgagatttatgattatcttgagcatgtaaggattacctatgttaagctaagaatgtctttgaccatttatgttctgtgcatgcttataatttatccattttattgtctccgcaccataccccgttctgttttagaacaccaatattgttttacactcatgttctcaacttatcgtgatgctactattattctttcatcgacaggtcatttggcaaagcaatcattcaaatgtcccagtgcaacaggttattgaaattcctcccgagtttgatccagattcttctgagtttgtctccgacataagtgattacacaacagaattcaaaaaggaggaaattttgcacattccttttgagtttgatctagatagagctgatctggctcctgacatagagcaccattcaatagaactgcaacgggaacaaatggaaattcctcttgactttgatccggacagtgccgagctgtctcctgatataacagagtatacaacaaagctcaaacaggtctgactattattatgccaagtgtgctgcgcctccaattctgtgcagtcaacagtcataaccttttactgctttgattacagtcacatgaacgtgctcgaaagctacgggcagatttagctgtcgaagagcaacgtgaacaagagttgagtagagtgctgaagggtattgtaactacaccaaattttactgaggcacataaaagaaggccaagacgaaaggtaactgcatcaaattttaagtatatttgattctgtttgttggtaaactttctattcattttgtcttggtatttgaactgacctttgtctccatgttgtggtaccagagtagtgtagaacgactgaaagtatcgaagcatttggctgaagaggcaatgaattattttgaggaatgtgtctcgatctcgacattggatagcactgatttctcatcactggaggaccctcaaataaattcagttgtgaacatcccacaaaagagcagaaatacatcttttaacaaaggtggatcaagcattgcagaaatccactatccaacagatcgtcattggcataatgaggttagcaaatcaatgctgtttcacttcactgaggctttgagatttgtagtactttttaggaatatcaacccaagtacccaacagcctccatcattcttttaaacatttatttttttattatgtggttcagaaatagtacagtctttactctctgttaattggcatattgcagctattttcatattcctattgttatccactcaaatattcctgaattgtctacgttgtacttaatgtgttgtttcgagtcatattacatattcttgttgatttcccagcagcattttagtagaatgaaaagtaggtctattttgtggatagtaacgatcattctcacactataacaagtacttcttgccctcccaggaatctgacaaccaaacccagtgctcagttagcttaactggatctgatgtgtctggaggccgtacttttagtcataatatgatgacccccgtttcaagaactacaaataactcaagtgatgatctcgatggctttgacacaccaaaaagcagaagttcttgtttctccttcacccatgaaccaacaaaaactgttgagggcgacgacgttcaacaatatttaagaagttttggaaggggaatcagtaaagatctaagagagataaggtcaagttattgtgatgatgactatgtatttcagaaaatgaatgcagacttacttatggatattgtgacatttaagaacagggtaaattttgggggtctccttatttgtaatattagaagatagtgagaaaacatcaactagtgcgctatggtgggaggactgatattcatattagcaacgtgcaattagtactactagagatgtatacatgttcatatgattctatctactaattgtgatttttttggtcatcgactgatatcatgtgatctgcatgctattttctttttaacctgggaataattatttgtaacattagaagatcctgaaagaaaaaaaaatcaagtagtgcgcagtggtggaaatggaacgtgcaattagtagtgctctattgtatatatatccataggattatctctactaatgattttttcgtcattgcattgctctcatgtgatctgcatgctgttttgttacttgggaataatctgttagtactataaagaaatattatatctattcttgtggatagctctgaaacagttcgcatttgattctacaacatccatttctatttgcaatatctttgcacatttcatcctttttaagttataccaaatgaaaaccagaagtttgcatcgactgctgttggcagctgtctctgtaggactatgttacatggaaggacacatgttttaaatccaattcatgatttaatggtgtttcttctgaacattgaaatttgatcattactacagtaataccaggagagagtgtgtgctttattggatattataacaaattggagtgcaagctcattctagagatggtttggttccatgaaagcttcaggtttgactagtgctgttttgtgttacagaaatttttgtacgatatgcaatcagtccgtggacggttgcattgtcaggtagcttgcaagcaagcatgtttctggtctaatgagggagatgttagatggaaaagcttggaatttcttttatcttgattgaatatttgaataatctggcaacctaagatttatcttcactctagcacctcaaatgcaggcaaagtagatgagaaacgtgtttaacaaccaaaccaaacattcaccgtaccgtactgcctgtactacaagaaacatgtctctctttttttttttttagaatttagagttgagaatattcatatttctgcatcatggaccaccctatactacataaacctagtgttagttgttgtgattgcatgtcttaccctgctgatgaatgtgaacaagctggacggacatcatggtggtgacacaagacgtcagtcggtctaatatcgacagtcagtcaggagtcaggttactaatcatctgggcaactgcagcagactgtctagacaaaaatgtggtcagaaaacagactcgtgataaaccattttggtgagtatgatctactacaaaacaaataatttggcagtcaggcatgggagcttaattgggatgactaatttactcaaatattgaggtcatcacggtcagccatcaaaccgtcatccacggtacaacacaacacacatgtttcacatgatctgtagtactccagtaatacagcatgagtaattgctgaattttctaattgaaggatgcactgtttgtttgatgattcttcatcgaaagggggtcgttgcatcggagctacagtagatgcttgttgtgtacagtaattgactgactgcacacagacacagtaggttgctctgaatgttggggacaggtgttgtggttgcatggctagtaggatgctttcctctgaatgaggaattgcatattttgcat

SEQ ID NO: 62681 - DNA, 13456 bp, Oryza sativa
  unsure (1)..(13456): unsure at all n locations
aggtccatgtccgtgtggtggaacgccggaagctgcgtggcaagcgcgggaagctgcgcgctggcagacaacgtcggcgcgcccgccgcggcggccgtgacatcggacaggtcgccggtgacatgncggcgcggcggtggcaggtccatgtcggaggcggggcgcttgcggaccatggcggcggcgaggtggtgttgttcttggtggtctaggtagaggaggagatggtggtcggaggggagaggaggcagcaaggaggtgatggcatgagaggaggaggagggagaataagaggagtgggtggcggaggaggaagaggaggggaagaggaggagggaggaggagcccatctacaaacgccaaggggaagaggccgtgggcatggcgagcggacgggcgtgcgcgggaggcctaacgcttgtgttgggtggaatttttatggaatttggcgcggcgcaagcgaggcgatggcgcgaagggggagtaaagaggaagaggccgagaggaggagaccaagaaggagaggttagcaggagcatatcacgagcattgagggggtaatttatgggggaagagaggcaacgcaacggcaagctgtctactggactggactgctaccagcgtgtcatttgcccttgggctccgtgtatcctttctttttcgttttctttttcacctttcccatggtagattactcgtaccgatgtttgtccctgttgtaatgttcacacttagcatgtaataatgcctttgtcaatatcatgtgtactgtctacaagtttcacactacagttaaaaactgaaaactttgtaaagcagacctccaaaaatcaagagtaaatttcacaaaactacagatactttgatcaaactatcacaaaactacagatttaagaatgtatttcacaaaactacagatttagagttaaatttatcatggaactacagatttaaggtattatatcacaaaactattgatttaacaactattttattacaaaactacacatttaaaaactattttatcacaaaactacaaattttataactttaaataaataatagtgctatgatctaaactctagaatatgtagttctttgataacttaatcactaaatctgtagttttatgatatggtgcattaaatctgtagttccgtgaaaagtttaacgctaaatctgtagttttgtgatacacattcttaaatatgtagttttgtgataatttgacacaagtatctgtagttttgtgaaatttactcaaaaatcaattgtggatcataagtaggatggagtataagggacctctcaattaagcgcccctttgaatcgtaggaatggaaaaatggagtgtcggtgacatgggaccggaagtatcatgacttagagacttgaggcagacacgatcacccacgtggcctaaccccctcaggggggggggggtcgggcccgagggtgatacggccgcccttaccccctgcctcgcatagatcagattgtcgactccacagcggggtacgaccttttgtgttttctagatgcatactctggttaccatcagattcgcatggctagggaggatgaggaaaaaactgcattcattacccccataggaacttattgttatacgacaatgcccttcgggttaaagaatgcaggtcctacttttcaacgtactactcgaatttctttggatagccaaataggacgtaatgttgaggcttatgtcgatgacttggttgtaaagacgcgcaaccaagagaccttactctcggatctagcggaaacttttgagagtctccgctccgcccgcataaaactgaaccccgataagtgcgtgttcggtgtacctgcgggcaagcttctcgggtttttggtctctgctcgaggcatcgaggccaaccccgagaagatacgagctatagagcggatgcgccccccagcaagcttagggatgtgcaatgcgtcaccggttgcatggccgccctaagtcggttcatatcgaggctgggagagaaggcgctacccttatttaagctcctcaaacgctccgggccgtttacttggacggaggaagctgaacgtgccctcactcagttgaaggcgtatctcagttctcccccagttctggtcgccccggagccaaatgaacccttgctactctacttagcggcgaccccgcaagtggttagtgcggcgttggttgtggagcgcgatgaggacaatcctcattccgcgcacccccaccctgtgctggcttggcccgggagagagcagggaggagaggcccccgagccgaacggtggcccaaggcccccgacgaccggagcaggccctctgcccgcttgtcagacggtgccaggtgcccccgacccccaggatggcccgagggccactgcgggaaggccgcacctatcgccctctgaccccgaggctaaccctgtgccgactcgacccgggagagagcagggagaagaggcccccgagccgaacggtggcctaaggcccctgacgaccggagttggccctttgcccgcttgtccgacgacgccaggagcccccgacccccaggacggccccgaggccactgtgggaaggccgcccctgtcgtcctccgaccccgaggtcgtcggcacagaagacgagtgcaccccgcgaggccgcttggacaaagagcgccccagggatgtggcccctagcgaagaggatcggccccaccgaaaggtgcagcggcccatctactttgttagtgaggccctccgggacgctgagacccgataccttcaggcccagaagatgctttacgctatcctgataacttcgaggaagttgcgccattatttccaggcgcatcaggtcacggtggttacgtcttatcccctcggccaaatcttgtataaccgagagggtactggacgggtggtgaaatgggcaatcgaactctctgaattcgatttgcgctttgaaccaagccacgcgatcaagagccaggccctcgccgactttgtggtggagtggaccccagctcccgagctcgtctccgcccccgaggccagctcgagcccatcgcagctgtctcacaccgccctctgggtgatgtagttcgacggcacctataggaaccggccccacctgtcaccaggccttagaagtggcgtcacacccgaccgcttccctcgaggagggcgatcgccctggcataacgccgggggctactgtcggtgacatgggaccaggagtatcatgacttagagacttgaggcagacacgatcacccacgtggcctaaccccctcggggggggtcgggcccgagggtgatacggccgcccttctctttgtctccccgaggggtcggaccgctcccgtctcggccccgagggccgaggcgccccgaccccttgtgggttttgcgccgcgtatatggggtaggtgagcatagcggggctcacctaaccacatttattgcggtttggacgagcgcgtcacgccgcatgtaacgcagtgcagcgcactcgtttatctggtctgtgaccagtcacagaccaatcagattgcgggttaggtggcgacgggcggtctgacgcacgcctcgccccatcccgtcaggatgagagcctccaaacactcgtccctagccggagccggcgtgttagctcctgggggtggcacgttggacccggtcagatatatgccaggcttcatcctaaccattacaagcaagacattgtatgaagaggggcgaacatgcagattgataaactgacgcgtggtggacaagaatgaccgatttgtgaccggtctgacactggtcatgtcgtcagcagacaaccatgttcccacgtcgcgcctgcttccggcggaagtggaggtaggtatgggccgtcccatcagaaggtcattcggacggcaaccatgcaagtctccgtctatttatgaaaagataggataagtccccacaaaaaaagagagagatggtgcatgtggtatccccttgaggtataaaaggaggaccttgtccacttagaaaggggattttggggatcgagaacgatcagagagggagagagtaagagctctctggttctccagctctttggtagcttcttcatacatagatccaccaaaacacaggagtagggtattacgcttctcagcggcccgaacctgtatacatcgcccgtgtcttgtgtgtttccattctcgcgaaccttccacacaccgagagcttagaatctcacccagggcccccggccgaaccggcaaaggggggcctgcgcggtctccccgtgaggagccccacgctccgtcatctggcgcgccaggtagggggttctgcgtgttggaggaatagaaaaaacataggattctgataagaatgtagttgtaaaacagaggattggaaaatacaggaaaaataaaggaatgactgtttgattggaccacaggaaaaatgcagaaatcggatgagagagatagattcaaaggaatttttccaagaggttggacctcttgctaactttcctccaaaatctctataggattagccattccataggaattttaaaggatagtataggattcaatcctttgtttcaaaagctttcataggaattttttccataggattgaaatccttcaaattccctacacttttcctacgaatcaaagggggcctaaaggatttacataggaatttcatatgatttaaattctagaaaattttcctattttgccatttgatctaaggaactgaagctttccaaatcatatggaatgactcgttatatgtcgatttcaaaggaaacttagcgagatctcaaacctcttggaaaatttcctttgactatatctctcttatccgattcatgtgtttttttcatgcggtccaattaaacgattatttctgtgttttgcgtctttctgttttacactcgcatttctgtcagaattatatgtttttcatattactctgttttttaaccctacgattcaaagggccctaaacatttcacatttttctcctcaaacatttgggggactgctaggaacgtagaattaaaatatcatgacaccttaaatccaaaataaatagaaatatatagaaaactgtggaatagtttggatgaagcacatgaaaacacacgtgatttaaaagagagaggtaggttccgacaaaaacaaacatacgatccatatgaacttcaaaggaatccagagacccaatcattcgttccaaagagccttataagaatttttctaatgagatttagggttagtttggtttgtaacctaaatagaccttaccaaattttgtcaatgccaaattttggcaagttttggcatgactaattttggtaaggtaaagttgtgtttggattgaagccaaaatagtctaagttcactattgaaatggcctatttttcttaggcatgccaaaatttggcttcaaaccaaatagacactaaacactattgaaattaccaaatattggtaagtctaatttaggcctgaaaccaaaccggcccttatatcctttgaaatttcactatttttcatgtgttcaaatggagctatgatagaaaaagaaaagaaatggattgattctggtgaaattttagtaaactcctcggtccaaaggagtattaaacaatgtccaaagtcgtagtttgtcatgcgatgcattggaattaagtgaggattggttctttcacatttccaattctcaccagagtcttgaggcaaaaatttcaaatactaaaatacggaaaatgaagaagaatattactgctgaaaagtgtgtgggcattattgtgacgctacatcgatctatcgtgtagaaactagtagaaaggtagcgactcctttggttacgcctgcggcctgcctgttgaccgactagcttgcagagaacaaagtttgggtacgcacgcatgcatatttgttacacgccgcgacatttcttcttcttggcccgataaaaagggtctttgaaacgttcttgtcaacgagtcttttgatcgatccatccatggatcattcgatatgtacgttgttggggtcggcaggcccgaaagatggccatctccatcagaccaggttagataattcatctttttcactaaaaccaagagaaaaggctatctagctcatgttcatgtagtagagctactaccttggtactcccactgtccaaccgatacaaacatttctggcatataaaatttatccaaattctgttatgatatcttacatttacttttttttatcggtagcacgatctttgtgggtccaaaaaaaactttcaaggataccaaagtagtttcaccttgaacttaatctctgctacaagctcaaagaaataattatatttttgtgaacaaagagagtaatcaaatcaaatcattttaaaacattatttttttaaaaaatatgacagtcgaattaacaagtggtaaaaaaaccaaatcgaactaccttgtggatgaaggaccgaactaaccgcacacaagaacaaaaatgaaggaggtgcggagaatgccaacaaagcgagatggggacagtgcctacgaatggaggccattgcaaatgtcacttgcggaggatgcgatggacgatgccagggtagagaccggcatagctggtgatgcaggttgctatggacgaaacccatgacgaaggatgacacggagggagctagccgtgaaaggatggggaataagacatgctatgaaggtgttgatgaaaaacacgagacctgggagatctgcttaactccaatgcaggtccaaaactcgccttcgggtatgcaagcgtgccagttgatttgatcctgcaatcaacaagaacaaagacaaagaaaccgcggttaaactcataaacgatagccgatcggctaagtgccgatgacatatcatttatttttgagccgatgtcatatatgcatcgatcggcaatcgttaagaaataactaaatctactcgatcggctgtagatattaacgatatataatccttatgtcgatatatacttaaatcaagtgattgggatagatcggtcgccatgccgagacagtataaatcacttagatcgaaatatatactaacaatgagactatatatgttcatagcatagccgatcagatagatctagcatgtatcggctaatactccgataccactctatattaagatatcaaagcaaataggatataccaaacaaagagcctaatatacttaaatgcggcaagatcttaacataaagggcagatttaatatgtcaataaagcatataggataaaagcagttaaaccaggtaagatcggctaaaaccccgatactaccctaatcggcaaccaagaagcaggctagagattgagattctaatcacgactcataagatcaaacaactgatgcagctataagtatgaaaagaaagacaatatctagacaatcaaaccattggaagtttcatagagtggtaggtaccttaggtaatctaagtcaacatcgatatctaacctaatcggttgtcctctacagacagatgttagccgattgtaggttaaatagcgatattgccagagattatgtaagatatatgataactcgacgaattacataaacaagattagagtatcataaagatggaagcactaatcccgagaacgcaagccgccataacaagttttacctcttgttgaagatcgaaaccgatgcagctcaaactgaaagcaagaacccgtcgaaataaaacgaaagcaaaaagggtggcgatgtgtcgagattgtattgaacgtgtgttaatttgattacatagggctcggggtctatttatacccgagaattacacaacatgtccataacggacacgactcttatctctaacaaactctaagataccataagtctttgcggtagacttttgtccaaacatatctctaaggaaattacataaaatatcctaattaatagatacaattgccttctcaggactctatccatgcacagcaatcatcttcaagcatatcaactcaacccgatgacgtacaccaagtcgtattgtcagaatcggctatatcgtctaacccagtctgactcggacttagccgatcccgatcatagccgatttggactccagccgattcccactctgttttcgggacgatctccatctcgaattctactttgattctatccctatctccgatacttagattaccaaatttggttgttaacagagggtcataggggccagagaggggagcaagactaaagacgtagtggcagaagatgaattcgatggattgccgaggccggtaggtgcggggtacctatgccacgccttgtgagtgttgaagggttgtgatgctagcgttggatctcttagggatttagggttatactttcatgggccttagttgatggtaagggtgaaaacggtcatggaattttccaatcgaccgagctttgttttcgtataaggggtaccatttccgaacgtaccctttttagctatttataatttttgttttttctaatttttttatatcatattaatatcgacactgaatagtttaaatgataaatatggtcaattactggccgattgagcatcatttccgtacggacttggttcggcatcagcttggttcggtacggactttggttaatttgtgctcacccttaatcgaatgtgactttccttctttgtcggcatttcaacagctggcccgagatgtacacacgcgacttcccatcacggcacgtacctcaagggttaggtttctctccactacttccattagcattacaccgtcttaaaaattagtatttcaggcttgattaattaaaaaaccgtctttgagctgaccatttcaaaaacatactccttccgtccaaaaaaaatatctggagagaagcctcccccgattcgtgttactagattatgtctcatcccaattctaggttggtttttttttctattaaaacatatatatggaataaaggcatattattttgttcttttgaaaatatttatgagatgaaaatagtagtataagaaaacacccttcatcgaccactcaggcttgacaatactggtagttccaccaggttatccccgaaaggatagaaaaaccacctcatgtttaatgcctagaatatgttcatttcaataccattgttcattgttcatttgacgcaggatatgagagattttgaggctacgtaatctggtacgcataacaagagaagggaagggtcaagggggggatatggggaaagatggcagtaggtagagagggtgctttgtgcattggaccccggaaggcaggcaggctttctggcactgtcttcttcactcgtcgatccactccacgcgaggatcgatcgtcgatgtatgtatgcatcgatcctgttttcggggtggaaagtgtctctccttttgttggtccctccctgtccaattctttcgtcacttgctcttgttccttctcattttgcagcctcatctcatcacctgctgcttgcctcgtgccgtctcgatcttcttcacgtccatccaacgcagctcactccaattatactctcttaccaatgtagttggagtactacacatgtgttcaagctggcttcaggtaaacccccaaccataaacaccatgcatatatgcatgcagagttgcagacatgcatcagttgctcttcctcttgctaagttgctatctccattgattaggagtttagaggagtagtcagctgagctcccgtgtcgatcgatgacaacggtaggatcgatacgcagttgcccttttactgcacttgctatagctgctgcacaataacattggcagtgttgcatcgagccaatattggctgcactgggtagctagctgcacgctgcttcttcctgcgctcttctgtatatatgagacaaacaagcggcggtgctgcctgtaactgactcaggtcacgcgctaatcctgcggctgccaatcctgctcaattcctttgtaatcttgtccataatactactctgtatgtctgtatcgctcaccgccaccgatcgatcacctggccgaggctgcaatgaatatcttcacgattcgcataccaggagtccaggactggctctgctcatcagtcatcaactacaaatgcaccaagtacacatactgatactgtgtgttcattcattgagcaatactgctcgtgattgtacagtctgcatcacctacaaatgccatcactggcacagcaagcacgagtaaatatggtgcttgctctctgcttctgttcaggcttttaaaatactggtatggtactccagccttttatttaagaaggttgcaggcttaacagtgtactacagtatagcagcccgtttaattggctagacaagctagtaataaggtatgatcaattcgcatcagtagccattgcctgtatcaagattagcaacaatgcacacactgatcattgacgcatgcaatgcattgtaccttcattcaattgcaattgcctgagatgatgtaggatgattaggacatgttcctgctgcctactgtttagtggagtaattagtactacaacagtgtactaattaaagtagcagcagtatgtatattcaggggatcattgcaagtagtaggtcaaccatgacactgatcagtcgtagcagtaaccatcactccacagattggaaagtctagtgatcagcttttaactaattcctagccatctcgagaacaaaacagacgaaatcatggaaatattcgaaatattatactgtaaagtggtgggtcgatcaacacaggcactagattaacatcatatttacgttacgtgcaaccgttttctatgaccactacttacgcctagcaaactagccatcacagacataaattgcttaactgcatctataaattaagatcacataattaagttttggcaaatggcaaaagtgtatctctgacatcaatttacagtgtaatattctctacgtattaggctatcttttctttggataaacattgaacttggttgtattaactggaacacaaacactggaagggtccgaagaaatattaggctcttttaggcttcaatctgttcaagacattacttaattgcctagcttttttttagaacagttaattgcttagctaggtcactgctttttttttttttttgaaaaccgctaggtcactgctatgatggcgtccccaatttacagccgtgagggttagtacccttttttgtgtatataaaagaaaaaaaaagaggaagtagtcagtagccttttaggtgagacttgactcgatctagaaagcttcggatatactagagtatactcctttactatagtaacaaaaatcctttttgtattattttttttacttgtcactaacaagtagtaacataggagtatgcatcaagataatctttaatatttaccatagctaattttatttatagaattttttacgttggaaggggtgcgagtatttctttttcacgtcagtcgttaggcggagagtgaggaagaagatggaacatgtgcatggggctagcgacagaatcagtttaaggtgagaggttttttcatactaggaggggatctagagtgggagagggcgcgcttatgacttaatgtgagagtaggagtagcacgtagggtgttgtttagtgctaccgtgaattactatagctgagtcgtactaacttttttggttattttttaacgtagtagtacgatctaaaaccagcgtgaacattttgcacatagtgaaattaagacatatcttcgtcacataaataaaattgatcgagaagctagctttggcttatttcattatattattgatagagaagtaaacacgccaccaacctaacaacgggtaaacaccagcagaaaaggtatagcaatcaaatacaaagcttaagtaaaaacatgagagagtatgtatatatatatatatatatatatatatataggagcagtaactagtttttgggagcagcaaccagagtcgataaaaatgcataatactttctccatcctaaatatttgacgctgttgatttttttaaacatgtttaacctttcatcttattcaaaaacttttgtaaaatatgtaaaactatatgtatatataaaagtatatttaacaatgaatcaaatgataggaaaagaattaataattacttaaattttttgaataagataaacagttaaacatgtttagaaaaatcaacggcgttaaatatttagaaatagaaggagtattaaaggcaggcgagcgattggtggtgtggaattgtggataggaaacgatcaaggggtggataatttatcttgggtagggatggaaacagccaggctggggtacagtacatggaaaaagcttaaaggggcaaatgggatccagcaatcagcatacatgtacgaccatatatatcagagcaaacatacaaactagctacgaaacaaacgacttgatcacgagtgtatccatatatatatgcatgcttgacaagcaacaatatataatgcatcaagaattcaggattccatgcgaaatttctgatacgaatgcgacgcttgcatacatcaacaaataatgctgctagcacatgcagatgtagcagacgtacaccagatcgatcgatgtgcggtgcggatatatatttaatatttaattttgatcaatcagcgaatagctaatatgcagcaactggcgggccacggaccttcacctcatctcctgcacgacatgtgattaattgcttcaactaatattatccccaatgtattttaatttgtttttctctcgtacgttttgttgcatgcaatgcaagcagctacttcactaggcgcatggatgaagttcagaaagttcccggtttcggacatgttttgaaaaaagagaggaaaatatcggtcggaatcttttcgaaaaattttggaaacagaaatagattcgaaatgttttctcataatagaaacgaatacggtaaggctactatctatcgaaaatcaaaatcggttggaaactgttggattctttttcttggaattggaaacgaattacttttcatataccgctaattatctccaaccttctctagtctagatgctcagatttgtattgagctttgaggcggttggttgaatgaagatattttttttccgtgctttagatatgtttttcttccattaggctatgtcatactacttacaataatagatgaatatagttcttgttttttttattgttctcctggaaagtgagaggtgcacaactagttgtattactactccctccgatttctgcgagaaaatattttcgaacggtaaaagatgcacaactagttgtactactgctccctccgttctagcagaaatcctgaaaagtgaaagtgagaggtgcacaacaagaaaatatttgtgcacctctc

SEQ ID NO: 62682 - DNA, 8046 bp, Oryza sativa
gaggcattattactaagttatatatatacatgagttccataatgtaaacatattgtgcacaattttttcttactgaagagggaacaaaatgtcagagctgagtaagcagcgctagctgttttctaattcttcagagctgccattacagatccaagaattaaacataagtaacaataaactcagagcagatagatatatacaaattaaaatattaatgttgcgctatgctatacatgctggcatttgctactaacagctggtttgcatgtataattttttttcttagctaggtaacgtagatatatgctacgcgcatttttgtggttaatttcttttttttcttgaaactttttatttaatttgtggttaatttatccaacgccaactagcttattagtgtatatcacatgacaatatgacatcaccacatggcttgcatgcgccgtccaactagctttgcatatataaaccggcctggctgcacgtgattatctgacagtgtcaacacaatttctgacagtagttagctagcttgcaacaagctgtagtgctgtgcttgctagctgtgtgttaacctcaagcccgctcctaacttgtgtagcaagcttacatatacaagacaagaatagaaaattgattgtgtgctttgcacctgatagagatctactatctctcatttgttttccggcctgcagtgcaccatttcttatcattggcatcagtctaatccaaccaatgttgcaatttgctccgtgaaataattagtgacagtacaatatataatggtgcaaagtgcaacatttgcacaaaaaaatatatgatcacaatatgtatagagaactaacaggagaagtctcataaataaatggctcccaaacatgtatgtgccacaacatatcaacaatcagtagtagttagcaccaacaaattaattaacaaaacaaacacgacctttgtatatacaaaagaaacctattaagcaaacggaatatatatagacgaatgatctcgctagctacctaggaagaactaaataatgaagcagtcaacaaaaataaattgcacacacatatattcctaaatctcgatgatgtccatgttcagtacgtaattcagtaatgcagtagccgagcacaaaaattctcagaacgcagcagcatgcaatatatatgtatatgtgatcattactgtcgtgatatgtaatgatccccataattctctatcttgtactgcggcacgccaaggggattctgctgcgtaagcccagccatcgccgacttcgataaacccttcagcttgttgctgctcggcagtagagtaccaaaattcgggacagcaatgacattttctagggctttcaccattgctgcctgctgctgctgcaagttgtagtagctgcttccaattccatgggctcctccagctccaggcgtaatattccaagaagagacgtgctgctgcagaggagcactatagttgctgctgctgctgctgctgcttttgttgatcaagctgtagtagtttggctgctgctggaagctaacggcagtagtattagtcgtcgtcgtacttgcagaaacggaataaaccgcgttgttgttgttgggcggcgccgacaagatgttggaagagttgctgacgaagtagatgctggggtcaatgatgtcgtctagctgaaagaagtcatcgccgccgtcgatgtcgccggcttgaacgacggagctgccgctgttgggggtttcggcagagtactgatccacggctgcatactgtggttgctgctgctggttgttgatggcttcgtctccctgcttcttgtggaagaccttgcacacaacccattcgtccttgggattcagacgaaggtttgggtggtggttgtggaggttggcgtggagacggaactcgtgcatcacccagttggtcttggtgcccttgggagccctccccatgtagaacaccagcgtcttcttcatcccaaccagctgcttcttcttgttgctgctgcctccatagctgcttgtattaacagctgcaggctgcctgaagatctccctgtccttgccggtggccttccagtagccctccttggtggcccggttggttcgcatgccagttgggtatttcatgtccttgtggctgaagaagtaccattctttttcccccatcttcgccttgccttcatcaaattaatatgaaaaacaagcatattaacatcaagatctaattaactacttgtgcatctaaatataagcttttggatcgaagaagaaaagaaaaacaaatttgacttacttggaagatcccatggctcgcacttgttgaggtcgacctcgccgatgggcaaggaggtgaagctagggttgagcaacttctgcaggaggtagcttaagattacctcagcgtccgtcgggtgaaacctgaagcctggaggcaagaacaagcctccatcttgctctaatttcacaagggatgtagtagactccaccatgctagctagctagcttgctccctagcttgaattgaagctagactgaagatggaggaagcactagctctagctagaggagaaggagaggaggagatagcttggtggcacaagcaagaaaggtggagacgacgcgcgatgaatgggaaatggaacagaaatgaaggggacaaagccagcaagttttataatgctttgagaccttttccatggttttgaggggaaggccacaaaaatcttggttagcaaggaagacaagtcctcactcggtttcattatgataaagaattaatatatgtactatatataaagtgtggctcttgccaaactaagtattttgtggccgtcaaattaatcagatttatatatactacatgttgtgcttaattagatccccatctatctatattattattatattcttcttctataatcttataatccgttttgccagataatgctggtgacagctacggctaggaaccgacctaaaagaaactaactgtccggctggaaggcttgtgtggtacgattgaggactacttaattaatttccatgtatagtgctcagaaagatacaaatcactgttctcatctgctcatggtataatagcatgccgaaatttgttacagatgttcaaattaaatttatggccttgtttagttacaaactttttcttcaaactttcaactttttcatcatatcaaaactttcctacatacataggctgtgtttaattcacacaaaaattggaagtttggttgaaattggaacgatgtgacgaaaaagttggaaatttatgtgtgaaggagagttttgatgtgatggaaaagttggaagtttgaagaattattttggactaaacacggtcataaacttccaacttttccatcacatcgttccaatttcaactaaacttttaattttgacgtgaactaaacacaccctatgtaatttgccagtgaacatcgtaaaactattacaaccatagaacttcctaaagctggttatttgtttttataggaaatagtgagggaggtccacagtaattttttctttatttaagattgaaattcgcttactggaaaattcaacctatatataggacctagagaggtgctacttgagcattggaaccgttaggacaacccctttcgcaagctggttattttttgagcaccttaaccactattttattatttatgatctaattggaaagagaaactacgttgaaataacggttttgactctcgaacccgcacatattacttggcttaaggccgagtttagttcccaactttttcttcaaacttctaacttttccatcacatcaaaacttttctacacacacaaactttcaacttttccgtcacatcgtttcaattttaaccaaacatccaattttcccgtgaactaaacacacccttagtttgctcgaatgaggcatctcttctcccattccctccaaatgtactcatgtccatgagtacatttttgtcttccaaaattttcattctcccccgccccacaattttcaaactcttaacatttcatcagtcaagtacattgataccatatgtcatattctttttcactccagcatcggtttagaaacttgtctgtctatcattcttttttttaaaaaaaaagattctctctaattgagccaaaaataatataataatagttatagacttgtggtgtcctctcataaattatcagtttttaaagatgttctacaggctatagatatgatacatttttttaatgttcattagtaaatactccctcctttcaaaagtctaagtcatatttctttttacaccaagatgaaggtgtagttaattcattcatcatgtgacaaaatcaatgaacatgcaacccataagcactaaaatgactttttgggttctgatcaagaatttaatatagcacatagtgactacaaatagaacttagacttttgaaaaaatcaaagaatgaaataggacttacacttttacatttttggaaggagggagtagataaattttaagtgtcttgttgcaaaatttgactaatataattgtttttgtctttttcttttttagaaagagtttgtgcaggtctagcaagttgcaagaagtttttagatgactagctaggtcgcaattgccatcagctccaatgcacaggttagctggcctttccggacgggtggtgtactgtctttcttctcgtgtgtgtgtgtgtgtaatttccatgcatttatatcttgatctctttttgacattaattaattgctagtattagagcgccgagtcagatcctactatgttttatacgtagagtatgtacagctagcgtcgaggaagggtcgtcgtcatgggggagtcaataatcacatgcatgcatggtcaaagaaagaatctgcatgcaatcaaataaatgacggctgttcatacttgatacctgcactgcagcctgcaggccatatataagctagcagctgtagtatccaagttggtcagctcttagatcatgagagagtttcacttctaggttcctctaagtagagtagttcttttttttaaagaattacacagtacaacgcaaacacgcggaccctacccctatgagtatctttgaaaactgggccgataaatcctagagagattaatgaagtcaccacagacgcctcactgtcgacggatacgtcacctaccactgaaagcacaacgccaatttggtgcacttccaataacgtcgacagcttctgttgatattttcttatacttcctccgtttcacaatgtaagtcattctaacattttccacattcatattgatattaatgaaactagatagatatatgtgtctagattcattaacaacaatataaatttagaaaatgctagaatgacttatattgtgaaacggagggagtaacttttatttcttcttaatatattttgatggcctcgatttccaaggaaaaaaaataagtttcacttctcataagctgcagtccctacagttaattatacggacggctagcggcctagcgcgcacgtgctaatatatgaaatgcacgtgcagatgccctcgatcattttcagagcacacaaatgtgcggtccattttatctgttaggcgcgcaagttgcattttggaggctggatgatcaagtcgaaacctgacatatataatttcttgaccgctgacttatataattaggtaaacaactcatatgctccaacttaacgtgcgtacggttcgtccaaaagatagtacaattaatacccctagattatttgacaaaaatgtttattactaattggtttatccaaatattagtaagtttcttgtttactgatatttcagtaatgcaacttagttgaccagttattaacctctgtcttaaggagctacttcctctgtttcatattataagattttctagcattgcccacattcatatatatgctagacatatatacatatatatgaatgtgggtaatactagtaagtcttataatatgaaacagagagagtacctatttttatttatactaaaaatatactaaaagtgattcttttcatgatgtatatgttaattctgaaattcataattaataaatatcgagttgtacttaatttgtaatcttagttttgtatcttttccatatacattttttagtaagtttgaaattttagaatctataaaaacataaagataggtttttaacatggcacacgatgttaatatataatagtaataatggggatgttcagattgtagccaaaataaaccttaccaatgccaaaatttagtaaattggtaatattaccaaaattttggcaggattatttcttatgcatttaccaaaatttggcaagaaactaaatgtatacatatttttagaaacttaaaaaaaaaactatgatttaaaatggcatcaatcggaacaactccaatatgatcatctgatcaacaactagatcttcttattaatgtgaagctatagagtgcccaacaaaatagattcttaatactcaacggataattgaaacacggagtatatacgatgtatttgacatagtaatccgtatgtgaaccggacagctggctcatgcgagatctaacacgtcatcagctgctagatgtatgacctttggatagatgcaagaaaagtattccatgcctagctagctgtaccacactagttaatgaagaaccccatgcatgcatttatcttcttttctttagaatcagatctaaacaaaaagaatctgctcgactagtctcaagaaagctaaatactataatatatgctacatgattctagtatctgctaatactagcaaacagctaaactgctaaagaatactagaaagaaggggtctccgaaatgtggttaattagttaatttctggcccagcccaggaagccaggagtacgtacaaactgtccagaagccaagaaaatctgggaccttgggcattacggcccatgtaatttctggcccagttcgctaaaaaaggccagtactctagatcagagtattgggagttcacaatggttattaactacactagccactaggcaacaaattattaatgtctagctagtggattaattactgttagttacttccagaaacagaatcaaccgtacgtcaatgtcacggataaacttgtgacgtggtgccacacgaagatcctaataagctcaagccccatacatatttcaattaacttttcgtaagcatgcatgcttacagataatctatcatatgcatgcttaaggcatcatgactttgccaccctgattttggacgcacatacccttccttcttatctactctcatctgatcgtcatcaccttttaggcactactgcatgaattgttatcctatcctaatccttcacctaaactagtgcacaagcaccaattataagcagcctctctaacatgcatgtgtgagcgtgacttaatcatcatgctttagctagctgtttcttggtgattgcttactaattaatccaatctatgggagagattgaaggttgttgctagctagctagagccgtagaggtagaccaggacacacgatgaattgttagggtcagaagaataaacaaatcgctgtctccaatagggagacgtggttaagcaagtggagagaatcaacttagtttaatttgggcttatctagtgggaagatgtcatgctatttgcacgcttgatcaaccactccgttgagcaacgtgctctgccgccgtctttccgttgtccttgaacgacataaacaatgctgttttgattgtttaattaggtcgctgatgacgcgtgttaattaagtaggcgccattgcgttttcggatattggtctagcaatctgaagcacagttcttcctcagtactgaattgtggacaagacgaccattaatttgtcattttggttggagtcgtagagattagttgatgaagcagctggtttgtcctgaagtatttgacaaattgagcaagaatttagtcagtattgttgtttgaaagtacaattgatcagcgtact

SEQ ID NO: 62683 - DNA, 8358 bp, Oryza sativa
tgattatcatatttgtatgtcatgtaaactatcccattactatttcttggatatttgtatcttcacattgtgccccaggttatattctatattctaacatagtaccaatggattcaaaagctgccattatcgttctagatcaatgctcataatttgtaaatggcaaaaggcagagcttggacagatttcaccaatgtacttactgcactatctttgaccctaaaatcctagtactagcataaatgtctcgacgacggcgaccacaagttagcctagcgctgacatgtgatgatgatgctcctgtccagcttacatagatccaggttgcaagcttgtcaggggaatttgcgagtacactgaactcatctgggaccattgggcttgatggggtctctcttctgcaatcgttcgtgctgatcacatgcgtcttcaatgcagatcctgaactgatttgcaaaccatccaaaccatgggagctgcagatgaatctggctgaaatttgaaaccaacatttggtagagctagaggagctacgaaattgcacagcatagctctgaattagccttatacatgaggaccccccggatgataagcaagattgtcaggttcagaagcaatgaaattccagaatactgtcaggtatggatgcatactgtgtacagtgcagcgtacagctggctcggatgagtggatctggctatcctatatgacctgcatacagtgaaccagtgctcactgatttgtacaacgatacgtcaactaacaggtttacaaacctagtagtacacttgagtcaatcagtgctcactagctggcacaacaatacatcgagtaacaggtttacatacaattattgcagcggagcaaacaggacaggaaaaccagacacaattttgtaagccgtagaaaagagaaacaagttcatccacaggagtataagagaaatccatgcagagaattgcagtaacaaattatagctcgatgaaattagtaggtggtaaaacagcctcaacaggaaactaagataatgagacatacttcagttttacaagcaaaactgtttgggaagtaaattcccaggtaaaactttggtacactcaaggactcgaccatcattgattgacgagaagatggaaacacaacagcagctgtaagcaagtcatccattgtgttaagagacggttatcactggatgactggaaaacatatcatactgagaccaagactgttaaatttctttttttccccttttagataactaagcaggaaccaccgagttgtagtgctcaccaagaccataggcatgtctgtgataggacaacctaatgctagggccatctttaccacctgaatccaatttgtattctttgcccatttccacatctggaaatgagcccgagtatacaacaatgcgcttcttcaggcagtgggttagagcaccaagctcaagttgcccaccccaagcagcagttgactcaacctcctcacagtacctcttgaagctctccaagggatctggtccagactcgaccttgccctctgataggaaaaatgggagaaaatctgccgcatgctctttcatataattggcagtcatttgccgcagctcctggtaattgtattgtgtggtttctctggaatagagtgacagctggttctcaacagcacggtacaggcagtggccatctggctttatctcctgaatggtcagtcccatgggctcaagcttcttctcaagcttttcattttctatcatgcggtcactgacaagattgttttgctcttcttgaatccgctgctctctagcggcctcttcctttgccttcttctctcgacgccgtgcacccttgctaggcttcgcggaatccgcgttgctggtcacagaaacaccagctatagcctttactaaggtgtccatgttccccttttctgagctgcctgaggatttgtacccaaaagtagcgagctctgcggcatgtttcgcctctaactcagctgagaggcgtgaaatctcctcctctacctgcttcttcttggccttctgctcagctttgctgcctttagcggctgctttcttgaggcttgtttccttatcctggagtttggatttctctttcctgtttaatacaaagagaaagaggacctcaacttttagaaacaataccatataattgaaaaggatccaacccacaatttgtgaagtcatgaaatcaacaggaaacgaaaattagagaatatatgtgcttcttattgctttaactgaacaaattaactaatggttcacattctacttctaagaaaaaaaatgctctgctgctcttcatatggttaactaaacaacccaaattcttgcaagtacttcactgcaactatttttttcctcctttgaataagcatatgtaagttttaaagaggtgttgcaaatacctatgaactggttgtagctcaaaagtagaatgtgcgtggaacttacaaattaactaatgtatttcaatataaggaaggttctgctatccaagaattgtgtatagtagagataaacaagcaacatgacgttacacctaaaaatgggaactttcctgaatataataagatccttagatcctcatcatatgagaaaaaagatagtaactactacgggcaaatgacatcgataatcagcattgaaaacactcataacatcagtttcagtggaagtcgctctggtggagcaaccctggcactacagtgtatgtggtaaaacgaaaatattatcacaaatgatgaaaatactagtctctgttcctcatctttggtgagcatatccaccatcacagaattttagagtaattttactcatggtaatagaatttctgttcagcaatctggtagcaatttcaatttcaactcatctaagcagtttccccgaataacgccgctttaatggagaactcaatctgacactagttgtataattagagggaaaaaaatgaatatgcgtaatgcagaaacactattgcgaatttagtcactgacaaacctagggcacttttagtcgaaatgcatatttttcttactactaagattccaaggacaaaccactaagacaaatctaagtagccaatcaaaatcatgaacaaaaacccgacgaacaatggaaaattccaaccttttttacagcccagcacaaaactttatccaagtcgcaattgggaccaataaggcagcacttaataataaacagcaagataaaaattttatcccctaatttgccaatgggactaatagcgcaacacttaataatcatcatcatcatcaacaaaaacaataatgggaccaataactcagctcttaataatcaacaacaacaagagtaatcctaaatcctgccgtgccgcagcctccgcccaccagccacgccaccgcgcactgcatcgccgcctccgcctgttgctctgctctgcggctctgctagggttcaacaactcgggggaaccccacagtcagcaagtaaaaggaagcccgatatagcccactggtacgacccagcatcacaaagtccctctccgcctctcctcatcaatcgctcgcagctctccccttcatggcgatacggaggacggcatcgaggttccggttcgggggcaggcggcgagatcgaggtacggcgaggtctccggcacatgagcacacacggcagcagaaaaagaaaaaaaaattgaagggtacaaagccaaagagtaaactaacctatgcctcgagagcacctcctcgagcgtctcttgctgcgattcctgcgctggctccgccgcggctgcctcgccgccgccggcggcggattcgtcggctagggtttcgtccattggcaaacgatgcaaaactcagttcaggcgaaggaaaaagaaaagagaaaaaaaaaaggtagagaggcttttgtgtttgtgggctactcgtgtgctcttgcgggtcttgccccaccttatcggatgcggatctgttactcttgcgggtcgtggattgtcacgatgcttcgcccgtttccttgtctgacagagactgggcgattaatctgttcttcttcagagattctgccccttgtttagatccagattctgccccttatttagatcagggtgtaaagtttcatcgtgtcacatcaaatattatatagagtgttacatggaatgtttggacactagtaaaaaaaataattacagaatccgtcagtaaaccacgggacaaatttattaagtctaattaatccgtcattagcaaatgtttactgtagcattattattatcaaatcatggaacaattaggcttaaaagatttgtctcctaatttagtctcaatctgtgcaattagttattttttagtctatatttaatactttatataaatgttcatacgttcgatgttatagtgtgtaaaatttttacgtgagaaataaacatgaccttagatcgttttcgtgtttgatgtggactgaactcttaccttatacttgtatgatgtgcttagctagatttcaactcctaaaaccacctactccaacgttttgatttcacgcgtctcacgcgaagatttccggctgtttctaaatccgttaatttactgggacgacaaaatggtttttcatgtcgaattgtgtctagaatagtcggagctagttaatttaattcttcctgtaagtgctggtttgaccatgttgaaaacatgcacgagtattttgaaagccggtggagttgaaactatttaaaacatgcacaaaagagcatgggaacgagtaacttgaccaaagttatggaagtcatatgttaagaataatccaatgggttctccatgctcaaagctggctatttttcgtgttcattcctaataaagaggttggcctttttcgtatcaagcaactatgtgatgtgtttcgtaaatacagctgtgtcacggcctggaagaaatcacctctcacgagttgtccgtctcgttatccaatttagcgcgtgcttagttcacgttaaaattaatagtttaattgaaattaaaacgatgtgatggaaaagttaaaaatttgtatgtaggaaatttttaatataatgaaaaagttgaaagttcgaaaaaaaaaagcgctaaaccaggccttaaccaggccttatccttgtgcacctggtgacaacacacttttgtcaacagggagagagacgtacggcagcacgtaacgcgaacacacggcttaacgtgtacagtacggctcagtactcacgtgcacggtggacgtccgtagtacctaagtctgacggatttgatcgatcgaaccggccgtccaacgacgcagcacgcgttcggtttggatacatccttgacgttttaacgacgacgtgccatgcaaaccccgccgtcgcgtatagtcgtacgcccacggctacgtacgcacgcacgcatgcacgcacggcccgcgcgcgcgagaccaaccgagccaacacggccgcgaccgcgaccgcgaggttgtgtgtgttgggagtgaaacgccgagacgtacgcctgatcaccggttcgctctctgctgtgctgcctgccacgcgcgcgcgcgcacggtgacgctgacgcagtgcaccacggtcacacgcagtcacccaccgcagcacgcgtgccgctgttgtttttaccgcgccctgcgttacgtcacgtactcaaatgggtgctcaaagggcataactactccctccgtcccaaagcttacgctgtttgaccatttgtcttatttaaaaaatttatataaatataaaaagcgaaaaattatacttaaaataatttggataataaagtaagtcaaaaaaaataataattctaactttttaataagacgagtgatcaaacagtgcaaacaaaaactcaaaattccttatattatgagacggaggagtagttagtttggttcattcctgataattatttgatccgtgagtagtaccgtcatgtttttttttaaaaaaaccattaccgtcttgtgagtttcgtcaagatataggagtagtatagaactctgtaacacctgagttccaaaggaggcttgagaggggaaaagaaaagttaaacactcctatggtttaaccgtgacacactgacactcctaataaaatctggtcaggcaacgtttggctttacttttaattagaaacacactattcatcatgacgacagacgagaattgccactatcattcaacgactcgtcaggactcaggagagcttcatctcgttttcctactacccgattaacccgtacgcgcagcacctgtccggcaacaattcaatatttctttttttatatatagcacctgtccggcaacaattcaatatttcttttttttatatatagcacctgtccggcaacaattcaatatttctttttttatataaaggagacgactattcaatatttcaacgtgaccacaaacgtctcagaacatgttggaacgcacacgacagttgacagcctgaccgccgaagacatacgtcggcacgcaacgtcgtcgtgcattgggaccagggcacacatccgcaccgccgatggatcggcgcaccgtgcagctagctatagcgtagcgttccactccactcaccatatacacgttacacgtacccaaagaccggtcgaacgaatcggcgtaatacgacgacggcgcccgcacgcacgcgcgcgcgaggggtttggaccctttgacgacgcgacgggccaaagcttagccgccacgcgggacaccgtcacacaccacgcaaacccgtactatgtctatgtacttcatgtcagtatgtgcatcgccgcgctccgccacgttccgcgaccaaccgagccaacacgcgaggctgtgtacgtgtggaaggggaacgtacgctagctgagacgcccgcccgcctttcacccccgggcggcgcaccgccgcgagtacgtacgccggctgcttttccacaccgccgtaggcacgtataagggctggtttggtttgaggcctaaattaggcttaccaatatttagtaattttaatagtgtttagtttctatttggtttgaagctaaattttaacatgcctaagaaaatagaccatttcaatagtaaacttaggctattttgacttcaatccaaatacaacttttccttaccaaaattagtcatgccaaaatttggcattgacaaaatttggtaaggcctatttagccataaaccaaaccaaccctaaatgcgcgggcatgtgggtacgcgctatattaaacgcaaaatctatttccagaggcatctcgatttagacttaacgagcgacgctgacaattacgtgagaagtactagtagcattacagacatgcatataagtagtttttgctattaggttgtgcattttttttcttcttatgaaattttctcttaaattacttatccgatatataatccgattacaccgttgtgttcataacaattaaatctttacaacaagatctcacatgattatattttgatgaaaaatcacaaattacttttatgatatgtctaaattacttttagatttcactaagttacttcttagacatacaaaagtaaattcagtaaagcctaaatataatttatatatattatagaagtaacttagacaaaacgaatgtaactttggcatgtcatttgaagtaaatccgttgtagatataaaaacatggctctatctagaaattaaattaatcagcacatattatgaattaactaaaaacaataataaaagtaatcacctcagagcattatgaatgtatagaaagtattttaatcaaatctaaaagtgatatatatatatatatatatatatatatatatatatatatatatatatatatatatatatatatatatatatatatatatatgataattatatatatgataatttgttcaatgaaaaagggtattaattaaagttactttctttttttataagttacttctataatatatgtaaattacttttaaactttactgaatttacttgtgtatgtctaagaagtaacttagtgaaatctaaaagtaatttgtgatttttcatcaaaatataatcatgtgagatcttgttgtaaagatttaattgttacgaacacaacggtgatatcggatcgtaaattggatgagtagtttaagagaaaattgtatttgaattatagatggatgatatttcttatagatggagtggtagctggtttagggggtgtttgggaactagggactaaatttagtccctctcacaaaattataagtccctatggtagggactaatgtttttgtgagagggactaaagtttagctccactttagtccctccaaccaaacaccaccttagacaaaccaa

SEQ ID NO: 62684 - DNA, 683 bp, Oryza sativa
cgttttaattaaccggctttatggcttggccgaaaatattgtcaaatccacgccatgtgttagacggctattttatagtaccccttcactttgtctaggtcaagtttcaacccatctaagatcgtaagtccgatgtgtaaatgctatggacagattaggtgtatgtggtcacacagcttttctcactttgagtgagaacattctccatttcacagtagagaatatgttacagtgctgcccatagacttaggctttccaaagtctttcatacgatttccacctcttttctagtatcgtccgctacttaaagaatgttgtccctagacgccactttttttccagcgtcaaagcccgtatgtaaagtcctttgagggtgtcccatgaagccatgcatccgacaattaatgaagagcactacagggtgcaacacttctgtgataattttacaatcctcccaccgaaccctatcactcccctattcctctctatcctctgccctctttcacgtcctctcccctatcacctctcctccctctatctcatccctactcgacgggagcatggctggcaatagcaccagcgacgatgggagaggcagtggaggcttcgtcgcggctcacgtctagtggatccggtgacggtaccctcatgcaggtacgggagaagcgcgccgggggggaggg

SEQ ID NO: 62685 - DNA, 7476 bp, Oryza sativa
ccaaaacgtcagtgtccgtagagacttgtttccacttgaccatccatgtaatgcaattgtgtgtgtgatgttgccaccctttggacattttcttcctactgacagatcagcatgatgagctgcagacgccatggcatacgtacagcttcgagctaagatctcatttctgaaatatatttgagttcagacaatttttgtgtatgatttggtcaagtggtttgttagttcgttgcagagaaaaatttgatagactgatgacaactcagagatgtgaatcgtgcagagcttatctttgaggctttgaacatcttcatttcgagatatttacacccagatcgagaagcaatacgctgcctatcttaaacatctcctcgtcacaaaaatcaaacaaacacgaaactctctccaaaaagagaaaaaaaaattgaacgtaatcctatcccctttcggagcaataatatacaaacacaaaaaaaacactagtcctgtctccacatttccagttcttcttcttgtttttttttttcagatagacgtctgcgtcggcgtctctgacgatgagaaaggctccgtttcatcagtggtgctgaacgatctcatgttggatgaccgtgttgtctcgttctccttctgctggctgctgctgaccttgaggtcggcgaagtcggtgatcatggccggcctggtgatccggtgcaccgagaagtgcttctccccggtgagcatcctgacgacggtgctcatgttggggcggcgcgccattgcgtcctgtgtgcatagcaggccaatcttcaggaaccggcatgcctcgtcgacgtccaggtcattccccaggtcagcatcgatgatctcagccaggcgttcttgctcgtagcgtacccatgtctgcaggttttctcgcattcagtaatgtttctttgtatggtggatttggtggtaagtttctaatttagttgattatatgagaagaaaaaaactgagttcattttgttgtttacagtttgatgatgggaacttaccctttcgagaagaaattgatcttcataaggcaatcttgtgttggtgttgcatctgccgctaacgatttccagtagaagaacaccgaagctatagatgtcggatttctttgtcacctggcctcggatagcgtattcaggtgccaggtatcctctgaacagaagtgaatttcaagtcagaacgaaagaactttccgatgtaaaccgagtaaataaatttggatttagttatgcttacaatgtgcctgcaactcgggtgctcacatgagttgcgttgggtggaaggagccttgccaatccgaaatcagaaatttttggggtgaggtccttgtcaagaagaatgttgctcgcctttatgtcacggtggataatcggagggcgaatttcctcatgtaaaaatgcaattccacgagcaacacccacagcaatttttacacgggtcctccaatcgaaccggatgttgctacccctagatcctgtaatatcacagccagaacatttgtaagtatggcagcgaaggaaggagttggtaaaggacaagttcgggaaaataatgtgttactacttgctttttttaaaagaataatgtgttacctagcaatgtctgtgcaagactgttgttctcaagataattgtaaacaaggatcctatgagatccttcagcacagcaaccaataagtgtgacgaggttttcatgcttgatgtcagaaattgctgtaagttcagtcaagaactctcggacgccttgtcttgaagtagcagacagcacctttacggcaacggttgtcccatctctaagcactccctgattaacaaaatgaaatgtaagatgatttgttttgacactatgggcatgagacactgatagggtgaacaaaatgtaagacatatttaccctgaacacagagccaaaaccaccctctccaatcttatttgccccactaaaatcatgggtagcctttctcaactcactgtaagaaaatatcttcactctatgttcacctggaacaacaaaacaacaaactcaagcatgtaagaatgatgaattgttttgaacaatacaggtaagaagcgtgctaatatacaaacgctgctcaccatcatcaccttcaacaggttgtttttttctgaacataaagcagcaatccatctgaaatcaaattgtagaggtgcccacaggccacaagaagcaatgaattggaaagaatttctgcagagcaaaggtaaatagccatcagaacaactgtaaattcatattgcaacaataaactaacgtaaaatgaggtgtacaggactcttagcaagttaatgaccccacatgccagttgttattgtttaaacaacaatttgcgcatcgataaccaccaactgcactgaaaccacatctttgcttgtttgattaatggctcaagttactatcaaaaagtctacatttagtacgatggaaagaaataaaaatgtgaaaccacccaagaaagaagatgtaaagagacttaaaaccaagtcaaggcagaagtcatccaccccatttgctgagcaatttgaagaaaatgaaacgtcggttgccacaagcaaccttaatcctgtctttctgaaaggaatagcgcctgatagacccaacggaccaactatccccgttgacgagtggaaattttgcagcaaccaaacccgttggaaatgaatttcgattcagatatagagcaaaagcctgttaattttcagtaatactaactatctataactaattccgcaattgcacagcagttgagtaactatttatacttttgtagtacaagaaagcaacaagctgcatattcccatacgccgatgagtaactagcatttccttcaagccaggatttgcctcatagctttacctaacaaaaatcggatttgcagctacagaaaccaaatcttgcatgcatcaaaatgagatgatgcatcacaaacacaagaaaaggtatcccctttctacttcccgctgacctaaaccaagcatcacatccatggaactcgatttcgtagaacgggaggaggtcgctcccgcaaaggcgcaatcgatccccaatttcaagcaaatagagagcgaggaacccagcaacatactcctccacatagaaacaaatgtaaaagcctaacgagttcttggtcatcctcactcaaacgcccccaaattaggaaccaaaccaaccaccaaccaatccaaaccagaaaaataaaagaaaaagaaagaactccacacacacagacaacaagaacgcaagaatcacctgcagagcaagcagatcgagccccggcagtgagagcaaagcaagcagctacacgccgaccaacccacagggtgaggagaggcgaggagaggaggcaggagagagcgcggaggcggcgctagtggtttaagaggggaggagagcgcggcgtggggaggaagaaggtgacgagaaggagagagtctttgacttctctctctaagctcctcctcctccgatttttttttttgcttctctcctaatatttctaaacaaatatagagatcagaggccgcctcgtgtggtggtttgagctagctagcgtggaaggagaagtcggttaaaatggttgggaggattggagctaactgcttaacgttcgttttcccgcgtgtacgcggacgtgtgcagcagcaacgcggaagcagccaggaccgggtccagcgtccacgtccgcttccacgtggccccccaccgggcacgtctcacgcgaatccgctattaatcagcaatttttcacgtaaaagaattacacgtcgatacattagaataaagatagttttgttacacaacacaatcagttagactggcctatgtcaaaagaagggagaaaaagcaaaacaaaaattgaaactaaaaaataaactacagcggctaaacacaactacaaacagcaggaaaaggcaaagccacgctacactctcgagaaatccctacaagcggtaacgccagctaaagaccgagaggatggactccagaaccaagttgttgttaatgagcaggctaattcctttgcttaatcgcgcgttaaacatcacgtggttaattcgtgttgctcacggggagtaattgggaccgagttacttctgaaaaccgatcgatggcgtggcgctcggtttggctcgctcgccggcgccgtagggcgaggagacagagactgtgatgtggtctttgagtgcagttttagctgatcagtgatggagtctctgtgattttgacgtgcaaagtggttaaaggcacaacaccggccactagattagcttagttaggagtagcgtatcacgtgtacctggtcatcagttttgtactctactctattctctatccgcgtacttatggttgagaggtgcccgatgcttactctgaatatacaaatacaatgtgtgcgacaagggtccaaaattcagacggttggatacaaagtccgagagattattagattaaccaactgattgtcgatataagtatatactagcgcgaacgtactgaccagcaaaatccacgcagaacacggagtaagtaaagcataaagaaaaaacacagatcagatcacatgcagcttgttatcattttatggtcaaaagcaatccggcacccatgccaggtgagctgcacctcgcacccccacctcatgtgctcgtgcttggtagatccatgctatagatactactcgtacacagcaaacaaaattaagcacgtgcatgtgcctgttatgtctatctgttcgttcaaaaatgtcagcttgttgttcaataggaacagtctgggtgtcgttcgcaggagaatagaggaataaacaaagttgctgacgaacgcggctgagagcaagtttaagagctcactaccagctatttgcatattttaaaaccaacatatatatgtaataaattaattataagattagctttaattttaatatatttgtcttgtaacatgtattaagctagttttacataagagctcacactcttcgtataagtgtatgatagaattatcctcactacaaagtacttctattatacttgctgtgggtgatgtggcgcgtcacccgcccgcccatccgaccggaagaacccacttgggaatagcgaaaacgaaaattccgcagtcgctgataataccacatcttgccgagctcgagcgcgtgcgttcccaccacctcacctgggcgatcgatcgatcgatcgctacagcgatccacgcagctcagccagccgccgagccgcggacgcacgcaggcgcaggacgtacgggtagtggtccactcgatcggtcccgcgagtcgcggcgcatcgctggtcgcgatcgcgcgtacgaacgtactccgtatacgtacgggtacgcccgcgggggcaaggcgtctcgctgtcacacataccggtctccaattttctcgtcgtctccccggcgcgcgcgagcgttcttcccgagcgtgttggctcggcagttatacgtatgttaggaaacgatatacaaacaaacgataaataataataaatcaatcataaaaacacgagattttagcgtggagctagcctttattaaatgtaaataaatttggaacataacacaacaacgtacgtggacgtgtggtggcgtgtgggtgatcgatcgatcgacgaacgtgtacgtcccgtcccgtcccgcgttgtcaaaggctcgcgcgcgtgcgtgcggcgccgccgtcgtattttgccgattagttcgaccggtcttaggtaggagtagtatacgtcgtacgtgtacagtactatgcgcggtgagtagtgggacgccgtacgtacacgatcgatcgatggcgcggatatgtccagccgagtggccgacccccacgcaacgttgtctgccgccgtacgtacatctccggcggtcagactgtgatcaactgtcatatgcattccaacatgtggtgggacgtcggttggtggttaggctgctcctattcccactgtcccaaagaacgatctattgatgaaatatgacatttattagtacaatgtatattaaaaaaacatcatgttttattttagattagtttttatgaaaaaaaatacgttgaatggcttgttcatattgatgtcatttcaaatcatattattttttggtagagtttttgcaaaactttagtatataagaaatcctactaaaattttaacaatattattaaattgtcaaaatttaataagatttattttgattacaatttgaacagcccaaaatattgaatggttgtcagataggtgtgcacgggccctattacaaaattgatgaatgatagtgccaagttgacaacaaacgagagctggcaatatttaacaataaattaaataatatgaaaaaaattaataattacttaatttttttaataatacgaacggtcaaacgtgttttaaaaagcaatagcgtcaaatatttgatttagagatgaagggagtattgtactagtgttttaacgttttttattgcgacaagtgttacgtatctctacgcgacagttgctcaccgatcagcacacgttgttgaacttgaacttgaacacatctcttcgccagaagttaatgagcaccaattaattagctcttggcaaccatttggtcctttttaacatctgacttccaaaaaaaacttgggtcaaggaagtcgttcgaacggattaggccattcctaacctaataaatggtgtccataacattaaataagttaccacctaaaatgaaaaatgatgtggcaagtgaataaatgagaaaagagaatgacaccatgttttgcatgagacatggtttctacacaacatccaagacatcatgtgagataaataacattaaatttaagtatggaacagtggtgtttgtattggaagagcaatgtctagtactagtttcttgatgatgtggagtttatggaaactatgtctagtgtgttgggttggaaatggccttagatatagtactgttctatttttaatgattctcttatatccatgttttaatataggacgtgactacactgctagtggtagttggtttgtctaaggtggtgtttggttggagggactaaagtggagctaaactttagtccctctcacaaaaacattagtccctaccatagggacttataattttgtgagagggactaaatttagtccctagttcccaaacaccccctaaaccagctaccactccatctataagaaatatcatccatctataattcaaatacaattttctcttaaactactcatccaatttacgatccgatatcaccgttgtgttcgtaacaattaaatctttacaacaagatctcacatgattatattttgatgaaaaatcacaaattacttttagatttcactaagttacttcttagacatacacaagtaaattcagtaaagtttaaaagtaatttacatatattatagaagtaacttataaa

SEQ ID NO: 62686 - DNA, 648 bp, Oryza sativa
  unsure (1)..(648): unsure at all n locations
agacagatctggtttgttttttttttttaatcttgaatcttgacgagctactaaaagattaacttggcttgcctggctcggcgagccaatgtgagctatattgctagtgttttttttaaagggaaaattacaaaaaccaccccaaatatcactctgagtttaagatgcctccccataagaagatttgttgcaaatccccacctcctaattcatcttgatttgatttaggcacattctctccacatatgcgtgattcccgattcatcggcggcaattcgggatttcaggatgacgaagcgacacggctcggcctcgatctccgcctcttcggtctcgcaagtcgcagtcgcgggcagacgaagcgacgcgcaatcgcgcacgcgcctttgccgctgatcggggattgcatcatcgcacgcgattgaacttctggtgggctgccgctgggcttggaaaaaaaaaggggggtggtaagtgatggggccccctctggccttggccctangcggtcgcacaaccgggctatgccctgcgccgggcctgttcccgaagaatttgtagcgaaatcaactgagtgccactaggcgggagcaagagataatgttggttgttctggataaatgaccatttaattgtgttatcatggaa

SEQ ID NO: 62687 - DNA, 735 bp, Oryza sativa
  unsure (1)..(735): unsure at all n locations
acctgtgcccggccggaagaatgannacgttggtggtggtgaagaagggggaaaccagcgggggggagttctttgnagctatggatgggggtgggnctgggccactgacgncgncggtgcggganccagtggcgtcggggaagncggcgaagaagaacgggnagncggtgncggtgncggtagtgaaggcgnaggtgncggtggcggcagtagcggcgnaagaaggtgctggtggggatgcggcaatggtagacggcgctacaaaggtggcaaaaaaggcggtgtcggcggcgaggcgggcaagggcatcagggcggagagggaaaaggccggcgatggcggcggtggcgtgggnattaggagcgcgcggcgggggagaaggcacggcggggggccgagctacaactcgagtctgtaccgggtgggggagtacgcgcggtgcatggcagcgatgaggcggtgccgaggggcgctgctggtgtgccagatgcagtgcgagggcccctgcttctacgactgcgacgccaactgcaaggcgcactaccacttctaatagcggcgccgctgccgacgtcatttgccggccgctcgggaatatatatatgtgccaccggctgcttgcatttgcttgctcattgtgtgtgtctagctagctcgattggctgcttaatttatcggtgagaaggggatcctctagagtcgacctgcaggcgtgcnttacatgggtcctaacgt

SEQ ID NO: 62688 - DNA, 9336 bp, Oryza sativa
aattttagcttcgactgtgtgtatgcccgatcaaattttctagcaattttttttctaacctgtacttacgtgtaaatgcaatactgatttcctcaaatgggtgaatgttgtacaccttgtggtggctttcagtacagagttggaggcaggaaattctgaatttacacccgaatttgccggtacaacttttaatttgccaagtcacatttgcaggtatggacttcggtgattctagacgcaagcctaatgtcgtcgggaagttcaccgtagctgttgcactcacggtcatgtgcatcattgtgttgaaacagtcgcctggttttaccagtacaagtgtggtaagtgccgaatctctccacaactagcccacttcactgtcgaattgttgattgctgttgagtcctcacttctcgttgttgtattgttcaaacttgatttaattgtgacacgtaagtttcatttggaacaatcgcatattgtctgacagaaagaggttcctttaacatgattgaaagaaacacattgatcgtccattccatttgatgaattcactgttcatttatctgtgttctgtgctagtagtggttattttctatgcaccatcgtagtttccaataaagcacattcataattccattggaagcaaagctgtttttgtgaagcatttcagattgtcatctgatctagttttcatgatacattcacatgctctatagttctctcgccatgaaattggtgtgactcatgtgttggtgactggaggagctggatacattgggtcacatgctactcttcgtctacttagggacaactaccgagttaccattgtggtaaatttcttattccagcttcatgtttttattcctaactcaaagagcttttatgttacagcaatttcttccatgtgatctttacaggataacctttctagagggaacatgggagctgtcagagtccttcaacgtttgtttccagagcctgggaggcttcagtttatttatgctgatttaggcgatgcgaaagctgtatcctttttctctacaatgtgaactttaataccttattatagccatttttccatacattcatgtgttggtgtgatctgttttgcacttaaccaatagccaggttaacaaaatattttcagaaaatgcattcgatgctgttatgcactttgctgccgttgcttacgttggtgagagcacgttggagccactgaggtaaggcattgatgtgctaatgttcttgtattcatgttacatagatggtggttatttatatattgcatgttcatgtgcaatcctttgatgtgttcagagcaatgcaaactgctcttggttatctctattattaaacaaaactgctaaacatgacaatctatattgaaaacatactatatagtgaaaatggaaaatataggcattccatctttttcaatgttggcattttttgccgataacatacttttggcacgagcaatttgaactgtgaagattagtgtgaaagactgcctaatgtaaatgtatgtgattttagttgataatttgttttccttttttgtatccttcagaaataatctgttgttaatgctgttactattacatgatctgtgctaatactgcaataacaggtactaccacaacataacatcaaatacattgacagtgcttgaggcaatggcagcatataatgtaaaaactctgatatactcaagtacttgtgcaacatatggtgaacctgacacaatgcctatcacagaagcaacccctcaggttggcttatcaatgcatggacttcttatctcaaagtttaaagaatatcatgcacaattcactgattctagacaatcttttaaccaatgcagaatcctatcaatccatatgggaaggcaaaaaagatggcagaggacatcattttagatttctctaagagatcagaaatggcagtcatgatcttaaggtccgcctctcctatagcctatactaaaatttaattcgtagagaaaactcacttcgttttcttttgaattagatacttcaacgtcattggatcagacccaggggggcggttaggggaagctccacgaccagagctgcgtgagcatggacggatttctggtgcttgctttgatgcagcactgggaatcattccaggtttgaaggtactgaacatgctcacttcagcatgtgtcctgacttttcacatggtaacatactatggtatatgactttcaccctgctttaggttcggggaactgattaccctacagctgatggaacttgcataagggactatattgatgtcacggatctcgttgatgctcatgtgaaagctcttgataaagctcagcctggcaaagttggaatctacaatgttggcacaggacatggttgttaaaaatatcactaatcatctcaacacatgcacaattatgtactcatttctctgcatgtatttccttgtttctgattgtgctttgctcatgattttatcaggtagatcagtgaaggagtttgtagaagcatgtaagagcgcaacaggagctagcatcaaggtttcattccttacccggagaccaggagactatgctgaagtttacagtgacccatccaaaatccatgacgagctgaactggacagcccgttacattgatcttcgcgaaagcctttcaactgcatggaaatggcagaaagcacacccgaatgggtatggatcggcctgattcagggtttaatagattcagacttaaggtacacagattctcaggtccatgtgcagaaatcatatatccttcagaaaattggttcttcagcacaaacatagtgccaggcacagaagtgttctgaatttttttggcagcatttggaagaagatacagaaagaatggcccctctattcctggcttaggatcatacatatagttttttttttccttgacattttttttaatcttttctactcgttaaagcataatataataaccaatagaaaatgtgttgtagacaaggtagataactatcatgtatgaacgttcatggtgttgaatgaaaggatatatgaataagtagatgtttgcttattagtggaagttaaatttccattttggcaagctcagcggttaaatttcttgtatgtgaagcaaggggtgactggggacaatgcattgctgtgcacaactcctggtctcacttgcaaaaacatttcttacatgtaactagagtacaagtggttggattataccgtatgtacatgaacgtcaattcgcagctacacttcttcaaagagaagattaattatgtactacatgttattcgcaactacagttcttcagaagagaagaacaaacaatgcaatggtaagcacctctaccgcgtattctgaagaaaacgaaaagagaagagaagaataaagaaagaaagggctacgtttaccctgaacttgatctgctgtctctctctgcgcctcgctgttcagacgaaaccgagccattctgcaagaagagggcacagcagcaggaccatcaccggcgtcggcagcggccgctcgacgccgccggcgttccagaggaccgccgccgccacgtccacggcgcggcggaggaacaggaccgcccccgccggcggcggcggcgcggcggcgccgcgcccccgcatcccgtacatgatgaacagcagccccgccgcgaggatcgcgcacgccaggacgagctgcagctgctcggctccttccaccggcggcgccccgcccccctcgccgccgccgccgccgatggtgttgagggtcaggaaggacaccgccgtgagcaccgtcgcgaagcccgtgccgacgaggtccccgccgcctccgcctcgcggttggtaggggcgccctggttgccggcgcattgttcgtcgccggcggcgagcggcggccacgaggaagaagctctgcgagaagcgggatcgcgagccaagttaaagcttgtgtcgtgtcagtcgtctatatagctatagctatctagagcgaggtggaaagaggtgtgtgagcatggccgcatgggaatttagcccgaaattgcacttgaaaccatagtagtattatcttcgaaaatttacgtcgagcttgaaagataatcgccggttcggcgtcgtcacgcgacgagtgcttctcggatacttcccaatcttgcaaaaggaaacctgccctttttaattagttccagcttcgcattgcggcattggacttgtccacgatcaacaaattagttaattactactccctccatttcgaaatgttggacgccgttaactttttagcacatgtttaactgttcgtcttattcaaaaacttttgtgagatatataaaattatatacctacataaaaatatatttaacaatgaataaaatgataggaaaagaattaataattacttaaattttttgaataagacgaatgtttaaacatttgataaaaagtcaacggcgtcaaacattttaaaacgaagggagtagttgagaagccatatgatgaggcggatgctcgcgcgctttttattcagaaaaggcgctgcgggattgacatgtaaaagagacggatctattaaagttttcagacgatttcttgagttcttgaccagacaagcttcatagtagcaggttggtatatatctggtgatttatttcatactacgtacaaagatattatatgattttatcatcaggtaacttctaagaaaaaaaaaaagcagacaacagtatgcagtctgcaattaatattgcttccaagttctgagagtggtttgaggtgaagagaaaacaagaatacgtgaaagacgacgggaggtttggactttggtgcttctagtatactagcaagtagcaaagcacgttaatatggtaatttaattttcacatgatttgcagcttcctggctgctgcggccaagagagtgaccggtgttactatcttataatctcgccaggggaagggtttggtagccacattcgtaagtcctgcatagtacaggacatttttcctgaattttcctcttctgtcatcggtagtgagtagtgacagactctgatctcacaaaagccgagctatgtactaccataattgagtacgtacaaaggttcttctgtttgtctgaaagcctgaaatcaccggcaaaaaacgatggtgtgatctgccgtcgccgtccgctcgtggaggagcgcacgtcgctagcttctcccgcgagattgacggcgccgtcgtcgccgcgggggaaggtgtttggaaggggcgcggaaactctagcaccagatgtgtgggcgtcgcgtacgtcgtcgtcgtcgtcgttgtcatggttcaaagtacgagtatgagtgtacgacgtacttgacgatgacggcgcggtgaggcgagaggtcagtggagacgacatgtgtgtgtccatgtcgtcgttgttccatgggaaattttaccataggtcgatcggagtcagcgtttgcgtttccactttccaccgccccaacaaagcgccgcggcccaggcgcgtgcccgccgcgtcctctcgtggcctcgccacggtgagggcgcgtcgtttgattgcctctgctgctgccgaggcgtgaccgcgtgacggtgaggtttcgtttgcgttttatacatagcatgatgtgggctccctcccggtttcgtttgcgtttttatacataggaagaacgtaaaagggaataaaatactggtttcgtttgcattttatacataggaagaacgtaaaatggaataaaatatttcaaaacgtttgcgtttttacatgcggaattgcggaaagcgtaaaaagaattttaaaaaatagtattagaaaaatgaaaagaaatccgacctgccggattcgaaccagcgacctaaggattaatctgcaacactacagtcctccgctctaccaactgagctaaggtcggtctccgtagtccgtccagctaataaagtatttaacattattcgttggtctgcacaaattattttttttttagaatacgcataaggcttgcgtatctttcgacgctgagcttgctgcagcaacgataaaagggctgtgcacacaaagagttcactatgagtgcttgcataaccataggtctgatgaatctgcgacgtggcgaacagtggattggtgcggaagtaactgcgtagtctgcgtgtaatccccactcccaccggccggcgccgaagcggccgcgcgcgccccaaggttcaccacggacaaaccacttcaccggcgcccgcgcgcgcgcacatgccgcgctccatacctccctcccccgcgcgcgcccgtgactccgcccctgcactgcatgcacgtacacgtactacttccccaagctagaagacgcgcggcgcagtcgccgccttcacttctcagttttcctctcctcggcagtccactacatcgacacgacacccctgctccatcctcgcaatgttgcaccatctcgcctataaatatgcccatgcaaagttgcaaacacaaatcaagctaagcagccacacagcccacagcgaaagaattcgccgaacagtggaaagctatagcagcagtcatggccaagcaccacaatcgtcgtctctccgtcgtcgtcgctctgctgatgctagcggcgtcgatcgtcctgctgcttcttgcgccgccctgcgatggtaggagacagctgaggggaagcgaggccaccagaggcggtggagtcggcgaggagaaggcgtcgttgctgccgcctccgatacccaacctgccgctgccgcccatcgtccccgggaatcctcctgctcgcaactccgtcgtcaacaacaaatctccatagctctcttcatcatcatgtctttttaagataagcttgttgttgagaggtagtaataatactctgttgtgtaccaaagcagagagtccttgagaggatcgttgtggtgtgttctttacgtgaaaaccatcggtctttttatgacgtgtcagctctccttaatcttttgcagttaacgatgaatcgtaaatacacgttgatatgtggtaaaaatataggtaacactaatataaaaagataaattggtgtccgctcaataggtaccagattttctaaccgacacccggcaaatgtctctagtgtgaggaggaataaatgtgtcggaactgacacttttgaggttttcgagccgatttatcgagcagatcgatctcaatcaccaagctccccccgagttcaccatcatccccgtcacctaaggacacaatcacaaaatcaatattgaacgtccccagagtccacacagagagaagatgaagttcatccaaaaaatccattagaaataaaatgaagttagatttcacaagttcatcgacgaattaatacacaatcaacattgacacatccagacacaaccgattggactagttgcttgtattagcagatcccaactagtcgtaaaattcagcgttccatggagattgctcatagcaataccgtcattgggggttcggagttcaaagtttcgaaccatcttgtgaccttcgactagtgttcaatcacggatttttttattattttttttagactttttatgttttaattttatttatagatcattcccaaaagtattttcaaatctaaactttttggccacaccagcctgcctgacatggccaaataactctatcacgtcacgcgtagctggtttggtagtgttattctgccacgcaagcctcttgtcacgccaccaccgccagccactcggctgggtggccaaaatgttcaattttcaaaaatattttctaaaaagatctattaataaaattaaaacataaaaagatctaaaaagagagatcgcactccacatatgcaagtgaggatcactgacatgtggacccatagaccctcagacccccatgacatgcaagtgagggtcactgacatgtgggcccctagaccctcatgacagtgagcagtaacaagatcacactaatcaagtactaaaacaaatgtaattcatcggcaaatgatccaaatccacaactggctggagtttcgccatctgaatacaatcgcaacagaacagccggttcggttgccctcgtagtacatcggtatagaagtacagatagatcaagctgcacgagaataacaaaccaaacaatgtaggatgtatatgtgcagaaatcagatatgacagttgagctgagcatgataaatatcaagatacagactgcctcacacaagtttgtactttgtaccgtgtacatcgatatcttctttttacaaatcgctcatgttcatcaacggtaacatgagtcaacctcaaatatttgctttctcagcgtctcccggtacgggtagtttggtattaagttaggtcattctcgtccaaagaatcctcgccgtcatcgtctgccaatttcttgatggtctgcagatcacccgtaggtagtttctttgcaagtcgaattacctgcagtaatattcaccataaatcgaagtgaagaaggatgaacaagcacacgaacaatcgagcagatatcattttagatggaacagactatgttttagctgataatactattatttgtcctatggtatgatgataagtgatggcctgataattgatgaggtatcactgcttaatcaaatgatccaggaatcaatatagtatagagcggtaatgttgactaaaaaagagatcatgagtaacatcttcaacctgtaacgcctcagctcctagcacactgttttacgcatactaactatccaatctgtctaatcgtataaggagattgaaataacagcctggtatatatagttcagatatcggatggccttgtaactaagaaactcaaaatattaccacatggtcaaggtgtttgatggcacttgattgtgcagcctgtttgattccttcagcatcaccttcctcataagcagacagcagtttcattgcacatcgattctggtcactgttaaggaaggcttgaaccctgtaatgtagcagaaggtaataacaatgaaagtgatgtttgggctttggtgcaagaaaatatatcaatggcaatgcacatgtaccaacttttacagtgatagtaactaccatgaatgtacaacttactctgagcagtcattgtaacatttctgagcttgttgaaaatcatgggcataaaggtagatgatgattgcactcaaatagccctgcatattaaaagtaacaattacagaatcagataagtttattgctcaaatttcgataatgcttacatggataatcaatatttattccattcccatttggaattcataaacaaatttacaatttcaaggaagtttcttattatc

SEQ ID NO: 62689 - DNA, 7908 bp, Oryza sativa
  unsure (1)..(7908): unsure at all n locations
ttcctctcccttcctgcacactataaggttgacagagacaaacgagagaagattgatctctgatctcgttctggattactccactctcggtttggtttactcccacactcattcttccatcgttggttcatctccttctgttcctgtgctgcttctgttctccccggtcatgatcgcttgcgtgcacgagtgattgggacgagcagggcctccggaaccacaccctcacctaagtatctgcacgggtaggcgggtgatcaggtttttggagagtgctcccgcacgactgctcttcatctgtttgtcgtcggcgtggacgtcttccgttccggttcgtcttcctctgcattgactacgccaacatgtcgaacaccggcaacgatatcaacactggagacaaggagaaggaggctcccgtcaacaccaacggaggcaatactacctcaaataccagcggagggccattctcatggtataatgtttcttctctagttgttgttgctgcactttacgtatgtgttgttgctgtttacgtttctgcagtttacgtttgtactgctgcagtttacgtatctataggacttcaatcctatgtgattgttgatactgtttatgcttattctatcctaagcatgctcctgcttacgttcagtactatcactagatcacctcacattgcaaatgtcatacttattgtctcaatattttggattaaaaataccgaattgtgaccatatttccaacagtgacgacgccacttctaggccacttttaaatgcttccatttggatgaggaggagaggatactgtggcaccaccaatagctccaactgtagcttctacccaagcaactatgtgccaaatgcaccccagtcaccaccaacatgcatgacgctctgaggggcggacaatataggttgatccttccaaacttgactataaggagacaacgtcttgaggtcgagtctaacatacataaggaatctaagataatttatgctctaaggaatgctaacttccccaaaggtagtttccctctctcttgagaagactaaacactatactacctaaaaagggacatgtttccgcgtgtgccacttcaaggggcctttactcagggatagccttgctctgctcttacctacccttgaacccgatcttgagtaggcgcttagtacaagtcctctttctagaaccggatcccaaagccaacccttagagcgggtacaatagcagctgatacacgggcgatatgcaagccatgtagacaggagtgatgcgttggcagaaaaaaggcatgagagagagggtgagccgacgactaaactgtcgcctggctgcacgcatgtttcgagaaaagtgggacccgagctcgcatgaaagcagtcggtgtagccattgtcagacgggtgtttcaataaattattgttgttgtgaaaggatggacagatggggttagtagcttgcttattgtatcgattagctactaaactaacttttgatgacatggagaatattgccgctagctgtgggcgttactattgatcttgctcttacaaaacatatgcatatcaaatcctagatttcgtaagctaggattggcaaaccgcatacctataaatcaagtcgagggatgagggggataaaaagacatgttttttatccgctcaacagcgatataatccagtgtttagtgacgccccctgtatcgaaacaaacccttcatctagttgacttgaaacccttcaactcaacttgacttcgcaatttgaaggacgtgggtcctaccacccttcctagtaagacctgagcttgctaggatgatttgngaaggggaggagtttgattcaagtaagggatggaagaaatgagtacacgcatacgcgtgtgcacacctacaccaatagaacaacatgcatgggcacactaaatataccacgtgtgcatacacatacccatgccaaagggggatggaagaaatgagtacacgcatacccgtgtgcacacctacaccaatagaacaacatgcatgggcacactaaatataccacgtgtgcatacacatacccatgccaaagggacgtgccttttcaagggctctgaataaaaccaatacatatcgttcaataccctttgctagcagcttgaataaaaccaatacatatcgttcaataccctttgctagcaggccagttgctagcttgactagacagtgccttgcgtgggttagtgttgataaataaggaaaaaaagaacatactttaagtaattgccctattttggtaatggcctcgttgagcctatcaaaatatatcttatcgaagaaagatcttatttagccattaaatgctttctggtattaatagataggagttaatttagaaagttaattaagaactaagagatagtgggatgtctgggctagctcatcctgagcatgggccaatggcccataggcccataactagcctagcctagggttttgccctagctatgtagtataaatagcctagacttatgattgccccacagcccccatatgtttccttgaagtgtgctagggtgagtcttcttccccactattatattcctcactatctctcacatatcccttctaattccaaatcttgctattatatgtagggaagaattttgtgtggcaggggttcaattccttaaaagcatagccccatagggaatctttgatttggtaagcttcctttgtgtatcaaggattccagtcttctaatgtcctttcttccctctccccaaagcatgcgggtggctcgcaagcgaaagcaattgcaaccatgctctccatgatccaacacagtaaatgattttcatgctaggtaaccataggggatgatccccttacccatgggatttgcggggctaaattccctattttatggccgtatatatccggttggatgtagaggtcgggtaaaaaatacccttctctaaaaaaaatgggattatccttgtagatttcagtttctttcctaataacaatagatcaacctgatggcttccatcttctatccggtgtccaaccgctgtggttcttttgtttctgagctgatctaaaactctaatcatgtacttcctataatttgcaggttacttggtttagctagtacagacctgtgaaatttaggttatatgttttcttggtttgaagtgtaatgacttttagctttcctataggtaggaatcgagactaattatatattaccgaggggattggccatcaggcttagtttatatatttataatcaacaaaacaagtgaattaacagatctacaagcaacatatacagattctatgcgatggtgtagctatatatttatgctggaacagtagtagataacttaggaaaatggatctttcagcaacaacatgtttcctctaggccaaatcatccttttcctccaggaagaagtagatctgtactagagaaaattgtgttagatatatctgttcgcatcaatgcttctagcttgctgataactagccttcgcattggctgttttccattctagggctcctttggaatgcaggaattaaaaaacacatgaacaggaaagacgtaggagcagcgatggcatatctagttgatccttaggaattctaaaatgcaggaattgtgtaaaacttgttgttttgatgctccatatatgggtaaagtataggatttttggagagatctcaaggaaagtttcccatggcattcaacctcatgttaaaaatccttcaaatttcccatgaatcaagccattccataggtattttctagaaatctcaagtgcccattcctttgttccaaatgagcatttaggtgaaatttccataggattttaatcctacaaaaaattcttccaaaggagcactaaatttctagttgattcgaggttgcctatacattaggaatattgtcagatgtttgaagctgtttgaagatatctagccatttagttccaaaagaagtgtgaaataatcgtcctataccactgatgcacaaatgcttttttgtggccacaagtttacactagctatttctccatgagagatgctatcatagtgcccagatgatcactttagtcatgggaacagtgaatctgcacctgatatttcatttttaaaaattggtttcacttttgaaatgcgataaacaaggaataactctttcactattgcatgcatgttgtcaggattcaacgaaggtgtgacggattacctggcaaatataaggtacaaagttttcaaacagctagcacaattatttctgtgtgagcaactttttttttgtacttttatgtgtatattttgctgtgttcttcatatatatgataataacaagagagagtattagtagtaccgctgtgatcacatcaaacaaataagttactcatcaccttattctgtttgtctccagggttcattttttaagatcacatcatagtactgtaagaatcatgcacaatgatcttctatcgttccatttacctttactagtcgaatacaacttgtccatatttgtattgaagtgtaatggtgtggaattgaaagctagctaggtttagtatatggatcagctgtccgtggaagcaatatttatacatatatatgatgatgggtctacattcaggtttgttaatctgtaactaattttttaggtattctcttgttcatgtacgaaaacattgtatacagacgttacaattctccttctctctttaatcagatagacgcatggtacggtgcaaggaataatacacttttcactcacataacatggttatatctttgttatatatatttaggtttaaaaaagaaaacacctttttatacataaagatgagatttccatagttggaatttttttctagatattgcagaataaaatgggcttgtgaaattgttgctcattgtattcttttggcctttagccaaattttctggaggcaatggacatcacatgtcattggcaaattgttcaccaattgtaaaacctgggggatgaaaaaaaaatcttttatgggcattttactttgaaatactatcctttcttctgcatatttttcttttgcaattaattagaactgatttaatcctttgcttaatttgtatttctgtgactttaatgtcataaatttctcaaaattaaagtgaacgtatttatcattctgatttgtttcaattgttcaaggttgggaaggtgtcgaaaatggaggaaaaatctagtgctatgtccaacattgcgcccgtcgcacctactcgtattactagatatgataaggatgacaagcataaaccagttatagtttgtgctctggctgctttacctattccttcacaaccacctaaggcttcacaagaacgtaacggcaacgtcgtacattttggacaaaatgtgcaacctgcaaggagaagaacaaattccccataacaaatcttgcatgtcaagttgtttgccctgcttgcacagaaacattcacagcaattgaggtagctagaccaaggaatacatctctctactgtaaagaaaaattggagtctagttcgtctgttgcggctaattcctccttgcagtctactgctgtaactcctattgctgatgtggcctatcacccttccaatatacaagggaagcgtaaagatggagaagtgaagattagtgaggcattccctaagcctgctgttgagaaacttttgcaagcaaggatgaaggagatcttagaaaagaagctcaacgataggcaagcaaaagatgaaggacagtaactgattgagaaaatggtgcctatcccaaggtttggtgctatattatcgagatatttttaggtttccatacttttccttcgcaaagttatatatttgcttgttactaaagtttcttccaagcgccaattatttattgaaaacttttcctagcaaaactatagattatttgttcatacaacacaatttgtgagtagctgtagcctgtagagcctttattttggcttaatatctatacttttaagctggttgtttactcacaggtatatacctccttcgatattattatggttttggtttcattatataaaatgaatgctactgtagctctttcactgattatgatattttctgcctctgtaaactaaaacggcatattaatagactagtctgataatgactataatatattcaattctatatatattgatacttggcattactttccatagtcagtttaatagttctatgtccatgttttatatgtaataataatcctggtaggccttcatgcaccctagtgttgtagtgatcggattaaatacttataagtcgatacatgtctgtattttgtttggtaatgttttatccttgttagcatgaaattacttgttcaattctgtattgaaacataaacattttagtctaaagaaacaaaaacttacttattattcccctagtgaatattacaattttctgaatataataagtacttccatattactttggtgcatctaggttgagaagcacaatggtggatttcgaaggtggcaaagagtgttggaagacgccagatgtgcattttgtggctaaaatcagaagattgataaatgaatatttctaaatggctactcaaaagctagctagacgaatatatttccccctaaacaaatgtttcagcagaagatatataccatagttaatttagtgtatgctgaaaatcctgtaaggttcattattactgatgaacaattatgttttatttgttctattttggggaagatgtcgttacaaatatgcatggaattttcaagtttttatgccaattttcttatttaatgattgtttgattggtatattaagagaggaccattgctacaccctcgaaacaaccaattctaatttgaatacacgaaaaaaaccacatgtattggaactcttatgattgtgattgatatcttaaactaatcctaatgtgggattgtcgaataggcttgctgatggattcaaattttatgtaatttggattttgtaatactccgctcttcaattatcactagaacggataccctcatctcaatcgggcggtaagctccatctcaatcgggcacagagtccgtcacaggctagaagtcactgatgtgaagagttatctcaatcgggcaaacggccgtcacggatgaatctatctcaatcgggccctaagtaaagtccgtcaccgatagctttgacccagacgaccagtcaaactatagcccgtcacagatgacctatctcaatcgggccacaattagtgcccgtcacagatgactactaacctttattgggcctaaactagagcccatcacagatgactactgacctcaatcgggcctaaactagagcccgtcacagatgactattgacctcaatcgggcctaaactagagcccgtcacagatgactgtcatctcaatcgggcatttagttatggcccgtcacagatgactataatccacaaaaaaaaataaattttgttttttggctagcctcaggcctttgctagccatgcccgctgcagaaatgacagaaacaaacacagatatccaatatccccagctccccagcatcacccattcatatacatatgcattcacatacacagacatcaatatatttcacacaaccacacattcacagccatctcatatttcacatccattcacatatttcacatccattcaaatatttatcatatttcacctgcaaaaccaagttaattggatcaaatatttatttagcaagtcttaacataaacatatgaaatatatacataaatataagcatcacagttacatcatcacagttgcataataagtgttcatcattgcctaaacataaaagttcaacattgttcatcatttt

SEQ ID NO: 62690 - DNA, 38826 bp, Oryza sativa
  unsure (1)..(38826): unsure at all n locations
tgaattttttctcaggtttttttacatgtcatgtgccgttggtacctggccctgtcgttgctgtcggtgagggctcgaaatctgctccaaacctgcagcagcagatgcgctagaaagctactactaccactgaattcttactcacagttaagtccactgcaggttcagttcttcggtccctttgaaggtggcggaggcattgctcccagcatgggcgcttcgtttgatgttcggaaaagtgctcgacctggcaaagaaatgctgagtaacaggtttctgaatatggcaagttggagtatatctgtacgaggcacacattaccaaatgtaaagtaattgcgtaatggaacatggaatatcatagccacctttttggcccatagcatgggcgtcagactcctaggatgctctttctccaccacagagaggccactggcgttggcgtcacttgctagcctaaaatcatattgaaattacacaatatgatttaaataactccaacatcacccaaaaagctcacattgttgtgtatttctgttagcaatccagaaaatggttttgcacttaaatgtcagtataaatactgaacatacatacatgaaatagctgtgctcaatattaaaccaaagaaaaggaaaatctggggaagaaaactactatggatcataaacccataaacctatgaattccaatgaaggccttagaagatgcaataataattaagaaaccatagtggcatactaatatcaaaacacttgaacttcaatgttagaagtatccaagtctgttctgaacataccttcattttgcattgccacttgacttaacaaggtatggtgttttgctgagagcttgagctctcatcttttttgcagacattgaaagcgagtgagaggatatcatttccttggtttacattcaggcatcttgtctgctgcatcttacttggtgacaaatgcctccgtctgtaccatataagaaaaaaggacataggaggtcaggataagcaccatttgatgcatctgttacaccagaggtcaaataaaagtagcatacgaaccgaacaagcagaaattatcatgaaataagaaaaatatggtatatctaaactctacatatctagaggtatggaaaaaatgaaagaggccataaaaattggctaaatcattagtggctcaaagatgcagatcagtacatcagacttattcattatatgcatgggagacccaggagtgagaagggtaagacagggtgctaacgagaactcaccagtcaccacttgatcaaattcatcagttctttctatgcaaatatattattgtttgtggttgtgccccccaatctgagccctcactgagcacttcatacagaactgcaaagcaccagccaaatcattgccaactagaacaacttcatctacaatcatattcagttcaacatcttctgccttttcatcttttatcaggtcttcaatgttagtttcctctttgatcactgctaacttgtcatgtccttttgctagatgacctgaaggaaaccgttactgtgttcatccataaaaacatctcttgcttctggcgcgcatgtctctgagaaaagataataacacagtcaatatcaatacaaccgagatattagtgaactctagcatgcttattccaaattcatttaaataaaacttcaggcaggttaccttattcggaactacctgagatcacaaacttcatttgtaggccccacacaaactctcccacctcagttattttgtgtggacctcctgcagctcttggtctttgctggcagtagctagtattgctacagcaagaggaccagaatctgcagtctcttcctgcttgctccagtgatttctgcagatcttcgtagtcttcacccaagaactagttttcttcaacttcggttgtatttttcaatgctttgtatgcctcttcttccttttgcaaggactgctgcatggtagacagctttctcttttcagcatcagtcttcctccctagcagatcacctgctccctatgcagcagcactaagttctgattcgagttcatcagatcaagtatttccttcttcctaagggatttctctttccctggtttttcaattgaaacatttcatcaggagcatatgtctgatatcatgttcattgcagaagtaaggtttcctgctctttttcttggagataacggccttccaatcttctgcagagctggcaacatgaaaatatcaagttatcaacatgaaaatccaggtaaagcaacaactgcagaattttcaggattgcccacaataccaatgttcacatgtaaggtttctagggacaaaattcagttacctcttcgatattattttctaagttatcattgaaattcccagcttcatcaagtgtcgttccctgatgagtaaagcaaacagttaaaataaatatcaacatgtgataaagcaaatgaagcacaaaagcatgcttagtttacctcttcttcctctggatcatcgtaaacacgagtataggtttccttgagaatggatcatcactgaacatacaatcgacatgcaaattaatagtacaaaaagtacaatctaagaaacattttgtaacaacacagctatgagtgtagtgagttgcttgtcatcatgcattacttccttattccgtttttcgtggacttgtaaggttgacggcttattcagaacacaggataggaaaaatgcaagaacaggaaaaacacaggaatagtataggattacatacggaaaacagaggattgaaaactaaggaatttgatgacatgaagcattcagaatacaggaatacatacaacacaagaattttacaatcaagtaacctcatagattataatctaattaagcaatagaatactattttctatctagtcactactctcaagtactctctagacaggaaagccttatcttatccccttcattcatcagttcattcaccgcatcatctttttccccaatgttccagaggcatggggagcagcaaacagacaaaatcaacagggatggcgagctcggtggtaggcggagcaagcgaggcggcggtcgggtgacgagctcgcacgggcgcgtggcaggagtgagctgctgctgtggccactcacaaggtcgagcagctggcaacctcgacttgcttcttccccttgttctttttaattggattgtgtcttattcctatccttcatagttcttgctcagttgcttcgcttgtgtttgtaaaagttcttgtgtattgcttgattgcctcggtcttacgcgaaggaaaacaaaaatgaggtcggagtgggtgttatttttcctgtgtttttcctatgtaatcagcagcaaaggaatctttccttagattatcctatgaattgtttgtgccttccgaatgataggaaagggaaaaatcccaatgaacagtattcctccaaaaatcctttgaaaaatactgtaatccgaagaggccctcgcatctttgcttctgctaacagatctcaatgtactgaaactgtcaagcataccagtttgacagagtctacaaaattatttttgcttaacttacaaaaatggtcaagtagggaacaaatatgtacacatacaaaaacaattactaccagtaataaccgatgatcccattggtcagaatgcaggtgtcatatccaaatctgtaaactgataccgaacaaagcattcactaactacactaaacaattagttgatctaataacatatacataccacatttgaatctgatgggtattcaaatgtttccaataaaattggaccgatgagtccattgcgtaaaggttcccccatttcccattggtagctttcccactaaggtcccgatcaatcggagaagatccaacactaaactaccgccacgcatcaccaaacacaaccgatcagaagttcggaacctggataaaccctaatccttgctgagcactcgaggtatggaactcctagtcacaaactgaatcggaatggtagacggaagaggacctcgcgttacctaggggagggaagaggcaatgcgtctccgaacgccgaggaagaggacgcgcgaacccgcagaaggagagatcgtcggcgccgccggccaccggccgcggcggcgccgccccggacgagcgagggaggaaggaagtgaggcggagagcacgacggcgagggcaattttgtaataagcgcattttgggcttttactaggtaagcattagctgtgggcctttagcgaggaggagagctacggcccaatatgctcaagtcgacacgtggtccacggtggtgttgggcttccctgcctttgaatggtctccaagcccactacgaatatttactttatgcctttttctttttatcttttggatggaaaaaaaatattgtccatcccactagctcttttttggaaaaacaaatgtcatctgcaaggtttgagactttcagcctttcaggggacaagctataatttatggcaccacattttcaaaagaaaaaaagcagtcaaattattcgtttttacactgtaaattatctacatttgcacactaattattattatgtaaatttcaaaagtatatcataaattttctaataagctatataagtgaattatgtttaaaagtaaagtgataggagaggtataaatatatatactgtacatagagacaacaatcacataaggaaaacggttattggaatcaataaaaaaaatgcgtgtcatattttagtaagattgtttttcaaatgtacttaccttcttcaggttagagagtccaaattcccaattgtgattaggactttgttcattaattaattcatataaaaatcccaattacatttagtcatttacagatgtcgttgcctgaatttattgtgatgacaaatagtcatgccgaacaatcatgatgaaggacaaggtttgtgggttatcttaatagaaagaacaaggttgcacgcactaagcgtaattatattgttcaatcaacacggggatgacaattccatgcaaggcaagcaatctaattaagtatcagtactcgagcatgcatgtagtttatagtatactcctagatgattaggtttgaatagttttctcacgtacgcgtatgtacgtgcatgaaggcatctcatccatgaaataattctattttattcgtaagcaagcagaaatggtcagcacagtgattttcttaacacgattttgctgagttggctggcaatttggttcaccgatccgctgataaacagctcgtcggaatgcgcacgtgtgacgttgtctgcagggaaagtttgacaaaattatggggtgatgccaatttacagatttgggtcagattcagcgaattccagctcacgtggtttcagcatgtgcttaaatgattaatttacactcgtaatcttatctgaaatgtcatgaaaggagctgattacagctcaattcatttttaatcatcatactcaaactgtcaaacttatgcaaccttcagtagcgtggagtagggggcagtaacagtgtgatgttcagatgagatggcaagttaggaaatgttcttatgattaacaccaacttagcatataattatatatcatgctgccgccctgcaggtagcgggctgctctgcagacctcactgctttcgtcaaaatcacacactgattagatgtgagtagatatatatctactgcaagacggctatgatcttccctggtaaattaatttgaccaggttaatattttaaaggaggtgaccagagtgaaacctgcagagccttggcttacgtgtttgatagccttaattttatcccatactgccaaagatgacattagtttgttcaggtgtatcaatcacagtatgttactcagaccaactcccatgtacttaaaaattttctgaatttttgacttgatgctcagttagatctccgtggctcattctgcctctggtgattttaattgatgatctccttccctgaaaaggaccggcatgatgacttgtaatgagaggactggacaaaactggccactgaactgcttatcaggcgatcagaaaattcagaagttgtcaaagtcatcaccaagaccaagtacggagtggatggtgttgtgttctttctttcttcttctccccatgttcttaattttgatttcatcacgagaacagtccattccatccgtgtgccttgttacctgacgatgagatggcgaaagcagttcgcagagtagactttgagaagttcgtgttcaaactttcagtgagacatattgcctgaattcagtgacagacactgtgcaagttccttcgaggcaggccagtggtaacaagagacgtacaacaaagcacttggactagatcactcacttatcagttatcactgttaacctcttccttttgccgaaaatagttagcagccagcaagtttttcttcacaaatcttcagagaaaactagcagagaactactgaggaaagctgcagcctttgtcacaggtttgccgtcaggtcaggagttgctcggtagtagtgaacaatatgaaaatgcaaggcataaataatactgctaataaattcaggagcagccatctgttcctgacgtaattagcaaaacttttcttcaggtaggcgctgctgaaatggagatatgcgcatcatgaacatcctgctgctgatcaacaggcgcgacctgttgctacgcatgctgggtgatgccattagacagtgtttgttcggcggatttggactagtaataaaccagggttaagttcagggatcaaggttatagctttggacgcgagtcgctgatttgatgttccattaattactagcggctgtgttgaagtacttgcgtatcatttcttgggcggttttggcccatggatttcgcacggatcgtagtacgagaggccaagccgaccacgcgaatacagcctaatttttcgtcgtcggctccaacgacagcagattcactgtgtggcggtgttgccgtcgcagtgacaccgccggcgatgacgctcagtagatacatgatggaacgataggacactcgtatggggcaccatggtgcccgggcaccatggtatctaatgcacaaaatcactcaaatttttcaaaattttcaaattgtgagtatatacctagttataataatttgattcatacctatacttatcaacaaaacaactcaaatttaactttatttcacaatccatgattacatacctaactaattatatgtatggatactatatacctagaatcaaaatctaacaaaaacaagttcaaattcagttcaaacttgctttaaactagttagtaaagtagttaatgttaatacctaagtaattgaaaaagtttcatactcatttgaattgggtatatactcaatttcaacaatggtgcccgggcaccatggagcaccaaacaaatttactatatatatatatatatatatatataatccctccgtctcattttaaacgtagccatgagttttcttgtcctactttaatcgtctgtcttatttaaatctttttttatgattaatgttttaattgttattagatgataaaatacgaatagtactctacgcatgacttatgtatttgttattttttaaaaaaatttaataagatggacgatcaagattaaacacgaaaactcattattaccctaataatgggacggatggagtatacgggaagggatatctgacggctgaacggatcggatgtgatatgtgacttcaaattctcatatgatttggctgttatatctaggttaatgtttgactgatactccctccgtcccataatataagggattttgagtttttgcttacacggtttgaccactcgtcttattcaaaaaattttagaattattatttgctttttttgacttactttattatccaaaatattttacgcataacttttcgttttttatatttgcataaatttttttgaataaaataagtggtcaaatactacgatcaaaaacttaaaatcctttatattatgggacggagggattactagatttggacatttggaggtacatcaggataactacaacagaataatgttcggggagaaaaaacatcacctagtgcacatgcccttgtacgggaaaaacatcttttttccttttaaaaaaatatagattataatttcacataggggtatcatttttatatagataaatgagccaggataaattaagtccacacttggaattaaaaaaaaattcaaatctagtctagatatagttagatctctaattaaattcaaggagctatagattcggatttacagttggtaaatgtccaactaactactactacatccgtcttaaaatatagctacattacacttgatgtgatatatcctagtccaacgaatctggacagccacttgtctaaatttattgaactatgatgtgtctcatctagtttcaaattgctatatttttagacggagagagttgtagatattagttttttttatcatataataactacgtatcctcgtaatccggatgagaatatgtttgatggagcaagagactaatggagtatacttgcaattactataagctccacaattcaaacataccatattcataacccatccattttagatattacatttttttatggcatcaaacatggcagatgcttaaaacaaactggcgcatatgccttgagcttaaaattccaactccgtatagtatcaagtacagcaatttctattgggtggcgtgcgtcatccacagtagccgtcgttgcgtcagttcttttcatggcacaataaaagaaaaacatatgtggtctttgcctacctacatagatctcccctattaatactccatcgtgtccgtgtcctagaaaaacttctgcacacgcagccgacgcccttctctatctagctaaatctccattttaattcctctctctctctctctttgtgtctttctcaagggagaattaaccatcaaatcaatatatacaatgagcttgatcagcatgatggaggcgaacctgccgccggggttccggttccaccccagggacgaggagctcgtcgtggactacctctaccacaagctctccggcggcggcgagttctacggcggcgtggccatggtcgacgtcgacctcaacaagtgcgagccgtgggagcttccaggtacggatcagatcatctcgtgcaaaacttcagcttaattttctttcggaaaggtgatggcagatgcgtatattgattagctccgagcagcacgaactgtgtgtgattaattagctttgcaccctctgcaccgatccaatggtacatgcataattgcatagcagtcgcataacctgaagaaagaactgtgtgattatttaacatctgcagcttgcacccatccatctgcaatatctgattttcttttttcagaaaggctatacagaacatccgcagcctgcacaattcagaaaatgtttttttttaaaaaaaggatattcagaacatatgcagctttgacgaattcaggccaaaaaaaaagactcagaaaatgaaggaaagaaaaaaaaaagagaaaaatggcgtcgcccggactcgaaccggagaccttcagtgtgttagactgacgtgataaccaactacaccacgacacctttgtgttaccgaaatttagactaaattatatatttttgagaaatcatcttgcacgaattactatgagcaccagctgcatctctgtagatctcgtttcgattttcctttaattttgaaacaagttccatttgcacatttcttcacgtcactagttgcacttgacctatctgaactatatggttttttttacttgccatgaatcgttagcatatttcttgcacaatctgatcatcttccctgcacgcgcacgcgcacgcgccgccggtcgccggcgacgagaagacgccgcgcgggtgggcgccacggagtggtacttcttcagcntgcacgaccgcaagtacgccacggggcagcgcaccaaccgcgccacccgctccggctactggaaggccaccggcaaggaccgcgccatcgtcacccgccgccgcgccgccgccggagaggccgtcgccggcggcgaggtggtcgggatgaggaagacgctggtgttctaccaagggagagccccccggggcagcaagacggagtgggtcatgcacgagttccgcgtggacggacatgccgttgccgaccacccctcctcgtccacctcctcctcctcatctaatcttctcaaggtactacatgccagcatttgttttgcgtgatctcagcagtaattattagtgattaatctatcatcacgcaggtaaaagagtgaaaaaagagagagagagaaagatgagaagtactcactctattccaaaatataagacacaactacccttaactcaaagatcaagaaataattaatatatcattatcgttgtcataaatcactctaattaatacaagagatgcaaccaatagaattaaagatcttgtgagtataggatttaaaataataataacttaggggagagaatgtgataattaattacatgcgtgcgtgcacgtcttatattatgaaactactttaaaaaatagatgtgcctatattttagaatggatggagtaaataattactccctctagttagaaatattttgtgtttggggcgagatttatttagttgaaattttgaattctgataatcagttctcaagcaaaataagtttatgaaatctaataaattcataccacagtacctccgtattaaaatataagtattttttactttgaatctggatagataaaaaatgcttatattctaattcagaggtagctgtattccttttgacacatctacacacgccaatgttttcttttaaaactagtattttagaaattacgaatggttaaaatttcaaaagttgattagatattgtcttatgcatcaaatatttatgattctaatgcctagattaattacgtactgagaaaatacttatataaagtgcgtactaggaagcttcgtcagtgttagaagagttctactcttgtaaatgcccacgattgcacgtctcttggtaagtgacagccagaattaggatagtagtagcaacatgtttctttcacagttttgttttctttggctctacagactttagccgaatgctgtttttttttcctttttctgaacattctgatgtgataaactagttatgcaacttgccaatgattgtttctacttgacctagtcccatccaatcattcccaaaccttgtacgtatcaccaatgcttgccactcgaggtttgttcgattggctacatcgctgtgcatcatcagcaacactaaattacaagcctagatatgtaggggaacaatttgaaaaggatttgactgcttttatagcacagattctttattccaagttgttagttgttctgttaaatgatgatttaaggccctatttagatgggactaaaacttttaagtccctatcacatcggatgtttgaaaattaattataaatattaaacgtagactattaataaaacccatccataatcttggactaatttgtgagacgaatctaatgagcctaattaatccatgattagcctatgtgatgctacagtaaacattctctaattatagattaattaggcttaaaaaatttgtctcgtgaattagcttttatttatgtaattagttttgtaagtagtctatatttaatactctaaattagtgtctaaagacagggactaaagttaagtccctgaatctaaataccacctaagcatattcagattattgaggtttccacaatatcaagcatcgtacgaactgtatatatatctatctatctttacaagataatataaacttcatcccaacctgaggtcaccaaatcttattttaaacacgaatggtaagttaagtacaacttaatctactttgtctgaatatttcttttgacaaaaaaaaaatgcaggaggactgggtgctgtgcagggtgttctacaagagcagaacggctacaccaagggcagtagtctccggtgaggctgccgtgtcactgtccggtgagctcagcttgccgccgccgctgccgccgcccgttgcccccgccgtcgtcgacggctacaccggcggcggctattacgagcaagacagctcagctgggtaccaccaccaccaccaccaccggccgccgccgtcggcagcattgccgttcaaggacctgacggacttcagggacctgctgagcaacatggcacaaggcggcggcggcggcgctgccgccgccaagacggaggggttccatcttggctggagcgaggaggagtcctccggctacgtgcagcagagcgccatggcgtcgcaggcgtggaacccgttctagcttagctagagctagagctagagctatatatagctgatataagctgatccagttctgaacttttttcagaaatggtgatgatatacaaaggcaaagtttgtaggtgtagcttagacaatgtaaatgtaatttatcttcgttgtttcagtaattttcctttgttaattagcgtggttgaatcctagttgtgctactgctagttaacagcgtagtgacaaacaatttgtaaatgtggagatggtttggtttacagtaacttttgagatgtacaaaggattgctccattcagttcattggttgctaaagaagagaaatagattcgatcgttactcatcttccaatgatcctcttagcaaaagtggtgcaattagatatctgttttggatgctttgttttgttcaacatttgctttattatgggctgcaagttttattagcatgcattgtgatggtccagtgaagtccaattatggcccataatcaaggcaggcccatcacagcctgcctagatgaatatctgtctgaagtctgaacatatgatcctcttgtgatttttcatcagaagttgatgtactgcacttgttggattcctccccattacggcatcacggacatctgcagtggttgatgacacttgatggtaaggcagttttgtaccggagtgaccagactctgatatgtcaagaacagacataatgtttctatgcctcaccgaagtactatagtaatcaacatggttcaaccatgcattcttaaatgttaacaaccgatacctgcaccaaatgtttataattgagcttatgcttctcatcgaagggaaaataaagggagaagagcaggagaggatgattcacaaacatacctgatactagttgctaatagattacagttcactacttttcagagacaaaaatgctctagttgaaatgattgccacagggtgtggccttgctagctgttgcccttgtcagagaacattcttcatggaagtatcatagtgttgtgtctttaggtagatggattaataaaatagattgataaatgcagaaagctttggtaaagtgattagcagcaagctaggccatgttccaaaatccaaacggcctcaaaaataaaagcaatggtttgcttcctctgggcggccagatgaagagggacccaagtgttagagcatcttttgctcatagccctcacatggattgccccccatgccggagatcacagaggattaaaggaaacatttgtgactgtttaatataatagtgatcatactaagcactggtgtcccaactagtacaaatgttgcaagcttctttcagagacctgtcccaattaatccagcatctggtgttaagtcaccacacttcttttcagggagtctgattgatccaacatcttgtgttatgtaactcttgggatgctaaacctaaaaaaatcaaatgatagaagagatgattaaagaaggggtaggagtactttgctagttctacatgcatgacagatttcagtaggtttggtatagtttgattgatgagcaggtaataaagacatgcatgtcctgcagagctagattctttttcccctttgtctttggcaagggtagttgcaacaagctagtaagccaaactgccaagacagtagacagagactaattgatctctagctggattagtatattattactgtggcatgtcgagtaactaaccaacttgtgagcaacttcttgattgattttgattttggaatttaggccttctcttgatctgatctgaacttatggtcgcatttacttctttatgttttatcttaacgaaagcgtataggggcctacttacgtatctctgttgtaataataagatagaaaaaagaattagtccgcaattcggattagttcaactaaacaactatgtatatcatctacataatgtacatctttattgcctgtctcctgcatcacggttttctggtaaatgtatcaatcaagtttcaatgaaatatgtcggctgacaatattacatgatctcatataagaaacagtttactggaccaacggaaactgaacaaaaaagttcaaaatggaacctaaatcttcttcaatgatccgattaaaaaaaaggcagattttctgtgtgtttgttagtgaacgtgtcgttcatctgatctaccaaagtttcatgtgcgattctcatctatagtcagaggagagatatcgtggtttcattacgaagatcccaactaattagaatgtttgtcctctgcatgctatgcagctcacatgctaaataggcacggtacgatgacctctttgtcatatctttcaatcattcgaccattagcaagggcacaacacgcgagcttttgtaaatggaaaccaggacatgctccaaatcaaacaacggatacggaaatgtaaagaaatggagcaattataaacaccgacggatttacgggctctaaaagttttgataaatttcactacagaacatcacgacctcgcggttttagctataagatgaagtacaaactcatttttgaaggaaaaaaaaaactctctaaccgttgttattttctagcactcattaaaataatgtatttatgctgacgaggtaacaaggggcctgatattttacacgttgtgacgccgccactattctccccaccatcctcgaccaacctcatcgccgggatgcaaggctgaacttcgctgtgtggttcgtgtggatctgagtaacctaagggtccacacagtattcacctcttggctgttgtggaagaagcagttttcgccaccgtcggactacacacccaaaattgcctcgtcggcgtgctggagactagtttggttcgcgtctgttcaagccaaaccagctcaatatgatctggacccgcacgcaggggcagtttggtcactccgcgtaaaatatcgggccccctattgtctcgtcagcatgaatacattattttaatgagcatgatgtttattgtaaataaccatgtaaaaagagtgttttccctcaaaactgagtttgtgtggtgtcttacagttaaaacttcgaatacgtgatattctgtagtaaaatttgccaatttctttcatgttctgccattgttttttatcgaactcaactaacttatgtctaaatattttaaaaaagtttagcagtatgatacttagtttgaatgtgaggtgaggattggttagttagtgacatggaaaacaaagcgcgcgattagagcatattaactattataaatttaaaatattattttattaaaaatcttctctatatatattttttgtgaagcacaccgtttagccattcggaaaatatgctcacgatgaatcaggaagtagctgaacaaataatctacttagaattccctaaatctagtcgcacaattagttctatgaattcttgagttaataatctgatatgacaagcaatgaatacttagaaaaataacaacaccataatccttaagataagataagtagtgactacaataaaagcaataagagttggcaccgccgatgaccgcggcggcggcggtattggcgacatgttcatctaccacacctcattattgtatcattagtcttagaatgtttcatttcgtagctctctacatacactatttgctccattattaaaaaaacacatacattatttgcacaagttttccatgggaaaatcagattggtcttagccgctgtggtgcaaacctgaaactatgcaaggcaggtccacgcctccactagagccatttcagctgcgctgctgattgctgaagcagtgaagctgacctatgcacaccggtttgcctcgtattctctcttatcggatccggttcacccccgcccgttaacccgaaatcacccgaatatatagcgaactttccgtgacacagtggagttaaccaccactccgctaaccaacctcacgagctgagcttaattgatgcgccatcgccgccggcaatggccgccgccgcagtgaagtcgccggagccgccgttcgcgttccgccccgcccgtcccccgctcccgccgctgctggacgacgaggaggatggcgagttcgagttcagcgtccccgcggccgccgccgtgctgtccgccgccgacgagctgttctccggcgggaggctcgtgccgatgctccccccgccaccgcggcgtcccccttcttcttcttccccgccgtgctcgcccccgccgtgcctggaggttcccccctccgagccggcgtcccctcgcgccccgcggtgtggtgggcatcggtggcgcgatctgctcacgctcgtgtcgaagaggacgagcgacggcgaggcgaaggatcgggtggtgggtgggagtccgaggcggcgggaggcgcacgcccagccgctcctctcgcgggcctcgtcgtcttcctcgtcggcctcgtcgtgcgactccgggatcaggaacgcgcggcggccgccgcggacgcgctccgcgccggtggcgagcctcctccacctcatgtccaagaagcccgccgccgtggacgcgccgccgaagcggcgagaccatcatcaccagcggttcctggcccgcgcctcctcgtcgtcgtcgtcctcggcctcctcctcctccgactccgggaggaactcccgcacgccgtggcacccgcccggccccgcgcggccgcggccggcggtggccgccgagagcccgcgggtgagcgcgtccgggcgcgtggtgttccgcggcctggagcggtgctcgagctcgccggcgacggcgggcatcggcccgcggcggccgcggccgagaggcatggagcggtcgttctcggccaatgtgcgcgtggatccggtgatcaacgtgttcggattcgggcatctgttcctgccatcttcgccggccaaggagaagaaggccgacaaggacagggacatcgccggcggcggcggcggcggcggccggaggaacaggccggcgaagctggccatggtgctgagagatccgcaagattaggtggtggccatgctggaaataatgcatgatattcttccagtctttggattttttttgtaacttcttgctgctgcttgatctaattcttctttgtctttcagttgttgtacacttgcactgtaatatactctagatttagaacaacaatttgcaaaatttcagagacacttttggtgaatctgaattcactgtcagctgtaactctgattataaatgcctatgtaaagaaaggaacttgatgaacataaaacattcggtagtacacaaaaacccaactaaaacaaatgactaaaatgagtactggtactaaaatgcaatcaagctgcaaataggatcaaagatgcaatgtcaaatcaaaagctcacaaccactggagaaaatgtgacaccaaagttttgaaatttctcgtcgtcctcgacagtacggtagaacaggaggcagtgactcctcctccccctgctgctggagtgagagaaatgggttgattagcctcgtgatctgtgcaggttttggggctctgtgctgctctgtccccacggttgtaattcaaaaagataaaaatatggtttgaactaaccagttgtatttggatttatttggttccaaatcattttaaagttcacccgtcgtgttttgacacaaacatgaggatctctcggtacttgttgccgatgctttctttggtgccggcagggacatattcttacgaatctatgcctttttcttaaagcgaaaaatgtgcacacaagttcaagttgtgttcttgtgaggtggatcaagttccagttgtcaccatcatcctcgttgatgttagcattatctcggatcggaagccaagcagaggcagcacgactggaaactcatttttttcaatcgcccaaaagcagtagaatactcatctacctaaccaggatttgctgccgttgatggcgacggcttccggcgccgctgtctcgccgccacacgccggtaaatgtgttatatgcgctaatgcgcacaggtcgacggcgttggtggcgccgccgctgaacacacaaaaaaagaaaaaaaaataagtaagatttggagagacatccttccaaacagttttttttaaaaaaaaattataagctattaagaattgaacaagagacatcaggattgaaatcacacaccccgcgttgcttttggacacgccgggactttggcacagctccagcttcagctccagacaatttcagctccacttaaaataggagtggaactaggtgaaactctcacaaaatgaactagaaagatggagctaagtttaaataggtcaataactccactttaaactttttatagctaaatttagatattggagctatatcaaatattgccgctacgtgtttttctagcttttgtgctgccaacgccctggagaagaaaagatggcggagtggttgagctgacgcgtgtgacccgagagaacggaagcgaaaaccgcaacggccgccggcaacaacaactactcccgtattggcagcaacaacaacgcgacctgacgaaacttttcagctccacggaaaggaaaagggatattttcctttccttatttttgggtgatatatcatatgatctctccccggtggtcaacgactccgccccgagtcccgaccgcgtcacgttacaactcacacgcgacgctgatggatggatcacagcagcatcagcctgattcagcgttggatcggcaagcagcaaaaccgctcgcgaggccgtgaccaactgaccaccaccaccaccacatgtacgtccacatgcgcgaattggcgatggaaacgggacggcatcccgttgcggcaacggagccctgcgagagacgagagacagagggccaaagtttggggagcttttgcgcttctcctgaaatttcctgctgccagaaatttcctcaaacggtttagattttcacacaatttctaagaaactgtacttgtagaatgagagagactagagaacatgattccgttagaacatgatattttaagtgacttcttcctggtacctgatagcctagtatcaagctgttacctaggcatctcggcttcgcttgaggcggagagacaccaccgccgaccgcagcggctgctgcttgcatggggcaagaccacggcggcgcagcacgtggtggtgtggcacctagaccacaccttcgagaagctcgcgtcggcgcacctcccgctcgtggcggcggcaccgctggtggacgcgctgcgtgcgtcgcccgccaagccactcgcgctcttcgacctcgcccgccgcctcccgctccggctccatcggcgaggcgcgctctacttcctccacctctcccctcgcatgttcggcctccgcgccccgctcccgctctccctctcgctcaccgcgcccgccaccgagctcctcgccgttgccgcttcccccacagcggcggccgttggctccggcaatcggtggggcgacggcgacggggagggctgcacctcgggagccatctgatttgtgggaggagagtgagggtaggaggaggggatccggattagtatagattttctcttgtagaattcagaagattagttttctagcttctctatatttttatttattacctctcaaaattttaagcttgtagaatttagaagaatagttttctagcttctctatattcttatttattccttctcataattttaagctttcttaataggatcggagtacacgctgctgagacggcgggatggacgcccctgttgatgggtcccaattcgcgtggaatctcgccgcctcgacgacatgtcacggcgccaccacacgacccgccacgccacggcgcagttcgtgtcgcggaacaggaggatgcatgggcctcgcgcggcgtgtgggggaagctgcgaatctcgcgtgcggatcgtcgcctcgtcgtcgtcggcgggtggaaggatttcttggcgcatgcggtgacggcacgcaccctctggcccagtagtactaccagtagggcccaaggtgaaggcctggctgataattgcgcacgttgcgtgatgggccaggcctggctgggctatcaggccgtacaggccgagatttgcaggagccgcaggttttttggctggtgttgccactgccgggaattcggtgccagcaaaaggttcacgcacccgatcaccgtgtgtgcgttcgtgtttttatgatccttttgtatttggacatttctaacacggagtaatacatagtatgtttcatataataagttatttaactttttctcagttaaactatagagaaatatactaatatttttaatacaaaataaataaactatcaaaatatattcaatgttaaatttaataaaactattttggttttataaatgttgctaatttttttctataaatttaattaaccttaaaagctttgactaagaagaaaatcatatgacttgtaatatagaacggatggagtacatgtttcaccgatctcactgcggcagcctgcatgtcccggtggttgcctcacgacagcacgaggatcattactggtctgcctatgatgtcgttggtggagctaaacatcctgaaaatagctaagtattccctccatcctataataatataatatagcaatataggataggacgagacatttcatataacaatgaatctggacatgcatacgtccagattcattatcctatgaaatgttttgtccggttctatattgctatattataggacggaaggagtagtgagttaaataagaattaagaaaagttaatattggtaaaaatcgaacataaaattctaaaggtcgctccggttaacagaaacttcataatttggatctatatctcctctcgggcagtgtgtggtatgcggcagctgatgctattgaggctaaaccaaacaacttcaatgtgcaaatatcaattcaccaacagaaaaaaaatatttcacacaatcaacttctgtatcctaccataaagtttgaggataatttcaactagtaaaacaacagagaaataataacgtttacatgcacgcaagacaaaatgatttacgtgaaaaaacatcctcagcgtgaggagtaaaaacatcggtccactccaagcatccactatagtacaaataaaatattgtccagaacacctagaggcatatcatagcagcatcaaaatcgtcgagttatacacttggcatcaacaacaaccataacaactaagaggtatagcaacaataagcgaagaaatggtagattatatctcatttgttggacctttaagctacaatgggctaagagcaaaaagctcctgcagagagaatttagcccaacagatgcctgtacaattttttttttgagagctctccgctttgagtacaagctgtagtatctgaacatacgtgcaaacgcactccaccacgcacacacacacccctacacgcatgctagacctatcaactatacacacacgtgctaatgagatgcacaaagccacctaagaaccttgtgcgtgacgaggacgtcactctactattgtggcgctggcacgcatgctagacctatcaactatctgaacatacgtgcaaacgcactccaccacgcacatttgagagctctccactttgagtacagagtacaagctgtagtatctgaacatacgtgcaaacgcactccaccacgcacacacacacccctacacgcatgctaaacctatcaactatctgaacatacgtgcaaacgcactccaccacgcacacacacccctacacgcatgctagacctatcaactatacacacacgtgctaatgagatgcacaaagccacctaagaaccttgtgcgtgacgaggacgtcactctactattgtggcgctggcacgcatgctagacctatcaactatctgaacatacgtgcaaacgcactccaccacgcacacacacacacccctacacgcatgctagacctatcaactatacacacacgtgctaatgagatgcacaaagccacctaagaaccttgtgcgtgacgaggacgtcactctactattgtggcgctggcacaggagagctggaaatttatttgggaataaatcccggtgagacgcgcggatgatgatcccagggatcgaacccgcgcgggctgctcgctcaccagcgatgctagccaaccgagcaacgctcggttctcgatgcctgtacaattggtccaattggtccatgggctaagagcgactcgtggaaacgacagaagtcctctcaaacaaaagaagtaaaagaaacaacagtactagtcaaaatcggtcgttggccactgatcactcgctgactcggccttcagaatcatgcatggcggctgatggtggcgccggtcgatcgagacaaaaacgcatgcgtggatgcatggacatgtccccctcctcgcatcttgcggtttgttgcatgtcgcgcccactcgcgcgcgccgccgtcgtggtgttcgtccagtaatccggccagcatttgcgttcagacttcagcaagtactgccactcaggtggtgtttgaaactagggacttaactttaactttagtctctgtatttaaatattaatttagagtattaaatatagactatttacgaaacaaattacataaatgaaacctaattcgcttaataattttttaaacctaattaatccataattagagaatgtttactgtagcatcacataggctaatcatggattaattaggctcaatagattcgtctcgcgaattagtccaagattatggatgggttttattaatagtctacgtttaatatttataattaatttttaaacatccgatgtgatagggacttaaaagttttagtaccatctaaacagggtctcacgttgatgctagactgctagtgctcttgattattgctatattctctcataatcagatgctatggtttgtgataatgacagttttctaatctttagttatagccgtggtccatgatattacctgagctaatgataagtcaaaagtatattcaattgaatccttccttttggcttctaaatatggataagggcccctttgatttgtaggaaaaatataggaattttggaggatctcaatcctatggaaaaaaaatcctatgaaggcctttgaaacaaaggattgaatcctatccaattctttaaaattcctatggaatgggtaatcctatgcacattttggaggaaaattagcaagaggtctaacctcttggaacatttcctctgagtctatctctctcatctgattcctgcgtttttcctgtggtccaatcaaacggccattcctgtgtgtgtttcctgtgttttgcaatcctctgtgttttacagttgtattcctatcagaatcctgtgttttttctattcctttgttttttcattcctacgattcaaatgggccctttgggaaagtggccttggtagttgcagaaaagctgtacccgatcttaaatttgaatataccaaacaaacagatcagcaagcgaacttcgttgaaaactactactaatggttattggagtacccggctcgatctatgtcttgttattttcccaagatcgttcaaaattttcagcttggtcggtgaagccaacaaaaattcccctcggcaagttggtacttggtagcagacgacgactaagcaccatgattccgagtcgttgcccttgtttttagctaagcatgcgttgatctgagcagtccaacaagtgatacacagagtttttttggcaaaagaaaccggtgcattgcagttagcacactgcagtattcagatttcagtatcaactcgcctgctgttctggaacatccttccctaactcttagaccagcaattcagaaagtactactacaattcagaaagtacttggaaatcttgatctcaatggcaacaacaatgaacaaacagaattgagcttttacactcgaacagactaacagaaccttcagaaatcaagaattctctggtcagtaaagtgacccaggtctgaacattttggcagtagagaaattttacggttcttaaaaagtacctcaagatatttattttttcattaaaaatcttagtacctcaaaatatttagcatccaaagttaccaaaattttatagtagaaaatatggtacctcctgtactttttgaaatatatgataaattgtccttgacaataaggcaatcacagatgctacaattatgtcggcatggcaaccatatctcagaatttcgatgcaactagccgtaggcccgtagtagcctctgctagagtgctagttgacttgcccgtaacgtaaagccgcatgcatatggtacgcccatctcaatcttctcctgcatatatcgttcccgccaaatttcaagtcaaaacctctcgccaaactgacacctttcgtcaaccgcggactctgaccgaagttgacggctgatgcaatctgttctctatatgcataatgtatttgcgaattgagatttgatcatgtgtttgcgtgtaaaagggagaaaatttgtgagcaaaatggcgcatcgcaattcgccagccatgcatacgcgtggtggtgggctgggctggcctccgcttggccacgtccgttttctcagtacaacactgacacttacaacacatccacactcatccctatagatgtatgtacgtaaattctacacctataagtatcttcgaagattggaccaataaatcctataaatctttggtacttacagtatcggatgcatcgagagatactaaatcttacattaaaaaataggtatcttctaatattttctcaatgactttaaaatcactctacctcgcttagttgcacgcatcgattctttgcatctgtcacgcatgtgagatgccactcaccgagatggctgcgccatcttgttgcttcatccactaacgcaagatttgggttcagacttcagctgaattctactggttttgtagcttctttcttttttttcccctctcttttgccggggcagcccaagcagagtgctcctcgcactatcaggttgccaatgatgatgacagtgttctttgattagtccatgctaacggccgagcgaaaccaaccgaaactaactatattcaactaaaatcttttcctggctttctgaatcatgcacggtatgctggaagtgtattcaattactagtgtctgatttttaatttttttaagggtatttaacacacgtctcttttccatatggctaagatttcttttctttttctttttcttttttgcggggacatatggctaagatttctgattagtggtgaagccaacctttcttaacattaaccaaagcacgtgaacttgcttctgtcttgttcgtcttgtgcacgctgcacagtccaatattttcagcatgatatcttgtccgaaaattttatactactgttctctcggtgatcaactgatcaagtaccaaaatgactctgaaatgcagtttaatatatattttttgtgtgtgtcagtactagtattctccattgtgcaatcttaattttctttctggcagatatatgaacatgctttaaaccgctcgtacgagaggttagggtttattattggtcctgtgttgattagaaaggtgcctttgtggaagccaggctaacatttgccctgggtcctgggcaagttggtacgaatcaaagacatagagtgtcgtttatacctaagcatgcgctgatcttaatcctgattcctgaagagtccaaaaagtgttcgtcctatctgatggcacaactgattgctgaaaagaaaccactttcaactggtacaaggacaaatttagcacggtggattcagaatataccactttcaacaggtctaccgtttgaccacccctttttgaaccagcaaaggattttacaacagaagaaaaaagaagtccattttactctcttaaataatttcattagatcacttaacgcctaaattacttttggctcattttactcctaaactattgaaattagtccagtttactccatagtagtaacatttttcttttttgtttctctttatataagctagtagtatattttaagctataattttttagagtcatatgataccattatcaaagttctaaaaatatattcattttctttcacgactgttttcttcaacttcataatctcgatgttcaaatcaatcccctaggtacttccaagttccaactcagataaactgtggtatgaacaaaaagtattgagatgtgagatgtatactattatcgtcctaccaaatttcattgcaaaatataacttatacatggaaaaacataaaagataaatactgttagggaataatcaatcgtttttaatagtttgaaggtgtaaaataagcttacgcggttaagccatctaatgtacggaataatagtttgaaaagattaacttttttcggagccaacagaaacgatgaagccttcgccgtggtactgcccagaatgcggccgcgcgcggcatcttggatcgtttggtcacatggaggctacgaccatgtcggcacggcaagcaaacgatatctgaatttcgatgcaggagtaaactctgaatttattggttgcgtgcagcatcgggccgtatggcccccatctcgtcctcgccgcaacggccaacctgccaacctggtgtcctcctatcctactacttcccgccacttttggagtcaaactgtggcctatctcttcacacgttgacgcgaccacgttgacgcgatcagggagctcgttgacttcacagtggattgccacaccattcgaagttctttatatgcacttgcgattttgattttgatttgatcccatggttgcatggagaggaataaatttgcaagcaaaatgtcgcagcattacacgaagacgatttgcattgccgtcgtcttggtggccgtgctgttctcgttgtcgtcggcggcggcggccggctccggtgcggcggtgtccgtgcagctcgaggcgctgctggagttcaagaacggcgtcgccgacgacccgctcggcgtgctggccggctggagggtggggaagtccggtgatggcgccgtccgcggcggcgcgctgccgcggcattgcaactggacgggcgtcgcctgcgacggcgccggccaggtgacgtccatccagctgccggagtcgaagctccggggcgcgctctccccgttcctcggcaacatctcgacgctccaggtcatcgacctgacgtcgaacgccttcgccggcggcatcccgccgcagctcggccgcctcggcgagctcgagcagctagtcgtttcttcgaactacttcgccggcggcatcccgagcagcctctgcaactgctcggcgatgtgggctctcgccctgaacgtcaacaacctcaccggcgcaatcccttcttgcatcggggatctgtccaatctcgagatcttcgaagcctacctgaacaatcttgacggggagttgccgccgtccatggcgaagctcaaaggcatcatggtcgttgacctcagctgcaaccagctgtctggctcgatcccgccggagatcggcgacctgtcgaacctgcagattcttcagctgtacgagaaccggttctccggccacatcccgcgggagctcggccggtgcaagaacctcaccttgctcaacatattcagcaacgggttcaccggcgagatccccggcgagctcggcgagctcacgaacctggaggtcatgcgcctgtacaagaacgcgctcacgtcggagatcccccggtcgctccggcgttgcgtgtcgctgctgaatctcgacctgtcgatgaaccagctcgccgggcccatcccgccggagctcggcgagctcccgtcgctccagagattgtcgctccatgccaaccggctcgccgggacggttccggcgtcgctgacgaatctcgtcaacctgaccatcctggagctgagcgagaaccacctgtccgggccgcttccggcgagcatcgggtcactgcggaatctccggcggctcatcgtccagaacaactcgctctccggccaaattccggcgagcatcagcaactgcacgcagctggccaacgcgagcatgagcttcaacttgttctccgggccattgccggcggggctcggccggctacagagcctcatgttcttgtcgctcggccaaaactcgttggccggcgacatacccgatgacctgttcgactgcggccaactccagaagctcgacctgtcagagaacagcttcaccggcggcctgagccgccttgtcggccagctcggtaacctcacagtgctgcagctgcaggggaacgctctgtcaggtgagataccggaggagatcggcaacatgacgaagctcatcagcctgaaactcggcaggaaccggttcgccggacatgtcccggcgagcatctcgaacatgtcctccctccagttgctcgatctggggcacaatcgcctcgacggcgtgttcccggctgaggtgttcgagctgcggcagctcaccatcctcggcgccgggtcgaacaggttcgccggccccatccccgacgccgtcgccaacctccggtcgctctcgttcctggacctgtcgagcaacatgctcaacggcacggtgcccgcggcgctgggcaggctcgaccagctcctcacgctggacctctcgcacaaccgcctcgccggcgccatccccggcgcggtgatcgcgagcatgagcaacgtgcagatgtacctcaacctgtcgaacaacgcgttcacgggcgcgatcccggcggagatcggcggcctcgtgatggtccagaccatcgacctgtcgaacaaccagctgtccggcggcgtcccggcgacgctcgccgggtgcaagaacctctactcgctcgacctctccggcaacagcctcaccggcgaactcccggccaacctcttcccccagctcgaccttctgacgaccctgaacatctccggcaacgacctcgacggagagatccccgccgacatcgccgcgctgaagcacatacagacgctcgacgtgtcgaggaacgcgttcgccggggccataccgccggcgctggcgaacctgacggcgctccggtctctcaacctttcgtcgaacaccttcgagggccccgtccccgacggcggcgtgttccggaacctgaccatgtcgagcctgcaggggaacgccggcctctgcggcgggaagctcctcgcgccatgccacggccacgccgccgggaagaagcgggtgttctcgcggacggggctcgtgatcctcgtcgtgctcatcgcgctgtcgacgctgctcctcctcatggtcgcgacgatcctgctcgtcagctaccgccggtacaggaggaagagacgtgccgccgacatcgccggcgactcgccggaggccgccgtcgtggtgccggagctgaggaggttcagttacggccagctggcggccgccaccaactcgttcgaccaaggcaacgtcatcgggagcagcaacctgagcacggtgtacaagggcgtgctcgccggcgacgccgacggcggcatggtcgtcgccgtgaagcggctgaacctggagcagttcccgtccaagtccgacaagtgcttcctcaccgagctcgccacgctgagccggctgcggcacaagaacctggcgcgtgtggtcgggtacgcgtgggaggccggcaagatcaaggccctggtcctcgactacatggtcaacggcgacctggacggcgcgatacacggcggcgccgccgcgccgccgccggcgccgtcgcggtggacggtcagggagcggctgcgggtgtgcgtgtcggtggcgcacgggctggtgtacctccactccgggtacgacttccccgtcgtgcactgcgacgtcaagccgtccaacgtcctgctcgacggcgactgggaggcgcgcgtcagcgacttcggcaccgcgcgcatgctgggcgtccacctgcccgccgccgccaacgccgcggcgcagtcgacggccacctcgtcggcgttccggggcaccgtgggttacatggctccaggtaaaagctacttcctccatttcagattataaaacgttttaactttgattaaggttaaatcgttttaagtttgacgaagtttatgaaaaaaaaataataatatttttaactcacgacaaaattattataaaaatatattcaattattaatttgataaaactaatttagtttgtctataaacttagttaaacttaaaacaggttaattttgatcaaaattaaaacgtctggtaatcggagggagtaccaaactaccaatccaaccatttcgtctcagtgatctctgaactgaaaacgtctaactctgtgctgaaaaaattcagagttcgcgtacatgaggacggtgtcgacgaaggtggacgtgttcagcttcggggtgctggcgatggagctcttcaccgggcggcggccgacggggacgatcgaggaggacggcgtgccgctgacgctgcagcagctcgtcgacaacgcggtctcgagggggctcgacggcgtccacgccgtcctggacccccgcatgaaggtcgccaccgaggccgacctgtccacggcggcggacgtgctcgccgttgccctgtcctgcgccgcgttcgagccggccgaccggcccgacatgggcgccgtgctctcgtccttgctcaagatgagcaagctcgtcggagaagactgaacaaaaaaaaaaaagaagagaaaagctaaactctcgctgcaattctgcagaatgcagcagcgaaaacgtgcaaatttcttggaagattcagagttcagttcatgatgatctcaaatggtttttcgagttgtttgcattgcgaactttctccattgatgaggtgtactgttgctactgtgcatggtcaaggagccgttcgtgtgagcttactgagggtgtgttagttcttcgggagtaaagcttttgaattatacagacacatatttgaagtattaaatgtatactaataacaaaacaaattacagattctgcctgtaaactgtgagacaaatttattaagactaattagttcatcattagcaaatatttattgtagcatcatattgttaaatcatggcgtaatttggctcaaaagattcgtctcaaaatttctatgtaaactgtgcaattgtcaaatcatctgcaattctgcacaatgcagcagtgaaaacgtgcaaatttcttggaagattcagagttcagttcatgatgatatggtttttcgagttctttgcattgcgaactttctccattgatgaggtgtactacttatttgctactgtgcatggtcaaggatccgttcgtgtgagtttgctgagctgaattaattgcgaggaacagtgcaggtgcagtggttaggtatcaatctcgcccatgctgcctgaaagcatgggtctgaagtggtaccaaagtttctgccttttgaccctcccaaaactttcagagctgcaacatacctgtatgcgcaggccctgcaggtgagaatggaagctgaaagattgaaagattcgacggagctgaaaacaatatattactcgagctgcatgagtgcgaacaaaagtggtgaactcatcacaaacatgttaacgtgaattatggcttctcagatgtagatgtgtcttttgaatccccggcagtagcttgttgctgggcagaagaatgtctcctgataactctcatttactactactcaagattaggtgcagataatcaatgccagttttgtcattacaatccgttcataccacaagtacatatttagctaggaaatatccattgctgcaattctctggagtacttgattaaattagccatgttgatttgcttgtcagagcacataagcatcagcagcaggaagtagactgtctgctaatatacagtacagagatcacaaaaacgctttaggtcttgtatgcacagaacatgacgaggaagcaagatcaggatcaccactatttattgacgtacaaaattaactagttaactgcatgcagtagattcatcactccattgagcaacttgtttcatctccaggaacaccatgaactgaatgaaggttatgcagtctagagtagtagagtctagactgcatctgcttctggatctcttagtaactcgtcaggtggtcatcactccaagaagttgtacgatgaattcctctccgtgatccaaccgctgttgtggccactgctactagctagacctcttctctgctgctcctgcattagggatgaacaactactcatcagccatgacgcatagcttttttttttgaacgaatcggcaagctgccaatttcattgaatagagaaggagtaaactttacaagtaagaaaaaccaggcccaggaccgaaggtcctactgagctaaaaataaaaagcaagccagctaccaagaatgacgcatagcattgttcatgtgcagaaagtctcctttttctcaagcacttatagtacatgtaaatacttttctgaagtgttaattagtacatatcatgtaacaatcaaacaccatagacatacataacctcatatcaggaagataaaagctgtactaataatggcgataaaggagtatatatggactacgtaccggcgtgtacaactgcaattttggtggtctgaggaaattttgaggtggctctgaagggtgcaaattctgcatctggctcaagaaatccgactcgacgttagactgtctctgttgggtggcgtgggttatctgaaatggccgcggctcggaggggcgtatgggaggaatttgagaaggatcagctgtgatatagtgcatgtattgttgcagctcaggaggaacaaccggtgccattcccttccccatgaccagcatctgtgtgcatgacatgattatgatcagaaatcacatgaaataaattgcatcacttgatctctaccacagtttcagatataacttgcataaaaagatcaggtcttggttctaataaacctgatcatatcttatgtttgatgctatttgtacctggagttgtagttggagtgatttcaggtagtcgatcgcttcatccagcatcgaaactttgtcggtctgaagaaacaagaagattagaagttcagaactgaatggctctacaagatcgagatatgtatgaccaaagatgcaccacatattgcataccttggtgcaatttggaagtagctcttgcagcgccttcagcttctcattgatcctatcccttctcctctacaggtatccagatcaaagataagaaacaccaagtgcttataaaccagcaattctgatcgatttgcatgataacaacctaccctttctgaaaaattgtggaactcagcagatctgcttctcctggtaggggtaggccttcttgcttccatcggatcttttcaagaatatattcaccttcctggaaacaagatgtgcaataacagatctaacatttaaagataacatacaaacaagaacaatggtaaaactgtctgaaacgtatgaactactcctaagatcatcagcagagataggatcatgttcttccttgtcatgcatacctgagttttggtgtctgctcttcttcttggctagctgcctccttgccttcacctcctccccttatgaactgatacaggctaccaatggctgctagctggtccagccctaagctggcctagagatggagagttctgagagctttcttggtgacaagatggtctcctcgacccaccaacctttagctccagggatagtagtatttatggcatctgaattctataagcttttgcaccatggcatgcagggtctgcgcactgtagttatccttatctttttcactcaccggccgtggaatttcttgtttggatcgatcgtcagcctctaccatgtatctgagtctctgatgggactttgtttacgatttttggagaggcgcccataaggtcaatcatttcacctaccttgctataggtgatggctctaacttgacttgcaaagaaagagttcgtcaaggtacagtactatgcatagattgtttcttcagagttcagagtagtgagggctttctgcataaagacatatacagtagattagtaaatgttgagagaaatcatgactgatgaatgtgaaactagtatgatgtttgtcctactgtaatctgtaatccttacatgcatatgttgttcagcaatattttttttgaacgacctacaccagacattgcgaagattcattgaataaagtaggaaaaaaaattgcaagactagaaccctgggatgcaatagccaggaaagaatgaagaaataaccacccccacgcgccgacaacaccttcacacaacccaggagaaggctagcactggacagaccgcgctagaccaacaaagaaactacaaccgagatcgcccaaaacccaaacctaacaaccatgaccggacaccactctatccacatctttggattgttcagcaataatttcaattatgattgaggatttgttaatacttgggtattatctgaaaaatttagacatgattcttgagctgctaaccaccaacactgtttgctcataaaaccgctaaactttatttttagataatgatagaagaataaaactagtgacaagaaaattgctagtaataaaaatgatagtctggttctggaaaatttgaagatccaagattaattagcatctgattggctgctcatgtgcatcctttatgaacagatgtgactactgacgatcacaattaaaaagcatcgagtagacatgtgcagtgaggatgctggctgctgctagtagtgctagtacctaacatgatgagcagctagctagcaagcagcccatgcgttatttctgaacacaaaaccctcggaaccagaagaatgcatggtatggtgaagcaaattgaagcagcaaagaaacaaagaacacaatcttctcctcacccctaacccctacacacatacaattctccttaattaattcgatcgacatcgatcttgatgattccctgcaaaaccaagagataactttcatcattacatatatacattcaggtgaagaaattctgacgatgatgtggtgaggtgaggtaattaagggtgagctagcatcgtcagcggaaagggtagagtccaagaatcgcccatgccgctgttgcgagggggggatgaggtggaagacgcaggaagggaacaaaggaggcagtcacctccattattttggttgctttcgtagcccgaatgcagcagctagtagaggccaactcctagccctagccctcctcctactcctctgcaatggtagattgcgccggtgactgcacgcgcgtgcgagcgagcagccgagcatgcgtactgccaggttcaggttcggtgaccacgctgacaacagacagattccggcagccaccgcgcgcacgcgtgacaacgcccgattcgctgcgtgcgcgactcgtcgccatcgccatcgccgccgccgccgccgccgcaggtgggcggtgcccgcggcggcggcgttggttagttggttagggccgaatagatccgcgcgatatgggccgaattcgccgggaaaaattgggcctcctcgaggagactcatgggccacgttagggtggagctgaactgatgggccgaactatgtatggttgggccggggatgggccgacgccgcgcgaatctcgaggaggaaccggatgcctcgttctcccttctccgagacgagatcacgagacagcttggctgctcgactcaacgcagcacacgcaagaggagtcgtgggagtccaggagaggaggcggaggcgcggaggagagaggaggaggaggaggaggtggttggtctccgccatggcgagctcgtcgtccgaccccgacaagctcatgtccaaggccgacaagctgcaagtcccttcatccccccatctctctcgcttttctaactccagatgatccgcgagcgccccatccgatttctgtcccttgtttttttagattacggatttttggcgtattttctgtgaatgaggccccttactcgagcgtattaagctgcgccctcgtcaaattcatcacgtcgtagttggcgaatgttagattttgcgttttggatcaaggactgggaactcgtgtggatctgtacctgatctgtagatgggggcagggctaccgttcctatttccaatttcgtggtaccgatttaggattttctcaggagaggaattgcctgtcagtttagttttagcttagtttgtttggtgcaaatttggtgagattttattcaaggtcatgccatgttttggggggaaaggtcatagaagcgagcgcggacgctttgttttgcggcaattttgtttacatatgtgtgctgtgtgggagttaccagcagactttatctcctactatgtagtattcgattttctgttcaaatatcttcagaatacagaatgcaagtacgatacttgtgctacctgtatcaattcagcagtggatgtgcttgtctgtgtaacttcagaagtggaaaatcagccactcgtcatcatttacagtattgttcagaatggatatatgtggtgcaccattgtttagacatgcaaactagagttcacttccagcactcgcacagaaagattacttctcaatgtgtctgattgggatatcttgtttgctctcgttttcatgccagtgcttttgagttgattttgatttaaatactgtcattgttttcatgtacttcctctgtttcgcgttataagacgttttgggttttaaatagattcgtgtatgatccatgtatgtgcttcatatgtatgtcaaaattcatatgaatgttagtgaatctagacgagtgatggaggacccaaaatgttctaagtactctctgtcttaaattgctcccagttcatccacttcagagttagctatatgctaaatatgaacattccttttgcttcgcagaacaaaattgagcttcacgagatggaatgccgattggaagagtgctacctccttgtatgagcaagctggtccgttactttttttgccatgttctattttctttctgtcaatttgcttccctgtggtgtatatgacagaactttcatatctactttaaagctattgcttataggttcaaaaaggagaatgagaaagcaaaggatgcctttgagaaggcttcaaaaggacaggaaatgatttcttcgtatccttcagaaaaaaaatttatagctgttgtattttcacatgattgaactatcacttaatgcacccttaactagtttaatataccctgggatgctgctaaacacatggaatctgctggtgctttagcgaaagagcttggacgctggaatgaagtttcagatttttatcgcagagcatcagaattctatcgtgaatgtggaagagcacaacctgcctctgatgctcttgcaaagggtgccaggtaattcaaaagaaatctgaaacttacgtgaacattgtgaaggattattgttctaacttgatgatatcagtttcttggaggataacactccagacgaagcaataaaaatgtatgatgaggcctgttcaattctagaagaggatggaaaggaacagatggctttcgatttgtatcgtgctgctgcaagtttatatgtcaagctcgagaagtaaggatattccaacatattccaacctgcttaatatttgtttattatattattcttctttccattttttcttttacggatagtttttaatctttttctttcttgctgggtaagttgtcattgtagaaggaattgtcaagtaaaccaataatatttgatcctttgtggcacttgctttaatatcgattatatgtggactgtctctgttttgatataatcacttcccatctcacacttctcattaattacaggaagttcttttcatagacctactagcatatctgtgccggtccatttttcctgaacagtttaaccttactactgtgacggttcttgatagatttttacattcaccctttgaatgattagagcctatcaaattgtttaattgttgatgatttccattcttactacaacctttcaagcttgaagttatcgggaatcaataaattgtcattactatgcatggttttatttaattctgcaacaatactaggaggtttcgctgtacgtctgtttattataactattgaggtcaaatgtacctggctttgatgtgctgtttaggcgtacccttttgctctttgcttgcacatgttttcacactttcttctatggttttgctctttgtttgcatgcattactgctaatctcatttctttgctcattcgcatttattcctatctttggcg

SEQ ID NO: 62691 - DNA, 3995 bp, Oryza sativa
ataagctacgataaaaaaacaaattaaactattgctagtcaatataaattcagaagttaaatttaattttatatttttctgaagtgatttattagatattaatctatgctgttaatttttttctataaatatctttacctattataaaagtttaagatatttttgccagattatttggtccgtcaattagaatcccaatcgtttccgtcgtcgtttttttttcagcctaatcatatgtttcctttttttgttctcatgaccgtaacgcatcgtcgcctactattcgtttttttcgtgtctccttttttttcgactcgttttgtcgtgttttttttgctgtttttatccgggttctttttcttcgttgtttgttttttcccgattcggtttttttgctaggtttctttttcgcttttttcaaccggtttttttatctcatccgatctgttgcatgcttctgtcgccggaccaaacccttacgccgccgccacttcgatctgtctccccatgcgttttctccttgaactgattgcaaaaattgattctccactcctctctcatcatttttctcatgatttctcctttcgattcggttttaaatatctagatttatcagtcactaattatggtcggccgacctttttatcccaattttgtgaattcattttgattttgggaaaaccaaaagaggatattgagtgtataagttgagagataaaaaaaaagattcgaccgaatttaatagggattgctcgcaatcttcctccacgcccgctgattccacccctctctttaaaccaccaccgccgaattccctcacagccgtcatcatcgcgattgccaccgatcccccacctcgggttcatgtcgcggtgaccgagcccccgccgaccgtcgtgccgcgccaccctgccttgccctagcgccatcactgattcgtttcatcgagatctagccgccggcttcgtgccgcccgagagcaggaagaacacggggttggtgtgagggatcctcggctcgatcgaggtgcagcccatgctaattaacggcgccgccgcagccatcttcatcatcaccggcctctaccctcagatgggaaaggaaatcttcatgttcctgtgttccttttctcctgattacaggtcatgtcattgttttggcttatgtttgatcgtgcatcacggccttcataatttctgattgtatttgagctctatctccggacaccctcatgttgttcgatgaaatgcccgtacacatacacggcaagaaatcatgtagtacatggagcagatgttcatgggtaatatatgtgttcatggcttttagggtaactttttttttctaaaattaattgcactgttgtgctgcacatacagcaattactgaattgggattgaacatcttaaatttttatgtgttacatgtaaacatgccattacatgatctggtggccgccactgccctttagctacaacatatatttggatcattcatacatttatatatttctgaaagtggtccaggtcatcaaggttgtctaaagatatcgaaactaattcacggactaattcaaaaccaatattattttcttaagatcatagatttagactgtatatatgtgaattgacggcaactattgaataaatatggtcaaatatctcatgaacccgcccttttttttcagaatcctttttttgtgaaaaaataaaaccatctcattatggtagtactcgagttgtgaagttaccgatgaaaacattcaaactgaatttggttgctgcatttaggatgtcataggtattttcttttttaatctctctcgctgatttggtttcattcatttagatgagtattgaaaacctttctcttgtgataattttattcagttatgtatttcattcagctgatgaattatcctttgatcatagccattataaatgaaatataaactgaattgcactatctgcatgatataacttctacaattggattatgtttttctgattttggcatatattgtatatgaatttcgtatacttggataaccgtgtttctggtttgtttaggaccttagggggcatgtttctgaaatttaccgtctggaaaaaattctgacattgcttattatatactcagattttccagaaaaatgcttatgtattgccagccttctagcacatgagtttggatgcttgttattgactgacataatgataacttgcaatattaaatcggaatacaaacagtgagtataaaaacttttgtatgaatggaaccgtttgtgttattagagtgaggtttacatttggtcaatattatatttccgtttatgttcatgaaattcatcttgtttctgttcagtgcagtactcccttattgattccttcctcatttctgaacaaaaaggactcacgaatcttagatggcatcatctacactattgatgcatcatctgcactattgacctccttatgttcatgcgatggatattttttcagatcagtgcagtacaatcctacttttgattagtgatgataaatagaagtttgatcgttgaactgatcaatacaagatccttatttgtaagtagcatctattgcacctaattttgtatatgcagtacattagttaggatcatgtatattttggtattgctggcaaatataactctcaccttggatcaaaaatgatttcagctaaacaccacctatataagtttaacagatatttatctaaactcaaaactgaaaaaaaaatgtgtttaatgtctgaaacttgcaaggtgctactatgatctctgaacaaataaacggtctgagtttcctagcagcaaattgatttgttcagagatttaggtgggggcacgccataataaatcgttgagactaggtcttataacaaattaacatgattttttaaagcaaattttctttatatttttttacataaaatatacagatcggaaaagcgtgcgtataaaaataagtgagtataagttaggaagatggagtaaaaagcacacccttaacccactaacctatgttttgcctcattgtaccccttgaactactaaaattggtttgctcgagcatttatcttcttcgtctctttttatacgagtcatattctaaagctgatattttgcagggccagacataacaccattatcaaagctctaaaatatttttaaaaattttcatgactattgtttgaaatttgaaaccacgatgtttaaatcatgcttactgctttgaaatatatgtatacggtggtaaaaaaatatgaaaaatactgagaggtaggttataatatatctatatatcaatcctaccaaatttgcttacaaaatacgacgtatatggttgtatatctttatctacttaaaacattcatagtgtttttgccgtgcatcgtagaaaagtgtgtctcacacaatttttcatccgacatgtgaattgttggtccgtatccatgtcccctgcaagcgtcaaactcttccgcccacgtgaaacggaaacaatcacgtataaaaattcagtttccaatccgagcacgacaacatcacgcacccactgcctgtagcctcaagcagtgacatgtgcctcccctatcacaaaaacgagactcatgacggtcaattgtcttttgagctgatagagattttttgctggtgggtctcacgaatatgtcttcaagtgtatagaaatcttgtgaccgccaacagttcgtagaatatactttactcccttcgtttcatattatttatttcactgaaccagttttagctattaattatttggcaaaatttgctacaagaaacgcaaaaaacgtgtaattggctgagagacaccgtgaaaacgtgacacggctgatggacactacaaaaaatgtgtaattggccataggacaccggtcgcattattttattatttccgggtcaaaagaggtgatttcaaaatgacaagattgcccatggagccatattcccccgc

SEQ ID NO: 62692 - DNA, 906 bp, Oryza sativa
agttgtttaatccaacgtaagtattgtgcggtaatatcttccgaccattcgctggttggctctaaaaccggatgtccgcgataagtcggcaagtgacgaatatcagcggcatagccattgtgctcgtgaatttgcaggcgaatttgtgcggttgccacctcatcacttaaacgagtaagttgtggcatatcggtcagcacggcggagcgtagcggataaaccacggtgctggtatcaaagcgattcagtaacgaacgttttatttcaagcttatcaggctcaatgccggtaatatccaccatttcacgtttgttcccgttcatcaaaaccgcacgcccaccgacataaaagtcaaagcccgtggtggcaagtgataacgttttatcgcctggtttagttggcttgtctaaatagacttgatgagtaaaaattggcaatgcccacacccttgcaccgtaagcgtagagcatattttctaaccgctgacattctgttccgacagtggaaactttaaattcaaaggttcgacgggggataaccgtttagcaatacgttgttccgcaccggtaatagattgatgcaccgtcgttaaaaactccagtttttcggtcacgtcttcagaccaatcggggaaaaattcccagtcggtagagcgtgaaccagtgatacgcaacgtaaccggatttttgccagcaatcgtaaaagttactgtgcaatcaatttctgccggaccattcatgctgactttaactgtccactttttaagtgctaacgcgcgtagcgtaaacggcgcttgactgctggttagcgtaatgccttcgccgtctttaatgtcaatcttagttaaattaacgctatgtcggttcgcgttccacaagtgcacatcaaacacttgctctgtcgaga

SEQ ID NO: 62693 - DNA, 1904 bp, Oryza sativa
cgaatagcacgactttcgcaactatcgccacaagaacgacacgctatacgatgttgtaataaacaacattcctgcactgcgactttgtgttgccaagcaacttcactggtggcgagaaaaacgcccgcttgacaactttgcacacatttttcacaaaaggtacattcgcctttgctgaaatctacttcaggataaccacccgcacctcgtacaataatttgtgtttcacagattgttatacagttatcgcaagcggtacatttagttaaaaaattagctaaatttacccaaggcggacgcacggcattatgcccttgcaaagtcgcttgttttgtttttaaggtgcttaagaaatgcccacgtaaaaaactgcgacgtggtaaagattggtcagttaatttagccaaaacacaccttttacaaattaaactcgatatgatttattatctgatttttactggtctgccttcatcactccatttaggtatttaataaataaacggcgttattcttgataagaatcaaaaaacacgccgtttaattttatattagcaaagtaattaaaaatcattctcaatttaaacaatcgaaaataacatttcctaaccagatttaactcaataaattccatattttagaatattgctgttatatatcattttactttttcatagcatttattacatttagataatctttgctttcattattcttctcaacactttatttaacctgccatttcaagcattatggctacttacgttgtatgccaacagactcatcacatatttatcctaaaaaacagtaataaaattttatagattattaagaattacactcatcatataaagataataagattgaattaattctttattgcttatttttagtatattccattcatattttttcagcttattacaaaccttattttttctgttctatatctattcacgactcaatattcttgcaaagaatatttttataaatttagccttataaaataaaaataaaccgaaattagtatacaactatatggataacatattttattgcgggaaaatttgttttagaatcagtaaatattctctgatttctggtcgctagtatttatgaaaaacttcttcaaaaaagtccactctgagtggttgtctgaaaatattattaagacattgccgatctttatcgcgatcaatttaatctcaatcatcgtttggcgattacagatatcacaattatcaatgccgttaatcttaggcgttatagcgggggggttggttgacttagacaataatttaaccggtcgaattaaaaacttaatgttaagtttaattgcctttactatttcctcattaggtgcgcaattttgttagtatttggttggttatttttacctgcggcaatgttaagtacctttattttagtgatgatgggtgcggttggacaacgttatagcaccattgccttcggtactttacttgtagcaatttataccagtttaacgtatatgcaggagcacccttggtatagcaatattatccttattttagttggcaccttgatttatagtttagtcagctaattggtctatctatgctttccaaaccgcattgcccaagaaaatttagccaaagcctatgatgcattaagtctttatttacaagctaaatctgaattttttgatccagataatgatgatttagccgctaagcaatttgccttagccaaagccaatcagcaagttacccaagcattcgaacaaactcgtgtttcgcttttttatcagttaaaaaggaatagccgtaaaacgcgcaccaaccagttattacaggattattttattgctcaagatattttagagcgggcaagctcaagctattatcaatatcacgaactttttcaac

SEQ ID NO: 62694 - DNA, 10933 bp, Oryza sativa
cggatattggtctagcaatctgaagcacagttcttcctcagtactgaattgtggacaagacgaccattaatttgtcattttggttggagtcgtagagattagttgatgaagcagctggtttgtcctgaagtatttgacaaattgagcaagaatttagtcagtattgttgtttgaaagtacaattgatcagcgtactatatgtacaagtggtgttatgcaagctactcctagctgcagggcactcgtttggcgccgatgatcagagccatctcaatctactcgaaaggaatcttgagcaggcaaaggtatattccgacctcaactgtaaagtttatctaatcctttcaaaatggataaggattgaaactttgaagatgcaaatgctagctagcccaccaactagtcctttgcatagtacaagaccaattatatatcagcacattcagacaagaacaaattgtttaatttgtaaggtccaatgaatcaacgacaaagtagcatgtttctttcgtgtgcttgataccagaataattaagaaacatgcataaagattatcatataaattggcttgagtactagcttgcacgatattaccatttataatttacattcttgtacatgaaaatgaaaacaaaaaaaaactcacaaattaatgccataggaagaaatctgaatctttccttgcatgggttacatcaagaattccgtctgtttgtctatctgtcatgcaactcctcaaaataaatccaaatggaacaatcagtatcttcctctctgaatctgtagtttcattcgttgaaattaattcacctctcttcagatcgatcggtaaacggatctagacgcctactagctactgcatctgcagatgattgttcagcagtagctgctggttcagaggaaatggatggctcaacatattgccgttctgaaactgaaaaccagtcgcagtctctgaaagctgctggttgcagtaacctcctccaaaaccactgccccttgaatcacttggcagcagcagcggtttcttggcaacatgcaaaaagtcactgctgctgctgctgctgccatcatcaaaagaagttgcactacacgccatcattctcttcctccttaggccattaacattataattgttaacgtaaccatcgtgatgatctaggcgtgactcgaaggcgtgtggcatgttgttgttgatgttatagtttagtgtttggtttggatatattagagggctgggaggagcaggaagctcagcgatggcgtcggatgagccgtcgaggagaaactgcgagagcgcggcgcagtcgaggttgttgaggagatcggtgagggagcatgacttgctcatgctcatcgccgtcatgggctggaaatctgactgttggttgttcatgtcaggtggagcaggaggttgttgagaggaagagttgttgtcatggatgtcttcaagctgttcatcgacggttgatccctcgggttcttggtcgtgttggtcagaggaattgaagtcgttgctcttcttgtggattctgcacagcacccagtcgtccagctgatgaacaatatcacaaatgcagtaaacaataattagaagtgtgcaaacttgctttatttatttttaaaataaagaataaaacacaagctcaatcaacatcaacaaatttgactttgtagagtgagttaactaagagcaacatgcacgtttgcttccttcaatatgccaattcaaacaacgacgtagctttcaaagaagacgtacgacgaagagaaaaacaaattaataatgaactaaaattaagtaattaaatgaatctcaccctcatggtcatggatgatgctctacgctgctttgtggtggtggtgttgttagctgatgtgcctgtgaggcgatactcgtgcatgatccagtcggtcttgacgcccttggggggcttgcccttgtagaagactagggccttcttgacgccgatgttgtcgctcgtcggagttgacaagatggacttgtcggtgccggtggccttccagtaccccgagccggcggcgcggttggggcgtgcgccgttggggtacttgcggtccctcgggctgaagaagtaccattcgttctcgccgaacagcgccttacctgcaacattccatatccattttcaaagcccaaaattaaatttggtcagtttgaaggcattaatttgatcgagtttaattgatacatggatagtttatatatgtatggtgattagttagttagttaccaggaaggtcccatgggttgcacttgtagatgttgacctcggcgatgattggcacggggcacttgatggaggcggcctggttcatgaggtagtgaacgatgagctcctcgtcggtggggtggaagcggaagcctggtggaagggcaggcatggcgccgccgctgctcggcatgctcagctccttcaatcggctcgcctagctagattttttttctttttttaaaaaaaaacaaacaaacagaataacagatggtgtttggtcagcgtgagctgaaggaagaagatgacgacctggctagcttagattacgtaggaggaaaactggcactagtgaaggaaggaagctaataagctaaggaagaggaaggattgaaatttttgagatggagggggtagggctctcttttatagacgccatgggcttggctcatcttcttgctgttcgggagaaagagaggtgggtgcatggatggattactacaaagcaattgattaatgagagctaattaactaggggcacaatagacaattaactagttattagtaggtggcgtggatgtgagtaccaaagactggaccacatttgacacttaaccatgcatgtcagattaaataacttgaaatttcagcgtccaagcgatttagtcgtaagttcagtttgacatagggttgtactacttgctacctcctttgatcgttgcattttttgtcaccggattactatttatttgcaaagtttcactatttatcttttttcaaaaaagaatgacattgttcttagtactctctatggcttcatatgttattgaagttagtagcaaataattcaaaaagtcaaatctaactcttgtaaaattaatcagtggcaaatgaaggtaatacaatgaaagagccatacaaatatatatttcaatcgtcttctatcttcattccaaaataaatttattttataatatgaatatagatacattcaaaataaatttattataaggcgaagataagataccatgagaagagaatatcgtcaaaccattaaccatggcatgatatactaaaacaaatattactccgcgtacgtagtagtaccacccaaggacaattggtaatgcaagaagctaatgacctgtccttggcgcatgcatatatacacagtaattataattgtacgtacgtggctccacgtcagctagctaccagtgggcaggggggaccacaacgtacgtgtggtgtggataaactcatgcatatggaagcaaaacaaatggatcgatcggctttaatttgttcttcacatactgtactaaagacgatgacgacacatgcatccagtagtacatggatttatgttgagccgtccaggtgtcaactacgcattgccgccaatgatatgtgcaccgatatgatggttccgtcttggcagcttgtgcgcgtggcacgctttcgactctttcttcttttgttaggccgaccggtgggccccacctacctcgtggaaaccacctgcatcgtcactccatgggctctaccctcgcttacactagacgacaatttggttgacgattaattaaagggttaattggatccatactactttaattttgcccattcattagatctatgctattatcatcatgtttgatattatcatatagactaaaatatctctagacgtgagatccacatgttagtcatatcttctttctccatcctcccattttttctcttatctgccggacgacacaacgcctctatctgcatctcgtcctcctctcgatctccccacgccccgtccgctagagaccaaggcctcgccctctctctccatctcatgtcctcctcctcccgatctcatcgtgctccgctcacttgctagagaccaaggcctcggcctcggcctcaaccttcaggacctcggatctagaggatgaaaggcggaagcatgctggccgtcgaagctctggtgccccttgcaacaagcatcaggatgacgacgttgatcagggagccgcgagcaaggagaagggcggagctctggtgcctcttcagacgagtagcaggatggccggctagggagcgatgagcaaggagaagtgcaccggggaggggggatagtagtggtggtggattgtcatggccaaagctcctccatgcggtttgcggcacctggcgcaccaaagaatttactatttgccatcttttcaaaatgtacatgcccaactctcccaaatgttcacttgatttgccatccggtcccatatgtcagcctccttccacgtttggacaaatgagatgtgggatcaggtgatgaaggaggctgacatgtgagaccgggtagaaaatgtgaatgaaaattatggagagtggcatttgggcttgtgcattttgggaggatggcaaatagtaaattctccccctgacgcgccgatgccaagcaacaggacggcggtgttgcccagggagcacacacgcctaatccgagtgctaggagcacgaatatttccatgcgacacatcatcttggcctaaaaggaacatcgtcttggcgacaagtgtgatgacggcttccgtaacgaatgttaccgccggctgcatccatgccggcatgctcgtgtcctctactcactgttgcgctctcttgccggttgaggaatggggatgagacagtgtggtagagaagatgagagaaatcatggagtgacatggttcaaattttataaatttccagtgacacttaaccaatatctcgaattgtaatagcacttttttgaattagcaaaattgtaatggcatggatcaaattaaccattaattaaagcgcatgcatgtatcatatcatgatgtgtagtactccatccggcccaaaataacttaatctaggatagaatgtgatatatcctggaataacaaatttggacaagtgttatcgagattcgttatcctaaaatatgtcgtattttatccaagattgagttattttttttagatgtagggtgtactctcttcataaggtaccctgcactaaagccaaaacaaacagatgaagcacgccttgactttggtgtgttcagttcacgttaaaattggaagtttggttgaaattggaacgatgtgacggaaaacttgaaagtttgtatgtgtagaaaagttttgatgtaatggaaaagttgaaagtttaaagaaaaattttggagctaaactcggcctaagacgacgacgaatgctccaaattgacaagatcatgatcgatcgaccgatatggatgatcctgctgtgcacatgcatgcagcaaattaatgcggcatgtgccatggatatatagagtatagaccagccgcctgaaaaatgcacgtgagtaacgttgataaagtatctcccacgcggccggagctaactagctagatgaggtacacgtacgcgcgatggacaacttcaataccaatactggtactttgcaattttttatatatatgaaaataaatttatttttcattcatctaatacatactccctccttcccagtatagtggacgtttttaactttgtactttcaacgtttgactattcgttttatttgaaaaattagtgcaaatataaaaaagataagtcatatgtaaagtacttttgataataaagcaattgacaaacaaaataaataataattccaaaattttttgaataagacgaatgatcaaaaattataaaaaaaactcaaaaagacaagtaatatgggacggaggtagtaccaatatatttttgaaaaaactcaagtttaaaacatatcgatcaattaggaggagacagaaagtacagcgtgtggctgctcaaatggaccggtcataaatctaaatctaacagctagaaaggagtcaaagaattcggcccacgtgtgagtgtgtgcattgctggctgacggcccaagtgacgaaatgtgtgaaagggacgtagtcctacatacgtacgtcgtagtaccaaattaattaataacgcatctaataattttaccgagtgaatactactcctacgtaccagtataattcttccttatttcatattcaccactgatggctatgttctaccagtacaattgacattctaccactggtggctgccgatatatataaaaacaggctagcgagttgggatgaaaaaggttcgaaaatttttctactctagatgttcacatttgtacttagtattgaggtggttagttaaatgaacgttttttttttcagtcaggtgttttagatcatttttcttttgcctaatcgctattttttgttttggtactacttatagttaccaattaaataattgttgattattgtagttctatcggagagtgaagtatacaattatttgtattattaccaattgatgacaatcgatgaaaaggttctatatgcagattggaatatttggaagcatcgaaatggttatattaatttttgataatgttgcaccctcagttttctcttgaatgacattctttaagaatgacttatcccatcttgtttttttgtttaagtttagattaaatatcagcgtctatctcctggataagtcagttgtagtaccttttattttaacctcctttttataatatatttactatgggggcttcctcatagtgctttcataaaaaaaagatgatagatttattatttttaaaaacaataagctacatctctttgttgatttgagaaggccagttagaattgtttttatattccgataaacattgttaccgtattcgctccgatctatattcactctattttagtattcaataatattcgattccgtttttataaccgtggttttcaattctgagaagaaatggaaacgaaaatggtagagctagttttctagctgttttcattcctaccagtgattatatatatataatcttaattaatttacttacaaaataattactagtcgcaggcacatctggggacgtatgacgtgcaagggctctaggcgtcaaagggctggtacctttcttccttgcccgtgcggatggaacggattatctactaccggagtacttgactaaaacaaacatcagatccatatagctttatagttggccttattacacgtcacgatcttgacacccagttcaacaatcctctactcatttctaccaagaaattctagcttgtgataagtacctataccaatccagtttgcatgcgtccatattagactctcctgtcaaaagatgttcgttcatatagatcgatagctatgtcaactgtgtattatatactagtatatcattagcaaaagtcgtacacaaagcaagtaaagtcatactgtagggcttttttgtcaggcgctatacaaattaattgaaattaatgttgaagggtcttaaaatgcaactgtactgcattcagatatgcacgcatatccgttcatgcaaatatatctatgttgacgtcttaaaatcgcacgtataataagttatttatgatatccatccatgtacggcccgccgtgacgccgccgccgcacgccgcagcaacgcacgccgccgcccgcgcaaccggctgtctccaaacaaatttagggttagtgtcttagggaattggggatttttggaggaggggatttttgtttggaaatgggctcagttgcggcccaagtggaatgcgggccgagtggaaagggggaggggagtggaaaatttaggcccaatacaacagaaatggtaaaacaaggcccaaataagtagcttctttatctttttgcatacatatatgaactatagagtatatatacctattttttgtccaaaaatctttggtatacatctgaatacccttgaattatagctgggcctgcccctgcacgtacctattaatcatgtgactcatttttgcacaaaattactacgattcaaaagtactacatgggtgcaaagcggtcggtttaacaagaaacctctttctcgttaaaaaagaaaaacctctttctcaacctactagaccaacttaaatttctaggcctactaagcctacttagattcattgtgctatcaacttattgggccattcttttcaggatacctatttagttattgggccttaacgttgagccaatatctgctgtaatcgaccctgctcatgctgttatgcagataaattaattagctgcttaattaatcacttacatccgaggccatgtagtagaaactggtcgcaacgtagagctcgtcctgcccagcgccaccgccgccgttccacactccgttgaagctgcagttgttggtttcgcagggcgcgtccaggttgagtgccttcaccacctcatctctgcacttgtggtagtctgctccttgtggcgcgccgttgcatcatactgctccccgttataaatgtacttacctttaatattccaaggattggcacaattaaaccacttgattaattataattagaaatgtagtaaacaatggattaattacatactccctctatttattataagtcactttgatttttttagtcaaattttttaaaagttcgaccaaatttatatacaaatacaataatatttatagcaccaaatcaattttattaaatctaaaattgaatatattttgatagtttacttattttatgttaaaaatattattatatttttttataaatttagtaaaaactaaagaaatttgacttagaaaaaaataaaacgacttataatataaaagagatgtatttcgtaaaacggaggtattatatatgatgcatcttgaagaaaaaagatgtgtaaacaaatctcaaggaacaagctagtaccgcaaaatccgcgcagcatgcagttgctaaatgtcccattcttcctttttaggatctccacgcgagaagcccgagcaccatagtgcaggtaactgcagattgatgattattgatcttagctagtaactacagtgataaaaagtatgcataattccttcccatagcttcagttatatattcactagagaactgttcaacaacgtagcagactgaggattgatcttagttaactgaacgttacactcttgaaaaccttattattcagctgctggtagtagagattgagatgtaaaatgagatcgatctgataaaaaaaataaaaacgaattaagttactgacctgtgcacataaacattgtaatctcttcctttaagatactcctttataatgtaaggatcctgcccatcgggcatttctggagcattagcagctgtgcctgatgagatggcataggccatttgcacggatccgcctccgagatcaatcacacccacagttttggagtagtcacctcctaatctatccaacaaatagttaagtgcaacccacatgtaagatcattcttgagatccactaagaacattaatccagtttggattgtattggaacttggtcttggtgtggacaacatctctaacctgtattatgaatcaaattgctgctagtgatatgaaggtgtttaatttgtatggtacgattattctgaaagtatacttaccgcttcaagaatctagtttgtcttgtcatctccaataagtctgagtccagcagttgcctacatgttcgattggcaagttaaaaggtttttttgtgagtaatatttgtttcaatttttctattttaatttgttcaaggaggaaacatatttttacaacgttacggtaggaaaatggtttcaactcgagtgatactccctccgttcgctcttacaaggcatattctaactctacaaatgactttaagactaaatttgaccattaatttctgataatatatattcatgataagcatgaaactaatattatagtagtatatgaaaagctctttgaaatccagatctagtcttataaaactgaacggtggaagtattctaacttatgggtaaaggatataagcaggttcataatcctaataaatcaaatctgctcacgagcgacatcatcggatttcatgtaatccgtaaaaaaactgatagaaaccaatgaaatctggataaattttatcaacaaaataaaattcactttaaactttttaaaaaattgatcgaaaaatcaagtggtttgtgtttacgacctggtcaaaaagttcggatttcgcgagatctaaatcagatttaattgaaattgggaaccctggatacaagagactacttcgtcacatggtccaatatttttttcttgtctgtattgatgttgttctcaagtagttgcaccaatctcaaaaccaggggccaacttaaatatttgattaaagtcataaacgtctactatatctatcgttttagaaaagcaaattagatgaaaagcaaattaaattttgttaagtacggtaccccaagttcaaggggagttttgttcataagccagatagggatagcgtggttggccttgtcaagcagaggcattatggattttgctgcctcttgcggccgcccagcgtacgagctcagcccaggatccacctgcaaccaacacaaaaattatgtttatatatctttattagtagtagtagtaattaagtagtaggaggataataattatctttagcagttaataagtactctcaccaattgataatacttgttattttgaacaaacatgatgtcaaactttaaaatctttgattacgaataatttttaaacactggtggag

SEQ ID NO: 62695 - DNA, 668 bp, Oryza sativa
gtaaagtaaaaaaaccattcaaaggcttgcaccaaggtttttaattgcaaattcgttaacgcaaataaacccaccaaaaattaaactgtccaaaaacacactaaagaaagtaattcctcttatttctttcgccattgttttattcctctttaaatagatgtcctacattcacaagttcttcgctgtctatccacgaccaaacatcaaaacaaggacaatctttgacccattcccatttatctactttgccgttaccatttgtgtcaggcgagagatcacgatgaccacagatttttgctttcgggtgttttgcctctagctcacgcaacaaacggtgtaatgcgtgccattgcttctcggtgtatgcaccgtgatttctaccactggcagtaatgccaccgacaaggcaaataccaaggctattactgttatgaccttgcacgtgagcgcctacttcgccaatcattcggcctgtttcacagtaccgtctgcatcaatcacaaagtggtaaccgaggtgggctaaatgtgggttgtattgcttaaccgctgctgcagtgcgcttaaagcctcgtttcttatgccacacattaatgcgttcggcagccgtttgggttgcatttcgtaaaagcttgccgttttggggtaccgagctcgaattggccctat

SEQ ID NO: 62696 - DNA, 12601 bp, Oryza sativa
  unsure (1)..(12601): unsure at all n locations
ccgccgccgctgatggttggatgggtagtacattaacggctacagcctagtatagctagtaacagctgtgcattgaacagagagatattacattacttattatacctgtgaattgaattaatttcataattagtgtccaattttgtggtgcatttcgagctgttggtgaggagattaatggattaccaccagtgtagcattttgcatgttgcagatgtaattggtgaaatactgatggttttctctgttttctgtttgttcaaatggagaatgaattaatcggatatttactcagtttcagatgtaactgatgaagttttggttacagataagtgtctgttattgtacaaaataagcgtaaatttgatcatatctttgatcttgctctaccaaaatggctcctcccctgcactaacattctaacaatgtactgtatagtaagtttcagttgctgttggtcggtgaccttgcctgtagttaatagtagtaagtcagtcaactcgtgtgcttgtgctgctagctttcgttttaacttttaactggtgtgctatcaactattcaacttgcctagtcgtccgtgtaccttcgctttcttcatttgtccattaattgacgctgtgcaatttgctgacgacaaaaacgaaatcgtccaacgaggttgctgagagttttctgcccccgtctcttttataatttattcaccaaacgttagcagcagtctgaaaccttgcatgtttgattgtcctactccaaggttatgttttagctgttgtcattcatctcttttcaaaaattatctccgtggtagatacaatattttataggaaataaatcgtatcattgaacgctttctgaagatcgctggccatgtattagtagcataatactaatatgatattgagctgtcgtcaagacctagtttagttaattatgacaataggattaattaggatgcaaagtatagtggcggagcggctgtccataaccgtgtgctgggtaagcaggagagagaatgaaacttagggaaatgtaggtctgcatagctgtagctttgtgctttaggatatactaggctcttggatgtttcttccttttctcttctatctaattaaacggtatgatcttactcaaaccgcaagaaatatactccgtacgattcaaattacttacagttttagttttatcctaaattatacatttgtatctttgaccatcaatttcttaaaattcggacagttttaacaacacgtggatgctataatatgaaaatacttctcatgttgattctaagatgctaaaatacatgaagttttaagaattaatagtcaaagatacaaatatttaacttatgatataagttaaaactataaataatttaaacggagtatatactagtttagcaaagtactctatccgtcccataaaaaacgaatctaaaaccagatatgatatattctagatatgtccaaattcatagtcataggatgtgtcatatccggtattagcggtattaggttggttttttataggacagagtgagtatgtatcttagttcttaaggctcagttcatctggggccatcaataaaatcaagagttgaacgtttcaataactaatagcagcgcatacgtgttttcaccaattgtcgccatggttgctttcgcctgaactcagtcatcccctgattttgtctagacggcgacagcccaacttcagtttgtttgtgcaactagctgtgtgcatgtcaacatactaggaatttccagcggggtggttagcaatatagtaatacggcaaacctgcaggacctgaatgatgcatgcaagaaacacacatctagtaaaataatagcagccaacttttttttctatttttctttcttttctccgagttggaccgtacctcatgcaagctgcctactccctccgtccaaacaaaaaaaggcaatctagtgctaagaatatccagattcgttgtactaggatatatcacatattatagtacgaggttgagtttttttgggacgaaaggagtatgttttagtatagagtacgatagctgcatcagcaagtagaatacgccctcaaaaagagaaaaatgaaaagaacaagtagaatacgtcaagcaagtagtccaggactcaacaagctgttctccatagctaagtcagctgggtgaggatcatcttcatcttcacattcacataaacaaaaatacttctgacttggctgcccttgttcaggatattctcaaccctgaaaccaacctcactctgttttttctctatttttgggtttttcctcctgactcctaggcaaccttccattcactgtttatacaagtcagcaaccacacaatgctggctgtgctgggacctgggagctttaaattgtcccttttaggaagagacacaaagaaataagcaacatagaggggaaaaaaacagcatgcatgaaactagcatcaacaagcaagagagccattcaaacaattaactgtgctgccacaagcaggcttgctttgccaaatgaaagcattaggcttctaatacgttctaagagttagtaacaagagcatccgaaagctatatatattcctctccaactagaagttgcaactttgcctgccacttcaaaaggattacctactggctactgctactgtatgtacatgacaaaaggaacctggagatctcactagcaagcacagatcaatctcatcagttctttcttctcttagatgccctggttgactgcgaaggtcctgctgcagatggcacctcttgagcagcctcaactgcttcagctttagagcttctcaaagccctccttgtcatcctcgctgatgggcctgctctttcattttcttccaccagttcagatttgacacctctgcgtctagtcctcgaatgctggttggctgatgggacctgatcttcctcaggttcgttaacatcctcatcctcagcaccgtcatcttcaccctccaaccgaggccattcagtaccacaaccacaagctctcgaggcctacagacacaaacaaatttagaaagccactcctgttcatatgtgtaaagtggaattaaaaataggtgactacctttctctgcgaaaatttcttcttcaaacagtacccatgaatccttacattgcattcctcattaggacaacatgatgcctgttttaaatataagtaataaaaatacatggaatgacattagtgaagtatatgaccatgggtacaagataaatgcaaatgtagaatcgtaattcataatgacatatctgcacctttatacaagcttcattgcagacctcacatgatgggatatcattactacgtaaccaacttcggagatcaagaaatgatcttatgccaagaccaatctttcctgtgggagtgtatgacagccaacgatcctgtatgagttcattaagagttttctccttttgggacaatgagaagttggtaatggaagtaggcagacgggattgactgccctgtgaagcgtctgcaattacaacctgggagcagaacaccaaataattctttcatttgtcacactaccataaaagtttgcaacaataaaaatataaaacatttgcttaaacagaaacaaaagctctcatagtgattgggtattaatacgagatacctggttctcaatccgtgtgttaagagcatcgatatttgttatgctcccatcatttccagcttcatgaactattgcttccaactgcccatacaattacatgaatatagcgaatactagattgagctggattttttaaaaaaaagtgcaaattgattgcataccaatcccttgtagaatgcaatctgtggcacagaaaactttgatccaagctttgactcttcatcagcaatgttattgaccactccataatacacagtaccatcatactggtttatgcctgctcttaactcaaactgcaagtacgtgagctccttgttgatcttgaggagtgtatcatcgaacagctgccgatgagtggctgcaagcagtgatacggaacatgagtgatcgcaaaccattttgttagactcaattatgggaatattcacaccccttaggccggaaattatataacatcacgcatagtatttttatgatttgtcagcaatcttaggtaataaaaccaggcgtcaatggtgaactgaagcagaaattatctgaaactgagagaaggttgggaccaactaagattgtttccattgagatgatagtaattcctagaggggcattacgtcgaacacctgtgctacgagtaatgaaatcaatgactgggagctacatcaggagaaagataagagtagcaagcggagcaggcagaagcatataccggggttcttgccgccggagatggcggagaagagggcgtggaagtcgcgctccgagaggggcccgcgggagagcagcgcctgcagcagcgtgtggtggcgccacgagagcggcgccatcgctcgacttgcccctgccgcaggatcgagctcgctagtaatctggaagagagggacggaatgggagggagatgaaggaatgaaggaaggaaccctagcaagagcagaaggaagtttggggatgaaatggaattgacgagggcattgagcgaggtgaggtgggggaaaatgtgttggcgattggcgggaagaggcgcgaggagacgcgggaagagaagaagagattggcagcgcagcgggccagcggagcaggacggcagaacaggacaggttggcgtgtgcgggccgaatacaaggcccatgtgatcgagcccacccattgccgttggtgagaattgagcccgacccaatcctacccgcccaagtatttcaagtgtagccgatgcatggtttaagccgaacgggaaaggacaaaagtttattcgaggcgcctcatgttgttgttgagtttcaaaatcgatttttgaaccgtaaaaggggatacaacgcatttctaactttcaaaaccagtacaaacaagattccttcctttatgtattgtccctgattttatctgacgtggaggccgccagccccatctctctccccgttagccgcccttctctccactgcccgtgttcggccaacatcggtctgtagatcatagatggaagaaagagggaagtaataagggttggttgttgatatgtgggtcctattattatttttattttctgatatgtggccccttgatttttattttttttcctggatcaaattatcatgtaagcgtcatgtcaatatcacacgtcgaataaatacctaatcaaagaagccacgcaaacgtcacataaaccaaaagcagtaacattattgtcaagtgacctcgtttgtattgggtttaaaagttaagagatgtgttgtatctgattttacggttgattcgacgagggaaaatttttctaacaggaaacgatgagaaaaccaggtcagtctaggccaggcagaccggctgacggctgttgcttcttggcctcttgggcctgtggttactggttagatatttttgcagccagttggtgcgtgtttgacactttgacccactgcattgtccattggttggttctgcatgcacgagtgagtgtctcaacctctgcttgagtccacacgtcctccacgtcacacgctcgcgattcgactcccatttcgtggcaggacagagacaaagcagagctagcgatctctgcagctttcttgttcctaattcgattcccatggcgcactcccactctgcggcttcgctgcacgccgcccggctactaccgcagcagcgcacgcccaccgcgccacggacactgttgccggcgggcggtggcctcttgctccgccgcccccacccaccgctccaccagcagcgccgcagccgctcctcctctcgtcctgacctccgctgccgccgccgcctcctcaccgcgcggggtgactacgacttctacgagaactatgccgatgaagaaggagatgaggaggaggagtcggaagtcataggtgggagcttcgacgcggcggtggcgctgttcaacggcggcgagttccacgcgtgccacgacgtggtggaggagctctggtacaccgccgaggagcccacccggacgctgctccacgccatcctccagtgcgccgtcgccttccaccacctcttcaaccaagtatatattttcatcgtctcatttccacatttgactatgcatagtaaattagtaattactccagtaaaatttgtgattagacatgatcgtgcacaaacacagaaccaccgtggcgccatgatggagctcggggaaggcctctgcaagctccgcaagctgcgtctcgacgacgacaccacgagcccattctctcggttccaggaggaggtcgccgcggcgctcaacttcatctaccgcacacagaaggagctcgcggcgtgcaccgacgatctctgcctcaccatggatggctccgcgacctcctaccagctgcttggcaacttcgccgctggccagaagctctaccggcttgaaacaacaaccagtgcagatggagatggcgttccaactataatcttctctgcttcttcacgactcgtcagggtgaagctccccacattgagcgccacggagcatcatctagcagcgcttcaatgtacaagcgagtatatttagtttctttttttttccctgataaaatgtttagctcttccgatccgtttgaaccaaattgtagttttctgtacttgggaaacgaggaatggagtcaaatggattatagtaccattggtttccttttctttcccttcaatttttctctgcacatactcttattatacgatgatgctaattttagcataacgggtgaccatgcatcttaaaaaaatagtagaactatgttatatttaaagtacctcaaatgataaaatgagtagatttcataaaacctgaggtcttaggctatctaacacaaaatcctaaaatttacaatttatgttcatgcccaccatgttttagggtaaaatgttccatacgattctagctacaagtatttcgtccatttgattataatagttgtaaaaaatgtatgagatattttttctatatgcacatgttaattatgtgcttttcaacgagccatcatcatggttttattgagtgaatttcactttggtccccctgctatcgaagtttcactttggagcatttttatctgatttttttttcactttggatcatctatttttgttttcttacattttggaccatccaaactctctttgcggcacatcaacaatctcaagaacattggcaccctcatgaggacgatctctcctatttacattcaagttacatcgttaccgagggagagattggatgtgattatacataagcattagggctaaagtgtagcctaatatgttgctaaaatatattctccccgtcctagcatataagagattttaattggacgtgacacattctagaactacgaatcttagttctgattcgtagtattaggatccaacccaaataccttacattttggaacagagggatgtagtgagtattatttggaaaaaaataaatgaacgagccttatcataacattaaatatgtaagggtatcaccaaaagcgatatgtataattcaagtgataaatgctatggctatattcaatatagcccgcattgtacgctaaacaaataacacgctttaacgtatgtatattaatagaaaaaatgtatagcatatttgtatacgagttttcaaatctcacaagaataaaaccaatagtattatctatttaattcatttttatagctatctttgataaaattataatccaataacattatcctcagtttcttttttcaccctctcatgttctgatgtgaaaaaccctctgccctcttgaacccaagaggcttgcagcgaacacacgcagcacggaaaggggaaaaaaaaagaaaaccaaaccctctcgtctcgtcctcccccgcccgccccggcctcgccgcccccttccctcgctcaccggcggcgaattcaagctgacgagctcgccaccggggtacacgccactctccctcccaaaacctccgcaagcttcaatctctcacttccaaattcctgattttctcgctttttttgggggattttttctgcgccaggattggttcgatcttggccggccaagaagcacaagtttcttcgggggattagcttgttcgcgagggggaggagttcggtggtggagccttcgccttcgtgatggcggacaccaaggcggacgccaaggcggaggcaaaggcggaaactatcggcggcggcggctctggctcgttcagcgagcaagcgtttgttgagaagcttaacaagctcaacaacacggcgactaggatccagagtatcctttcttccggttgtttatttcttttgcgcttgcaaatttggtagcgctcgtactttatctgtctagtggttttaattgatttactgttccagatgaatagaaccctaaattgcaatgtggatcagtacaactgacataggatatctccttggcgttccatacgttggttcttgcgctatttgtttggttaatattcaccttcttatgttcctaacagtgcttattgctgttagacagcatctcgtgcgttatttactgatgcatacggatataacttagtgtggcaattgtttctgtagcttctggatcatttttttgggcatattttgatatactgttttgaattatagctgtataagtgtatatagatgagcatggctacaaaatttagatttcttatcagcattatggtgtatcagcaatcaaagttggtataataatttctgtttgatgcattcttactgtatacatgctttccattatttttgtttcttggggaaatctttttttcttgtcttttgaggatgattatctttacaaaaatgaaaaataatggcatgaactgttaggtattattttaatagtatccttctgtttgatatgcaacgattttttgtttgttgagaaatactatgtttttcaatgccttttgaggatgactgtatctagaaaccgaaaaatgatgataaggagcgttcgggctttgtgttacattttactagtattttctaggttgtctacttagtacttatatatgtttcctgtacattagaatggaatattttacctgttcaatttgcaaattaataaccagaactgatcatattgccacatactttggttccttttggttggtgctattagggtagtggtatgctagtgctattagggtagtactactttggttgcttatattatctgtctggtagttttgattgatttactattcaagttgaatagaaccctaaattgcaatgtgaattagtacaactgacccagcatatctccttggcattccatatattgccttttgcactgtttgtttggttactgttcaccttcttctgttcctaactgtgcttattgctgttagagttagattgcatctcatgttttacttatcaatacttattgatgtgtacgatgatacacatataacttggtgtggccattttttctctagcttctggatcattcttttgggcatattttcatatattattttcaattatagctgtatataaattagcctagctaaaatatttgtagtttcttatcagcgttatggtgtattgtgctattggcaatcaaatttatattacaattttggtttgatgtgttcttactgtcaatacatgctttccttttgtttttgtttcttgggaaaataagttttcactgtcttttgaggatgattatcttttgaaaaatgacaaataatggcatgatttgttaagctgttgtgttacatctagtagtatcttctattcttctgtttgacgtgtaataattttttgtttgttgtgaaaaattaagtttttctatgtctgttgaggatgattatattttgaaattgactaataataataataaggagcgttaggtttgtatcacattgtagtagtgttttcttgtacattcgaatataactgttttcctgttcaatatacaaattaatgggtagaatcagtcatatatcacatagtttgtttccttttggttgctgctatcagggtactgatatgctagttcaactttttttttttatctcttgatggctgagcacaatctttgtggaattgctttttacgatgttcgaaatacagtgtgacaatatttggttgcactaatgttgtacgcccttcgtcccaaaatataacaatatctagccttcagaatttgttgcaaatataataacttcttcactaacattctctttccaaccaatcacaatcctccatttctcatccaatcacaaccttcctccatttaattctacctattttcttaataaccgtgtataaccctaaaatttcttatatttctaccaaacaggcccgtagtattggcaaatgaataaacaaccttttctattattttatggccatttatcttcatttctaagtcagttaatcagttaggtcagaactaatatactttcatcaatttaacaaataacaaattccctacggttgtaaaaaaaaaacaaattgcaattttttggcctttgaacaaggataaatatagcatttatccacctgcatccatatattcatgctactaagggggtggggggattatgtgatggttatgtcatgtccttttgcttacatattagcaactcgaagccctatgtaaaatcttctgaacaagttttaccacttgctttcctgtgtttaatgccaatgccataaaaatcatttacacagtcatgataccaaattcccacagcatatttttaacaatagcatctagaatacagtagcttgccttttttattccttaattcttaagcagcactttcaaattggtgcatttttcaccgaaagagagccagaaaggttgttgatacatgggagaagcagtataacagtgcaaataaggataagaaagtatcattcctgtacctgtcaaatgatatcctgcaaaatagtaaacgcaagggaggggagtttgtgaatgaattctggagggttcttcctggattattgaaagacttttatgtcaatgggggagaagatggaaagaaagtagtcggaagattagtaagttattcttaattccgttacatgtttaatggcaggaaaagtctatttacttcatttttttctatcacaaggccaaaacccgaaaagtaaaaaaatatatttatttttaaaattacagatagatatttgggatgaacggaaggtctttggaacccgtattgaaagtctgaaagatgacattcttggtggtagcactcatacaatgggtaacaatggcaatagctcaaatccaagctctcacccctcttcagtttccaaagctgtgcgaaaagattctggtacagtaacaaaagtaagttgccagatcttgacctgctaaagaaatattttcttgtgctgaggatggatgcagtatattgtcatgaatgtgagctatttttgttgttttttcttttgatgtagaaacttactattggcgggatgccagaaaagattgtaacagcatatcagtctgtgcttgatcaacattttgacgaagacacagctttaaacaaatgcaataatgctgttagtgttttggaaaggatggataaagatgtagatgatgcttgtacccaaggtaaaggattttctctcttcaataggtctgttatgttgtagatatgtaccgttgaaaaattggcacttaatgcattctgataccttggcctgtattgcatcatgattgttccagcgttattttacttctagttccatcatgtacttgacttgggaaaaaaggaatttacatagtatttccgattttccattgatctgccatgtaaattctagactaaacaaacatctcaaatacataaaaatgatctagcatgttgacaaagaaaattgctgtacataattttataatcatgtgaaaaaaactataatgatgtgattgtagcacgcgttggcatataaaggggaaaaaacatttttctgacatttgttttcacaagtggtggtctagcatacatatcctttttcagtggaccacatccagcagcttaattattttacattgcgttccttgagtcctttatagtgcccactatgcctgtaggccataattattgacaattgctaatttcaaatttgactaaatgttttaatgagtcatagaggaaaagaaaatactgtagggcaaagttacctattaaaaatgttcctagctctgatgatatgaaagagtaaaatacatggccagtccttaaactagagcggtggtgtcacatagttccgtaaacttgaaaattgcacatttatgtccatgataatgaaccacagtaggtccaaacctcgattgactgaggctgaccgccgatgtggcgctccacgtaggcaacaattttgcatccggcccccttttgcaggacagcgtggtggtaatattgtacttagcccctttgagccacaggggtncgagctnggttctcaatgcaatcaagccgc

SEQ ID NO: 62697 - DNA, 20729 bp, Oryza sativa
acgtagattatcgtgattatcacgtacggtaacattctcagcttttgaaactctagtataccttgcggtaactgtgtggttatcacggtaaccgttaaaacgtggggtgacaataacccaccctaacggtttagtaaaccctaaatacacactgacatgtgggctcaaggatctattgggcctacatatcagtgagcagcattgtacatacagacgctctctccacgactccacgcctccacgcggacatggacccacccgcccgctacgtacgtccccacgactggcacgctctctcacacacatctgctcacacgtctgctcactcgaccacacatgcgccgcgccagcccgctcctcttctccgctcatgtcacacgcgtcgtgccgtttgcgttgcacgacagggcttatttttggaatgttttttaaaagggcttcttgtaaaaatgttctgaagaaaaataggctgtgttctacccttcattttcccaacccacctctctcgttttccacgcacacgcttttcaaactgctaaatgtaatgatttatgtaaaaactttctatatgaaagttatttaaaaaaatcatataattcatttaaaaaaagttaatacttaattaatcatacaataatacgagcttcgttttgcgtgccccaacccctcctcccaaacccagccaaatctgcattgtgcgcatgttcattctctctgaattgcaaaacccatcccctgatcgttgtttatttgaaaatgagataaataacaaatggctaaatatgctttgagtaaaaaacgactacgtataaacatcatctctatcatggttcgtcacggatgagcaaaacgatgagctccgcaagctggaaggtgtcgtcgttctccacagagagcggcgacgtcacattgctcttgccgaacccgtcccggcactccttcaccgcgctcgccgatttctccagcgatgaaatcgcctcctggaacctgccgcccttcacggcggcgccgacggcggcctgaacttgcagtatcccgccgtacaccgcctggcatgacttgaggcaccgcgtcgtggcgtcgccgccgccgccgctgctccggagcatggcgtctatctcggacttggtgctcgtcgcgttggccgtgaggaggtcgacggcgatcaccgcgaactccttgtagctgccgacgttgctgctccggttgtcggagctgagcgcgtcgatgcagaacgtgacgccgatgagcccgctgccgccggcgatggtcttgcacgcaccgtacacggccgagttgatgccggcggcgagttgagacgcagcaattaggagaacagccaagaggaagagagcgctgacgccattgttggaggaggccattgtggaaacctctgcaagtctgtaagataatgttgaaacagatggttttcttgacgccattgcgtgtcaattatataagcacaaaattttgcatggcatttaatgacctgatcgatcgtctcgaatcaatgattatatcgtggatttgtagaatcgattattgattttccgttaatttctctccccattaaatgatgcatcgtcctttattgccatgagggaatttatggtttttttaattagatgaaaaaaaagagattccttttcagagtttatggtctatgaaaaagatgctgttacaaagttttgccccgtatatatgccatcatatggatgttttcatgatgttcctcgttttataaaaaataaatacacgaatagtcatgaacatttttagaacaattatttgatggtgggcccaaccaagtttagtacacaagtatagagtatcccatatttaggacaataacagtagcccctgacctctattcaaatgtataaatcgatcacattagaatccaccgaggagccgagctgtcggaatagatttactttcagtagcacagaaggaatttatccgtacaaatatcatgatggagaaaagcagtacaaaaaacacattgccatcagctgctataagaacttgaatatatagatgaaagtatggttatactatttctgcagccaaaataaaaccttaatgacatcaacacaaaatacaatggaattgtggaacaaaaatatgcggtaactttaaaacagccatctactcctggtgacaaacagccatctacatctggagtatgtagcaacagacgagtatgaccacgagtttactttgtctgcaaagcacagataagtgacacctggtgagcaatgccatcaggtgaacacagcagtcagcagctgacttcatttagatgttaacagtttagtggtaataaaataagagctcatttgattcctgcatcctgattgaagattcaagtttttgtccatgttctatcgtcactgtcccttggtgagacaatggaaggttaataatctggaatagatgcaaaggtgtatcctggtgcccctctcgaggaatagtaagcaactcgagtctcataaaaacctacaaaacaatgtcagaacaatataatccatctcgctaaatggatacaatagtagagctgtctactatctacaacaataacaaaggacataattttacactgatgcacacttaaatagatttcatatccaaagagtatgaccattctgtttccagtatggcactccctccattccacattataaggtgttttgggtttgtcctaagtcaaacttcttcaaatttgaccaagtttatagaaaaatgtagcaatatttccatcaaactacactaaaataaatacttttgaaggaagtcatggcaaatgatcaataaataattgggggaaaaatttcattgagaagatgaaaaaaattccatgataacgttacgtgaaaatgtaaggtaaaccagtgtacattaacataccaggaaggaaggcaaggatgcccaggaacaagagaccatatgcctgagagttatccccctccatgtgacctgtgaatataaaatatgacaggaagagaagagaacatcctaggaggaggaggaatagtgccagggcaattgatttccacgggatttttctgagggattttggggtgtaagtgaaccgaaggtctacatcatcagtaaggttgctgtcatccctgtcctctgtaggaagaggagcataccccccaacattgcgtctagacgccatagtgcagtgcctgcatttgaaacacatactgtaaaatacaggtagaaaatggcatggtaatacacagtaagatctaagagttcaactgacaaagaaaaattaaaatacactgttgctgttaatgataatccaaaattacaaggtttgaaaaaaaaggtgcaccaaacagtaacagagatgatatgacaaacaaaactaaggttgtggttgtcgtcgcatgtgccatgccaagggccttaatggactgcatgtgacatggacatcacaaatttcatgtgaatcattctcagagaagaactattagtttttatagaatgattagaaaaatataagataaaattttctgtaatgcgatacataatttgaaatgaactcaaagaacagaatcaaagacaagaacaagatggcataccagacagatttgagtttctctaggttgttgcacatataaaataaaaccttatgcatcaagatgcatattaaagctttgatcatctacaatcatctgcacgaactaaggctaaaatgagcactctattctacaggataacaacctgaaaatatggactaaacaagacacatctaataattttaacatggtgattattaatcgttccttttccttaataatttcaacatggtaagtatgtaaggttctaaaagtaattcaaaattggtactccaaaagattgatactttcaagttgctgcaagatagccaaaaatctcacagacaactctagtgttgtagtcattccaatcagcagaatctatgggcattttaacacccttcaaagacacattttgagccatgcctgtcatccactcactcacaccaatcctttttcaataccaacatacatcataggttgaaaattgagatgattgattctgaacagagtctacaagttgacatttatatgtacagaaaagaacaacatccacacagccatagtgaaccatacagaaaagaacaacataactaatagcagtgatacaaagggactagtttctcgagagcaaatgtgaaacatacaggcagttggaacggaaggtgtcatgaaaacatttctgatgtgatgtgcatctcatgtaaactataactacagatcgataatacaagtatccaatctaagttagtactaaattttgctgaccaaatctttcaagaaatctaagggtgtgtttggttgctcgtatccctctagcctggctcatctccctcatccaggctaagctgagcctggtttaggggatacacatgcaggcatttggttgcttggatgagatgaacctggatatgatgagatgttgtttggttggttgcagcaaggggcggatggaatggtagcatgcaggagatgttgtttggttggatagatacatattgtgtgtaaaatacctattcttgtgggtggtgaggttacccccataaagtttgtgaaacaagattttttccaagtccctaatctatttatgtgtgataagtttaatccgtcgtagaggttatagattaaattatgttactctgggtgtgtgcacacctactaatattcctaagctcatttttgtcttagagaatcgatgtactgtgcatgtatgttttactgatgtcattttttaaaaccaatgagcagcactgatgataattttttttttaacaaatgtaacgaaatggcctggatgaacacgcaagagtgattattctagcaaaaatcaactacataattttattgacgacactggtacatttgacaattcaaaacaaacatacaaatatacgtgctcatggcaagttttttacaagtaaccaatttgataaacaaatctgtaaccgcatacaaaactaaaccatctgtttcagctatgttctgcctgcaagcttttgtacagattgcttcaaactcatcaaccttagtatatctacacttgatctcacaagtttttccattatcacattttcctgaaacatagtaaaagtaaacaggataacctgtacctttgaaacagtacaggatcagagttgcagagatcaggtcgcaagaacatcaacacttaatagtagtattatctttaccaaaagagcaagtgcagagtgtatcggtttcatataaaaacttgatcatgtcaaaatcaagtgtggttaccaaaaaaaaatgagtacatctgttgatatcaaaacatgaacaaggaacttgatagtatttgcctgacatcaataactcgaaaatgtagcaaatgtgcagaaatttgacatcattgagcctcatttccagcaggtaaataaatgcagaacaatggcctcagatatatgaagaatgtgaattagctactatcattggtatctgttcttaccagtatctatcaaatgtagcaaaagaaaaggtataaggaaaaggaaaataagaccaaatgtaggaaaaaaaaccacaagaaaatgagaacaagtgtagagcaaaaatttattcacatgcatcacaaacagcagcatatatcatcattggccatctttcccagcctaacagcaagaaaaaagaacaagtgtagaaaaatctgttcatgtactcttataaattctgctcaattcaagtgtagaggtggcctcagttctgctaagatcatctgaagtataaaatactgagaaagatcacagaaagacagaaacttagaaagggcatgtttggtggcctgaccttatcgaataaggtcaagtgcaggcatatctgttcttatgcatcacaaataagcactattaatcaagtgtgtatctgtcagtatcaatttaaaagaacgcactatttcttgccttatcagtaacttctatttgtaggcaaagatacaatggcataacacaaatcaacaggaaataggaataagtgtaggaaaaatctattcataagcatcacaaatcagcaacattagtcatcattggccatcttagaacaaaaaagcaagccactagacatttcattccatcgaaatcaactaagaaagatatcagcttttagtagatctagcatatttatgaaggggacacggtctaatccaaacaaatcggctgaaatcaaaggaagagaggagaagaaaactggaggaggtgagaaaaggaaggagatgcccaacctagcccttaccagagagctcaacggagagagtcgacgaaagagaggggcgtagcagagagccggcgaaaccaaacggcttgacggagagagcgaaccagtggaagagagcgatggcggctagcgaaagagagggaggatgatcaacggaagagaggatgctgacggacgaccggccctcccgccggcgaggacggcgcgacgagcagcgccctccactcgcgagtcggcgaaaccctagctttccactggtttggaacaaatgaggagggatggtggtgaccctatccatgggttctgcacgcgcgggtgcaagcggtgcacgcgtggatgcagcctcgcggcatgaggcgagccaggccgcaactcagcctggctccgcgggcctttttgcatccatcgaacctggctctgagccaagtgcaggcatctaaacgaacacaaccctgctgactaggtgtgagctaggtgcggtccggaaaaccaaacacatcctaagttgacaagtatattgagaatatggttgaagtatactgactaataatcaagtaataatagacatacagacggtgaaaatttaactggcaaccaagcaatgaatcccccaagaaataaaccagatttgagggagaaagtccaggattttagcctttgagtttatggataccttgcaccagatctcctatgccgccgccgttgtgcgcctccgtcaccgccgtgcgcagcccaaacctccgcgcggcgccctagccgagagaggactgagtcaggcgcctcctttctgtcgtcgcgagagaagccgaggggatgcgcgactcggcctgagcccggtgcggatggggaacgctggcatcctgcttgtaatttcgtccaacactagtgtttattacttccattttggactttttcttttagcgaaacttaaataagtttgatcaactttataaaaataactagcaatattcgtaatatttaattagtttcattaaactgataatacatctattttatgtactaaatattattatattttttataaacttgatcatttgacttagaaaaaaaattaaaacgaacaaaaatagtactccctccgttctaaaatataaacatttttagttgtgtgtccagatttatagacaaaagttgttatattttggaacggaggtagtagcttatttgtttactcttacttcaattctgacttattttaaagtagttgagatctggttattggattggacacaattcatgtgtgcttccccttaacttccacttcatatgacagtatgagactaacgtttatatccttcatatgcatcatatgcataagcatgtcattggcatatatttcacttctatttactcattgacatgtatggatataaatcaattgtcaagcttcaatataatgttggtttatatccttcatatccaaatgtggttattgttaatggatttgtcatcaatcaccaaaaagggggagattgtaagttcaagtgccttaatttggtttcggtgattaatgacaaatctaattatatgagacttatgtttttatgagcctttctttgactagtctcatttggatatggaagtaaaaatgatgagaggtatgtattaaacttcacatattctaacttggtctctcttgtggatccaaaatattgtgttagcttcctatttgatctttattgattatgtgcatatgcgttccttcatatccatatgtatgcacatcttgagggagagcttatcctatattttgtttattataagatttctatcttgatttgaaatcattttttatctcatcaccaaagagagaaaagattgaaagatcttggattaaacaatttgtgtaattgttactttagtgatagatgataaaccgatgtttatgggattaacctctcttttgcataagttgtctactaggttatttcccgataatgagatgtggaagacatgcattcttttttgatggaccttaatcatgactaggatgaaatgcatggagataaaacgatatgtaccacttcttatctcctactttttgataggttcatatatatgatttccatgttattgatatataagtgtgagactaatatttactcgaatgttatcttatttagtctcatttacattgagaacatggagatcatgaaggtatatgttttatgttggtctacatcattactacatatgccttctctatatgtataggataaacccccattggtcattctctaattatgcatacacttgcatctcttgtatatttatttgtatgcatatatttagggggagcaaatcctatacatttattgtgcatgttctagatccatgttgttcacctattatttatattggatctttgcacttgagcttgcatacgagtatatgacacttgtgatgttaatgaatactcaacaaacatatccatatctttcatatgcaaccggttggtcatcaagtgaaggatgacaaccgatttgttgagactaatgttctcctttgaggtgtgaaaaggaataggtcccactacgatgaggctaatgaatgacaccatgggttagtggtcaccaagtcaaggacatcgtcatgttggcaagaatgaagtcaagcttttgatgagaataaagtcttgacaaaggatggacaagacctcggcataaacatggttcaaccgaatggtcacaagtgttgatctcggctcaagcttgaccccaagatggatggcgcaaggcaaaggtataatgtagctaagaatgttttcttagtcttttcccggtcttggtgtttggtgtagactagatttgctagataggcgccgtactatcaagaggggtctatgaagcgagcttgtggatgatcttgtgctatattagttcatatgcatgtaggtgcattttgtgggcttgtctaaccaagtgtgatgagttttctcaagtcctaaaccaagagagaagtgggcatgtccaataggagtgagtgacatcttgtgggtatgtccggtggatatcctttggagtgtgagccctttatccttgacttaagttgtgtttcttggatggatttttcatgggttggatggccctttgaataagctttccatagagtccaagaacgccaaattccgagacccgagtcaagagatatcgccgttttactaacggttggttgagctgaaaagtgacctgcggtctgaccgtgggccttaggccggtctgaccgggtctgttagccggtctgaccggcgtggtaaggccggtctaaccggctccactggtctgttgcactggtctggtttttggtggcgatacagagccgccagagccgcaaccggtcagaccgagccgacggcggtctgaccgagccgtggacggtctgaccggccactacactgcagttagaccggccaggttgagtgggctcaatgattgccctgtaacggctagttttctagccgttacaaagtagtccggtctgaccggcctcacaacggcggtctgaccggcagagcacaaagttggggatttcggttccaacggctagttttggtggttgggggtatatatacccactcctcagcagcaagggtaaggttttggcactccattgcattatcttgaacccttgcaagagctctcacacccttgtgcacttagtttatctagtgaggtgttagagagtgagttaagccaatccaagtgcgttgcttcattgttatagctagtgtggcacttgatcatactcggcaagcatcctagacttgttactcttggaggttgccgcctcctagacgtcttgtggaggtgttgcccggtgacctctccgaggagattgtggaggaggcccggcaccgtttgtgagtggtttggagttcaccaccttcggagtgaaggaagaactaccccgagtgatcgaggcttgggtagtcctctctgtgggccggctcccgccttgcccaccccttgacgaagggggcgtgcggtggcttcgtggttgagcggtggagttgggctcgcctcaacggggattaggaaaccggcgagtttccgaacctcggtgaaaaattccttgtctcttgtctcatttatttgctgcatttatatttgtgctatttacattcatagagacatatttgagcccatatcagttaggtttgcaaaacttaacttagttgcttagttaaccttgcacctcaccttgtctagcaacttaggttagttttgtttaagtgccattaagttttaaaaccgtctattcacccccctctagtcggcctgcttgatcctacacacgcctgcgtatgccgcctggcacatctggaggctcactgttgtggcatcgtcgggtttcatgccgccgccatcatccttgaggatgctgtctatcttggcattggcgctcgtcgcgttggatgtcaggaggtcgatggcgacgatggcgaggtcactgtagtggttggcgttgaggctccggctgtcggaaccgagcgcgtccatgcagaacgtgacactgatgacgccaccgttgctgccagcaacggtcttgcatgcgccggacatgaaagggtcagtgttgatggcgagttgaacttgagacgccgcgacgaggacaatggcgaagaggaagagggattgatgacgccatgggaggagaccattgtgaaacctcgatcgatctgcaagatgatgtcgaatagtttttttggatgaatacctttgtggccttgcgtgtgaactatatatggacatgttttgcatggtgttaaaaacgaatagatcgtgtctctagttaatgattagatagagtagatccgtagagtcaattattgattccccgtaaatctctgaccaaatatggctaaggcatgtataataacaattaatagcatgttctctaagttattaataatatgattttacttacataaaaaagagaagacagagaaatatatttgttacgtgtgacaacgacagatttttagtgttgtgttacgtgtgaaaaaaaaacattcgtgacgcctccgacccttctttccctcacatcgtcgcacattctcaatccaatggtttgattgtgtgaacccaacttggggagggggtttggagaattattctccgacctggtgtgacctcccactaagccgtcgcggcgcttgccgcgcctctgacactccatactaccaaacgcctccggcaagccgttgtgttgcgctcgggtagcaaacaccacgagactcatgacgcttactatgtatctcgagataaaatttgatacctttagatactaaggctgtgttcgctcattagggttaggaacccatctcctttacacggaaaacggaacggtccattaggacatgattaattaagtatttagtaattttttttcaaaaatggattaatttgatctttttaagcaactttcgtatataaactttttgcaaaaatcacactgtttagcagtttgaaaagcgtgcgcgtggaaaacgagagagaggggttgggaactagaagttccgaacacagcctaagtatctcgagatacctctagttattagtgtaaacttttctagttaaaatctaattcctctatatactaagtatctcgagataagaaaaaggtgtaaaatttaggtaccgagatatcttctcaaggatcgtaaaatttcacttgtttcagagatgtcggtccatgatgattacaagcatgcgtgatgtatatcatattttactataaagttaatgcttaataactactaaatctcaatatccaagtgtgtcacctcatcatccactttaaattttattatttattgcttttgtcaggtgtgatgtaatatgcattagtacatttgtttgtacatttttctttatcgcattatattgtttgttacaacaatgtgtgcatttctgtcattttgtaaaattcagcagattatgtatggaagggaacaaataatataatgtacttacaggtacacatatgtgattacttgcaaacggaaatcctctagctggtacatcaagagaacaaacaaaatgaagagagaaaaagtgagacatgggctaagccatcgttggatgcacttaatataggcaaatagagtatgcatacattaagaatgtcttgccatttctgagtgtataattaatgtttatgtggtcacgtacttgcatctttttcttcccctcttgtccttttgcagtgttcaataattgcatgccaccgaaattcatccatgtaaaaaaaaaattaaataactaggcacaattaataattcaagctagacatggtaaacagacaagaacttgattcgatttgtgcaagtacatatacggaaatactactactgtccaatttccgacttcatgagatttatgtctttgtggtcagtatcttcccctcttccctctcttgcttcttgccgtgtgtttgcgtgcttgccagtgaaattcattcgatgaagatattttatttacataaataggaccaataattcaatgcacgcatagtaaaaaaaaaaaaacttgcatgatttgctttgtgttaatttgtacatggaaattggaaatgctgtcctcttttgtcgatcctgttcagttgcttgtcgcaacaggacatgtctagcccgagaagcaactgaattgccgatcaagcggttgcccgttctgcctttccaaccgctcgatcaagatccaacggtgcacatactcagtagaggcgcttgcattattgcgtccgtggctcaggctacagatgtcacgttatgatgtagctcagctcacacttgtcttgttcatagcatgagcatcgcacgcctatttaaagatgctatagcttcgattccctcctgagctctaacactatcgaagcttcacaaattcagttgacgaattgtagctgttctctctcgtctccaagtgttggaggcaaaggaatccttcgatccataggttcaaatctctctctcctccactcttctgaccctgatcttgttgtgcggttgaaatgttcgacgaaatgcctgagagaaccactctgctttcccttctgctgttggttctctgcatgatagattcgtctctgtttcttcttttctaaggaaaattttgtggggtttcactgaaatttggatggtttactggtgactactgacgcttttttggagttccctttgtaagtgcttggttgtggatttatgtttctgtaactggcagtttcgattttcatgtaggtctgatccaatgatacctattgttttctcttcagtttcttgctgttaaacgattcaatctatattgttctcatccctttattgttactgcgcttactctatgatctatgggctgaattagtgtttatcggcaggcaggacgcaggacagagaatgggtttcgaagaaacatatttttctgccttctgttacttgcttcttttctctgtcagctggaaatgccaagctgcagaactggacatggctcagacagcagtactcgaagttgatgcttcatggaacctttctcgaaagatccctgacacgctatttggattgtttttcgaggtcaggctttgcttatttagcttctggttcagtacatccttctcgcatcactcccacgggcactagaactgatatcaggatcggctcaataacttaatgaaccttacctgggggatgcataaatgcatctagtattttcagtcgaatttaccgttgttcacacttcacactgcagcacgttgtactagctatgatgagatttaataaatcttcatgcccatcttctgcttggtttcagaaaataactcctattctgtacatgttttctcctgcgccggtgtattatagttccattttcttctgtggatggcggtgttgaaatttttatgcattacttgggaagaggagggattggggtggggtgtgtgaagatttcttttgttggcccttgttatattcattacatgttcgctgcaatttgaatattctagattatcctcgacagtcatgataactggatcggtgaacatcacaggaaattaaccatgccggagctggtgggatatgggcggagcttgtcagtaacagaggtaactgtcagcttgataatcatgcctcttggttcccttggaagctatgagaaatgaatggatgcacttgactaagttgcagatttgttacatggaaatagatatatcagtcctaaaaagcaatgagtcattgtactgcctacttgtcagagagagagagagagagagtagcattttaccagtggcatacagtgtagatttacttcataatagatgttcttaggttaataggtctaatagtcaatgaaggaaaataaattataaagtgaaccttttcatgtgatagacaactcctcttttacaaggacaatatagaactccatgtcaggatccagaaccatggtattatacttcttgtaaaagagattaagagcaaacttccctcctaaatgaaatgatatgcatcactcctccttattcatgagaaaaaaatatcaactctcgtcaagagtatttattatgtttatccttattcatattgataactgaaatcagtttgcctaacttctattggcttctagctagagaacagaataggctaaagctcagcactaaaacctagaaaatgaaacaaaagaatctgtgctttataaatttccattaacattgaagtattgccttcactgactaatgcaaaatttatacttcagggtttgaagctggagggccccacaccccttcaaatattgacccatggtctatcattggagatgaatcctctatatacgtcacgactgattgctcatcttgtttccgccaaaatattgttgctctaaggatggagattctctgtgataattgtccagccggcggtgtcggcatttacaacccaggattctggggcatggtatgagactctgtcaacgaaaaataactcacagtccaaataatcttttcttctaaatgacagtttacactgtacacactgtcacttacagaaaatacagcaaaattatcatttatcttccaaaaagtgaaactaacaaatagctaagctaaccctttttttttttggtttcagttcatgttgatctttttctgacgtagtgttggctttctatccaatggttgcatgttgcttacttggaaaatgaataactgttctagttttttcttcaaaccatttccacttttatcttctgtttgttttctgggattttaccttctgattatttgaagaatctgttcatttcaacttccagaatatagaagaaggaaaagcctataatctagtcatgtatatcagatcattagaatcagtcgaattgacagcttcgctcacatgctcagatggaatgcaaaatctggcatcagtttctatacagtatgtatctttgccatagaaataaataattgttaatgtcttctttgtttaagattgaaaggattgcatattgaaatgttgcagaggtattgatctgtcaaattggacaaagatagagttgcaattactagctgaaggaacatgcagaacttcaagacttgaattaacaagtatgaaaaagggaataatttggtttgatcaagtgtcactcatgccttcagacacatacaaggttcatcgcattttcatcttgctagtggctactgaccatcatagaagcatgctttgctctgggagcagccactgaatatatatatatatatatatatattttttgactgggcagccactgaatattcatgaagaaaatatagtaactagaatactcgaaaagataaagcaacgatgcactgctttgagatgcagatatgtgtactagcagaattataaagtattcataagtacataacaaacatgttggttcaatctcattgctaattaataagtcataataaaattttatattcattttgaaaaaaaactggaaataaaatctatccctcctttctttattggcagaccatgattattagtttacaacattttttaatgggaattttctagcaatatttgttaatgggcattttctgctatatgtacagggccatggctttcgcaaggaactactatacatgcttttggaattaaaaccacagttcctacgctttcctggtatttcttgttccctaaccaaaataaactattaggggctttgaacatatgccttggtttttcgcatatttacgatcactgtattatatccagttatttctcgttaaacttcaaccctatattcctttttaaaaaattcgaggtcatattctaactagaattaggaaaaaaaaactaatatccaggtaactaaaaataaatcaaacgtgcactttatgatgtctgccagaggaattaataaggacttgctatcataatataacagaaatacattgtattttactttgtgatgttaatctaaatcattgctgggataggaacaagcattaataatcaagactctagagtaaagcattaaaaagttgaattagtacaaaacagcatgttagacatatatacatataatttttagataacataacatatagataactgttcgtctgtttgtccctaacagttatagatttacctatatttgcatatgatttccataatatcctagatagtgataacttgtagtaactaacttctgaacaagtccatatatgtctcaatcaaaaactttatatgacacttttgataggggggtgctttgttgaaggcgattggttaagaaatgctttcaggtggagggaaactattggtccctgggaacagagacctgggcactttggagatgtttggaattattggaccgatgatggcctaggatattacgagtttctccaggtgtatgttagttaatgccatctgagtgtttttttttcatctcttctgctatcaacatatctaacgaaatatttctaccgaaattttcatggaaagctttctgaagacctgggtgctgcccctatttgggtgttcaatgttggtaatacattattcttatttatatttttcttgttttaccatatgttttcttatcgctagcatgcccattaactgcttacagtttttatcttgaaatttagggatcagccaccatgatgaagtcgataccaccataattgaaccttttgttaaggtacgttaaatgcccaagtaagaatagtcatccaaatataactgggtagagggttactacggttccatttttccttattgcagatgccatcattgcaaaacaaaatgttgttctatgcatatgccattgtttcaagtttttttttcttattataggatgtattggatagtcttgaatttgcaagggggagagcagaatcgacatggggttctgttagagctgcaatggggcatccagaacggttcccactgaagtatgttgctattggaaatgaagattgtgacaagggattttaccgaggtatatttttattaaccagagcttgtcatgctaatgatcccatttgttgtcaatgccatagttgttctcattagttttcaatagacacatctataggctaaaatgatgtgatggccaagtataattaacacaaaatctcttatcatttatgtctgcatatctaaaaccgcttattttccttcttcgttcccctttttctttgtttgtatgccatcattacttggagtcaactacagttatgaaaaaataatttcacccttacaaataagcataataaaaatataaacatttgtaataaataatagatgaaaatagaatgtatgtaacttttagccatttattgtaccagtttccgaggatacattttctttgcacatgaagttataattgctcataaccttcagagttactatagccttcactaatttcatgaaagtactagagagccatgacggttttcaatcctattgtacaggaaattacctcaagttttatgatgctatacgcaaggcctatccggatattcaaatgatttcaaactgtgatggatcatctaggccacttgatcatcctgctgatttatacgatttccatgtaatcttctttcatcagaaaatattctccattttcactttttaaatactgtttcatgatttcgacatacttctcattgtgttttcattaagatgcattctgacatttttttcaggtctataccagtgctgctaatctttttatcatgaagaataagtttgataggacatcacgcattgggtctaaggtattttttaatccttatttggatagtatgggtctctgggatttctggccatcatggtccatccaaaacatgacctttgtttttgtgatttattctggcaatagatatatccttaaaatactgatataaaggttggccttaaataggcctatcttcctaattttggtagaatatttttaggacattgtttcttccatattattctacctgaagttggtttcttcatttatttaagtttctttagaaattatattgaagtcataattttatacgtgcaaattcaatcaatggtgttgtagtgtcaactgtcacaacactctggaaggctttgtttctctgtaccattacagttctcttgcatctcgacatcctaggatattggatacacagaaagtagtcattaatgactatgctataatcttattccaggtatttgtcagtgagtatgctgtcaatgaacaaagggatgctggtaaaggaagccttcttgcttcactggctgaggctgctttccttactgggttagagaaaaataggtgatctccttcacttcatactttccttgaataatctctctctccatattcttgggctagctgaaatgctgaatcatgcatgcggctgtatttagatcatccatgacttttccaggataaatgtcaatattgtcatgaataattactagtttatgaccctgtttagataattaaatttgaattgaggggataaaagtttgtttttcagaaattacaagataacatgtacacatgttgtaaatactaatactgagcagcaaaaatactctccatcatgaataaattaaaagtttctgtcatgtttctttgcagtgatcttgttcagatggcaagctatgcaccgctcttcgtaaatgacaatgaccgcacgttagtacctttggctttgccttttttattttctaacattcttcttgttcacaagtgcttgagtttgactagctctgaatgtgatgatcagctggaacccagatgcaattgtattcaattcctggcaacagtatggcactcctagttattggatgcaaacatatttccgtgaatcaagtggttctgtgattcatccaattacgatcggttccagctactccgattcactggctgcatctgcaatcacctggaaagacacacatgatatctttctgagaataaaggtagttaaccattccatttttttcctaacttgcataccattgcagcaattcattagcgaattacctaaatgttttgaatgatttagttacaacaatataaagcgatataaaactgattgagccactgcatacttgcacatctgtttggattttagaagatatattcatcttcaaaagatcttctgcagatagtaaactttgggccaaatgctgttaacctcgcaatatcttcaagaggacttcaagctggcgtcaatacggcaaaatcaactgtgactgttctcacatccggcaatttgctggatgaaaattcatttgctgaaccaaacaaagtaagacaaccattggttggatcacaagttatttgtttcataactatgcactgaattagtgaatttagcagagggtaagtttaccattacaactttatagaatgcacacatatgcaagccgtatgtcgtaagcaaactctgtctttcagctttatttgtaagcttttaagaaattgtttatttagctgtctggaattattctctagtctttctcgataattttttcgcagacagggtcaatctcagtgtggcacacgatattctcaggtgttggcgagttcatctaacgtacaagtatcttgtgaacgatggatgcaggtcgtaccggttaaaagcgagctgccagatgcttcagaagagatggaagcagcgctctctccttattcattcacttcatttgacctcgctctagatcagtacagcaagctcgtggcagagatgtgaagcaatgatgcacacttataccagagaatagaacacaggatgattacgtgaggtgtggtacctgaatttcagaaagctaacagagtgtatatactgcattctggcatttgctaatcacacttcgtgtgaccctgttgtttatgacgctgtaagagtagtttaaggttgtcacattatcgaacctagcggtaa

SEQ ID NO: 62698 - DNA, 4348 bp, Oryza sativa
catctccaatggcttgcttgtgccgtagaacgcgaagtagagcatggactagatccacatcatctcgatgcagtcgcttgccgtcacgccgagctccgggaaggtgtcggccatggcggcgacgaggccaaggcgtgtgccgactaccgaggtacagggactcgaactgcgcgttctggttctgcactatgacgtggagaagttcccgccgccgccacctcggatggcccagaagaggtcctccccaatggcggccctgtcgaggagcctccccctcggcgttcaccatggtggcatcgacgacgaggtcagaggcgaggccgtgcttccacagcatcaggccgaagccgccaccactgaggaacccgtcgacaccgaccgtcccactcgaggcgtcgcgctgcccgcgcgccattcctccgctccgccgcgtgtgtgagaaagaagaaggataggagagcaatgtgggcccccacttatgattagcaaatagtaatcaccctactaattaggtacaaattagtccatgacgcgtggggctaggtggttaaaaacctattaaaaattagattaaacatacactgtctatgacatgtgggacccactggtgtttaaagaaggaaagagaaggggcaatctgggcatttagaaaaatatctcacctcttttgaaccagaaataataaaataatgtgaccggtgtcctatagccatttacacgtttttttagtgtctatcagccgtgtcacgttttaacggtgtctctcaaccaattacatgttttttgcgtgtcctatggcaaattttgccttattatttttatttcacgaattcaccagttgcatatataatagttcattttcttaaaaaatagctaccatatgtgcccatgcgcgaaaaccctattttcgcatgtggtttgtgctgcccatatggaaagatactaaaaattattttttatagtgataatcgccgttatagtttagccaaaggcgaaaatcattttttatagtgataagtgccattgcagcaaaaaataaaatctttataccacactaataagtaatgacaccttcaactattgattatctctatgtgaaacccacatctctatcatatgttccatccacgacgtgcctgagacctacccaggttcatgaaaaaagacccccaaatatccatcatctaactctctgccaccatacacaaaaaaaataacatatgtaatttggatttcctatcgcaatgcacgagcatctttgctatttttttttttaaaaaaagagaaatgagagagatgaaaggaaaaggttcacttgaggtcccttatcttgtcgtagagtttcgaaattgtccctgaactaaaataccagatataacatatctataatcttgcaaaaccgggtcacattaggtcccaaggcagtattgctccccggttttggtgacttggtggctgagtcagcgtgggacccatgtgggtcctacatgccagccgataatcttctcccacctatctcccctttcttcccgtctcaacccaaaccttcagggcagctggcaacaggtggggagaagagtggcgactgacggctgcgtcatggacctacacggcgaagagcgcgaagaagcgaagtaggaagggctcccgacacgtcgtcccctcgggttacaccactacatcgttgcatggcagctcgccgcgcatctgcgccacgtccacatcatggtcgcatgtcagccacaccgtcgggattggcaagaggatctccaagagttgggagatggagtacgttgcgacgcctgagcatactcgcgagcaccactgactgcatgagtgcccgtgcatgcaagcgaagaggacgccagacgctgaatcgcgagagaggtgtgtggtggcctgtgaccagcagggagaagggtggtggttgttgggcggcggtggtaggtagaagcccgacgacggcacctggcaatgggtggggagaaggctagcagcgaacaagaagcttggcggtggcaagcgttagggaaaagggcgcatgcatcgaggatgatgcgaccacaacgtggagtagatggagttgacctcgaagacgatgcggcggagccgcgcgttcgcctctgcggaggagaggcgaagctcggggacacctaaacacatcggcttttgagccgctcgatgggggcgactatgagcttgggggataggagttggccatcgtgacgaggcggaagcccgggataggagcttggccagcgtgatgaggcggaagccccagccctcacgcgtgccggtgaagacgagattgcagttgtagttgggacccgcgccacaccccgcacgtgcgcaagtccatgacgtgagcgctcccggtcattgggagccacgtcagctggcggcctccgccgtcgagcttttcccctccgaccgacacccttctccccacccattggcgaatgccctggaggtttgggttgagatgggagtagaggggagtgaggtggaagaagattgctggttagcttgtggggtccacgtgggccctacactgactcagccaccacgtcaacaaaaccggaaaacaatactaccttgagattaaaagtgatccgtaatccgttttgcaagattaggggttcagggtcgtttaaaactcaacgacaagataagggaccttagatgaacttttttgggagatgaaaaaactccagcctcatgggcctgtgcatatgacccataggcaggcgacaccgcgtgcacgacctccgcctccccaatccgtcccgtctcctcgccctccgccctcgactcccgtctcctcgcctgccgctggcgccgatctccatcctgctagcagaggtggcgccggcgtccttctgctcccgccgcattcgctcaccggtgagcatcctaatccatcccatccggcctcggcctcgaatttcgtctcctcgcccgccgcttgcgccgatccccatcctgcgagcagaggtggcgcccggcgtcctcctccttccaccgcatcgtcgctcgccggtgagcatccctccctacccacacctcatcaggtattctgcattatccctcaaaaagtttgggggttcaacggaaacagggttagatctgcctctgcccagctccacctactttcaagttgttaattttgatttccgtttttagcatatgtaatttggttactgaatctcatccaaacacccttagaacgaaaaatgtaagctcacataatttgtactcatccaaactcacataaatttcttaagaagaatctagaccacaaactacccatagtcacacaaaatatctttttatcaaggtatattcttataagtaatttttattccacaaaattttctaaaggacatactttgacacttggcattaatctaatttaactttttttctttatcaggttataaattttctaagacatttgtgccacttggcatgaatctaatttaacattctttctttatcaggttataaattgaaaccattgaacgcactttgtcttcccgtccctaaaacattgtgatatatctataatattttaatatttttaattttaaaaataatttagactaataatatagatatttaaattaggtaattaataaattcaaatcaactatagtttagaataaaaaaacaaaatgatatatgccaagtacaatctaataacaatagaatgttagaaacaatatgaattcaatatttttataaattttaagtacgattcatacataaaattaaagaaaaatatagatttatatataagtgagaacataataaaatgcaaggtaaaattattaaaggaaaaatgttattaataaacaatgatgttgatgtatttctaaatattttcacgtttatttattaagtgtcaatgattgaaatagatgatttaccatgtgacagattaattattaaaattataaaattatattgttttcatccgttgcaatgcacgagtattttgctagtttagatgatatgcaaagaaatgatgtaaactcgagggtcgagagtttagaacagtagtttccccaaaccaacggctcagacccccctcccccgcgccgcactgccgccattgcttcgccgcgtgcgccaccaacccgtccttcccaccgacgagcccgtctggcgagccacagcgaggttgcagcctctcgtcttccaccaccatcccttccccgcgagtgctgctccctgtcccgccgccgccgccccggtgcccctcaacccggggaattcgcccccatcttccccctccccgcctcgtcccaactagtcgaggggtcgccgccgccgccgcttcccccgc

SEQ ID NO: 62699 - DNA, 626 bp, Oryza sativa
aatcaggcctgcaaggtcctcgaagcagaatttcagaacgtagctagacagcatctaaattatgaattgatgttggcaatagtataggtaggcatgaattatttctcgtatgtaaattatgataaggtttatggttctgatctcagtgagaagatgcattaccagtttcctttttttttttatctaaattatgcagcgtttgtacgtcggccacgtacgtgcatgggaatgcgccggcatggaatgagtgtgaaatgcaatccggaaatgtgtcgccagccgctcctgctgggatcacattgctgatatacagtattgaactgtaccctcaccgtcaccgactatatgcataaaaccgtcgaatttcagagctccagaattaaaatttggcaaaaaaaggtgcagatatatggcattctgttctgcaagttacactgaggcgccaactcgtgtcaggcttgctcggagaaacataaaaggatacaactcatacaacaaactacaaactcaagaagcactccgaattgaaatactcgccattgcttgcagtacgtacagagccgaaattgctacactacccttaagtttgcatgccgtcgctagctgcttatcgatcaatctcacat

SEQ ID NO: 62700 - DNA, 570 bp, Oryza sativa
ttgtagatccatttgaatctctaagaatggagtctgcatccataagctttacagcccaacccagtcgacaagcaaatgatgcagctgcctgaagctgatacaggtcagcctgcaacgttttagccaattcagcaactgtagcattttcacttgatacaacaaatacagcatatagtagtctgcaaacaagaaaggcgtaaaatcattttaatagctacagatgattcttgcaatgcactatagtttaatagggaatggagctcagttgtgtggaagaatactcaaggcaagtactcactcttcaattggatcttcgtaagactgatccttatttgacacaaaaccttcaagccttgatactgaaacaacaggacaagtacagaactgaaccaattggcatttagggagaattgagctgtgttgtagtttcgtgtctacagaataataccctcaatatacacacactgttagtgcctctaaggatgttataggtttctaactgatattgtacttatcagcagtttaccgttacaagcttgaagcaactgtgccattgaattataggccaat

SEQ ID NO: 62701 - DNA, 3165 bp, Oryza sativa
gggttggtggcggtgttctgggtggaggtgtggatggcggagcactgccggcacgtgaaaaagccgtcgtcggggtcgtcctcgggcgtactcgaagccatggccgcagtactcgcagacaagatggatgccgccgcccccgtagtgacccggcgagccaccgccgtcatcgtccatgggagggatttttgtttgatcttcttgcttgtttttgctcgctgaaaggggcggagaggcccgcggcggcggcggcggcgacggccggtgagcgagagcaaccgagcggcggcgtggaggtcaggtggggttttttttggggaaaaagcgtgtatttttgtgggaacaatcctctacctgctggttttacaacgcaggtaaaaaaaacaaaaaagaattttcacttctcgcaattttatactccctctatcctaaaatataaatatttcatccaaaatccattatatcttgggaataagaaaatactaggatagatagagtattttcgtgattatgggtaagagcgagggccttcttgcggaattgtgtggcacagccacacacacatgagacttgagagacgcttgtttagagatggcaacacgatttgatcaccgattttccgtagtgaattcacataatggggatgtggatgattgatatctatcatttatgggaaattatattgtctaaaattcatcatcatcggggatgacaaaggtggggacgacgctccaccctccgtcctcagccccccacggtgacccgcgttatgtatgaaccaattctagactttttcagtcgtaatagcttggctgacccataaatttaaggcccctagactaagtcaacccttagtctcattccccatctccaccactgcaccgatccactgcgtcgtcgccgccgctccagactctagatgatttgttgtttaagcagggacgagggcaaccacggggaacgaattcaccgcacaagggggaggggaggggatgggggggaggggttgggatggataaaatgtacccccgtcgtggtgggcgggggtggggacggtaaaattttaacatcgtgaggacggggacacgaatgtgacacccgatggcgaaatatccgttgccatctctacaagggtgtcgttattcccctgtttgagcgtttgaaagcaagtggggtgggttgtggctgcctgtcccacttcctctatgtctgttaagatttatgttgataatccacatctcgcatatgaactgttaagagttaccactaaagcccgtgaactagcccacaatctattttccggtggctagctcttcttctttgtcaataggtcgataaagttgactacacaaataatttttctagatgagcagtcccctagattccaggcaacccataagttaccgtgcctaaaaaaccgatcccttgagaaccggttcacataccataggcggcaatcgatcttcacgtgtggtcgcctcaagcggccagcatacgaagacatatctttggcgtgtggctgggccacccgcacgcgaagatggtgatcttcacagactttttgggacaggcggtgcgttcaatcacgcatgagaatatgtttaggccatttgcaaaacctgtttttggtgttagtaaagttattaaaaccaagtgaaaacaattatgcatttttttgggaaaattagttatgtctttgatcattccatatagtttcacttgagcatgtctacttacattatctatatgctctatatagttggcaacaaaaactaaatatgcattgagccacgtcaccagcaaaacaagagccattcgatcattttcatgcgccatcacaaacatccagtaggcattaaatatcgccagttagtatcatttttcattcatattcatttgaccacttagtgtagtatgctgtaaaaaaacactataagaagtatttcacttttcatatgtgtcaacggggatacccgtagaccagataaatagggtattggggtacgtaggcatgatgatctatacgatacgacatcaaaacaaacagagagacaaagattatactggttcagacccttcgtaaggtaataaccctaatccagtttatatgagattgatatggaaaaccacagagtacacagagaacaaatgaatccggcgagacccttgtcgagatgagtcgacgagatctcccggtgagtaggcttcgcgtcctccggctgcgtaaactatatatggtgggtgtgttggcgctatgattcgatgatctgaacccctcgaggggtgtgccttttataccgtgagttgccttagtctctaagtacaactcggagacaatgaaccctacacgatatagaataaatccaatcctctctgagtaggactctgttaatcaccagcccatgaggatattttctataatatcttgtagattttcttaccgcatacgaaaatatatcgtatggacaatggtataccatacttgtatatttcgtaagtcatagataggaggtatgtcttatccgtaaccatgacaatatgtgaggtgcttttataggttcataatatttctcatatttatacattaaaatttggggcaattgcatgggtgcccccactttcgaagccaattgctgttctaccctcattttttagggtttgcagttttactcctactttttgaatctgaatcagccgtgtacccccacttctaatagccggttttaacgacgttagttgtagaaaaaaagacatttatacccttggtggttattgcatttttgcccctatttttttcagctttgtgtgattttgcccctattttgtgatttcagcttgtgtgatgagcatttcgaccaaatatgagcatctcttgtgatgtttttttactttaacaaaaaaaaaatcacaaatactatgcaattacaaaatttgaccaaaatttgaacaaaaatcacaaatactactagcactcatcgtcgatgctagtctggacgacgacacatgcgttggtgaggaactgcagtggcagcgcgaggtagtcaaggcggaggcgcgaccgtcgacggcgaggggcgacgccacctcctcgagccacacctggaggtaggcggcaacctcgacgcggccgtcgctgactcgcgcgcgcccatggctgccgtagcg

SEQ ID NO: 62702 - DNA, 557 bp, Oryza sativa
cccagtctgagaactgttcaggctactgatgaagaagtaaaactgaaaataataacagagagtgtaaaggtttattaggccattcacagagattatttttaaaatcaccttcctatctagatccaaatttagtggcattgcacttcatatttgtcattatgatgagatgtgttttgcagactgaacagaaaaagcaagccgctgcagatgtccttttccactattcacagtttattatggtttgcattggtgagggtgttcgcccaactgatctgaggttgcatcttatgaaggtatattttattaaccttcgcttgactttttgtggtttgttaatgatgtgcatttttcgtttgcaaaattgagatatataattctcaatttcccatggtgaattttttgtacgatttgatgtggtgggatgtgtctgcttagcaaggttgcaatggcaatgcacatgttgactaggaagcagcagggttgggcactcatgtggcatcaatcagtgcctaagcccccattacagttattgagctgctcctactgaatttttatct

SEQ ID NO: 62703 - DNA, 5949 bp, Oryza sativa
ttccagctagcacaactgcacttgagtacttgacagtgcactattaattattccttgcgagagttgaatctgttttattttaacagttcatgcttgtaactattagaaaattagattctcagctgtttcttttttctcatgtgcaatagtgtttaaaatgctcactgtagcccataaggctcataatatgctaactttggtcctatttttgcttttcaggaagtttcaggaatggccacttctctaacgaaagagccacagcaagcagctgcctctccggattctagtgaaccatcttcttcagggacaacgaaatgagacacgaatgagatcttctaagcttcttcaagaagtatgataggaaatattgcaaactagtaggttcacagcttgtggtctgagaactgtttctggtgcagtgataggaagtattgatgatgatatacttgtgttggtgatgcttcttatgagcacttgatttgaataaattaaatgtaaatactttagtatgtttggcccacaatttgtaatgaaggaacatggatcgtgatgtttctgataaaattcttgaagtgcctagcccgcgttcatgtttagttttttttttatcgcaattgtggtgctatgctgtaatgtaatgaataatgtgcataaatgtggatgatgaatcagagccgctcctgtagtagtacacacatgtgccaatgctgtaaaagtggcaagctatacgctgcaatttgaagcaatcaggagtaagtgaaagtatcctccctctatccagcgtaaatatttcacagaaatctacttggattcaagaacaagcagaaatccatctggttgggaagaggagaaagagtcaaggacatagattaaatattgtggcttaaagcctatatcaagtgtgtaccaggagatgacagaaagcaaagatgcctgtcctaggaacgaaagagctgttcagaaacaagtaggcggggcatatctgctatagcaattagcatgaaaaaaaaaattctacattcacctaatattcaaactttgatcaccaactagtagtagtagtactagtatttcagtgtggtttatgtaagtgaataaaaagcacatcatttcctcatacctcagaatattgttcattgggcgcagcaatgacaaaacgaacacaatttactcgcgtctattttccttcgatttcagctctggtttgcaccgtgcctgttttgctccacaaaagatcgcaaacaagtaggttcacagaacagagcatttattcactttcagatataaaactgaacatccacagcaaagtatatcatcaaatatcccaaagcctgtcaatatcatcatgtattaaagaaaaaaaatacccatacctatatatgtttacgtcaaagtaatgacaaaccgaagaattctccaaaaccatcgctcaatttgctatgtaccccctgcagtggacaaactttactcgaactgaacaacatcctaagttcttacaagtaaacctatacctccgatttctcgtgttgtcttgcacactgtttcccttggattgaagaaaaaccgccaagggcagcagacgattcgaaagatcaattatcagacactatacagaatgcctccagtatccttcgctgatgtaaaaatatcctgttactgttatgcaatgttcttgtagctcctatgcacatttcatctcttcttttttcccttacatttctgaagaggaagacgatagctcaacctacaaaagcaaaaggtaatggatttccaatgagaacatgagatgacagatgaggcaaaagtgcaccagttctaaagaaacaagattaatttcttcagtgccgatgttttgtatacttgcctgagtttctgaacacccatctggcgtagtcgagcaccgatggtctctctcgtggttgcggctccgacaccctcaacgcctcaggatcccagctccccgaccacgagtcggtgctcccagctgccgtgcgccgcgaggaggacactggtagctccattgcggtggagcggctggtggtggggaacacggcccagctcccagagagtgtggccagagaagagcggagccagccgcgagatcccccagcatcatcgtcggctgcagccacctcttcatcagcgagaggcagcaccggcagctgcagctgcagctgcacctccgtctgaacgccacgcgagtcagcgccgaggtggaggtggcggccgctcgtgctgccagtgccagggctccagcttccggtggtgcggcgcgacgaggagcaccccggcgccgccaccgctgcgacggcgcggctgcgggagcacgccctccagctgccggagagcctgtccagcgaggagcgcagccacccacgagatccccccactgcctccgccaccttctcgcctggcggcgcgggcaccgccagaatctgcgactcgatgtcgtactcccctgagcagaaggttggaacgaggcttctcttgtcggtgcggcagcgggtggtgatgggagcatggcactcggggcagcatagcagcggcgtgacgcggctgcggagccaggcgacgaggcagcgctggtggaacatgtgggagcacaccggaaggacgaggtgcagatcagttgggagaagcagtttgttgcagatgaagcaggtcgccgtgctgccgctcatcgccggctgcaacggcgaaggtggcagcgagagcagctccaatatcacccgctccacctccggcagagacggcgcagacggcggcggcgccatcgcagcagctgaggtagccgaggacgccatcaatccagccgtcccctgcactgccccttgtgcagagctcgacaatgccactggagggcctctgccgggatcgcctggagctgaagagggcgcggccatttccggccaggacctggcactggcagcactggccctcggtgaagaaccgacagctgcaactgccgcgcgccacatctgagacattgctgatggcgaagatgacaaagcccttggggataagctgcggcgtggggagaacgatgagcaggacaggcggcgcccacggcggtagctgcgtcgaatgacaacaatggcgacagtcacgatggccgtggtaatgacgacgaggacgacaatggcaatgctggagcctatggacgacgacgatgacggcggcgtggctgaaggtggcaggctcggcacagagggatacactacgagctccggtggtggcggcggcggaagtgggagaaggggaccgggtagcatacctgcatcagtgcagctttttctctgattagtcccaaatcagatgctaattcgtaaaaattgactagatagagatcatgcgtaggatgaaggaacagatcatgggtgaaatttcgtggaaatgaagtgataaaacaactggaaatttggaatctgggactaatcacacgagcaggacgcaaaattcgatcaatcacgcaacctaatcgccccaattcccctccattgcagctaacaagttcaggagaaattccacatcagcaggtagcgacaatccaatcacgcatggagttccatcaggtgatccgttcaattccactcccaaatcaaaccacaccacaccacaccaaaccaaaccaatccaaatctcaagcgcagctggtgcgaaaaaccggagaatctctaggtgcggagagggacacgggcaattaccgacctgatgcatcggcggcggggaggggacgaggacccccggagcagcgcagctggtggggcggggggcgcggctagacgctgcacacgcttccctccacgaacctgaaggagaaggaggagggggttaggtctaggttagggttcgggagcgacgaggctgcacttcacgggtggaggaagcaccgccatacatcgacctcgcagcagggccaacacgtacatacctctgcgacgctgccggcggcggcggtgggagaagggggcggaatccggtggatgctgcggtggccgcggccggagagagccgagacgcggcggtggcggtggcgtgagggattggggaggaggaggaggaggcgaggcgaggcggagggggatttggaatggcgcctgcgcgggcgggaggaagaggaggaggaggggagggcccacatgtcagtctcctcggggcagattaggcctggtgggctcggcccacggaggcctcgctagagtaggccacatctccggcccatccacgtgtatgagcctggactggatatctcggcccatccaaacaaaggcccttctgccaatttattcttcagagtaagagagagaattgcacatcaggccagacatattatcaaagtttcattttgaaccatctcttagtcggtactacgccgactaatgtaacccttgaatattataatttatttattcaaaatatataaatattgtacatgttatgttatcatattacttgttaagtatatatgagatggaacaaaaatgaatcaagcgatggtaattgcggtggtatttgtgatatttatgttttgataaatctagaaatgtttatttcctgataaacatattacactaagattaacataatttggataatgattttaatgtttatctataatcattaaagcaataaaacttagttgtacagatcaagcatacatcaggctagcaattggagctgcgtcttatatagctgatcgattcttatgttctgattgataacacaattaaaattaaaagataaaaaatacaataaaaaacaaaagaaatagaaaatatgcgcgcagtacagtaaatgcacgcaatatttattatttatttgtaaaggagttatgaatagatctttaagcagttttaaaattttatatctgtcaagcctgacaaaaacattatgctggtaaatgtttaaattacatataaaagaaagcaaaataaatgtttgaaacgtggtacgtggaacgctggtcttgaaaaatatggtacgaaggggtatacctcttcaaaacgtttgttcgaagggtgaagcacgttccatggattttcgggatgatagtccggaatgatatggaaaatcaggatgcctttgttctgcagagaataatttgaactaaatatatgtaaactttagggcttatatggatgaaaccatttgaatacaagacttttcgtaatattaataaactcaaagggctaaattgaaaaaagatgaatctcttctcctttcaccacatcaggccatcaccccacgatggaatccacaatgggcatgtacggccagatcaacgtcaacaatggcagaggcatggaggaccaagaactcgtcctgcgtcattgcagtgcatcacccacatatctgacactgggtttctcacattctgatcttcattttttattagttttgatcgattgaagaagacaacattcttttatcagttttgatcgattgaagaagacaaatggatacctcttctttcatgctttgatgcctatttttatttcgatttgaagagattgcaagtgatagatagtttggaatactctagagttcagattaatgttcgcgcgggagactgcgcagggttctccaccacctctccatatggacacgtgacagattttaggagggattcaaaccgaaatattaggatgccatgtggtccaatgagaggctagggattggaccttgaaatcggtattaaagatttcactttgaacctactatacgaatgctattatgtttattgttaatcccattgtcctcaaaccttgagaaagttaaagggttagagatgcacagcagtttacagaagtggcaataatgccgtggatagtaagtgtgagctaatggcaaaggttaattttgggcagggttcattcaaatagatacatatgagttagcactgattacgaggccacatgtgcccattgttcccgatacaatgttgttatg

SEQ ID NO: 62704 - DNA, 10246 bp, Oryza sativa
ccacctaaccacatttattgcggtttggctgagcatgtcacgccgcatgtaacgcagtgcagtgcactcgtttatccggtctgtgaccagtcacagaccggtcagatcgcgggttaggtggcgacaggcgatctgacacacgcctcgccccttcccgtcaggacgagggcttctaggcgctcgtccccagctggagctagcgtgttacctcccagagatggcacgttagtcctggtcagatatatgccaggcttcatcctaaccattacaggcaagatattgtatgaagaagggcgaacatgcagattgataaactgacgcgtggtggacaagaatgaccgatttgtgaccggtctgacactggtcatgtcgtcagcagacagccatgttcccacgtcgcgcctgcttccggcggaagtggaggtaggtatgggccgtcccatcagaaggtcattcggacggcaaccatacaagtctccgtctgtttatgaaaaggtggggtaagtccccacaaaaaaagagagaaatggtgcatgtggtatccccttaagatataaaaggaggaccttgcccactgagaggggggactggacttttctagattagaaacccagaacaagggagaggctggctgatactttgtagctccttcatacacagatctcccaaaacacaggagtagggtattacgcttctcagcggcccgaacctgtatacatcgcccgtgtcttgtgtgtttcctgtctcgcgagccttccacatacagagagcttagaatctctccctgagtccccggccgaaccggcaaaggggggcctgcgcggtctcccggtgaggagccccacgctccgtcagtttcgatcttcaacaagaggtaaaacttgtcatgacgacttatgttctcaagattagtgcttccatctttatgacactctaatcttgtctatataattcgtcgagttatcatatatttcacataatctttgataatatcttcatctaacctataatcggctaacatctgttaatggaaggcagccgattaggttagataatgatgttaacttagactatgtgatatatctaccactctatgaaacttccagcggcttgattgtctagatattgtttttcttttcatacttaatgctgcatcagttgagtttgatctattaagtcgtgcttagaattgcaatctctagcctgctttctgattgctgattagggtagtatcggagtttcaaccgatcttatctgatttaactacttttattctatatgcttgattgacatgttaaatctgccctttatgttaagatattgtcgcatctaagtatattaagcttatgtttagtatattctacttgctttaaaatcttagtatagagtagtatcggagtattagccgatacatgctagatctacctgatcggctatgctatgaatgtatataatcctactattaatatatatttcgatctaagtgatttatactgtctcagcaaggcgaccgatctatcacaatcatttgatttaagtatatattgatataaggattatatatcattaacatctacagccgatcgagtagatttagttctggtttgcttattgatatttgtcggtcgatgtacacatgacaacggcttgaaataaatgatatgtcatcggcacctagccgatcggctatcatttataggattaattgtggtttctttgttctatttcttgttgattgcaggatcaaatcaactggcacgctcatacatccgaagacgagctttggacctgcactggagttaagcagatctcccaggcctcgtgttttctgtcaacatatatttactgagcatagtgattgcagaagcattatattgaagtagctaaattttgcacatacttaacagtcttatgccacacatatatatcatttggttactgctagcttgctgcctgtcatatgggcaacactgtgttttatttttaagggaaaattgcaaaaaccaccctcacatatcactctgggtttgagatgttccctcataagaagatttgttgcaaatccccacctcctaattcaccttgatttgatttaggcaccttttctctatacatgcatgtttcctagagaatctcatggtgaaatcaatcgagtcccactcggcaggaacaagaggttatgttatttgttctgtataagacgatctttgtgcagtaccaagaaattaacaacaccctaaaacaaaatttccattgattacattgccaaaaccaaaaaaataaccacttgctaccatgaatttctaccctaacgaggatgtaatctgatagtgctacatatgaaaaaccaactctctgtaaattgtaatgccaacgaaatctcaaattttaccaacacccaagaacttactgtatgtccgttccgcgatcgtcgaagtgaaaccctttctagtcgcttggacaagagaaagcatcacaatcggcggcgatcttcgcagctgttccgcccgctaccgccgcctcaatctccactcccgactcaaactgactcggagggaacggtgtgattaactaggtctcggcgtctctcgctcccgtcaagcgggacttggctaatttcgccacgagatgctccaggaaaaacgcatgtgtagagagaaggtgtccaaatcaaaccaaggtgaattaggaggtggggatttgcaacaaatctttttataggggggcatctcaaacttagagtgatatttggagtggtttttgcaattttccctatttttaaggaagtcagctgcagtgcccaatttttcattaatatcgcatacggccatcgctcccataagctaacaagacctaatttttcagaccaatcagttcaatgaatcagagaatgatgaactacccaacatggtcatatctctgaatgcagtgcaccctcttttcagcatgctcatatgtgaaacatgctcatatgtgaaaccacctaactgtattattaatggccctgttatatcatacactagcaatatgtatgacaccttcaaagagcaagctataaaaatgagtgcaaaaaattttatggctggaggtacgtagacagactacataatcatgaaattaaattgcatctagcaattgttaattgcatcctcaccagtaagagtgaacaatcgaaatcgtaatatggtgatttatgattttttttagatgaaatactgcctgacatttgccgagcagtgttgtatggtgatttatgactgaagcagtctaattccacagttagtaaatttaaatgtactgataatgcaatagaaatgtaaaaccaaataaccataaacaacatccagtcattcagtgttcatcagcactgctgtgcttaacattacgttaaattgtctatgcagaaactgtatacatttctttgtgtcaatatgctttttatcgcctccaatttgatgcatagtacactttagttttgactgtgctaatccaggtcattgagtaattagtccctaatctatccatctcctacttgttcttcctgtgatcattgccaccccaaactctgaggtcctcatcgatgaaaatgaggaatgagcacaggaaggataaggggagccgggaacgagatagatttagagttgataaaatgtacaaggaccatcaataaattagggaacatagatagattcagagtttggggtgattcatgcagatgcagagatgacaaaaggtacaacatagatagatgcagagatgacaaaatgtacaaggaccatcaataatttcactactgacatcccgtcaagccaaaaggtacaacatagatagatgcagaggtgacaaaatgtacaacgaccatcaataatttcactactgacatcccgtcgagttgcttaacagaagatagagtagaggggataatatggtcacctggtggagttcatggttggtgactttaacgaggatgtggcagcgaagcaggaatccaagcccagttttagtaggccaacatgcagctggagcaagactgcaagaggcggcatcccggtcgggtggcctgagatggatcagatggcgtcgcataggcactgtactgccgatgatggcgccggcgggctagggcgcatggtggtggcaacgaattgcattcggcggagcgatggttgctaggagaagtcagggagaggagaagcgctatttcggggagggggggcgcagcgtgggaggttggtaacgatcgctatttttgtttttaatcggtggttacgtgttgcagagcaggagattgctaattgtagggacagatttaactcgccacataagccattggatgaaaatatctaatggttaaaagagaattatgtacaatttgtggataaaactgttacattttatatcagtatatctctactatattataagaattgaagatgtttccgctgaaattttgatacgtcattcgtgttagtttttcagtttgttgtacatcgtctatacacaattctatgtaagtatagaatagctattatacactctcctcctatctcaaccactcctcctcccagcccatcccaactggcccacaccatcctatcagcccatcctgcgtgcctccactcggagccgcaggtgcaactccccatatcagtgtcttttttctcttgatcatcctgatcctctccctatccttccaatctcctctcttttctctccatgttctcttctttcctcttagttttctctttcaaatttctgttatcataaatatttttgttttgatattatgaatatttaaggtatatgtggcaagtttgttactttagaaatgtttttcatctatattaaaaaaaacttccactgattgaataatcaaaatttcaaactttggtcaatgaggtatagagaaatacgcatgcgtcaacttatggaatagccacccaacgatttgtaaggctatggaaatgtgtacaaaagagattctttgtgtgatgcatgaaacgagcgcaactaggttcaatgctatatatgattcctaattttgttttgtttgtcttatttcggtttgtcgtttaaattagtggagtttttatcaatcatgaaaattatcttcacctgttgcagtattttttgctagtatacatatagatataaaactgattctttggtgcaaggttttgtgccaagcgtgaaacgctatgattcgctttgtctcttaactctgaacgcgcaatacatttagcttgtagtaatatatgcttcttttattctactttctacactatctgaactcttagaaaaaaatgattatgctacgattgtgtcaggtcaaatactcaaatgtgcaccagatgttcagtcttttacatacaagacatgcgtgctcatgacacacaaacacaaccgatgatttctgtgatagtacgtaattatatatagaaagctgctatatattcaaacatacacaacttggagtctaggacaaagagcatggccgcctcgatctattgatagctcgacccattattaacatactacttatatatcatgatactcagttatactgtaataaccagcacacagacatcgatcatacaacaatcgatatcctaacttccaaagtagctagtacatcgatctcaagatcatttgtatatttctcgaagccgttttttgggtgacacagcttcaatagctgtacccaatggccaagccgcgtcaatgtagtactccccatgcttcaccttgtctaccagcgttatctccttacttggatgtagacctgacatccaattatatatatattaattagtaaactgcatgttagataaattgttcaacaatttacacacctatatatgagttctttttctttagagttaatttcttatccatggatatatattgtatctccattattagaagctagtgtacgtaccgaagccgtcaacgagcaaggagtattcgtagataagatccatgcataagtaggcatgatcacgaacgttggggtattctacttttgcttctttgacactcagtttacaaaccttttctgcaacagccttaaacgttgcaggggttgacttcgcactgggtgcatcgctgttgatgaacccaacctttatcccggtccgatcaaaatgtatgcattggagataaaattatcaggtaaaagtattaatttgtatatgtaacataattacacaaacaattaaatgcacatatttaggggtatatatttacataactagttagctagtagccagtctgaagcatgcctgagaagttaaataatttagttggctaattaattaagtaatcacgacgtacatgggaggctatgtagtagaaggcggacgcaacgtagaggtcatcctgccctgctccgccaccaccgttccagacgccattgaagctgcagttcttggtttcgcagggcgcattcaccttcagtaacttcactacttcttctctgcacttgtggtagtctgcaccttgtggtgcggccgttgcgtcgtactgcttgccgttgtaggtgaagttaccttgtttttgccaaatcaacaaaacaaattaaatctcacttggttcattaagcactaaacgttaattgattatatgaatcttaaaggattaaagggtcgatgcgtatagtaaacagaacaagtaataagctagtatctaggtaccactgaatccgcgcagcatgcagttgctaaatggtccatcctttctctctaggatgtgcgcgcgagaagcaaaaccgccatagtgcaaatagctgcaaattgttgattgatcttagtaaactacggttcaaaagactatatatgcattatttttcatattttctacagtaagttcagatattaacaggctaaagcctacaggcttcaatagttcagtttattcagtattcactagtacagtgtgtgcaacaaatgaattaatgttgcactttctaagtagtatattattcaccagcttgcagtggatccagatataaaattaaacaaagatcaaattatacttaacaagagcgtgaacttattaattgacctgtgcacataaatgttataatcttttcccttgagatactccttcacaacatagggatcttttccttcgggcacctttggagcggtagcagcggtgtttgatgagatggcgtatgccatttgtacggatccacctccaagatcaaccacccctacggttttagagtagtctcctcccaatttatccaggagataattcagagcaacccatatgtatgacccttcctgggatccctcaagaacgttgatccagttcgggttatactgatatttgctcttggtgtggactacatccctaacctgtattaagacccagagtactaattaaagggattattaagaacaaaaagttattaagaatcaaagcaagaaatggttttgagttaaaaattttgtatgatatgatgtatatcattgtggaattgcacgtaccgcttcaagaatctggttcgccttttcatctccaataagtctgagtccggcagttgcctagtacatgtttgattgaattaacaaagaacaaaatttagagagtacaagaagtcaggccattttgtttcagaggaaacatatcatcgttaacattttgtcagtagttttaagaaactatttcgtcagataaaccatcatacggaaacatccgtacgtattagtaattttaaattaagttcccgatgcaggtttcgtttaataattagataaagagcaaatcaatttagttgtgtacgtaccccaagtttaaggggagttttgttcataagtctggcaggaacaacggtgttggccttgtcaagcagaggcaatatggagtttgcggcatcctgaggacgtccagcgtaggagctcagcccaggatccacctacaacaacacacaaattaattagtcagtcagtagtaggattaaaatagctcaattaagtaggtactaacgaatcatcatatattaataagtacttcctccgtttcatattataaaactttctagcattgcccgcattcatatatatgttaatgaatctagacttatatgtgtgtctagattcattagcatatatatgaatatggacaatgctaaaaagtcttataacctgaaacggaggtagtagattagattaatgtggttaccttagcgaagagctcgatgttgtcgccgaccttgaggaggtccagcttgttgtcgaacctgaagacgtgcacccgtgtgccggtgctgccggcgtccaatatcacggcgtacctccccggccccgccgcctgcccttccacgacgccgcctttccggccgagcaccgccgtgtcgtcagcaacggccggcggcgacaaagccagcaggagaagcatggccacgacaaggtgatcagccgccattgctaactagacaaggtgaggcgcaggtgctcatcaacagaatgcaaggggcaggttttaaagggagaggggaattaatggattactaacgtagagtttactctgcataattcagtccctaatcacagtgtccacccattagcacagtacaatactcaatccgtattaattgtatttactgtaataaacagcttttagacggggccgtgttgcaaaggtttcactgtggattcacgtgtgtaatcctagtgcgctagctttattgattttgattgatcagaagaactgattcttggtgcccagcgtgaaacacgatgattctatctgtctccaactctccttacataacaagtttaaatcataaatattttcttggaaagaaaatcagttgattgtaaaagaaagaaaatcagttgattgtaaaagaaagaaaatcagttaattgtaaaatataggattccatttccgtcaccgtcagattagacccctaacatcttagcttcctctcacacggttgggtccgtccgtccatgacatcaagggggccctttcgatgcaggcgctgcacttgtgggatcggcttgaggcaattcagctacagccggattccagggacagctttgtgtggaagctttcggccgacggaaactactactcctcctcagcttactccatgtttttcatggggaaaacaaaggtggtatgggtggagttagtctggggggctaaggtcactcctcgctgtaaaatgttcatgtacctgacggctcggggcagctgcttgacctccgacaatttggacaaacgcaggtggccttcctgccctctctgttcgtctgggccagaaaccgggaaccacctgtttgtcaattgccctttctccaaacaggtttgggcgcaactgcgactccgcctccgccttcagccgcaaacaccaaatatcccccggtatggtttcctggtggctgcatgaacacgagcttcataacaaacaagggaagaaggtgtttgacgctagactcttcctcttctattggctgatttggaaagaaagaaatgggagggtcttcgaaggcgtttccaacttccaagacagcaaccgaggtggcagaagccatgacagaggagtggtggacttggagagatgctggtttaggtgctaggatcgagtctgtatagtcctcctgtggtattagacttggcagtggcatgtgtatagctatgttgtgggtcttcttccctgtggtacttagctcagtctccgctctgggcttggcgatggcccgactctctgctccctaggggagcgttagccttctccgtcaagaaccgttattgttgtaactgataatcttttctctcattttaatacaatttcgtcggcttccgctggcccagcgaaaaatcttgcttcctctccagaagttcactttatcttagtaatggttgccccttgttctctaattgatcagacaaaccaacaaaaagttaactatcctaactctcttcctttcaaatatattccattatacttgaacgcatgtattggcgctcaaatcttttacatgttcgcttggatcaaatatcaatcataaagggttagaaataactagttgttgttagtgctatctatattcaaattttaattgtttgtcaaatatgttgattattttccaaattatagcaacatagattaaaagaagagtctatccacattagtatttcttgaattgttacgacttgtacctaacaaaacagtccatatcagttacaatgtgctactccctccatttcacaatgtaagtcattctagcat

SEQ ID NO: 62705 - DNA, 59876 bp, Oryza sativa
gcccataggtgggagctggccccgtccaatctccctctcatcccacccccaatggcgacgccgccgcaccatctcctccaactccgaccatccactccctcccggcccttctccacctccgcctcgcctacagcagtggcaaccgactgtagagagtgtgcgtcgaccgcccgccccccgcccccgcaggcccgccgtcgtgcgcgccgaccgcccgtcccctgtccccgctggcccaccgtcgcgggccgccgcgagggattgcggccgaccgcctgccctcgcacgcacgccgccgtgtgccgcccgccgctccacttgtgcccgtgcgtcgtgacgatgatgatgagagagagaggggaagatgggaagatgaggtcttacaggtgggccccaccattttaaaaaaagaaaatgctgattggatttcaacctcagcgccacgtgtatgccacgaaagattcataccgcttcagattgagtgaggggggtaatttgtccggttttaatagtttgaggtttaatatgtctggttttgtggtttgaggaggtaattcggacgatcgcgatagtttacaggtaattcgtaccttttccgagattgaatgattttgtcaaataaacgtgaactggttaaataggcgagcacagtcagctaagacagcaagtctgggtggtgtagttggttatcacgttagtctcacacactaaaggtccccagttcgaacctgggctcagacacaaacatgttttttccattttttttcaacaatatgaatatttttcttaataacaacagcataattacatgcaaaaaatatttctccataacaataaccatttttttcaacaatttgaatatttttcttaataacaacaacataattacatgcaaaaaatatttttttccatttttttcaacaatttgaatatttttcttaataacaacagcataattacatgcaaaaaatatttctccgtaacaattaccatttttttttcaacaatttgaatatttttcttaataaaaacagcataattacatgcaaaaaatatttctccataacaataacataaaaacttgataaccacatgcacatgattttttttttcaaaaattcgaatatttctcaataacaacagcataattacatgcaaaaaatatttctccataacaataacataaacacttgataaccacatgcacatgattttttttttcaaaaattcgaatatttctcaataacaacatcatacttacatgcaaaaaatatttctccataacaataacataaacacatgcacatgcacatgcacatgcacatgatctttcttttattttaaaaaattcaaatatttctcaataacaacagcataaccacatgcacatgatctttttttttaaaaaaaataaccctccatatcatcgagcaactttaacagcataaccttttctttttcaaatatttcctccataccaacagcataaccacatccacatgatatattttttttcaaaaaaaaaatcttcatatcatcaagcagcagtataagctgcaaaaccatatgcacatgaagtcaaatatttcctatacgacctatatagcatcttagcagcacaaccatttgcagtaatgcagatgatctcattcagagagttaacagggtttagtgctacagcttcacatccatatgatctcatccactaagttaacagagctttaattctaccacagcaactagcaaaagatatagtaattgcattggtggctacaggcctacgacatcggcaatgtacagcacaaaatgtgagggtctcatctcatgccacacaaagcagcagtccttgctacatttccactaacccaccaccacaaatacagagagcccctttatcactttatgctaccattcatagagtagcttaatatcctgcaaatgtaggatggaagcattaggcagtcacaagagaaatagagttgccatagtttcagatctaattgttcagtttgtcaatatcgtatacattcttgaataaatatatggcatgctaagcttaagttgaaaatatatgcttatgtaccaaagcatgaaaatcaccacgtaggtgcctcaggcgactgtaaccacataaagttgttttgagagttcttgacttacatgaatggagtgatgaatcagctacttctaaaagagattattcagttgcataaataggttggaagaatgcatttcccatgaagaagcagtttttgttttaaaaattataaattggaacgattgttaaacaagttttacctgctttagtacaccagcctccatatcttttatcagaacaaacctcgacaatgcttagagccacagaggcatgatttgagtttgcaagctttgaagggttttccctcaaagccagggggagcacctcttgtaccataatcataagtcagttcagtcatgggagggatatgttccattgcaaaaaacatgatatgggggtagctgtcatcgccatggtcatactgtacagcttgccaaaggagattaggagaacagctatggttcagaaaacgagccacattcccttcattgtttgctcttatgatgattggtagcttcttaaagttcttggttgtcacagccgtacttttttcttcaagtaattctgctcccaaattccagcttaaagccttatcgccgggacatgaagcgcaaaaggtatatttgtcttcctcaacatctatgtccatcttagtttcatcaatgacttcaccggcgtactcacaaatgaatgtgccagcacggataggatcccaagaccgcaggccccagccacggtctccagtccagaatacctcaaagttcagttttatacccttctgtgtgatcctgtttcgacaattatgagaacactgacagttagaggagcactcataaaccattggagtgtgctttgccagcaatcccgttgcgctgtaaggaagatcaccaccattctgttgcgcacacgaacaattagggtcaccaggcaagcaaacactaggacatttgcaacattgtaatggttttgtcttcctaagaggtctcaaatacttcactccagcaacataattgaagtgacttggccctttttcatcatcaacatcattaacaaggcacacaggtaggtgttcaacctttgatgataaatccaacaatatagccttttctcttgtggcaggatttgctttccacttctcagtcatcttccaaagtgaaattccatcaggctgtcctgggtcccttctcagcttgtacttgaaaacattaaatccgttctttgccgtgtctgtccaagtgtcttcgatacgataaagcccatcataaatatatattttgcctgagttacaaaaggggtcttgtgcgctgcgcacaaccctgatctgattcttcttgatcttgctgttcatgagagcaaggttacctctctcaagcttctgatcatgcttctccttgtgacgactattgcctccctgtcctgtgtagaccaaaatgtcagtgtcatcatcgtcattctcatagcctccagatgaaatgatgcagacagccagagtctcatctttgttcttagaagagatgtaatcaatgccacccatggctggtgcatgcaaaccaatgatgcacatttcaatcctaaagaagaagatatcgccgacttcaacaccaggcacatgccctatcatcttatgattgttgattctgaggttgttctgcatcatgagggtgccagctttcaggtcagcccgcctgcttgcatcctccttttcatccaactgcagtacacggcgccgaagggaatcaaacatcatcaggattccttccaccgattcctttgggttgtctgatgaggatgaacacaagttgaactcgttgtccaggctcctccttattgatctgcgcttgatgttggcatcattagatttctcagcttgctggggcctcttggctctctttggcagcgttggttttttctgcctgcaaaagggcttgtaatcttgatctgatgattcatcttcatgttgcggtgttggaaatgccgctgagattggtgtagcttttataggaactggtgactttggtaagggcagagaaaatgaagctggggcttcttgaggctgttgtgatgaatggtgtggcataaactaacaatggattggttgattgagtttccacatcatatcccaaaatagtaggaaactttggcgctaatgagcgcaatggctccaattccaagggtagtttgccattctctgcttcatcttcagagttctccatggtgaactcttggagaaattctggcagcagcaaaagcagaagtcaataaatagtctgagcatgatacttgtatgtatcagcagatgaatgatgtctcagaacttgatatgttaagaataagtacgcgagataaatataaagaaaacatcgttcagtgcaaatacaacgtagagcaaagaaattgaataaaaagaaaatagatctgcaaaatcagaaagctgcatcaacttctgaacaatcagaaacagaacaatctgcatattttggccattgatcggtcggctgagcactgatggctcacttaaagataaaaatgtgtcaatgcgaagtctctgtggcatatgaatcatggatgttctgtccggaatctatttggctcacataagcattaacatttcaaagttctacttgttccccccttacaaattaaccaaaacaaatgcaggcactagaatgacgaagatggaaacaaaatgcattgcaacttccaggcgctcatctggggaacccaaatacagtgcgtccatttgttcaacaaacccatagttaaactccaggcaaccatttgcagtacacacagacaataacactaacaatcacacgaacttgctacaatcaaaaagatgatcaggaactaggacttgcagaaaattagttagaattctaggaaaaaaaaacaatggagagaaagctgatcaagaagcatcagatgaggagtggtgtaccttgaggatgtcgccttgctggggagtgtgaaggggcacaggacagcagttccactatcggagacccctagaccaaaccgtcaaatgtatacatgtatgtggacacaggcaatcgtgtcagtgtggcactaagcactagctttacaccatctaccgtcggataatctcgagatgcgcgcctctggaattggctggaatatactgagtgagatacttaatggtgattacttaaacataaatttagaacagcggtgtacttcatctactgtaaaaaaaaaaggaacagcggtgtagttacagtcattcatggcaggacactggaagtgttcaatttctgataaactcatttcactttcattatctaaaaaagcaccaccttattttctccaaggacacagacacttcattaacacatttgctgctccagcctatgagcttgtctctgattcttttcaggtcaaaagtagtcaaagtacagtagcgtttttaatctccttgcaagagcaaaacttgcaatcttttcactgaacgtatagcaggaaaaacaccaaaactgacaaaatgtagcaaaaagcaagtgatgccccttaggtatagtttctagcatcaactatagtagattctacattctcgacgcaggaaagacctatgcgaattttcacctagggctgctaactcgttgcatggtgagcatcttcagttcgagaaagcgttttgcgcagttggacagacacgaggcttcgctgttgctgaagctgcttccaatgctcccagtgatgcatttgtcccagcaaacatcagtcagcttcgccacgaactcgtttgccattgccttcctcttctcctcctgaagagggaaagaaaaacaaaaatgtcagtaacatttctgtgagtaacaagcaccgcggttctgcaattgaataggggatcttgaaaatgaacacatggcttaattatccattgtccaaagaacagagtacacaaaataatttcttgtgcataaagggaagcaagcaacttctgccattctcattacatatcagaaacccaggacaaaaaggtcctagcagcatactagatgtaaaaaggcaattcccttttttccttaagtcgtttaatttgcagactgatgacctttctatgttagtatttcctttcacataagagtatatcggtatgtcaccgggaaaacatctttggttccttgcaacgtgtcagaatacccagcactatcattttctaacataacaaagctggtagcaaatcaaatttaataaaacacctcactgcgctatatgcattagcggctagcacacttgggatttgggactactgcaatttaagaaactactgcatgaaaataaataatttgttggatatcatgagagagaattgtaacttctattagtaatgagtgaacagccataatccttaaatacagagcaccacaaaagcaattgggaatgacagaatatcacctcagttgaagcgttagaaacttttcaagctatggctattttttaggaaagacttcatgaaccaccaggaccattctgatggtgcctaaaactagactctatccaaattagtttggttcacagtcagggttactgggtacttgggtgatagtcacaaccacaaggagccccaagaacataccctagttctccgcaaggaattgatcaaaagccacaaccacaagctggattaactccagttatgctatggatttgggaccctatcaacaacagaaccggctatgagatttgaggccaaacaatccttggatataagataccgcaattgctctgagcacttgatatactttaaaataaaattgctatgatactagatacctaagtaacacaactaggattcgaataccgatctccacctgaactgcaactcccaggacatctgttaaaccccaaaattagggcacaaccttactcttagctagaaaaaccagtcgtgatgcctaggaattcctgcagactgaagaatattgctaaaacaactgaacaaaataaataaaatgcatacataataagctaatggttggaaggaacagggcaaaaacttggcacaaatcagcaaaatttcgcccaaagctcagcctttttcacgaatcttcgagtagatctaaaaaggacaaaaaattaatcgcgagcgtagcaacaaacagatgggctgatgggatcaaaagaagggggctgctaattaatctccgtgttagggttccataggtcgggtactcgagtgtgcggctcatctctaaatctccctaatacattatgggtttattattacctctagcatggcctgcagccgcgggttgctgagcgctgaagcatccatggctcctctcctccttctcttccgctcttcttcttcttcttctctctcctctgcgattttctctctccttctctctctctagtggtggtagacttgtgcttgcctcgtcggcggcttgcagaggaggaagaaaggagagaagaggccgtgggctcttttcgttaatgggctatgggcttttttagaaatcagatcgataaaaatgggctatggacttttttttacattctggcccaataccgtttgcgaaagcggccctcaaccgcatccaattgcctttccccgtgtcactgtcaaccggagccaacctaagcaaagtgaagagattaaagatttttattagggaataataccagaaattaaagatctatagaagagtgagaaatcaagagtagagtagtggaactggaatgaacacttgtgcattatattctccaggacagatgtgacgattactgtcgcatatatatcttgcaagcaatgcaacttcttcttcaattcgtggatatcaatcatatctcgagtgcaaacggacacgcaagagagcatcagatatatatatatatatatatatatatatatatatatatatatatatatatatcgagaaatcataaatgagctgctagtattattatatatgcaacattcaaactcaagctagatatatctgtcgatcgatccatggatgaatcaatatgtttgtgttgcagtgcacgcatgcgcatgcatttcagtgatttctgtcgatcagaatcagatcagatcagcggtaaatgagtcacatcgctatcgcgcatgtatgatcgatcgatgttccttcacgtttagacccaagcaaggcaacgccattatattccatcaatcattacgcatgaacgttattttcatgcatgcccggtcaatatagttcctcaatttgacggcacataatctgggaaatttgtttcacttgctgtcctgcatggctacatcttactaggttcttaactaatcaccacttttctttaatcaatttcattctagccatgaatgatcagaattgcaacgttgtcgatgagggactacctacgaagtggatgactaattagaggtcctaatttttttcatatcttaatttatgccaatttgttttaatatgtttaaagatctttcactctctttttttcttttttgaaaaaaaagtactcttactttttttattaatgactagaatgagtttgtttcttcagctttggtaagtagtactactaattatggccaccttaaagaggcgataacgatacgaacatatgtttcaggcattacaaattccatttttccacataacaaaaaaaaataaatcactacatcacaccacaattctttttctaaaatctatttcttttaaaaaaaaattcttccgacttagttagagtaccaccatcaatttattcttttgtttcttggcatttttctaaatatcaatttatgattcgtatcggggactcagattattaggtacggccccacggaattgtaaaacaaaacacactactcctctgtttcatattactcatcattctagcacttttttttaaaagacaaaacatgaaggtatggtaaattactgaactatcctattaataacagcaatatttgtacttcatattggagttaaatgggtattttatacaagcacaatagttgagggggtacaatgaacttaataaaatgtctaaatataacagtgttgtaccttttttttccttctttctgtatgcaagaacatgcgctgttacctagtactatgtagaatgaacatgacaatcttcactgccacactgctcaccaaatcctaggagagagctacttgtaattttagtcttgttgaaatgatcaattgattagaggctatgtgcattatctcatactttggtagtactaatacaaactttgtttttgcgaggaagtactaatacaaactttgacggaggcgcaactgcctcatcccttgtgatagcaaggaaccatgaagaaccgatcctcttttgtattggtgtgctctgtgtatgatttcgtatgtgatcgatagctgaaatcgctccctaccgtttccattgataactctagtcgttaacgttattgccaaaaaccgatgaaagtcagataaatttggttagaaagtttcatttttttaatctttggccaattatggttaaatacagccagctcaataggaaccatgacatatatcgtatttgaatccaggctctgctctgttgagatatttttgttttcttttggacaccaatcatgtactctctacatccccattttaagtgcagccatagttttccgcgtccaactttgacgattcgtcttatttgaaaatttttaaaagaattttaaaaatataagtcacgagtaaaatactatttatattttatcatctcataataaccaaaacactaattataaattttttttaaataaaacagatgatcaaagttaggcgcggtaatggatggttgcacttaaatgaaaaagagagggagtagattagatagagtcaggcagtgtgggccacggagatgtctgagagccatagacagatgatccatttcattcgataattaaatacagtactgtagctagggataatcaatccctcgtgtctgtcggtgggccccgcgcacccaaccgccgcgccgaaccccgccgcagcaagcaactgctacccgtgccgccgcccgtctccggcgtccgatcaccatcaggcggccgcgcgacctcctctgcttgcgttgcgtgcctccccacgaggtcgaggtacacttcccttcaaagccactgtctctctctcctcctctcctctacttaacaccaaagcctcgcgctctgtccgtcctgctcctaatcctcgcggcagcttgcttggcgctcgcctccctcggccgcacttctttcttcctgattcctgacgtcttggatggtgcgctttattatggtgagaaattttgacgaaaatcgtttactgctattcctgcttgtcttctttggttatgcggacgacctgttcgacgaaatgactgatacaagggaattgattggtctttgtgttgtttagcctcttccgctctcctaatccttaacaagttgactgtttcattttgttgtctggtgtcaacgcttttatgattttctaaaaattgtagttgagcaaatgatgcaagtgttgttatattgtagacatggttttggacatatcactgtcttctctatgtttggcctttcgtttcttctaatggtatcgctgttttgatgccatctagtaatagcatctgcttgtccgatgcctatctttcttagttgacttctcatgcatactgtatcatcttctggccttatttgttcaacagacacacgacctgcactagtgtttacagctccaagtatgggttccagagaacccttcctgagtgccatcttcttcttcttcttcttgcttttgttctgcctcggctgcaagtgtatagcttcagagttacacttacacacgacccagactgcggtcctcaaggttgatgcctcactgcaacatgctcgacagatccccgacacgctatttggaatattttttgaggtaaaccgtaagatacatatagtaattttgttttgcacaattgcattatatcactttgtcctttcctctggcactttgttagcatgtctagaataagtcaggtagactacatgtttcactatgtcctgatggcaatttcttggctaatattgtaggaaatcaaccatgcaggagctggtggaatatgggctgaacttgttagtaacagaggtacttcaattattctttaatgcaagatatgcacttattttgttccatcgtccagataaaacataatttgcttctggatgaacatgaataacttattctgcaatccgatggaacacaaacacatggctttaaaaaaatccttttgttatttttttttgctgggccggcaaaaaccggcagagttgtatattaagaagaaaagaaagttttacaagtacaccctaagccaggggtggcttaggctacagtgaatcgtctcagcgatttagcctacagacaaacttaggctacagtgaatcgtctcagcgatttagccagcatcgatcgcgctcaacaggccggcggccttccatgtttcccactcatcagcgatggtagcacagaggtgtaccgccgatgtggtttttccatcaaacgcgtgcatttcgttccttccaaactaaccacgttaccaggataaccccggcgtcgaaggtcttccgatccgtcttatgaaccgatttgtgcgcctcgcaccaccagcacagtaggaaatccttttgttattgtctttactcgaaaattctccctactatcttattaactaaattatgtttttcccatgaacttaaaaaaagagtttaattttttttagcataactgtaattctgtaaacttggaacacaaaactttgattaggagcataaactggatgggatgcaaaataatatgccctttcatggaagctatattgacatgtagggcttagtataaccagcttatgagttttatgcacaggttttgaagctggaggccctcataccccatcaaacattgatccatggtccataattggagatgactcttccatatttgtggcgactgatcgaacgtcatgtttcagtcggaatactgttgctctaaggatggaggttctctgtgacaattgcccagctggtggtgttggcatttataacccaggattctggggcatggtatgggtttatgtattgttgttctttagtttgttttcctcatagtactgctaccattttgctgtattttctcatgaaattacctagtaaatcatggacctccacacgttctgtttcaaattttcatgtagcgatatttctttcgtgcacttgtgttgggcaaaatatggtaaacatttgctttcctaacttttgcaatgcttcctttccaatgctttgatcgcccttaattgtcatatcaacctgcagaacatagaagatggaaagacctacaatttagtgatgtatgttaaatcaccagaaactgtggagttgacagtttccttgacaagttctgatgggtcgcaaaatctggcttcaagtaccataccgtcagtgcctttgctctcaatactgggacaggagaacaaggatgtctgcccattcccattagttgaaagaattatattgttgcagggtttctggtgcgtcgaattggacaaaactggagcagaagttggttgctaaaggaacaaatagaacctcaaggcttcaaataacaactaccaagaagggagttgtatggtttgatcaagtctctctcatgtctgcagacacttacaaggtacattatattttgttatcaaacttcgttactggaaaaggaaaacgatatcatggactttttcatgctatctctatatagtgtatgataccacttaaatcttcatgggctttttctactgcttccaacatttcttttacacattcagggacatggttttcgcacagaactaatatctatgatgttggacttaaaaccacgattcttgagattccctggtatgagctatattttccaattgaaaatcaagttcttgatatctgcacatatatgtcagacgtgtctgggataattgacttgatttccattcaaacaattgtaggaggttgcttcgtggagggtgaatggttaagaaacgcattcaggtggagggaatctattggtccatgggaagagaggcctggacactttggggatgtttggcattactggactgatgatggccttggatattatgagtttctccaggtaccagtttagttgacattatttccgcccttcattttcttatcactccctaatcatatattgcctttgaattctatttttttttctaatgaaaaatttgaactctacatcaaagctttctgaggacctgggcgctgccccaatctgggtgtttaacaatggtaataattgccatattttttatatctttatcgccacagctgacctccttaattgctactaaactcttttatatatcaggaatcagccataatgatgaagttgatactgctgcaattgctccttttgtaaaagtatgttctgaactccctggtttattttctgttaagtcagatgcaccttgattcgctaaattgtttccactttaaaatttacctgcaacatcctagctatgactgggcattactatggatatggaatgtgagaaaattgatactatcttcactaccatcgtagtagtgttccatcttttatctttgtatatctaaatattaaggatcttcgttgtgcagatcctaagaatgcaactgcatatgatgtgtctcattgactgatgctaaaactcttgccttgttttctcatgattgaaatagagctgattttctgtgtaaaataaaggatggtttgggcttgttcttttacactattagttcagagagttctttaaaaaattttcacaaagttcacaagcagtgatgatgtttaacctgaatttgcattctgatctacttttcctgaattgagacggtaacgtacctatccaagaaaataccaaatatcttttccttaattgagactatggtagttatcataacaccacttttgttttgggaacgtctcctgtctctctacaggacgtattggacagtctagaatttgcaagggggagtgcagattcgacatggggttctgttagagctgcaatggggcaccctgaaccattccctgtcaaatacgttgcaattggaaatgaagattgtgggaaaaaattttaccgcggtatattcctcatccaatttcatattttatccacttgaccatataactgcataagttgaagaggcttgtctggataattaagaaggtgtatgatcgaggaaaaggatatgcacatgaaccatgctaattatgtaaaatatattttatggatttagtcactcaactcactctctatccactttcaatactgggctttgattttgtgattggacgtgtatttcaaataatattagctcaataaaataaatctctacatgaaccagagggaaatatagtccacaacttctttatgatgctgtttctgtttcctgagaagtcgttcattaatttagtcacataaaatctccatagaaaaaccttacaaggtgacatttgtttcttacactatttcaattagtatataatattaatttttttatgtcatatgttctttttcctcttttatactcacagtaatatacgttgttattttttatcgttgcaaataaagtaggattagtaatacataaaaacaagtcctggaagcaaaaactactaaaatgtggttattttcattattttttaaaaaaattgggatgcaatttttttatgtttgatcataatccccaatggtactgcacaagttttacttgaactgtgtggagagcaactgttgagttctccttttaggtatatgcatgatgttctcttatccgttatacaggtaattacctcaagttttataatgctataagggaggcctatccggacattcaaatgatttcaaattgtgatgcttcatcaagaccacttgaccatcctgctgatttatatgacttccatgtaaactactcatcctctggagttctgttatgcagtacttctcattctgtcaccaatgtcaaggtttttcccatttattaaattctaataattcctttttctctaggtctatactgattctaagactttgttttcgatgaagagtgcatttgatagatcatctcgtaatgggcccaaggtatgttgtatacctggactttcattgctgtgtgaaccttttcatttatggagatgcttgtaaaacagcactgtgaatctcccatctttcatttatattttacattaataatccaggacttctcttggtatattcgtaggatgaccttggccatctatgttttaacaacaattcagtaacatccacagttcatctatgtcacgtgtgatgattttttccatgttttggataattttggaatctcattgcttctcttgcttattcacttctatctttacagatgtgctgcctatttatctcttctcatccctattggccattaaatatatttcttcatatatgttttggttgcaggcttttgtcagtgaatatgctgtttggagaagtgatgcaggtagaggaagtctacttgcttcattggcagaagctgctttccttactggactggagaagaataggttatctttccttgaaacaatcttttctttccgggtcgtgtgacagatcacatttgagctttcctgcgtagggctttattaagatctactaacaaatgcaatgagatatttactgtaacttcttgttggttctttgcagtgatgttgttcagatggcaagttatgcaccactgttcgtgaacaacaatgatcaaacgttagttttgatggctccatggtttctttatttgtgtttttgtttatttaacaagtactgtaataatgcttcaatcaaacaatcaggtggaacccagacgccattgtatttaactcctggcaacaatacggaactcctagttactggatgcagactcttttccgtgaatctagcggtgctatgtttcatccaattacaatcacttccagctactctggttctctggcagcatctgcaattacttggcaggattctgaaaatagcttcttaagagtaaaggcaagaaattttgttataaacctactctacatctgtaggagaattgcgtacctcatggattgatcttgaaatctcctgtgcagattataaactttgggtctgatccagtgagcctcacgatctctgcaactgggcttcaggcccgtgttaacgcactgggatcaactgccactgttatcacatccagcaatgtgatggatgagaactcttttagtaacccgaataaggtaagcaaacatttctgatttcttactggatgtaatgcacatatcaatgtctagtagagtttgtggttttggtcatctgaagccaaagctttgctcatgataaccaatgcaggttgttcctgtcaaaagccagctttccaatgcagcagagcagatgcaagtcacgcttgctcctcactctttctcctcattcgatcttgcgcttgcccagtccaaactcgtggcagagatgtgaagcaggaacacaaggttagcgacagaaacacaagaaatacacgagatgtgatatgcgaataccagaatgcagtccatatatgtgcatgtatcttgaagcactactgtatagtgtaatacacaggaaatgatgaataaaattcactccaggcttactttcttcttttcgtttcgtttcttttcttttttttttcttttttttgctttctccatatttgtatcggatgagactagatggcgcattgccaccgtgttgctttgttccaaggataacaaatatgggctctttagcctgggaaagagagaataatttggttcaaggataacaaatttgtagagaatatctgaatttgatttaaggatttgtgaactgaagttggcatttaaacttgagaaaaattaaggctcagattatgggctaagaatttgaatttaggattgagcagatccaaatggagtccaatccctattaggatggatgttgattatttgtggatatgtttccctgtaaatctggaatgttccccattaggtatattgataaaatgatgatgagaagaaaaggttggaagagggaaacttgtgtcgtgtgcatagatgagaactgtgtcagtaaccccggataaggtaagcaactgttttctacttttatctctggatgtaatgcacaagtcaatgtgtggtagaataggtggttttggccatctcaagccatagcttcgatgcaggagcagatgcaagtgtcacttggtcctcattcgatcttggtctgggccggtccaaagtggtggcagagatgtgcagctgcaacgcgcacggggttagcaatagaaatgcttgtgcttattcgtcttcctcgatatatttctgtcgaatgaatcaagatgagcagataaagaagaggaaaatggaagaaaatatgcatgggctggctgtacatttttggctggaacccatgtgaacttgtgaagtgaactagtaacttgttggcaattttagcaagttgactgactctgtctaactaaagcattttccagtagtagatcgtgcaacctcgaataatcattttggatcgtttcgtgtaactcaagtagtgtagttcatgttacactaactgaagcctccatctggcagaggaatttctgtgaaatgaatcaagatgagcagataaagaagaggaaaaaaggaagaaaacatgggctatggctgtacatttttactggaacccatgtgaatgaactactacttgttggcaattttagcgacttactgtatctaactagagcaatttccagcagtagatatcgagcaacctcgaataatcaggttggatcgtgtcgtctaatacactactacaccagctagcagcctagcaagtagtgtagttcatatcaatatatcatactaactcaagcctccctctagcaagtagcaacacaatccaatccattgtcatcgcagtcgcagaatgatgagagtgtggccgccggcgacgacgagcatgctgtccaggcaagccattgtcgtcgtcgtcgtcttcctcgttctgttcttcgtcggcggcggcagcagcagatgcgaagccgagacgttggagacggcgtctctccatgtggattactctgtcgctcgaagaatgccggacactttgttcggcctcttcttcgaggtgagactagctacgtctcttttctttcttttccatttcttctcctgtggatgcttgcttttcttttctttatcaaaatctgcattattattatttgtgcaggagattaaccacgctggaagtggtggcctttgggctgaactcgtcagtaacagaggtaacaccacattatagtactactccctcctttcctaaatatttgacgccgttaatttttttaaatatgtttgactgttcgtcttattcaaaaacttttgtaaaatgtataaaactagacgtatacataaaagtatatttaacaataaatcaaatgataggaaaagaattaacaattacttaaattttttgaataagacgaacggtcaaacatttttaaaaaagtcaacggcgtcaaacattttgggatggaggtagtattttatttggcttccgagctgaaattgaccattaaattaaagaagagagcagtggagtggtatcagccgttggatgtccattcaacggctgattggtcttcaacctccagttcattgacacgatttgtctctctttttatcttctctctatttttttttctctttgagaactcttctctggtgaagttgaacattaaatcaagagttaatttcactttggactatatttttttaaaaaaattattttggatcaccctttgtttccaattttttcactttggactaagtaactttaccttttgttgtataatagatactccaatccacatcttcagcacttcaatgactctgagcaaatcgttaacgatatgctggcgaattttcatacctatacgcatgccatatctttgccaaaggaaacaatagacatggctagcaaatagagttagggtggttcattatgcaacaaaggtaaaagtacctattcaaagtaaagagattgggtatatggtgttgcaaattgaaattttggcgataaaacatggcactaagtttaattcactcttaaattaaagaagaagagagcagtggagtgctgtcagccgttggatggccatccaacggttgatggatcgtcttcaacctccagctcatggctactctctctctctctctctctcctcttgaacgattccctcctgcctcctccctccccgcacctgcacctgcaccatctccggcgtctctcgcggccggatccgccgcctcctcacccaccgcccaaggcctcccctccctgtatacgaagccccgatgaactgctcctccctccacaacccctctataccccgccagatccactccacggccccaccccaacccaatatcctaatccattcgccctctctcgccggggaagaaagccaaaaggaggaggaggaggctcatcggcgcagggatgctcgggattcaccggccagctcgacctcgttttggtgggggtggtgtgtgtgagagtgagtaacgaaggcttgaggttgaagaagcaacatggatggtttggatttgtgatctactgccaagaatatttggggagaaatcaatcacctcatgtatggcaaatgcaaggatttttgaggagaaatcaaccggctgatgtatagcaatgttgaataagaaaacattttcccccctcaataaataaataaataataatatttggagtttaactttaactgattttttgtctaatttcttgctttaggttttgaagctggagccaacacatcaaacattgacccatggtccatcattggagatgaatcctctgttcacgtgacaactgatcgctcatcctgtttcagtcaaaatcctgttgctgtaaggatagaggttgtctgtgacgattgtccagccggtggtgttggaatttacaatccaggattttggggcatggtatgagttctatccatttttataagtgcattcctatatgaataatatgcaaaatagagcttgtaattgaaagtagtatcctttttttttacgacagtttacaataaacagtgctgccacagaaagaaactatagcaaagttatttattctgttcgaaatggtgaagaaaacaaataattaagctaacctattttttgtttgatttcaatttgcatttatcttttccttgcataatgctggttttttatcagattgttgtgcattgctcttggaaaagtgtaatctatagcttttcttcgaaccgttttcattttaccttctcatattttaatgggattttaccttctggttttgtgacgaatatgatcatttcaattttcagaatgtagaagaaggaaaggcatataatctggtcatgcatatcagatcattagaatcggtggagttgacagcttcactcacatgctcaaatggatcgcaaaatcttgcatcaaattctgttcggtatatattttttccgtaacactgagataaaaaaggtttttcaatctctctcgctcgttcgctcgctaaccgaaaggattgtacatcaaatttctgcagagaaactaatttgtcaacttggacaaagatagagctacagttactagctcaagggacatgcagaacttcaagacttgaactaacaactaggaaaaggggagtaatatggcttgatcaggtgtcacttatgccttcagaaacatacaaggtgcactgtcttttacttttttattgctactgtcatcatagcttgatctggaatccggtatcatcttgtgaagaatggagaatagaattcatgcactgaccccaaagattttagccactacaccatgccaggttcaatggacaccctgttcaaatcatgtctgctatttgatattattcaaacttatttaaaaaggtcatcataaaaattatcaatttattcacattgctatctgacaagaaaaaaaagtaaattaacttatctgtaatcagtaatcccgtagagatggcagatcgagttattgttccttaatctacatttgcttactatgagtccataggagttgttgatcgacatttttcttctacatatgcagggccatggttttcgcaaggaactcatgtacatgcttttggacttaaaaccacggtttctacggtttcctggtatttcgaatgttttccaactggcaatcaatttcggttgccctgtaatttaatcgctcgcattacatttggcagggggttgctttgtcgaaggcaattggttaaaaaatgcattcaggtggaaggaaactattggtccatgggaagagagacctggacactatggagatgtctggcactactggacggatgatggccttgggtattatgagttactcgaggtatgggttgattaatgtgaaatgggttttttcttttggtctcggcatatctcaccatttgtttacttcaaaatgttcatgaaagcttgctgaagacttgggtgctaaccctgtatgggtgctcaacattggtaaatatcgtgtctatttgtcttgttcaatgtatttttaatctttgcacaaaccaacgaactgctcagggttttttatcttgtaattagggatgagtcaccatgatgcagttaatggaactatgctcgcaccttttataaaggtatgttttcgatgccctacattttttgaagtatggatgagatgaagatggacttctcatgatgtaacagaaaacagttgtaacatgtgaatattaacataaggccttgcatttattgtgatcccatgtttcttatttcgagatgctttgattttcttgctacaggatgcaactgacagtcttgagtttgcaaaggggagtgacaaatcaacatggggctctgttagagccacgatggggcaccctgaaccattcccactgaagtatgttgcactagggaatgaagattgtgctccattcaagctgatataccgaggtaaattttgcataataaacaaatagtattgtccttcgtgttaatgctgcgatgattggctaaattcatcattctgttttttatcgatctgcaagggtaatagcactattttatttaacttcaccctttttagtactatctgattgcataatggagatattttggagaaataatagatgaaaaaattggctgcatgccttgtggcagaggccagggatgtaaaatatttccattataaaaaaaataatagatgaaaagaaaaacaagaagttaatttaccagtctgctgttatgtttcgaaacagactttaccagtttctagaaggttcattagttttacatttgattgaggccaaattggctacgacgtataatgctgtttcagtacatttaaatgggctactactatcataaatatcctaattttcccttgatatcatataaccatgtaattctgttgaacagaaaattatcccaagttctacaacgccataaaagaggcttatcctgacatccaaataatttcaaactgtgatggctcgtctgggccacttgatcatcctgccgatctctatgactaccatgtaaacaactcactgagactaatttatttctatcattctccctatttttaaattctgtcttgctggtttttttcagacttggttatgtgatcattttctccatagatttctgagaatgttacatttattctgtagatatatgaaaatgcatccactgtgtttttcaagaagaatgaatttgataggacatcacgtaatggtccaaaggtaatgaatttgatataaagtggcttcttttgggaaattaagttcttttttttattttttttagagaagggtattttttacccggcctctacatccaaccggatatatgcggccattgaaatagggaacttagccccacaaacaacccaatctgaaattcgctccataggagatttgaactcaggaccttgggtactaggagattcgctccataggaaattaagttcttagattagatcagtcttacaaaggcagcttctctcatgcgccattatcctcgacattttcttgaatgaaatatgcttctagttatttcgaaaaaaaagtgtttctaggtattagtttcttccatcttcttccatgactgagactgaatctataagatcagaatatatgataacttgaataatatcccaaactagagcaatctactagtacttcataacttgaactccagatcgcttctagagcaatctgctgtggtattgattgacaacaagcatagttagtaattatgacaacaagcatgttcttcttcttctcttccttttcccatgagaagaagcctaactatcgaatagcaaaacgtaagacgctgttcttccttttcccatgtttgttggatggtttggaaggaaagaaatgcgcgtgtgtttcagaaccagcggcgctcagccggtttcctgtttggttcaatcaaagaggaagtggcgatttggaaggaagctggggttttcagaaatataggagagtagtcccttagtgtaatcttttgcttttgggaggttgctccggtgacaacttccattacttcgacagcttcttgttgaagttataactttgtatatttgtatatattcttcaatcttaagtaaatttggttggcctttcttggccggcccggcaatttattcatctcattaccctttgatgttggatagacagaatataagtgagcaggaaccactgactatgcaattgtttcactgcaggtatttgtaagtgagtatgctgttaatggtgaggatgctggcaatggaagccttcttgcatcattggcagaagctgctttcctaattggtttagagaaaaataggtgatccctctggggatactctcttaattctttatcttgggttcagagtaaatataaaatcatgcgcagagttgtctacttgtatccagaccatgcatgaatataagagatcgttcaatgggattcctggataaattgttgatttttgtttgacaactactacctcatctttgtacttctccacaaggaaaatattttgagtaaatgtataatttgtaaaaatttacattgagcaacagtaattccttattgcaagttattgaattggctctcatcatgcatgcttctttgcagtgatgtcgttcagatggcatgttatgcaccactcttcgtgaatgacaacgatcgcgtgttagtatacatggtcttatactttctttgttcaaggattctagcatctgtttcctctctgactattgctaatgtataaatgtgataaccagctggaacccagatgcgattgtcttcaactcctggcaacagtatggaactcctagttattggatgcagacatatttccgtgaatcaagcggtgctatgattcatccaattatgatcagttccagctactctgatttattggctgcctctgcaatcacctggcaagacgctgagaatacctttctgagagtgaaggtaaaccatccattccagtttcttctaaacttatatgcatttggttcaattcattagacatgcgccttattgtttggaatgatttagttacaacgatacaaaattgattcagccaatgcatacttgcataacatgcatctgtctttatatgtattactgctggagtaatatgtttggatcttagaacatcctgatcttcaaatgatcttccacagatagtaaacttcgggccaaatgctgtgaacctcacaatatcttcaagtggacttcaagctggtgtagatacggcaaaatcaactgtgactgttctcacatccagcaacttgctggatgaaaattcatttagtgaaccaaacaaggtatgaccaattttgctttgatcagtaattattggtttcagactttcattactatgcacagaatttagaagagggtaacttctccattacaaaaatctggtctgttacaattagacatgcaggtggtatgcctcgcatttgtcaagtagtgcgtgctacataaacacctttgtagatatatccctactctgccttttattttgtcatgtctggattatttccttgtctttctaaagaacacagagaatctattgtaacacacgatatctcagggtacgcaagttggtctaacatacaagtttcttgtgaacacgcattgcaggtcgtgccagttgccagcgagttgccgaatgcagcagaacagatgcaagtcttacattttccttactcaatttgttcgtttgatcttgctctggtttagccgtttaattagcacaagtttatcaggctaacatgttgggacgctgtttctgtccttaatgacatcccaggatttcatagtgatcaaaagctaattattccactgtatcagagcccattaggccaaggatggttttaattaaagcttagtttgaacaactcgctttatttataatatatccctttattgcttctaagaaatcatcgagttgtttgtttggatattagtaatgatatgggaattattaagttgaccagataaaaatgtagaatgcatcaaaaaggaacttggtatcaatgagatcacgtctcctttttgtttgatagccatggatatgatgtttctataatatggggatggtgatgagtctctcttttgttttcttgcggtaatgcagctctgttaatttctctattacggtttggcaagatggccggtgtctccggatgtgattttttttgagtaaatttcactttggacctgttttattgaccaaagtttcaccatgaactatgtctaactcgaccttttcagttaacaccaggtatgattaccttcttttgcaatttggaccgggttttaagacttcgggccaccacgctggcttgatctgagcctagtgaactcagttcagggaagagaaattatcgacggaaactagcgcatgggagaggaagatagtgccgtggaggcgcggaggcggattttctcaacgcctcggtctccaccctcaccactggtggctcctgcgcctgcggagcggcacgatgcggcggcggcgtggcacgacgcggcggccgtgtgcacgtctctggctctggcgaggcatggcgcaacggccgcgcgtgctcttcttcggctccggcgcggcagggcggcggcatgcatgctcttctcctgctcgaccgcggtgccggcaacgggggtgcacgcactgctccttcagctcacggcagaatggaggccaaaagcctcaccaagttagagtaggatttattagctctgtgtactgtagataagtaccactaaagagaaggcactgggaagggaaattatcagaaatgccatgttgtgccgataattcattgtacctcaccatcaggtacatgtacatatggaacttggaacctctctgcttgtttttagtggcaaaatggacagctccatcttacttgcacactcattcagaaacaaacattgattcattccgccagcactacactggagctgaagagcgcgccgccatgccaattcggagccagaaaagagcacgccgccgccgcgccatgccgctccggagacacggccgtgagccaccggttgcgagggtggagatcgaggcattgagcaagtccacctccacgacactatcttcctcctttcccgtgcgctagtctccctcgataactctctgccctgaactgagttcaccagctcaagccaacgtgctggcccaaaagtattggtacccggtccaaactatataagaaggtaatcatacctggtgctaactgaaaaagtagagttagacttggttcatggtaaaactttggccaaaaaatcaggcccaaagtgaaatttactctttttttttttgataaaatgtaacttccattacccagctctcgggagaaagccaaacaggaataaacagggtgttatacaaagctcataaactaaccaagagcattcatctccggtaacggacacgctacagcgctaatatgttgttgcctcccatgcggcgcagtccacaccaaaacgaccagacctctaaccccacaaaagaaagagtttagacctaatagggacggtaacaacttgctaggtaatttggctctcaagaaatgatgtggtttttataggaaaactgtttcttctcctttgcaggttattttcttaattacacattggctctacattggctctgatcatgggttattctcgagaagcccaatttgtagggttttgtcacttcgacttgtctatatttaaagcaagtgtcaatgagttttatacctcggtatataggtgacgacctattatttgggttgtagccttgtagggtcttgatcttgcaagctgtttttttctcttcttttgagtgtgttggctgtgtgcactatcgtagtgcagaggctgggagtgttatcaaaacttttgagtgaaatcaataaagcttccattatcttaaaaagaaagaacccaacagactgacacatactaatcccagcaaaaacttttgagtgagatcaataaagcttccattatcttaaaaagaaagaacccaacagattgacacataataatcccagcagaaaggaaactacgatatactccctccatcccataaaaagaggattcctagcatcccaaggcaaatttagtgagaagtaaaatgactaaaatgaccctcatcaatagaaaaggtagtactggtgataggtaggtaaagattatttaagagataaaacttctcgttttatgtgttgaagataggtaggatggtagaagttggttttttgtgggataaaatttaaactctagaagttaagttttttttttgggatggagagagtatcaggcaaggtctccggttcctgcagcttgtccatcagctccttatgccacttgtctgggcaatctccttccatttgtagcagtttccatctttgcacccacgccagggctttgtagactacctgcaaaggtgatttagcaattttattttcaaaaacccactcatttctatttaaccaaatcccccaacagaaccaagcaacgaacacaattgtgaggtttgtttttagtttcttctttagcatcctcaagccatcctcaaaatcatttggtatttctgacagacccagagtttctctcaacacacaccatctaaatttggcaacagagaaattaacgggatatcgattctacagatccgatatctgatatcggaatcattgattggagatgatcgatcaggtcattgaatgccatgcaaaatgctgtacttatgtaattgacacgcaagggcatccagaaaaccatctcattcaacatcatcttacagagaaggtccaagatcaaatccacaaccacaatggcgtcatcctccaatgttaacaatggcgtcagtgttctcttcctcttcgctgttctcctaattgctgcgtctcagctcgccgccggcaccaactcgttcctgtacggtgcatgcaagaccatcgccggcggcagcgagctcctcagcgtcacgttctgcatcgacgcgctcagctccgacaaccggagcagcaacatcagcagctacaaggaattcgcggtgatcgccgtcgacctcctcacggccaacgcgacgagcaccaagtctgagatagacggcaagctccggaacggcagcggcgacgccgctgcgacgcggtgcctctagtcatgccagtcggtgtacggcggcatactgtaatctcaggccgccgtcggcgcgacggtgaaggcaggcatgttccaggaggcgatctcatcgctggagaaatcggcgagcgcggtgaaggaatgccaggacgggttcggcaagagcaatgtgacgtcgccgctctccgcggagaacgacgatgccttccagcttgccgagctcatcgttttgctcatccgtgacgaacagatcaacaatgtttcgccttaattgctttttttataagggcagtcccaacccataacactggatatggtttccatagaaactagtactagacactactcttccaatgcaaacaccactattccatacttcaatttaatgctactttatctcacatgatgtcttagatgttgtgtagaaaccatgtctcgtgtaagacatggtttccttctctttcctcatttattcacttgccacatcattttttttcctaggtgacaacttatttaatgctatggacaccatcctagtcattgggttgggaatgccctaatgcatgttttccccgggttctcaataatatagggggctgtttacttcccaaaacaaaaacttttcacccaccacatcaaatgtttggacatgtgtatggagtattaaatgtggaaaagaaaaactaattacacagtttgtgtgcaaattacgagacgaatattttaagcctaattgcgccatgatttgacaatgtggtgctacagtaaatatttgctaatgtcggcttaattaggcttaataaattcgtctcgcagtttcctggcggaatctgtaatttgttttgtcaatacttcaaatgtgtgtccgtatatgtgatatgacaaccaaacctaaaaatttttcccaactaaacaaggcctaagtgatgataaaggtaatgatactacctgcgtttctttttcagatagagcattttatggcactgattctttccagtaataaacagcagaaaagaaatgcacacaaattatttttccaaatgtaacatatgcatccaaatatcaagatatgcatgtaaacgatcttgattaaaagcttcatccattttaattttaattgtttgatattaggtcacgttttttttttatcaaaagcttccatagtcaatgttcaatgaatttggtggaagtattaattcaatggtggaaatttcgtattcatttatttgatgtacaatacttattttgcccttgtttttagaccctatttttagggttttgttttccctccttttttaaaaaaacgaaaccaagttttgctctattttagatgaacaagttaacgatgttaaattttggcaaaaagacattcataccttattattgcccatattttatacatgcaacttgcaattttgaaaaactacaatttcaacaaaaaaaatgtttcaaaacttacattcttttgccacatttgataattttgggcacaattttacgctactaaaaatttgggcacaattttttttacacagttatgaccacctttacgcaccgagccctcaccgcctccctgtaagttcaagtgccttaatttggtttcggtgattaatgacaaatctaattatatgagactaacgtttttatgagtctttctttgactagtattatttggatataaaagtaaaaatgatgggaggtatgtattaaacttcacatattctaacttggtctctcttgtggatccaaaatatagtgtgagctccctcattgatcttgattgattatgtgcatatgcattccttcatatccatatgtatgcacatcttgagggggagcttattctatattttgttcattataagatctctaccttgatttgaaattatctttcatctcatctctttgtattgtttatatcggattattatctatcacagaagagagaaaagattgaaagatcttggattaaacaatttgtgtaattgttactttggtgatagatgataaaccgatgtttatgggattaacctctcttttacataagttttcaacaaggttatttcccgataatgagatgtggtagatatgcattctttggtgatggaccttaatcatgacaagaatgaaattcatggagataaagcgatatgtatcacttcttatctcctactttttgataggttcatatatatgatttccatgttattgttatataagtgtgagactaatgtttacttgagtcttatcttatttagtctcctttacattgagaacatggagatcatgaagatatgtgtttttttgtttatcttcatcattactacatatgccttctctatgtgtataggataaacccccattggttcttctttacttatgcatacacttgtctctcttgtatatttctttgtatgcatatacttagggggagcaaatcctatacatttattgtgcatgttttagatccatgttgttcacctattatttatatcggatctttgcacttgagcttgcatacgagtatatgacacttgtgatgttaatgaatactcaacaaacatatccatatctttcatatgcaaccggttggtcatcaagtgaaggatgacaaccgatttgttaagactaatgttctcctttgagatgtgaaaaggaataggtcccactatgatgaggctaatggatgacaccatgggttaatggtcaccaagccaaggacatcgccatgttggcaagaatgaaatcaagcttgtgatgagaagaaagtcttgacaaatgatggtaaataccttggtataaacatggttgaatcaaatggtcacaagtgttgatctcgactcaagcttgaccccaagatggatggcgcaaggcaaaggtataatgtagctaagaatgttttcttagtcttttcccggtcttagtgtttggtgtagaccggatttgctagataggcgccgtactatcaagaggggtctatgaagcgagcttgtggatgatcttgtgccatattagttcatatgcatgtaggtgtatttggtgggcttgtctagccaagtgtggtgagttttttcaagtcctaaacaaagagagatgtgggcaaatcctataggtttgggcagcctcatgtggttatgtccggtggagtatcctttagagtgtgagccctttctccctgagaaaagttgtgtttcttggatggattgttcatgggttggatagccctttgaataagctttccataaagtccaagaacgccaaattccgagacccgagtcaagagatatcgtcgttttactaacgttcggttgagctgaaaagtgacatgcgatatgaccgtgggccttaggccggtctgaccgggcctgttagcaggtctgaccgacgtggtaaggccggtctgaccagccccactggtctgttgcactggtctggtttttggtggcgatacagagccgctagagctgcaaccggtcagaccgagccgacggcggtctgaccgagccgtggacggtctgaccggccactacactgcggtcagaccggccaggttgagtgggctcaatgattgccctgtaacggctagttttctagccattacaaagtagtccggtctgaccggcctcacaacggcggtctgaccgacagagcacaaagttggggatttcggttccaacggttagttttggtggttaggggtatatatacccactccccagcagcaagggtgtcacaccctaaaaatcctaaatatataaattgttgtttaattggaattattagaatttattttaaaagcctagaagagaagatctagttttaattaataaattccaatataaaatggggccagataaaatttcattaaatactttgcttaattctataattcctagatttttctgggatttatttgagctaaggaagtatttttaataaatggaattgcatttcatgaataatttaaattgaaaaaggttttttaaaagtcttcttttggctttgggccgaaagtcggcccaaaaccctctctctctcctcctcggcccaagccggcccagtcaagccgagccgcccacgtgcgctcgctgccgctgacaagtggggcccacctatcaggcctgtcgtctacctccggccggccgccgcccgaaccctagcgccgcgccgccgtcgtctctttccaaattcggccgcccctttccttttccggtgaaatcaatagaggggaaatgatcttcgggatctcctctaccttttctcttttggaatcgtcggctaaaatcgtttggaaatctgtggattcgatctcgaatcggattcgtctctctccccgaaccctagaccttccttcgccgtcgccggtcgccgtgggccttcgccgccgcctccttgcccctataaaaggacccccaagcccgccgctacctgccgccaccctcgccttcgtctctcgtcgccggtagaaccctagcaccgtgtagcctcgcgccgccgtcgtcgccgccgctccagccgtgcgccgccgtcgctccagtcgtcgccgtcgctcgggaaggccgccgtcgtggtcgccgtcgcgttgccgtcctcgtccgcccctccatcgttgctgtagaccgtcggagcaccgccgtcgtcgtcaagccgaaggttgccgccgcttcttcctcgacgccgtcgccgtccgttgatcttccgccgccgttttggtcaccggtgagttcgccgcgtcattctctacgtgctggtgccctccgttcgcgtcgtcgcgccgtcgttcgccggcgagcttgtgcgcccgagccgctgccggtggtgacgtcaccgctgacgtcatcgttgccgtccgtcgtggtccggccgtggaccggttgatctcggccgttcgttttggttaggatcgatctcggccgttcgtttccgtgagccgtcgccgtgcacccggtccaccgcaaaccctagccgctgacgcaataaacccctttttccttttcaaaaataattcattattgcgtcataattcaattaaaacccatataagtgttttaatccgatttaatctctaaaaattcataactaattcatcttagctcggatttagttggttcaagtctctaaatttttttaaaattgagatctacatgttaaaaatatccacatgtactgttcatgcttgtttatgtgctgttttggtgtttttgctcttttctgtttagattctgacgtttccggagagttcgttttcgctggagaagaatttgaagagttccaagggcagcaaggcaagtcacacagatcccaaacaaccctttgaacatgtttatcccgtttaaagctattgtttctattcaactattgcatttattttcgaatgccattgggtggaattaacctattgtttgttatagtccttttgttcttgattactttattccttgataccttggattattataacttgactagttgagctttatatattggttcagctagatattagatatgattgcttagccatgcttagaaatattagcacacaattgggataactaatgtttcactattacttaatgatggatatttaatgatagctcatgatggttaatcatgattggttaattaattaaattgccaactaaaacttgataatggtgggttgtgagcacatggttttgagagtcgtgctcatgacaatttaggaccggttcacgagtttcggttgtgaaacattaaccgtgccaaccacaagccagcgtgggcaacggctttaccttttgtatagcatggttcattgcggagcaccagactgagaagtggcggagataagcccatgggggtcgctggggagtctatgccttgtttataagggggtgattatgatccaggaaaggtgcgctgtggtggattgtgttgtgcgaggggtactgtcacagctcctttccgaggtaccgtggtggtattgaggcacatggtgacatgttgtggggctgtgtcttgtgggtacagtggtacacctctggccagagtaaaactattcgaatagccgtgcccgcggttatgggcgggtctaacaatgtctttcgtgattagtctcacacttctcaccataataaaagatgctataactggtaataatttgattagctcctggtttggaatggtatattcctggtttggagatagaactgtgcagccaggattggttgtacagaatggttgggcctatgcaacagggtatgttgtatagcgttggattaatattgtttaaattactacttaactattttattaaattctgaaatgtttattaaatgctgtttatgcaaatgaaaccctactatgccatcctttgttatcctgtgcacttgcatatttgctacgtggcttgctgagtatgtcatatactcaccttgcaatcattcatcagaggaggagttctacagtgatgctgatggtgtggatgattaggtgtagccctggtcaagctgcctgtggagtggagtcgtctgcgccgtttatcttatttttccgctgcttagatctttattgattgagaggaactatctacctctgtaatgacattttattcgcttattaattagagtaataattgtactctattatcaatttgttattgtgtgcctcggctgattcctggacgagggttcacacacatgtaagcgtttggaattttggatagaaattccgggcgtgacaaagggtaaggttttggcactccattgcattatcttgaacccttgcaagagctctcacacccttgtgcacttagtttatctagtgaggtgttagagagtgagttaagccaatccaagtgcattgcttcattgttttagctagtgtggcacttgatcatcctcggcaagcatcctagacttgttactcttggaggttgccgcctcctagacggcttgtataggtgttgcccggtgacctctccgagaagattgtggaggaggcccggcaccgtttgtgagtggtttggagttcaccaccttcggagtgaaggaagaactaccccgagtgatcgaggcttggatagtcctctccgtgggtcggctcccgccttgcccaccccttgacgaagggggcgtgcggtggcttcgtgattgagcggtggagttgggctcgcctcaacggggattaggaaaccggcgagtttccgaacctcggtgaaaaatttcttgtctcttgtctcatttatttgttgtatttacatttgtgctatttacattcatagagacatatttgagcctataacacataggtttgcaaaacttaacttagttgcttagttaaccttgtaccttaccttgcctagcaacttaggttagttttgtttaagtgccattaaattttaaaaccgcctattcacccccctctagtcggcctgcttgatcctacactccctgcgctgagtcgctattgcatcgcctactcatagcagccaccccgcgccgaatcgccgtcgcttgccctactcgccatcacctccccacaccaagccgccgccatctcatcgcactgacctgccgtcttcctgcgttgaactctagctaggccactgactcctccttatgcagagtcgtcaccaccgtcacccctccctacaaggagccgccgccgcctagccaggctatcaccgattcctcctccctgtgaggagctgccactgccattgcctggttgggccaccactgtcgcctcctccctacaaggagcagctgcctggctgggcctccttcctacacggaactgccgctgtcatcacctcctcttcgccgcctggctgagctgctattgccttaggtttgggggcatgaatttggatttgggataggaaaatgactcaagggtattgtttgcatatggcaaaatctccacgggtagaaaggttaactgttaagttgaaataatattatttcttgttttgttactttttagtttagcaatcctggacccactaacttctataaaaaatatttgaaaagaaataatgaaaaccaaaaaatagggaaaaacaatatcggaatcaaagtagcagcaagaataaaattgtcccaattcaatatgatggatgaaatgaaacaaaaagacgattatatcttgctgtttcaaattgctatgtgatgcaaaaattatgaaattgtttcaaaatcacactacaatatgtaagtaaaaaaaaattaaaaagccctattttaatctggttgtggtaacttccattcgaaattaatttactagctgaatttgattgcattaattacgaactctatacttatacaagtaaacattggtccttattgtaatacaatggttgacatattaatggagtctaaatagttcttttttttaagaaataaggttataggacccggctaattgttaaacatttatgtccccttaatgcacatctttataaaattgactaatgcgtgcatgcagtcaagctttacaaagtttcgcaacgatcacaaacaagtatcaacatttattatatgacattgaattattactagcctttagggcttaattgatcatcctcttatatttatggcctaaaatgtaaaggcgcaacagagttttgaaagtaatctacgcgtcttgagccaatccatcttcttgatgattttggtttagcttatagcaattatcggtgcaaataccatgtgtatatggaataacatgaccaacagtattataggtggcaaataacaattaacatcggtaccattagttgtggcatacaaaatcaaataacaattaacatcggtaccattagttgtggcatacaaaatcaggaaaaggctccagggtgttggtctgaccggctataggtagcccgatctaaccagccaggtacttggtctgaccgacggctataggtagcccgatctaaccagcctggtacttggtctgaccgacagttagtgagatggttagaccggccacaagaggcatgatctggccgaggtagggcgcagtctgaccagtcatgatgagcacggtctgaccaatagagggagcggtaactattctctcaacgaaatgtgcaaaggaattgatttccttccagtagcacagaaggaatttatccatacaaatatcatcatagagaaaagcagtacaaaatgatacacattgccatcagctgctataagagcttgaatatatagatgaaagtatggttatactatttctgcagccaaaataaaaaccttaatgataccaacacaaaatacaatggaattgtggaataaaaatatgcggcaactttaaaacagccatctactcctggtgacaaacagccatctacatctggagtatgtagcaagagacgagtatgatcacgagtttactttgtctgtacagcacagataagtgacacctggtgagcaatgccatcgggtgaacacagaagtcagcagctgacttcatttagatgttaacattttagtggtaataaaataaagagctcattttgattcctgcatcctgaagtttttgcccatgttctatcgccactgtcccttggtgagacaaatgaaaacaatggaaggttaataatctggaatagatgcaaaggtataccctggtgctcctctcgaggaatagtaagcaactcgagtctcataaaaacctacaaaacaatgtcagaacaatataatccttctcgctaaatggatacaatagtagagatgtctgtctactatctacaataataacaaaggacataattttacactaatgcacatttaaatagatttcatatccaaagagattctgtttccagtatgacactccctccgttccatattataaggcgttttgggtttgtcctaagtcaaacttcttcaaatttgaccaagtttataaaaaaatgtagcaacatttccaacaaactacactaaaataaatacttttgaacaaagtcatggaaaatgatcaataaataattggggaaaatttttcattgagaagatgaaaaaatttccataataacgtgaaaatgtaaggtaagaacattaacataccaggaaggaaggcaaggatgcccaggaacaagagaccatatgcctgagagttatccccctccatgtgacctgtgaatataaaatatgacaggaagagaagcgaacatcctaggaggaggaggaatagtgccagggcaattgacttccacgggattttcctgagggattttggggtgtaagtgaaccgaaggtcaacatcatcagtaagattgctgtcatccctgtcctctgtaggaaggggagcatacccccgaacattgcgtctagacgccatagtgcagtgtctgcatttgaaacacatactgtaaaatacatgtagaaaatgacatggtaatacacagtaagatctaagagttcaattgacaaagaaaagttgaaatccacagttgctgctaatgataataaaaaattacaagctttgaaaaaataaggtgcaccaaacagtaacagagatgatatgacaaacaaaactaaggttgtggttgccgtcgcatgtgccatgccaagggccttaatggactgcatgtgacatgggcatcacaaatttcatgtgaatcattctcagaaaagaactaatagtttttatagaatgattagcaaaatataagaaaaaattttctgtaatgcgacatgtaatttgaagccaactcaaagaacagaatcaaagacaagaacaggatggcataccagacagattttttctctaggttgttgcatatatcaaataaaaccttatgcaacaagatgcgtattaaaagctttgatcatctacaatcatctgcacgaactaaggctaaaatgagcaatctattctacaggataacaatcagaaaatatgggctaaacaagacacatctaccctgacctccgaacacaagtactaacaaaatatggagtacattagtaccttgatgtgcaaattagttagaatctgaaatagtactaacaaaacatgaatacctcagatttttatatctgaaaaaacacctcaaaatatactagtctttagaacctttccaaaactgtatcttagttctgtatactcctacattatagccaagaaaatcataccagcagcctactgttagtaagaatcaccaatctgagcctttatatgtctcctagctctgaaccagatctatagaagagggaaaacgaattacaggcaagtcagcaaaactggtccgagtggtaaacaaatcacagaaagaaatcagaagagacaggggtggcaacaccaacgcttgtctcaggaaaggattgaaggaacgaggaggtctgggggaaatagaagaggaacaggcgaggacgagagcacgtctggagactggagtgacgtgtcctctcccttgatcctgatttccttcggtagccatactgttggcccgattggacctttattatcatgcatatagaggtaccatctatgggcttggagcccctaactaatgggggtccagatcggtcgtccttactgacctgcctcagggccagccctgtgaacttcacaagtttataaacatcgagcagcaaaatatcatttaattaacataaaaaaaaggaaaaccctacaataacttataattctccaggtaaggaccttctgaccccttccccccctctttttttttgtttcttttttgcaagtagcagggcagaatgtgatagaagagaaaaacagtaataggatcatagtaccagtggctgacttgcaagaaaccaaactttttgcaggcacaataaatccatctaaaattcaggagcctaatctttgggactagaaccgatgagtgagtattcctaaaaaagatggagttgtacagtttttattactcgaccatggaagatcacaaagacacagaagttagtatggttcaagggcgcatctgctataatgtgagagtccaagattttgctacccctgggctaacagtacagtgttctaggcttaattttggcaaaaaaaaaaaaggaaagaaaagaaaaaaaaacacagatagcagcctctgagatttgacgaatattgtcaatttacagtgcttagattacttttagtttttccgatgacggtgcttagactacaagccggctgtacaatggagtcatacaagattatgggttcagtcttaatagtaactcttcaactctgaggctaaaaacctaaacaagcaaatgctcaacataataaacataaaaataaaggatcgaactatgctttgagcaacaaattatattgtacatttggcatcatatcagcttgtcgtggggcaaggaaaacatacaaaatcttgtaatttcacaggcaaaatgttcattctctagttcgttcagacagaaaggtgttaaattcaatcgtaatggtcatacctaatatcaacaaggcaatatcacaagaaacctctcaaacgaatttctatatgagggatgtccagcaatcaaatgccataaacgaatttttgttacctttttttcctagatggagatgtccctcggtgatgaaggggagaaaggagacaaactgtcgacgacggaggccaccgtgcgatggggtggtgggaggccggattcaggaggtggtggcagccgcggaggactcggtggcggcgcgcaggcggccgtcgaggtggagatcggtcgcggcgcggaggagggcgaggggagcggcggatcgggggtggggaaacgcgataggcagggggattggggatttttttttttttactatttgacatctttccaatgccacgctcccaaatgccatcttccaaaaaattgtagctgaattgccattggtcccccacattagttgatttcctaccattttggtccattcttgatgccacatcagcagccacctcatgacactttaagaaaatgacaatgatacccctacccgttcagtacaaatttaacacagctcacagcaaataaaatgaaaccaacttcaatgcacaacaatttcacaagcaaacacagcttggaacatacaacaaaacttgcaattgggtggagccatggctccctcaaatctttctgaaaaccaaaccctagacagatcaatctaaaaaaagaagcaaagatcatgaaaaaaattgatgccaaatcaaagagggaaatacaaaggatctgttcttttacttgggattgtatcattgtttggccaccgccagcggagtcgcctagagcagggagtgacgcgaagtcagacgaggaggagcgatgcgaagcctggagaaagtagcgatgcaaatattagagtttttctcccactccctatacgtaagggcaaaatagggatttcgccccatccaatgctgatttgacataaaaaggaaaaaaatggctgagaatcaactaatatatggacccggtggcaatttatctagaatttttgggaagatggcatttgggagtgtggcatcggggaagatggcaaatagtcaaaaatcccgggggattgagggtggccacctttttttccccctttttttatggtatagaattcatctggagtatttctgctctattccgcattagaactccctcggctggaaaatataatatatgcgcattttactacctccatttcaaattataaaatattttgactttggtcaaagttaaactgcttcaagtttgactacgttcgtagaaaaatacaataacatttttaacccaagacaaatttaatatgaaaatatatttaattactgatttaatgaaactaatttggtattataaatattactatgtttttccataaacttagtcaaacttgaagtagtttgactttaaccaaagtcaaaacgtcttgtaacctgaaacggagggagtagttttttctagactaatcatggattttagtttttattaaaattacgccaaaacatgtagatatatagtacatgtggtgacgctatattcgtatttcatatgaagttaattttataatatattgatataaactatcaaagaaattaatgatcaaagttatcaaaggccatgtcaaaaactaaaatgacttatattcctcatcgaagggagtgcatactacgtaatcatgtacttcactgtatggtctttctttctttgcaaatccatataacttaggtggtgtttggatccagggacttaactttagtccctatatttagacactaatttagagtattaaatatagactacttacaaaactaattatataaatgaaagctaattcgcgagacaaattttttaagcctaattaatccataattagagaatgtttactgtagcatcacataggctaatcatggattaattaggctcaaaagattcatctcgtgaattagtccaagattatggatgggttttattaatagtctacatttaatatttataattagtgtccaaacatatgatatgatagggacttaaaagttttagtcccatctatacagggccttaacctccttgatccttgtttatttcaaaattaaaggacatgacaaagggatatgctaagaaaaaaaaagactatgtgtatataaacattgtctcttgatatcagtgttcctcattgagtaacaaagcgccaagcttggcgagctcaaagctgtcgtggttctctgtggtgagcaatgacttgacattactcttcccgaaccctttctcgcattcctccaccatgttggctgccttctccaacgccgacatcgcctccggaaacctgccagcctgcacgttgtagaagatgccaagctgaccctgtagcacgctggcgtatgctgcctggcacgactggaagcacaccgtcgtggcgtcgccgggtttcaagccgttgccgtcgtccttaaggatgttgtctatcttggccttggtgctcgtcgtgttggatgtcaggaggtcgatggcgatgatggcgaggtcactgtagtagctggcgctgaggctccggctgtcggaaccgagcgcgtccatgcagaacgtgacgctgatgacgccgctgctgctgccagcgacgatcttgcatgcgccggacatgaaagagtcagcgttggcggcgtgttgagcttgagacgccgcgacgagggcgacggcgaagaggaagaatgcattgacgatgccatgggaggagaccattgtgaaacctcgatcgatctgcaagatgatgtcgaatggtttttttggatgaatacttttgtggccttgcgtgtgaactatttatggacaggttttgcatggtgttaaaaacgaacagatcgtctccagttaataattagatagagtagatccgtaaaatcaattattgattccccgtaaatctctgaccaaatatggctgaggcatatacaatgacaatcattagcatgttttgaagttattaataagatgattttacttacataaaaaagagaagacagagaaatatatttgttacttgtgacaacgacagacttttagtgtttctaaaataacatttgtcgcatgagaatcgataaaagaaaagaaagataataaaaaaatagttttggtgtattaattgttagagtagtattttaccatctctactgctgttgtaaattgtaataagatagtctctaaatgaactaagaacctatactagctttaactttaatcatgcctaataaaacatccttaccgttgcatagagttgatgatttttttttatatgctgtaccatcaataattaagctcgtaaaactatactatatatgcctccgattcatttgatgttaataaaaagactgacagttgctagtttcctataacatgttctactctcacatcatttcagggaagctggaggtctggagcatatatatatagaagcagacaagagagccaacggtttgaatcaacgatgagattgagatatctcgcactgactgaactgcattccatgcaggtgacggcggatcaatccctaattagctgtggaatcagaaaatcgattgatatatagctcgagtttcagtcattatctttaaaaaaattatcaagtttcagtaatctatactcgagatatatctgtgctggactctatcgtcttgattattgaccgcacgatcatgatcaactggttcccgtggactcgatagggttcggaaactaattctccaaccccgcgtaacattcgtgacgcctccgacccctctttcctccgcatcgttgcacattctcgatccaacggctcgatcgtgtgaacccaacttggggagggggttcggagaattattcttcaacctggtgtgacctcccgctaagccgtcgcagcgcctgccgtgcctcggataccccattctaccggccgaacgcctccggcaagccattgtgttgcgctcgggcagcaaacaccacgagacttatggcgctcactatgtatctcgagataaaattcgatacctctagatactaagtatctcgagatacatctagatatcagtgtaaaattttctagttaaaatctaattcctatgtatactaagtatctcgagataagaaaaaggtgtaaaatttaggtgctaagatatcttctcaaggatcgtaaaatttcacttgttttagagatgtcggtacatgatgattacaagcatgcatgatgcatatcatattttactataaagttaatgctcaataactgctaaatcatttttttttgaaaaccgaagccagcttaagctggagttatattaaggaggagagaaagtatttacaatatcaccaagaaggtgaaagaaattagagggggcgaggaaaaaaaacctaaatagagctacacattgaacaaaaacctaagtggatattctcgcgatgtcttttgctccacacatgctccatagcttgatttcgtcttgtattttggcaagtagctgcagcattgttttttcttgacttcgaaacaccctcctgttatgttcacaccatatttcccatgccaccaacaagtggattgacttgagtgctttagccttgctttttccaacttgagatgttcttttaatccaccattccaaccgagcttcattttcatcatgtgggtggtctatgtcgtggcagtataggctacttagaaccctctcccagatctgacgcacgaaagtgcaatttttgaaaagatgttgggcggtttcaaggttcctatagcatagttggcagaagtagttgtttggccattgtctgacctgtagcctgtccgctgtccaaatcctattttgtaataggagccatgcaaaatgtttgcatttggaaggtgcccaatgcttccaaatcagttttgctgcagctgagcttattctgccattgaactgtgctatgtaggctgactttgcactgtactttccatttctcgtccatctccaagttatggtgtcctcaacaccttctgtaggaacaatgtcttccacacatggtagaacacctcaaagaattcattgacaagctcgactgtgaggctgtgcctgatgtctattatccattggtcatttgctaacccttcttggaccgttctacctttccttttggcatggttgtataaggccggggctaactccttcagtggttgttctccaatccaatttgattcccaaaagctcgctttccgaccatcacctatagtcaccttggttggagaagcaaaaagcttttttgtccatttcatcacaagtagggggtgtccctgcccaaggcttgttcgggctttcccaactgaaccatagccatcacactctcaatgctcgtgcaaatttctctaaatccaagactcctagtcccccaaatttggtgggtgaacataccgttggccaatttactttgcatttgcccccactaatctcttggtcgcctgcccaaaggaacctcttcctaattttgtccatgtcatgtaggaaatttttggggggttttagtgctgtgaggaagtatgttggtatagaggttagtaccgaagtgacaggggtcttccttcctgcctgttgcaacaacttccctttccaacctgcaagtcgggatccgagcttgtccatgactggttggaggtgcactctcttgattcttcccattgtcaaaggtaaatctcagcatccaagtgtgtcacctcatcatccactttaagttttattatttattgctttggtcaggtgtgatgtaatatgcattagtacatttgcttgtacattcttctttattgcattatattgtttgttacaacaatgtgtgcatttatgtcatttcgtaaaattcagcagattatgtatggaaggggacaaataatataatgtactcgcacatggaaatcatccagctggtacatgaagagaacaaacaaaatggagacacaaaaagtgagatattggttaagccattgttggatgcacttaatacaggcaaatagagtatgcatacattaagaatgtctttgccatttctgagtgcataattaatgtttatgtggtcacgtacttgcatctttttcttcccctcttgtcctttgcagcgttcaataatttcattgccacccaaattcatccatgtaaaaaattttattcacataactaggcacaattaataattcaagctagaaagagacgaacttggtccgatttgtgctagtacaaatacggaaatacggtcgtattttctcgatcccggtcatgtctagcccgggaagcaacaaccgagcggttgcccgttccgcctttccaccgctcgatcgaagatgacaagatccgtcaggaattcaggctacagatgtcacgttgtgatgtagcttgccggcaagcccatacttgtcttgttcatacttcatagcatcgcaggcctatttaaggatgcaagcagcatcacagctaaattccctcctgagctccgctaacactatcgaagcttcacaaattctgttcacgcacttgtagctgttgcctctcgtctccaagtgttggaggcaaaggcgtacttcgatccgcaggtcgaaaagttctttctctagcccccctaatcatgttcctgttgtcgtgcagtttacatgtttgatgaaatgcctgagagaaggccactactttgcttaccttctgttcttgattcattgcatgatagattcgtcttcatttcactttttatgaaccttcaaacctttgttagctgatcatcaaattcatcaatatatgtatgatgatggggaatcttcccctgttcctctaaaaaaaaatcttgtttgacggagattctgtgggattccactaaactttacatgggttcagtagtgactgcggacgatctttggagttccctttgttagtgtttggtagcggacttctgttgcggcagctgcagtttcaattttctagtaggtctaatccaatgatgcatactgttttctgttaaatttcttgctgtttaacaactcaatcgattccgtactcttctttttactgctccttttcttactctatatttctatatgactactagcgaagtagcaatggtctgaattacagtttttactgacctactgttgttcggcaggcaggaccgagggcatgggttccaaagatgcattcttttgcaccttctgctccttgcttcttttttgtttcagttccaaatgcctatcttcagagctggacctgcctcagacagcactagtagaggttgatgcttcatgggaggtttcacgaaagatccctgacacactatttggattattttttgaggtcagattttgcctatttagctctgtcagttcatcttatcgcgtcactttctctgccggcatcaaaatatgttaggatgagatcaataatttagtcaaccttacctaactgctgcagctagtcttttcagttgaatttaccattgttcacactacactgcactgtattaactatggtggttcttcatatatcttcatgcaaatcttctttctggtttcagaaaataactcctatgttgtacatgttttctcattccactgtttccttttccaccactattttgtgtggatgccggtgttataattttgtctgcattacttctagtcagggaaagaggagggattggggtgtgtgtgcgcgcgaagatttcttttgttagcgcttgctttatattcattatgtgttcactgcaatctgaatattctagattatgctcgtcagtcatgataactagatcagtgaacattataggaaattaaccatgctggagctggtgggatatgggcggagcttgtcagtaacagaagtaactctcagtttgataaacattcctcatggaagctgtgagaagtgaatggatgcacttgactaagttgaagatttgttatttacacaaaaatagataaatcagtccaaatatcaagcagtgaatcagtttcttgcactgcgcacatgtcaaaaagacacattgcaggttttgctgtataagaaatattcttatgttcacatacatccaatagtcaatgaaggaaattaaagtgtaaagtgacatttttgtgcaagtgatacacaatgctattttacaagaacaatatagaactccttgtcaacattcgcaactgcagccctttgcaatgctcaagtttattcatgagaaaaaaaatcaacccttgtcaaatgcatttactatatttatcctcattcatattaataactgacatcaggttgcttaatttctattccatattttggcttctaagttgctacagaacagaaaagattacagttctgaattaaaaccaaatgaaacaaaagcatctgtgttttataatttgtcatcaacattgaagtcttgctttaactgactaatgcatggattatactccaggatttgaatctggagggccccacaccccttctaacatcgatccatggtctatcattggagatgaatcctctatatacatcacaactgatcgctcatcttgtttcagcaaaaatagtgtcgctctaaggatggagattctctgtgagaattgtccagctggcggtgttggcatttacaacccaggattctggggcatggtatgagtccttatcgatgtaaaataactcattgtccaaataatcttttttctaaacaacagttactgtacaatgctgtcacttaaaggaaatacagcaaagttgtgatcttttttccaaaaagttaaactaatagctaacgttacctatattttgcttgatttcattttatgctcatttttctgacataatgttgtctttctatgcaatagttctgttttttttacttggaaatatgaatatctgttatagtttttcttccgaccatttctacttttatcttctgatatatatatatatatatatatatatttatttatttatttatttgcttgggattttaccatctgatttttggatgaacctgttcgttccaacttccagaacatagaagaaggaaagacctataatctagtcatgtatatcagatcattagaatctgtggagttgacagcttctctcacatgttcagatggaatgcaaaatctggcatcagtctctatacagtatgtatctttgacataacactgaaataaataattcttgatgtgtttttcttttatgattgaaaggattgcatattgaaatgttgcagagagattgatccgtcaaattggacaaagatagagatgcaattattggctcaaggaacatgcagaacttcaagacttgaattaacaagtatgaaaaggggagtaatttggtttgatcaagtgtcactcatgccatcagacacatacaaggttcactgcattttcatcctgctattggctactgacagtcatgagcatgctttgctatgggagtagccagtgaatattcatccactgctttgtgatgcaactaatgtactagcagaattataagttattcataaatgcgtaggaaacatgttgattcaatctcattgttaattagtgatacttaataaatctacttatattcattttcacaaaactttggaaaaaaaaagtcctcatttgtttattgctagaccatgcttattagtttccgcatttgttaacgggaaatttcttatatatgtacagggccatggttttcgtaaggagctaatatacatgcttttggaattaaggccacagtttctacgctttcctggtatttcttatgttcccaaaaatcatattttaactagaattagaccaaaatgaacatttagataactaaaactaaacctgaacatgcatacaatcataagaattttatgatttttgccgggtaatatgaattaatagtgataatatattgtatttactgtgtgattctattttgtggttatgcatgctttgcaagaggacttctaaaccaattctgggatactaacaagcataaataattaagaaataatactctagagtaaagcatcaaaaagttgtggtcaattagtacgaaaccagcatgattgtagatttatctatatttgcattatatatggttccatgatttcagcaactaacttttgaacaattctacacatatattgagtcaaaattttgtatcacaattatgacagggggggtgctttgttgaaggtgattggttaagaaatgctttcaggtggagagaaactattggtccatgggaacagagacctgggcactttggagatgtttagaattattggaccgatgatggcctaggatattatgagtttctccaggtatatgttgattaatgcaatctgagttttttttatctcttctgctaccaacatatctaaccaaatatttctaccgaaattttcatggaaagcttgctgaagacctgggtgctgcccctatttgggtgttcaatgttggtaatacattctaattatttaaaattttcctgttttaccatatcttttctcatcgctagcatgcccattaccagcttacaattttaccttgaaatttagggatcagccaccatgatgaagttgataccatcataattgaaccttttgttaaggtacgttaaatgccaaaagtaagaatagtcatccaaatagaactgggtagaggattactccggtttgacttttccttattgcagatgccatcgtagcaaaacaaaatgttttctatgcatttgtcattctttaagttcattattttttttctatttataggatgtattggatagtcttgaatttgcaaggggaagcgcagaatcaacatggggctctgttagatctgcaatggggcatcccgaacggttcccactgaagtatgttgctattggaaatgaagattgtgggaaggaattttaccgaggtatatttttattaatcagaatttgacatactactgatcccatttgttgtcaatgccatagttgttttccttaggttggtacatctataggctgaaatggtgtgatggccaagtgtacttaacacaaaatccctcatcatatatgaatgcatatctaaaaccacttattttccttcttctttaccccttgtttttctttgtttgtatgccgtcgttactttgtggagtcaactacaattatggcaaaacaatttcatccttacagataagcataataaaaatataaacattcgcaacaaataatagatgaaaatagaatggatgtaactttgagctatttatgtcatcagtttctgaggatagattttctttgcacatgaagttactataacattcactaatttcatgaaaataccagagagctagccaatagtatcccacttgtccccgagttgcccatgatggttttgaatcctatcttacaggaaattacctcaagttttatgatgctatacgcaaggcctatccagacattcaaatgatttcaaactgtgatggatcatctaggccgcttgaccatcctgctgatttgtacgattttcatgtaatcttcattccattttcactgtttaaatactgtctcattacttctaacagacttttcattgtgcttttattaagatgcactctgacatattttttcaggtatataccagtgctgctaatctttttatcatgaagaataagtttgacaggacatcacgcattgggcctaaggtatttttcagtccttgtttggatggtcagggatccgtggccatcacggcccatccaaaatatggactttgtttttgtgatttattctggcaatagatatatcctcgaaatactcctatatgggttggtctttaattgacctatcatcctaactttggtggaatatttttaggacattattttttttccatgttattctacctgaggctggccactggcatgtttatttattaaatttcttcagaaattatattgaagtcataatattatatgtgtaacttccattaatgatagtgttctagtgtcacaacacttcagccggctttgtttctctgtatcattacagttctcttgcatcccgacgccctaggatattggatacacagaaagtacttattaattactatgctatgatcctgttccaggtatttgtcagtgagtacgctgtcaatgaacaaagggatgctggtaaaggaagccttcttgcttcactggctgaggctgctttccttactgggttggagaaaaataggtgatctctctcacttcttcctttctttggataatctctcattccatattcttgggactaactgaatcgtgcatgcagctgtatttagatcattcatgacttttccaggataaatttcagtattgtcttggataattagtagtttatgaccctattcagataatcacatttggaacaaagggaaaatgtctgttgttcagaaattacaagataatgaataatacacgtattgtaaatattaatagtgagcagcaagaatactctatcatgaataaattaaaagtgtatgtcctgtttatctgcagtgatgttgttcagatggcaagttatgcaccactcttcgtaaatgacaatgacagcacgttagtacctccagctttgctcctttttatttccaacgttcttgttggtcacaagtacgcgagtttgactagaccttaatgtaatgatcagctggaacccagatgcaattgtgttcaattcctggcagcagtatggcactcctagttattgggtgcagacatatttccgtgaatcaagtggttctgtgattcatccgattacgatcagttccagatattctgattcattggctgcttctgcaatcacctggcaagactctgaggatatctttctgagagtaaaggtaaactaaccattccagtttctcctaatttgcatacccttgcagcaattcattacacaagcacctaaatgttttgaatgatttagttacaacgatataaaactgattcaactactgcatacttggataacatctctttggattttagaacatatgttgatcttcaaaagatcttctgcagatagtaaactttgggccaaatgctgtgaacctcacaatatcttcaagaggacttcaagatggcgtcaacactgcaaaatcaactgtgactgttctcacatccggcaactttctggatgaaaattcatttagtgaaccaaacaaggcaagacaaccattgtttccatcacaagtttcttgtttcataaccatgcactgaatttagcagagggcaaccttaccattacaaatttacagtctgccaatatatatgcaagccgtatgacttatttaatcaagtagtgtatgttatacataaggcataaacttttgtagtcttatagatgtcctctcctctgtctttttttttcaccgagccctctcctctgtctttcagttttatctgtaagttttccaggaaatagtttatttggttatgtctcaatgtctggaatcatttcctacaagtatttctagaagttgcacctttttttgatagagttgccaaaatttagtttggagagtctgttagagatgctctaacacgcaatattctcaggtgttggcgagttcatctaacatacaagtatctttgtgaatgacgcatgcaggtcgtgccggttgaaagcgagctgccaaatgctgcagaggtgatggaagcagtgctccctcctttttcattcacttcgtttgacctcgctctggatcaatacagcaagctcgtagcagagatgtgaagcaatgatgcatagtttcaacagagaaacaggatgtttacatgagatgtgatgcctgaatttcagaaacacttggtgtgatcctgctgtttatgacgctgcaagcatagtttaaggtttgtcacgttattgaacctaggggtaacgctaattaatatccttgtcaataagctatccccttgatcactgaactctggttactcagagcttgaatggattctcagttaatctggataagcaaacagaagggaaaatgtagggttgatgagaaatggtcctgcatgtttaccttgtgttcccccaagtgataagattgacatttaataatgcagcagaacatatctgtgatatctcaaacgtaagtccaataaaaactgatcaagcctttcagtgaaggtttcttaccatgcgatagtgcagtaaattaatgacaaccgtaatcatgcactaaatggacacatggtaagagtaagacaatggtgtctttgcttagggaactgcataaacacaagcgtagccaatacatttccccatccaaataagtatagtacatacattttgtaatgctaccaaatacatttcagttttttttcctacttgtctccattcaatagcatcgcttccatagggcagaaatttacatacaagaggataacaatcatagtagcattttttttaatataattcaatagtatgccaatcatctcttgacccagcgagctttccttactggacgaaaaaaggaaattcaattaagaaacatcgctgatatcgtgccaccaaagtaaatgactttcaggcagccaaagagatttacctcctcttagggagtcaatgaggacgaagtatgaggggatatgtacaacaccagccactgctccagcactgcatgaacagttgaataacaatgtgagcaaccataattatcatttaactaataggctcaaaacttttgatgatctcataccacagaaagcaatggtccttgcttaaatttgctatggaaggcaaatgcaagtggctttgctccatctccaggtcctcttatgaatccactgtatatgcacattggaaattcgtcagacaatggtccaaaattatcaagattcaatgttcatgaccaagataacatggtaaattagaggactgcacttacactagtgaaactgagacaagtggagatctcctcacatcatagacagcaacaaggccatgatacatttcattaccatctttgaatgataatgccaagcgctctcctgaagaatcccatgctaatttatctatgcctcggctagatgaaccagagaaagctagcataaataagtatatggactggacaacaagttacttttctaggctgtaatggatgaaatgatagacttttgaacatgtaaaggttcatcctaaatgaaagcatctgagtatatactaaaatggcaagagacagactttttacaagccagatctaaagatattttgaaaaaaaaaatggttgaggcgcttcaattgattagggagaacttgcctttacttgctaatgatcctaagttacataccataagtgatttatttaaaaccatacaatccatatcatgaatgacttcccaaccagatgcagatgtggttattcaaaatatcatcagttaaagttagcattgaagacagcagtaaaatatgttccatcgggtccacaagaagttaggagtatagaatggtaggtactgccactgttgttacctgacaatcagagaggaaatttcaggtagttcgactggtaggagatgggcatctgaagtcaatgaacacaacacaatgttcaggattcagacaataaacataatactgtaacttcacataaaaatgctgtggtgagatgagggtagctgtccatacctaaagatggtggctttgatgagaagtgaattgagcccagtgttgttgagttagaaaaggataataatgcagtacggccttctgggtcccaatttgctccctggtatgaaagcaagattaaaaaaaaaaagcatcataactccaaaattaatcacaacacccatatttcattcaaaatactgctttaaggggggggggggaatgtatatattacaagtgaatgagaaatgtttgctgtaaaactgatcttatgtgatatacttgggaaggttcaaattaagttgagctttatgtaatatttacaatttataaagtcaactgaaccaaaaatcaacttttgaacaagcaattgatcttgttggcaaacaaaagtatagctgttgaaatgacaatacattaacaagtaaaaaggtactgcaaggtagtcataaatacaaaataaacccaagttcagaagcttgatacaggcatgtttaaaatgtatatatcttaaaacaactggttatataagttaatatgttgtatcaatcttcagaatcatgctaaacacacttgttttcaagataaatacatgtacaaaatcagaaagaaagttacatatacaattttgaaatgggtctgagataacaattcttgagttaaaactggacccaataacccataacatgcaaagcatttgccctttcatttcatgacttaattaagaatccattccttgcaacatggtaaacaataatgttgaatgttaaacaatacttatttaaagagtgaagatactactacttacagacacatatccattagatgaagaccatggttctgacgtccatgtatttgtttcccataagtgaaaagttccatcactaattaaaaaaggaaaactatataaatcttcaaaaggtatgagcaatgaaaataactaaagttgaagttcatacagcttagcagttaaaaggtaatctccactaggtgaccaccgcactaatgatatactacttaatccacgtcttataggcgttcccaaccctgaagcagaagaaaatctaaagatattagcatgcagttctgtgtaagatggaattgggtatctgcattctgatgacatttagataccttgagaaacatcccaaattgtgaatgatgggctattacaagaggcagataccaagtatgtggagatatatgtcaaggaatattgtctagagtcactgatattttttctgtttgcaagtgaagacatattatttgttttaggttacattttttttatttttcaaataaaagagatgaatgatacttatgattaaatgctatactgaaaacttataaaggatatcttccatcaggtttccaacaaagtgcgctaactagctcagcagaagaaccacggagaatgtccacgagtatccattgaccaccggaacctctagaaaggcaccaaaagaagaagaggtgacaccagatttcacagatgcaacattgccaggatatgatgctgaccagaggcatatccctcccctgaaaataataataataaaagttaatctaatagtagattgtgccactaggtattatgacatgaaaagaatatcaaaacaaatctttaatagtgctctagtatatggcggcagtaggacatacttgcacccaactgcaatcacctttccactatttggcctccattcaacagctttaacatccttttgatggtcacttgttagaatgtaggattctttattatctgttcagagaatacaaatgattagttgttggcttcagctgagttgagaaacatacttcagttcattaaatacaagaataaatgttcatatagccatcatgcttcagttcatcatatctatcttattaatacaacataagaaagttcagcagatctcacctggctcctcaaagtcatgaactgtaacttggttcttcccagatacaaatgccaagcaatgcttgtgaggattccaacttactttctgggtatcaatttcttgtagcagatttggctgcgaaaacaaaagatttgtcgtaagtactaaagtacagttgttaaaaaaaatctatcctgagcactttgcacacaaaaataagcttgtgtgtagattttgggtgaacaacgagaatggggcaatatatgacagaaaagcagtaaaatcatgaatgcaagcaattgattcactaagatatgatgaagaaccaaactcacattgcacgaagggaagagcatttgtttgaaggactcagctatggtggaagctaaacttgttctggggacaacttcagcaggctcagcagcttcagtgacagcaggaggctcgtgggtggcaacagtcgcatccggctggaaaggaatcgggctgaagaccattccctggaagccccaaattgaagtttcaattagaggcctaataaaattagtgttgtgaaaaagaaaaagaaattattgcgagggggaggagagtgtactgacgaggacatccccgtaggcatccttggctcgatcatcggacagcgcatccgccacaactgcaacgcacagatttggacagccgattgagagaaaacaaggaggagaggagatcggggtggagaaagcaaggaggtggagggataccataccgaggtcacggttgatctcgcagacggtgacgccgccgggcggagggaagctcggcatggccacgccgcgcgcgggcggagaggttttgttcgcacctggacctggggaggagcttgtcggcgaggctgtggccggcgtggagcttgacggcgacgccaacgagaggggaggtgttggtttcctcattaaaccctcgccatccgcacgggaggagaagaacgga

SEQ ID NO: 62706 - DNA, 2283 bp, Oryza sativa
ccgaccccaagcgggcggtctgaccggcgcataaggccggtctgaccggcggcacttgcccgatcagaccggccccctggaggccgagatgatgctgctcgggatggccgaaacagagccgacggagccgtagtcggtctgaccgagccgaggccggtctgactgcccactcaactccggtctgaccggccaggccgatggggccctctgacagcacttcaacggctagttttctagccattgcagagtagcacggtctgaccggccacatacctccggtcaaacaggcagagcacaaagttgggggatttcgcccccaacagctagttttggcgggtgggagtataaatactcccccaccagcagcaaggggactctcttggcacccaattcaattgcatacatcccttgcacctctctcacacccacttgagctttgtgttcatccatctagtgtgttaaagggttgattagccaagagtcaagtgcattgcttccatttgtagagctagtgtggcacttgattgatcatctccacgccgggtcattgcttgttactcttggaggttgccgcctcctagacggcttgtggaggagttgtccggtgacctctccgagaaaattgtggaggaggcccggcgccggtttgtgagtggtttggagttcaccaccttcggagtgaagaaagaactaccctagtgatcgaggcttgggtagtcctctccgtgggccggctcccgccttgcccaccccttgatgaagggggcgtgcggtggcttcgtggttgagcggtggagttgggctcgcctcaacgaggagtaggaaaccggcgagtttccgaacctcggtgaaaaatctcttgtctccttgtctcatttgattgtcgcatttacatttgtgcaaatttacttttctagcacctaagtagatatcatatcaccgtaggtttgctagccatcgacataggggtgtgctgtcctttctaagagatatagttgagccacaatcaccataggtgtgcaagacataagtaagttgattagttagagttgaccctcaccaagcctagcaacttaggttagttttgattaggtgtcatttagttttaaatcgcctattcaccccccctctagtcgacatctcgatcctacagggtggccgacgacgacgggtgcgcggagtggccgacgacgtcggttgccagatccccttccctctgccgcggggccgtcgccgtcgagggtcatcgccatcggagtggcggcggggtggccagatccggcatgggctttccggatctagcctcgggcagcaacggcggtggcttgctggcgaggtcagcgcccggtcgccctcctcccgctcccctctctccctccagccgtcgccgtcgccaaccccagactccgccgccccgtgccgcctcacaggtcacctcgccgatgactccgccgccctcggcacccccgcccagcgccgcctcgcgggtcgcctcgccgatgtctggctcgcccttctcctcttcaaggccgccgagctcctcctcgccgtcacgatggcggctggtggagcggatcgacgagcgggcggcgccgtgggagagaggcaagggtaggagggggatttggggggagcggcgaggagacaggagcctgcagtgggtctcctcccagggacgagggttgtgtctctgcgaaaagtggtcgctccttgcaaagacccgcgttcctctgcttggcgccacgttcctagcctgggagacgactcacgctgaaaaggggatgggaggcaaacggccgtttgcgagggcacgggtcgagggtagggatggcaacgggtgcgtacccattgggttcacccaccccatacccacacccattgaaatgaaatacgcccgctccaatacccacacccgctcacgggtgaaaaattcccccatacccacacccgcatgggtgacgggtacccattgggtacccatacccattagagtatcaaattgagcacaccaatgcatccagtcagacagcagggcagcaacatagcagccagagatttttacaaattaggattgaaaagcacataaacaaaccatgcagccacattgcacaatcagcaaatcaagtgataattggaacagtgatataatataacccattaagtttaatagcaagcatgctgtccactccaaaatacatccatccatcgtacaatacataaatcctccagtgatccagtctcaattgagcaacagtccagccaattcaatggcatacaagtaca

SEQ ID NO: 62707 - DNA, 1960 bp, Oryza sativa
ctgtgcacagagcctcttaaagagctccataagatgcttgttcttgaattgcttgtagaaatttgcacccatgtgacgcatgcaccaccgactccgaacatcaggccacttagctggaagtcccttctcatcccaaccgttctgcaagtagtcaatagcccgcaacatacccgcatgacgatcatgtataaggcaaacgttgggcctcatacacaccactgcaatgtgcactctctctaggaaccagtaccagctttcagtgttctcactctctacaaatgcaaaagccataggtagaacctggttgttcccatcacacccaattgctgtcaatatctgacctcggtatttacctgtcataaaagttccatctatgcatagaacaggtcgacaatgcacaaaagcattgatgcaagcacccaatgagaaaaaggctctttgcagcacactctttgttcgatcatcaaccgatgtaaatgtatgtaggtcatagtacgtattattattcctctgggcaatggtggctaacaaacgaggcaaattatcataagaagcttcaaatgtgccatacctcatctcaatgatcttttgtttggctctccaggcctttgcatagcttatggtgtacttgaatttgttctcgatgtgcctaataattgattttggttcaaagccaatgttaccaacaacactgctgtacatctcacttgccacaaaagctgaagtgatgtttcggtgatacttctccaccccttgtaagtagcacttgtgctcggtcacaatgctaactttccaataatcattccatttacccttatatgcatggacacgccacggacaatcttccttcatgcacctcacttcatacacataatttgttgacttgaccaccctaaactctctctgcaaggaaactgcccaatgcttcaccgcctccttcctctcatccttatgagcatatcttgcaccctcaattacctcattctccttatactcccagggtacatgatcaccctctgatataacaagtccagagaagtcctcatttgcccaatcagtggccattacatcaccttcctcatcggatgatgcgtcgtcgtccacttcctcattatccgaatcttccctctccatttcatcaacaattataccgactctctccccctcatccgccatgcccatagcctgctcctcccttggttgattttcctcattttgcatcgatggtccaacaacatcccctgcattgataggaccctctacatcttcggtttgcattgaaacatttatatctttctcttgtaccgacacaaatataacgaggggccatgaccgttcaaaagccatttccacataccgtctccaagcatcagtgctgtccatcggcattagttcccaaaaataaccttctgttgcacgactcactacaactgacactgacattgtgtagacttcttggtctattctaaatcctctcaacaaccaactataaattgactgaaatgttctctccgcaggcctatcgatgcccttagatgtcattacaaaatctgacagatcaacaccatctggaccaaatctaatatttccttcaccgtgaactatctgaaatgtgaccttacttgacattgtgcctgatgaaaacaataactgcgttaacctcgcatttctgtactacgccctaagttacattctctacaatattgttctctaaatttctaaaattacgttacattctccagatcaaactaaactacatcttacaattaacactactgtctatgtctcaattcatactattatattctatgctctggatctacacatatgtgctgtgtgctacagatgtgctaaaatatatggaactaaaactaaaacgcaacatatatactcaaacataacatattagtacaaatgcacaaaagatgtatgggagcatacctgtgatgaattgagcgaa

SEQ ID NO: 62708 - DNA, 32788 bp, Oryza sativa
tgtatttccccttgctcttgttctgggccttgtgcacaacattggcactggactgcccaccatcgccctgagacgcggcgtctttttcccgagctttctcctcaacatcaagagacgctatcaacccctcaacggagtattccggtctcttgtgtttgagtgcagtaccgaaacttctccatgatggaggtagtttcgcaataatgcacccggccacaaatttatcgggtaagacacacttaaggagttcgagttcgttagccatggtttgtatctcatgagcctgttcgactacagaacggttgtcagccatcttgtagtcatgaaactgctccatgatatacagatcattgctagcatcagtagcaccgaatttagtattcagtgcatcccacaactccttagcgtcggtcatatgcatatacacctcgaccagacgatcgccaagaacgctaagaatgcatcccacaaagagagtagtggcttcctcgaattgcttctgctgatcagcagtaagaattccttcaggtttgccattactcacccagaagcatttcatagccgtcagccacagagtgaccctgatctgccatctcttaaagtgcacaccggtgaatttatccaacctcagtgcatcggcaaaaccagccatagtaaaatcacagcgcctataataaggtttttggattgttgaaattataagcacataatgatttaatttattccataaataaatcatgacattgcagatgtaaactagattgaacacatcattagatctacacatataaactaagcagtaaaacatgaacagatcaaatatgcgcaacatgtcgaacacgtaccaaggtggcggaaagaccggttgctcggcaggaactactcgcggttgcgagcgtcgacgaaggcgcgaagcacgcgagcggagaggaaggcgagccgtcgcggacgaacagggagcagtcgcgcaaagcgcttcccaaaaaccttattgccgccttctcccggtgcaggacgtcgaaggcagaggttccggagacttgctctaccgatcgccggtgcacgccggtgagcgggatggagtagtctacgagcgatggcgcagcacagagtaggaggcaaaccctagattgatttcgcgtgtgttgcgtgaaggtggcggctcggtttatatagagatagatcgcctgatcagggcgcccgcgtaaaccgaaccggataagtcgcgcgtaacctatccggactccatgccgttttcacgcaccggattttttggagtgtttccaaaacaaaacaaattcgaatttcccgcagcaaaacaaaactgcaaaaggaggctgcatctgcgtaagggtgaggagccaattttgcggaccattcgacgcgtacgtcgtgcacgcgcgccgcctgccaggccaggcgagcgagctcgcgcgtgtgtttcccctcttctctccaccacacatgcttcaagtggctaggagggcatcctcccttttaaggagatcccctctcctagaataagcaaggtagtactaaaccccatatgcatgccatcccatgaggtgggcttttgtgattttccaaagaattaatcttcgaatgggccttagcccatctattaattccaatatcatgaatttgaaagttttgaggagaaaatactgacgttccctttttttaagtaattccatttttgcgttacaaacggtcaaaacggcattgatgacttcatttacttatcaacaacccatggactcaggatgcaagcgggctgactcatgaactcacttataagtcaaataagtaatcatccatggattttcacgtcaggatctagcttggcacatctattataagtggatcaacctataaacatatttataggttaacttagtaggtaatccgcgagccaaatcacgagttacccgctaaattttgcctataaacgtgtccacgggttggcacaggcacatccctagaatggaccgaacatattcagtgataatcaacagaattcagatctcctttttctatagtgcatgatatccggttgccataacaaatagagcaattctacggtacttgaggaggtaccatgagatatcaaaagtttagtgtaaaatttggtacctcatagtatctaggtaccaagaggtaccaaatttacaatagaaaaaatggtacctcatggtaccttctcaagaaccgtaaaattgctcaacaaatagtacaaattttgtgtatcaattagaatcccaatgaatttgggacgctcctgatctatgcctggatttctggagctatgaagaggcctgaaccttctaaatttggggcatcagctcttgccatcctcaaattcgccaaaccagtgtcttccttgttatcgatgttgaggaactttgagcttggcccatgaagacctggcccaaatacacttatttggcacaaaccttctatatttgggattgcactatataaaaaaaaggtggctagtcatttgtatactttgtgtctccacttctcttcttagattatacaacctcattagactactttgtagccggggttgtataatacattatcaacgcgaagctctactggagatgaaagtagaaaaggataagaaacttgaagatttgttttgcatcttgtagattgaattgcaaaacaaatcccttgtatcttccttgtttcctttttttttttactcccgacgaaaaccaccattgctgacatggagtcgtcggcgctctccaacagcagcgaggcatccttcgtccgggacgtttttgcgagcaaaaaaaaaaaagaaagaaagaaagaaagaaagaaaaactgaaatagatgcatgttgcggcccgttaggtagaaggccgggtcacgagcagcagcgcggcctagtagctgccgccaagcctctcggtgagaatccatgggccgcttcggggtggttgtggtagtaagttcacttttggtccctcatcttgagggcgggtttgaaaaccttccttgaacgataatactccctccattccataatataaaacacaacctttttctagatgttccataatataaagcatggatgtatgtaggcaattaactatgacctcttctccattaaattattacttttttaaattctccactctcatattctctaattctattggatgcatgcattatatttattagcatgatccaaactataagatgataataattattttcttggtctttaggttaggggtgattaaaccttatattttggaatgtagggagtagcagataaaatgtgtctctaatattgcaagatcaggttaaacagggtatcaagacagtatagctccttgtttcgtctgacgtgacgctttgaccgtggtctgctttgctgagtcaacgtagcttactgtggggctgtgtttgaaatcatcttctccccccccccccctcttcctgtttctctatcttcccccacaatggagcgatggtggcgcccggagcagtgcatcagcgaggagagcggcgtcgtgttgggtttagtcccacatcgataattgatgatgggggagcatgacttaaaaggtgaggacagtccttatctctcatactagtcttttgggttatgtaggcccaggacctaaagttgtgactccggttgggcttgtggtggagcaggcccaatgtgacctaggtggcccatggttggtgggccaggctgcacactctaacaaagtggtatcagagcctaggtttggaagccggaacaattaccttgggtcacatggtagggaggccaggtaacaagttttcacggtcatatgggttgaggtgacgggggagattgttggggccaggtaacaagttttcacagtcatatgggttgaggtgacgggtgagattgttgggcccgatgtgtgcaaggaaggcgcaaaaggccttgtcggaggcaacaacgaagtcgtgtgatcaagttcgatggtggacgtggaggccacgcggagcggagtcgcaaaggtggcacggctcactaggtcatgcaaatgtggcgtcgagccaggttcgatggtggacgtgaaggccacgcggagcggagtcgcaagggtggcacggctcgcgccaggtcatgcaaaggtggcgacggttcgatggtcgacatggaggctacgcggagcggagtcgaagggtggcacggctcgccaggtcatgcaaaggtggtgacacctcgacgaaggagccacgacctgggcttggagaaatgattgaatgatttgaattgaaatattatgaaaatgatttgagaatgataatttagtgctagatgtttgttgcggcatatatgttagatattggagaaatgatgaaatgatttgaatagaaagttttagaatgtaataaattgtaatataattaaaatatgcttgtatattaagctttgtatgcttaatgggttaacgtcgcatgcttgcatgtaggttttgaaagtgctactaaatattatgtttgtatgtttagctttagatgtttagtgagtattagctttatctttataataagaaaggattacaagttaaaaggacatgtcgttatatatagcattacgtttcaaagatacgattcaaaactcgatgtcaagatgagctagggagaccggagacgggcggtatggaagcaggtccacgatcgagatgcccgcacgggagggagggagccggtgccggccaaggaaaccgattgggaagcagccgagaggagagcgagtctcagtcgtcaacccctggtcggctgattcgcttcactcgcatagcatatgatacgcatacgtacgtacgcacgcctgcattcatcatcgatcgagccgaaagtatatgtgtattattactttgttggtccttgtttaattacttaggtcagcctgctggtctcgcgacgactctcgtctatccgaagaacacggtttaattttagagtattgtgcattttaggagaatggtaaatagtaaattcttccgcgtccgtgtctggattttactttacttaggatgcttatacattagttgccccatcgtttagttttcgactcattagttataagcataaatgaaaatttgaaatttaaacttaattttagatttgattttatggctttttttcaccgtagtatattttcagtatttgtttttaaatcgttaaaaacatgtatataaaaaaagtttacctacatataaactattttgtagtcgctagtaagccattttgctagggacgtaagtgggcgatctcacaacccgtacaaaaatatatttgctaatttatttcttatataatagtacatattttttttaaaaaaatacactaaaagtaggataagctggtaaaagaatcttgctttgcatccctacatttctataagcgaaatgatgtggttgtagagttgatttttagactgttttttcctttttcgacagtatatagtttttactttggtgaaaattaaatctttctccctcctgtttaaattgatagatattcgtgatttaattatccatgcctatatatatgtgtgtgtgtgcaaaaaaaaaatattaacgtatgcttctttacacaagtacttcctccattttaaaatatataagatgtatattttattttgttatgacagagcttttaccaacaagtactatgtaagaatatactaatattttgacacaattttttataaaattagagcaattgttgattaaaatcttgtccaatgaaacaatatatgccaaacaggagtatttcagtatcttttcttacctttttccaattgaaatgacctgtttgctgccggcatgcaagcaaaactattcttatatatcttcgcacgtacgaggatattgataccatacatgcaattgtttcttcttcttcatcctagataagatcaactacttattcaacctcatcaagttaattcgttttgtgtcaatttcatcggataaaaccgatcgaggtgactacgctttcttggacaggataacaaatttcttgtacacaggagaataattgatcaacctagtgtcgtctcatgtgtccattctacaatacagtcatacagataagatgaaatccctatatatccttgtgtgtgtgttttttctctgaaagacaacacttgagacctatacatctttctagccttatccatgcatatgtaccaactcgtacgaatatgctaccatgtcagcgtatttggacgttctgatcaatctgctcatccagcaacaagagctagaagaagcagggaaagttcagataaaaggcctagctaccacatgaaagatcagataaagttcagacagtgagacagtgagacagagttagcagtttgcaagggcatcgatgctgatgctcactgaattttcccagctcgtgaggccgtctgcatttgaaattgcattgcattgcatgcctgaattgacttcaaaactaagaacatgttctgttctgcaatctgtactactgtccatgcatggcgacgccatgctctgaatttttcagtacaggatcagacgatcagttgcgctcgcttggtctgtccatcgactggtctagttggtcacacacctttctgccaagcttcttgattctgtggataacagcttgagatcactgcaggtctaggttgctgcctactacactgaagcttcctgtcaagcaatccattcgttggtagtattggacatcttccttctcaagattgtcccaaattgacctcaaggctgaattgttgtgttccaaaaggcagtcttccactatttgcttcaaatcccaagagtagtcaatttcttgtactctgtgattaatttcaaaattttaattactagtaaatatgttatggaatttggttagctccgtaattcgggcgggaaccgtggtaaatataaaaccaagattagtactgtgagacagaatttctactcttctaggctgtcactgagacaggttgtactactgatcacaagaatgttgtccatggtgagcttttgcatgggcaaaagaaaaggagcccaacttgtagtcttgtactttccaggtacagaaaagagcacaacttgtgtccattgatttcaaaaattcaatgaactgagcaatacgattctggaattcagttcggcctgtaattctaaatatgaaatcaagactagtacttacaattacagtcagacagaattttctactctcttcttattctaggctgtcactgaaacaggttgtacatactactaatactactgatcacaagaatgttttgtccatggtgagctttttcatgagcaaaaggaagagagcacaacctgtactttccaggtacagaaaaagttcagtcctatatactcctgcttggatggatggatgagtgagctgtgatcattcagttcagagatcttcaatccttcacacttctgcaacagttttcagacggctctcctccgtccaaatggtccaaattgttgtcaaaagcatcaacacaattccatcctctcctcgctcgatccagctccactcccggaaagaacgacgtcgcagcgtctcttggaaaatgtgtcgcgcgatccgggccccagctgcaagcagcaacgctgcaaatgctaattaacctcgtgagattcttgagctactggggaacgacgacgagcatctgatcagtggtgatgagtaatctaattaattagctcgacaaattccttaagcaaagtctctgattagtcgaagttactaggaaatcaagctcttggagaaaatggcaaagatgcaagtgcgtgtgaactcgtgagctttcttgcatttggaggattttttttttgtgcattccacatgcaggagaaggagatgatgccgttgcaatttgcaaataggaataggagagataggatggaattatttttttggttaagtttcatcaagagagtatcttgtgcaggaggacattgttttcgatggattagtggtaaggttgacggaatcggtacacatgatctgcaaaatctctgacataattccatctctgtaggtgttactgtgttcttcagacatttttcagaggcttgagattgcaactttcatacaaaatatctatgttgcttgcttgctggattgcagaattccattatcgaaaaaaaaatctgcggtttcttgcatgtagcacagcacaagggacgatgaaagtgacaagcatatgccaggggaacattttgcttttcttccatggatggcatttcggccatttttcagggaacattcagagattcaccggcattctcactactttggtaaaatctgtggattggacagtcaaaaaaaaaccatgaacagtgatcaactaagaacatcagatacatagatgctgccactactgagtgctgtactgctgtgagctagctgaagctatggcattttgcagatcaagaatctgagcagtgaaaagcaactgatgattccgagcaattggcggcaaagcgacgatcgatctttcgaaagatcgatcgaaagccaccaggtccaatggattgtcaggcatcattatattggcttgttcttatctatcaaaagtgacaattgccatgaaggaaaaaagagatgagagggaaggctcatttgccgggaggaaggatttgatgcccctacctctaagggaattcctttttctttgggagctcaaggagaaagagaggatgagagttcagagacaagtagttcatgcgatccctgtagtttgccgggaaaatgtgaatcctatgattctagggaggataggtttcaaatgatcttgcttgaacatgtttcttaccatgaaaacgacatggcaagaatttaacatcaactctttatttcaaaactaaaatcatacttgtgttcttgacaccgagtaatattgtcgaaaacaaaaaccaaaggtagtatttttgaaattcagtagcttcaattcgatagttcgattcactggaattcagtagattaattgtgactaaacttcagtaaattcagtagctttgattaattcaacataattgtagtaacaaatggtaaaaatactttccacagatcaaattcaagtaccaggagacatacatatgcctctagcgtcgtctagggtgcttatcatcagacatgagtaacggaatcatgatgttccactagtgaaacttcagtggcatggcataagcataattaaactggcttgagaacagcaaaagatcggccagaaaaacaagaaatgacactttggcttttgcacgtatttacgtacgtacgcacaagattggaccttggaattggccctgattgatggataaggtaagaacagactgcatgtgtccctttttctcaaaaagaaaaaaaaatggtcgataaaaattctgtcttttttaacaaattgtagagtactacttttaaaagagaccactataaaagttgttatgaactaaggcctgtttgtttcaacttaagattattgagccagattattataagctggattataataagtcggcatagaataaattgttagctgtttgtttctctagattattagatgcttgttagctgttagcaacccaataatctaaaaaagcacctttagagtggattactatattatagtaatctggcttacagattataataatctatcacaataagctatctgtttgtttcagcttactcctaataatccagattataataatcctaagctgaaacaaacagggcctaaggtattctttagaatagaggaattttgtgagaatttcccagggaactagagtgattcatgtgaaatttaagtagaattcctgcgttactaaggcatggtttagttcccaaatttttttcccaaaaacatcacatcgaatctttggacacatgtatggagcattaattatagataaaaacaaaaactaattgcacagtttgcatggaaatcgcgagacgaatcttttgagcctaagagcaagtttaatagtatagccaactactcgctccaaatcacctatagtcaacttaatagccaattcatacaatagttacatactacactattaatatctggtcccacctgtcatacacatattgtgtcttggagtccgtgctacagctggctacaaatctgtagcccgctgctcctctctctcctctattatctccttaaaatatgtttatagctagcttatagcctgctattgtacctgctctaattagtccatgaatagccataagtgctacagtagcccacatgtactaatgacggcttaattaggctcaaaatattcgtctagcggtttccaagcaagttatgaaattagttttttttcattcatgtccgaaaaccccttccaacatccggtcaaacatctgatatgatacccaaaacttttcttttcacgaactaagcaagccctaagaggctaagagacctaacaggaagaggtgatggaaccgagctggctgctgacgcctgtgagcaaaatataaattattaattcctccggtcaaaaatatttgttgtttaggacaaatttgattaaagaaattccagcaactaagtttgtgtccgaataaatttacaaaatatgataagtttgtgatattataatggtacacttttcagtgaaatttatgtatatagtttgttttggttttaaacaaagcatttgaaaattattaatggctgaaattttaaaggtttgaccaaatattttcctaaacggtaaacatattttcatcaaatggagtataacagagagatcagcaaaaagaaaaacttatcaggccagaaaaacttgataacaaaagctctcgagttcactaaagaagaaagtggggaattatgacaatcttacaaattactaccattgatatgctccccgagaaccaaaacagcaatgagtaaaaataaatcataaattaattaatcaccggaatttgtagaaagtttttttatttccgaaagcacctgcgctcctgcatttatgtagtggaacagaattggtcggcattctctaaattcgttctgattgatttcttctcctttttgttttcctttttgtgtaaactctgcacaatttgcactttatttatttgggtggaataaattccgaaaactaattttatgttagaaataaatttaccaaatctaataaatttatgatactagccaaatgtttgtgcttttgctatagataaaacaatatattataatacctaaaataaattttaaaataattcctcataaaatatgttatatatcattttggcataggaaatattcacttaatttgattttatatatgtggctatccatctagatttgattgatttttaatactaaaaagctttttaaggtgtaatgtatagaactacaacattcatcgctgttcttctacagcagtatagattataataatacttttggaggcaaatctatgtctatcatttgttttggtttaaattaagcattaaagaaattgttgatggttggaattttaaaaacttgaccttattttatcctaaatggcagatatttttaaatgacgaaggttgtataacagagagattagtgaaaagaaaaacttatcggaccagaaaaaacttgacaaaagctctcaaggtcactaaagaagaaagtgagtaaggatcccatcggatgccctaatcagtcaaagataaagcgaaaattagaacttttaaacttaattttgagactaattttaacatattctcaatgtagtttatttttcaacattaactttcaagtcaccaagaagctatatataaaactttcacctataaatttatttttattttctaataagtcgctttggcttatcagggaatatgagcaaacaatgggacagtaaatatgccaatattcttacatttgttatgctcccccagaaccaaaccagctatgagtaaaagtaaattataaattaattaatcaccggaatttccagggaagatatttttttatttcccaaaacacctgggctcctggatttatatcgtggaacaccttcggtgccctcttttgttttcctttatctgtaaattcctcacaatttgcactttatttactcaggtggaataagccgtgcttctcgtggaaattaatcgcgatcgggttggcatgtataaactgaattttactgagttagacctaacgaagtaaatcactggtatttctaccataagctacatagttaaaaataataataataagctacatgagaatgccagcgcgcgatcgatcaaatctcagaagtaaaataccgccagaagatgcacgaagaaaataaaatttggatcaaattagtaaatacaatgcacgcacctgatccaaaacgcatcttgaacaaaacactaattctaagttcaaacatgacttttactctttttttctacaaacacggtacaagcacaagcatccacgcatatatgcgtgcacactcaccgctatcaatacgcatacgcacactgaacctaataattaactgtaaacataggctgttaaatctagaatttgaacctaatcaataaattcaaccataaaaacctaacaagttaaatatatgctcgttctctaatcataatttctccggagcagggcaaatacaaatataaacatgcacgatcgtatatttatatatcaatactattaccggccaatctggttaactagatgaatactccatcacattgctgcggaaaattaagttgcataatatgtacaaataagatgtaatttgattatcaaaactaaaacaatttgatacaattttgagcctaaaaataattgagattgcatgtttttaagagagaagaaagaagagacaatttgaaccatagatctatcatccaaaggttagaaataattggagtgatgtggcttaataagagaagagagaaataacattaactacacttagtggtgatgaactatataagtatgtatataggataccggttacgtccggtcgatttaaacttctactccctccatcattttaatgtgtgattttgttagttttatatgtaatgttttgttacctgtgttattaaaagtttagtgtaaatataaaaagaatacaagcctaatatttaattaaattgaatggttaaatcaaatgtcatattaaaataaacagcatcctacatttaaaaacaaaggtagtatatatctagccatagtttcaatattccgtcacgtactcgcatgaacctcctcctcttcttcttttctaaagaagacaataagctctagcgttcactgaggaaggatatactcatatacatgtgcataatcgcattctaagaaaaatttatgattttttactgatctcataaccaaataactagcactggtagcacacttagtgtgctataattcacccgggttcaaattctccattctaaattaatattagaacttcattcttaagattttaacccgagtataagtggagggttcactacccctatctatatattggcttgtttgtagtgagagagaactattaggcaggtcagacagtcgcctggactttgcagctaccatcttcactattgacaaatgtcgttacctgtaaaaatcagttgatcaccaaaaaaaaaaaacgctattagtcatatggactcgacggtaatgctagctctgccactgcttgttcccgtcatgcatgctgatataattcaaatcacagttatatatatgatttatttatttatttatatttattttttgcgaacacgctgtttgtttctcctcaaccatacacatgtatttgtgcgaagtgttcacttgttatgacctaagagattaattaaaactgattgtatacatttgtagcactgtcacaacatcaaccagagagtgataattatttcatattttcattcccatccaaaaccacttatattcttcaataaatttacataattaattaagctgcatgcatacactagtattattggctagctagtactaacaattataccagtataattaattaacacacacacctcttaaattaattattcattagtagcttcatccttaagacttagccgaagaacaacaacccaatctctgcatcgatctctctctcgcatcgcatggcggcggcggccggagctcaggccggaggcgggtgcgccgccgccggaggaggagcccgcggcgtgggcggcgccatggcggcgtgctcggcgcagcagttggactggtactggtggaacttggcgatgtagacggccgcctcgaggtccaccgtccgccgcccggcgagcggccactcgccgtcctcgtcgctcggccgcacccgccgctgctgcggcctgtacccgccgccgccgtccagctcggtcgacgacgacctcgacgagcagcaccctcccatttgcaagcagtttatagctactcgatcgagctagctagctagctatagcagtggttggttgggcttagttaatttgcttagctttcgccatgggaggtggtgaatttataggcgccgcgctgatcgaggtgtggaggtgggaagagaggatggtggagaagaagcgcacgcggaatacgcgcgaacgggggggattattcccgcgcaagttgcagctgcgcgcgttagctgctattgcgcggtttcgacggtggggatttgatcacacgtttctcgaccccttcacccttgagattggtgatctgcaggaggttccatgagctaactagctggctacactctccgtcttaaaaaaaataaaaaagtaaatctgaacacgtacttatctaagttcatttagcattttttttttggacggagagagtagttgattactgatcgatctagcataagatcgatgtacatcagcagtttcgatggtgggaattgactgtacgtttctcaatccctttgatagaggatcgatgagctatctagatacgctctctaaaaagaataaactttaacaacaaatgtgaatacgtacttatttaaatttattatcagtttaatttggaacggagtgatgagtagctgattatatactgatcgatagatgtacatgaccacacacaagttgctgcaactttgcagccgttctttatcttgatggacctggatctgcaagagcctgcattattgccatgaaatattgctatagttcacaaggagtatatatgtatgacgtatagattaaatatggatcaatcatcaatggattcttggtctgtaggacctgacaaatgatttggtgattgagcatttggacttgatggattacactataccaccttcatgaaaatgtcagttttggatattttcgactccaacattaaattcaatcatattgaaaatagaaaaaaaaagattggatcactactatgaaattttccccgtgctctctcctccctacccccaagaaaaactccatgggcattccatgaaaggagacaaatgtggagaacgccaggtgaggtccacattgtctgttactagaaacaatttaagtggaccgtctatctaaataggaccatttccataattcactgtgtttaaaatatattatcaaagacagtggagtaagttgtcggggctcttaaggaggtcacttaaaaatagctacatgtattaataattctcacaggcggctatgttaagtggccgcctatgtacacgattgtttgtacagccttttgcttagaaatgaccacaaggcacatctatgaaaatacttttagcctgtctagaaaaatgttcatcttaatagtggatgcatggaggttgtatgtatcgatatatcttgtttttatcgggtttgtaaaatatattataatagaaattaaatgttaaagttgtatcttggagaccatgtcgatatctaaatcaaacgattctcatgggcattggcaaaatagccaacttgatgtaatcgtatgagattaataaaagcttcctttataaaaaaaatggcaaaataccagaaggaggtttattttgtaaagaaaaggataattcctagtaccttccaaagtactgaggtaccataagattaaaattatgctgcttgacagtcgatatattcttaatagccgtaaaatcactcaattagacgctaggacaaaataggccctaataaaaatcattaagctaatataccaaatgtaactacggcggtagacgaagattgcctaccgtacgtagagaataagaaggcacctgtcttgggataaattccaaccgttggattggactgcgaaaagaatggcctagatcttctgctacagtgattatggcctactagtacggaatactgtggctacagactacagttaaatgcatttctttttttaaaaaaatcagcaaacaacatgatgacaaactaactattccctatagaacaaaaaggtgcattctggatagcatttttaggagtcaaattcaggtgagcttctgaattctgttcaaatgaaatttttctgaagttacagtcacagaagaaatttctgaaatgcattgttgcagttacttgtcatcggatcttcaaagtttgcatgctccagtatgatttggaattttggattagtataaatatggtgtttatatttagcgtttcatatagcaagcgttaccaataaaaactgcttccaacttctgattcaaatgtgatttttgttggggagatcagtgaatggtaagttctctctttcgctaatcaagaagagaagttcctgatggaagtcctagaaagcaaattatctggcatgcatgctactactagttaggcataattttacctctaatcaacctcagccaccctctttctttgaccggacaattaggtgtagtaggtactcttttgatcttgggttgcaagaaaaattaatcattttcttagtactagtaatgtgcagctgaatgtgatgctctcacagtacattgtaaaaatcacaactgtcaaaaggatcattcagacttctggaattgttctctgaaaaatctagctgtgcagcaatgctttcctctctgatgctcacagtagattgtaaaattagaattgccaaaaaaaatcaaaataaaaaataactattgccaaaaggacaagttgttctctgaacaaatctagctgtgcagcaatgcaaggatgcattcttccctgatgctgaaagtacactgtacaattacagtttccaaaaaaagtcaaaataaaaaattgccaaaaggatcattcagacttcaggagttgttctctgaacaatctagctgtgcagcaattcactcctctcggattagaaatgacatgaatatttaactgctaatcataggagcaatatcccagttgagcttccacaatccacagcatgcagtgactctttgcatcatccattagggcactgattaaagtaaattcagataagggaagcgagaacaaactgtttagataaggcagtttatgacgataagccagcatcttagggtcactaacatgtttagtcatttcagggccattttaataaccagacatggccaagatttggcctacctctttaccttcagtactaacaagtcagggaccaatacctcctgtttaggagaacaagaggaacaaatcttgattagcatgcaattccgtgatcttacatcctaatcaaaactctaaaaaaaacacttaaaaagaagcattcacattaccccaaattcagtaccatgttcggtgcctaacaagtagacaggcaaaaagttttagagcaaattattcctgctccctttagctatataccgcgtataattctctatactaatctgtaattcagtatagtatagattataccagtttactactgatcagtgatcactgagaaagaccagtcaaaaagggaattctgccatgtaaatgattctaaccacccaaagaagatatcatacagcatattgcagtagaagctttgctgcatacagctccagtcttgcagtctcccaagtaccttctacagataaatttttgcctagttgtatcagaagacaagctgcaaactgcaagatctctttgcttttaggcctttggttcattatttaatttagtcctcgccgtacatgtaatgcgttcttgctgtaatcgcaatgttgggatgatcatgcataacaaattttaggcagaatcctaatgatgagaagaggtccggagttgttaggcgagagctacaaatttagatgtaaagatattagatatgttcatgtcataatctctgttagattaattaatttggattctcaatgcaataatgcagaaccatctccatctgtatgtctttgtgtccagatggcattggaagccgcagctagagatgaatcttggcataggagagtgagttcatggcttccaaagaaagatagcaaccaaagagaacaaagaggggattaatttaagatatttctcacctttaaaactgagaattgttttcatatgacaaagtgtttaccccttttgatcaaactagcaataatttatcgcctcctttccttttgtacgtgccgaacaaatgaagaacaatagaatcttacaaatggtggttactacttacaaaacctagaaagtataaagcaagcatcatcactagagtaacatggagagtatgaaatatctcacttagtttatgaggttccgatatgcaattctgagaagaaaaaaaacaaccggtaagaggttagggtggtttttttattaaaagaactaaagcaatgacctgttttgataaagaaaatattaaccaactgccgaatttagtatattctgatttttttttattaattatgcaacattgcactgttgcccaaacaatattgctacaagagttatttgacaaaattattaacagtgcatctattatgtttctaaatggcagctatattttctagacagacataatagatgttgactggcatcatcgcaaaagcaatataacgagattacaaagaaatcaattttcaaatagatacatcatcaagtggtttaatggatcacctttcctaaagctatcgcgctatcaaacgaactatacgagcgatttgacacaagttgaataaattgcacagtaacattataccttatcaaccattgtctgttgcaagaagattttgcctttatgaatattatgaataaagcacttccagagtccagagaagagagttaggcagtgataccctttttttttatcagccaattaaattcagagtttcacttgtacagtcctaactgccctgtaaaaagcttcttttcttttcattgttatcccctcctgatcatgattcctgataatactgagtttaaacttgaggcagtataggccctatcatattcccctgtgtgtagagttagaacaaatttcagtcttttctcctctgctttttctataaagtgtgtatgaatttattctgctcaagttcagcaagaagcttatatgagccatagatatactagtgccggcaccaagaactctagctggaattttgacttgtcctggcaaaattttctgtgcatccatggccattgaattgcgcggttcgcgagacgtttcaatcgaattttcttcagaattttccactggtgcactgaggtaaaagaaaaaaaaaagaagctggattcatagtgcattatattgcagcagatagggattcatgtgtgctgttcaatctgtcattctgctgtaactagtgaaacgggtggctgttacttgcgttcgcgttgtgccctctgccactgaaattgttccaggtaggtaccttttgctagctgctgttcctctagcttatcgctgattagcgaggtagatgcatggaacatcatcaaggaataaactgttttttgtctttacaatgcaaccaatctagtgctgattgtttttcaataaattggatcattatgtcaaaaaaatgttagcattgcttcaaaactatgtgattgtccatctgaaaacatatttgaaaaccagagcacaacaggaggctgcaactccagtacaaaatttccaaacttttcagcttctaacatatgccattgaggctgtcattgggaatgtcggatgtatgcatcctgggcatgcgcatttacaggataaacagaacgaatgcatgcatgataaacattgagaatctccagcacgggcatattattaacctcccagaactagcagtgtatatctcatatcatacatgcagcatttgagtttgaactaacaaacaatcgactaactttgacaaatcaaataagaatcaacagttacagctcttgtcagaattcatgcttccatgggttgcctaacctggaggcttgaaggtataaaaaaaggcagttaaaacaccgacgacaagtttacactttacagaagcattcccatcttgcagagcattacttctccagactatattcaggaatcacctcatatcagttaaacgacaagatttggtagctgtggaaaggaaactgaactctggtgtacaaagcagcgcattgtctcttttgccaataacaatccatcagtagacaacttttgccgatttatttacgtccatgaggtgcttggtaagcactgccaggattagttgctgcttgcccagctccatactgcggaggctgtgcacctgacccatagggtgacaccccttgcgctggggcaaatggaaatgatgcttgcgctaatccatatgaggatggtagctgtgcgtgtccatatgaaggttgctcctgtgcatgtgcatatgatggtaaagcctgggcagagccaaagttacgtgctgttgttgcactgtaggatgttgattgaacaggaggtccagatgcatgtgactgtggcacttgtgcagatccataagcggatgcagcttgtccccaagcatatgaaggtggtgttgcctgatttgatccatagtaatcagcactactcccatgagcagctgcagctgttgcctgtcctccaagtgcaggtgctttagaaggatcatatccagcacctttcaaagaattgtagcctgcggcaccccttgatgcatcatgtcctccagcttttgaagaactgaagctagcaatacgagaagcgtcatacatattgcctcttgatggatcaaatccagtccgaggagctgtgccagctgggtttccgcttaaagagtctcccagtccagcaggtggtgtccttccctgcaataacatttgaaataccatcgttactaatacataaagattgctccagcaccagttagaaaagcagaagacaaaatatgaaattgtcattgctacaaggaaaaaggtatcgtaattactttatgatcaagggtgcaccgcaagaaaagcatccattaacttcaggacagaaaagaaacgcacaaaggaatcaatgaacaaaagtaaaaaagctagttagtcctgctttcatttacggtattctgtactttcgatgagattgcattggaagcccatgagagcttaggatttgatccaaatccttgattcaatcgtatctttgttatgaactcattctacagtaggtgtaatgatctttgaataaactggtacaatgtattttgtataactcagtgccataacttgaagtcttaaaatttaaaaccaagcaaaagcgcaaaactagctaatggcaaggggtatcccgattgtgcaaataaatcaatttaattacacaagtatagaataagaatttaatatttgggactgaaaataagatggcaattgtataaataaacaaaacaatatccgcaaaagttagcaaaataataattaaaaacttaaaccagtgacattggaactaacagaggccaaatcctcgtgctcttgctatttactggtttattgacctgtgctactgtgcataacttaattcaaggtatatgcataaacatcatagtagaagtgctttcatgatagagactagcccatgaaggtataacaacaaaaaggctcaacttccatgacagataaattctgaaggctatggagaagtgaggtttgcctagtggagttgcaacgacaatgaaatgatatacatagtcatccagatgaaacatgcttcacaaaataataagttccaccgtatgctggttatctatttaggagttataaagatgctcacctgcgcagctccataaccgctatcataagcaatttgtccaacaggaagactaggcgcgccatcatccttttgagcagtattagtattgtatagcatacctacacatagaaaatgtctcatggtgtggtttctatatatgctacccaaaaattgtggtaaaaaaaatggaacaacagataaacggcatgcctcctctgtcaatattagccgtgttcatcagctcagcacgaagcttgtctagctcagcgaccatggtgtcataattcctcttcatcacctgcagcgactcggagtgatccatcctgagtttcctttcgtactcatacgtagccctgagatttcgaccggtgcgcacgcagaaatcgatgtcagtcataaatcaagtaaattcataactaaaaggcacaaacgcggagcatttcatatcgcgcggcacctgaggtgctgatactcctgcctagcggcgtcgcgctcggccacgagcgcggggagctgctgcgcctcgccgaggttcctctgcaggtccttgctcagcttctgcgtgtcggcggccagctgctgcctcgcgacgacgaggccctgcgcctcggcgtgcgcctgctgcagctcggccttgacggggtcgcgggccttgaggtcggcctccatcttggcgaccttgtcgaggatccccctcgcctcctgctcctcggccgccatcgccgcctgcccctgcgcctgcagcctctgcgcctcctgctgcgccgcggcgagctccttccgcagcgagtcgtggctcatcgccagccggtcgttctccaccgccagcttctgcagctccccccgctgcgccatcagcttctgctccaggatctccggcggcggcgccgccgccgccagcatgtcgtacgggaacggccccggcatccccggtgcccccccgtacgggtcccggtgcatcatcttgtgcgccccccggtggtggtaaggcggcggcgccctccccttgctccccatggtgggaaggagagggagggggagatgcgggaggagaggtcgttacctctcgcggtggccggcggcggcggcggcggcggaggaggcggcgggtctagggttggtcgtcgtcgccggcgtggggggaggaggaagacggcttcggatttctcactgaaattttcgtgctatttcagcccacgagcccaggaatggggcgagaaggaccggattgtaaaattccggcccacctgaggaggacaggattgtaatttctgtatttgtgcagggacctattagtattttccctatatttttttttctcctcccccttccttcccttaccctagccggcggcggcggctgcacgagcacgagcacaatccccgcgagctccaaaccctagcctagccgcacgcgcgcgcgcccgccgcgcgccacggtggccggcggcgctccgtccgccggtgctcgcgggctgggaggtgaggccgtgatttggggggtgttcctggcggcggcggcggcggcggcgtgggtggtgagggagcggaggcgcgactactgcatccccgactccggcaactgcagctgtggaagcttcaccgtggccggtaaaaattccgtgcgttcatatgtaaataaatataatggaatatcgaaaatatttgtggaaataattggggggcttcatttcgtgcgttcgtatgtaataaatataatggcttatcgaaagaatttgtggaaatagttggggggtttctttgcttttgatgaatgtttagacattgagctgttcgtgggtagaatttgtggattttgtgagggtttcccgtgatctttctgtcctgggggatggagaggagacgggattagggttggatcactgacgttttgggcgtaggtttgggatctgatgagtaatcatcatctcaccacggtggcgaaaagtgtgtccagaaactaatggatggtcatttctccagtttcaagttttccactttatgtgatatagatagaaccctcagttccatattcttcaatttaagcactgggaccttttgttttgagttatataactaaattaaactgttgggaggataaggggtaagaagaatattttctctaccaataataagctgttgtaagcaatgcagagaaaagtaagggagtgatgggcagattagagtttctgccaaagtccttcaagtcttatctaattgaaattaggtccaaaagttttgaaacctatatgtatggaggggatatgtaatagtaatatggaaattagggtatcctgtgcgttcccagcattccagtaccaaaagtacacttacataaatagtaaattgttgcacgcaaaattaatcatctgactgaacagagagtaatatatattttatggttatctacgattggctgtctaaaactcatttgcctgagtagttaagtggtagcttctttaaaaggattaggataccaggaaactcggtaaaaaaaatgttctgttattattttctgtctgtatctctgttaatatagtggtatagattatagtagtattattctagtgagactagataattcatgtgctggatgctgtttttatgtcctgccccatttgtttaaggatggcctgctgcttgtgtctctcaaaactctttaagtttttcactcggcaatatggtagcctgataatatcttgaacttgatgcactgcctttaactggtaaacaagtatcggctgcacaataagtactttcccatgtagattaacttgctgagcatacatccttaattctgcaaatcattaacactttcattgaacctcttcttaggaaagtgtaagtcatggggagcaaacagatagtagctgttcttcaagtaggtggagaattcaaaactgatgatgatggacagatgtcctattctggtggagaggcgcacgcgatgcatgtgaaaagtgattggacttttaaaacattcaaacatgagatatcttcaacgctcaataacctcaaacttgactcctatgtgttcaagtacttccttccgaggaataacaagactttgatttcaatttccaatgacaaagacctaaaacgcatggttgaattccatgcagagtcagagacaacatatatttatgtcatgaagaaggctgacaacaggtacccttctgactggcataaacatcttcataagtggatatccaaaaatgacatgagacatttttttcagggtaaaaacatctgccgtggtgcctgctgcttctgcagatcatgctgtagcagcaactactccagatggatctaagaggcaaaagatttgtgcaagttgggagaatgcgattactggagctggtcaagtgtttgaaggtccaaaggaattccgtgatgcactacacaagtatgccattgcacataggttccattacagatttgtcaagaatgactcttctcgtgtcactgtggaatgtaccgctgaaggatgtccatggcgtatacatgcatccaagtctcctgcaaagaaggatttcatgattaagaaagtttttggaagtcatacatgtgaatcagagtcagtcaaaagtcatcgtctagcgtctcaaaagtgggtggccagtgttattaaggaaaaattgcgtgatagtccaaactataggccaagagatattgctaatgatcttcagcgggaatatgggctaagcctgaattactcccaagcttggcgaggcaaatcaatagcccagaaagaactatacagttcacatgaagaggcatgcaaccagcttccttggttttgccaaaggattgtcgagacaaaccctggaagtgcggcaacagtagaggccttggaagattcaaaattccgcttctttgttgcatttcatgcctccattcaaggttttgtgcatggctgcagacctctcctctttcttgatgtgatatctgtgaaaccgaacaagcattggaagctgttggctgctacctcagttgatggtgaaggcgatatgttcccagttgcactctctgtagtggacgacgagagtcaagaaaattggcattggtttcttgaacagctaaaagcttcattgcctgtgtctggagaactaacattcatatcaaatggcaaatgtggtctgttggatgaggtctctcttatatttccagatagctatcatggctaccatgtcaactattttattgaagaatttaaggcacaattggatgacagttggagtgaagaactaaaagatacaatggttgagcatgttaagaaagccatgtattcatgcaaagttgatgaattcaaccagtgtattgaactcatcaaagttgaatctgataagcttgctgaatggcttttggagactaaacctgagaagtggtcagatgccttcttcaaggggtcgcgacttggccagtacacctgcaatgttcccgagacaattcttcagtgggtccccagtagatatgagctctcagtagtgcagttggttgatacaatcagatgcaacttgatggagatgatgtatacgcgcagggaatattcgaattcatggacggaaccgctaactccatcaaccaatcagaaaattcaggaagagatgggcaaagctcttacacacagtgttgtttgctcaacaggcaatgacggaaacaataatgtgtttgaggtatgcgatggcgctgtcaatgttgtcaacattgatacatgggactgcacctgcagaaagtggcatgtctctgggatcccatgctcacatgcaattgcggtgtttgagcgcactgatcataacccacttgacttctgtgccaagtatttcacaacagagtgctaccgcttgacctatgccatgtcaatcaatccaatacctgacattgttgtggctgctccatcaactgacccatcacaaggcgaggcattacatcaatcaccgattctaacccggaggcaggttggaagaccaaaggaaaagccagctgatcctcgaatcgcaatcaaaagggcggtgcgctgcagcaggtgtaagggttatgggcacaacaaggcaacctgcaaagtccctatcgcagcataaaacccttgccatatgttctcaagtgtaaattatgttgtgccttttgttgcccttttatgaactcgttctagtggaacctgtgcaatgccatcatgtatcttttatcagataacgtgtgaaacataatcttattcggtggttttagctccaagtatggtttgcctagcactagccggtacttttagattgaactttttgtggtgggcagaatctgggaaaaggattggagttttttgtacgttgttatccagcactcccttcctccatatggttgtaaattttgacatccgaagataagttattttatttctgttgaactgtgcaaatctttggatgagtaataatatctcgatactactcttaaaccgtgacatggatgagtaatagtatctcgatattactcttaattcttaaaccataataccaggttgatgcttgtaacaaatacgtgtttagcatcaatttaaccgttttaggttgtatttaaactcctgaaattttaactatttcttctaaatattatttactatcatatcaaaaatacgcattgttggggcattagaggtcatcagatgccaccaatcaacggcttgccctcgcctgttctgttacatcttcagtttcttgttcattactaatcactgctaataattcatgtcaaatgcatcgagtaatatttggttactgttctttgttttttttgggtgatgaggatagttgacattagaaatgttcattgaaaaaaaaaaacaattataacctctgagaaatacatttgtatagaatcttcatattatattaaactaaatactgcagtgtttcggttttactcatcagttaccactcggatattctgagtaaagaaatgacaattagtactcctttcgatttctaatatttagcatcattaacttatggaccatttgtcatttttttttttttttgcataagtcacgcttaaaatacatttgatgataaaacacatcacaataaataaatgatatttccgtgagttagagttggataccacaatgtaaccatgacgacttagccacacggggagatgatggtggtgtggccatagacttgtagcggctagttgctatgttgattggggagcagcgtccataatcatagtcacaaggatgtaggtttgggtgaacctcgttagcaaatatcatgtgttcctatgtcgtcatatggcatgtcttaggtgatcaatgagaagcgattaggaaggttggtcgtcattccgctatatcgactaaattttataacattatattttagaaccgaaggagtatcactaaataaatgtgggtttattaccttccactaatacaccaaaaatctgaatcatgacaacccatatacagcaaagatcataaatccgtgtaatctgtgaaaatcgcatagcaataaatatatccccattaaacacttgctacaatttcccatggaaaagttaaaacctgcctgaaatatcttctctatgtgtagacaccagccagtacacccagcgaaatacaccaccctagaaacagccgcgcggacggacaccacgtgcaacccgtgcgccgcgctcgtccctctcggtcactgacaagtgggcctcaccgcatcggctgggttccccaaacatggcccacgtcgctggccccactcatcctcatagtatagaatcttcatattatatttaaaacaaatattgtagtctttcagttttacttaccaggggtagagatattttaaccagcgtgccagttctccgggttccctgcttccagtatttgcatcccagtagcattttttttggtttgatgccattaacttatggatcattcatctcatccaatttttttatacatatgaaaaaaatcatccttaaaatatctttgatgataaaacaaatcacaacaaataaatgataattgcatactttttaaataagaaagtggttaaatatatttccaaaagtcaatggcatcaaacattaaaaaccggagagagtaataatatgatagtcaagtggtgaaactttatttaacctgggaaaaacatattacacacttctaaaaatgtttatagcaaataattgcaaaactcaatgaatttcttttttttgtttttattagtaaatactaagatattcacatcaaatcaatcaattctgattcctacaaaccattattctgagaagttaattgaaaacacaatatgaaaatttatactactttaagagaacatagtggtgatggtgattctcccccaagggctaacatccttcccatgaacctccactttatattttgttcattgttagtcactgctaacattttcacaccaaaaaccatagtatttgatcataatgaaatcattctctatgtatttttgtagtattataatggtacgtataatagatattttcaattttgagttaccacttaacactaaacttaacactaagatattactctattttcccccaaaatataaggtgttcatattacttttagctgatacttaaattacaggacaagcttagcataatgtatgtgatgtcgttagatttgtattaaaaaaactttttcataatgttagtttcgtagttgttgattgtatactataagtaaactaatgatcaacgtataatatgtcggaaagatgggcttagacagacgtgggaaaccacatgtctgtgattgactagaggctctaggtgaacttgatctgctcaagagtgcttgggagcaagaaatgcaaagcaagtgtttgggtttccccaaggataacaactatacatataaactagagtagggttattactcatcccgagggtctgaactagtatacaaatccctgtctcccgtctaccttatcgcaaactcacgtataccttagcactagtgttccccatactatactaataccgttgtcggtatagctcatcgatagatacacatcaacccgttttacttaccatgagaacacatataccccttcccggggtgctaatgggttctcgcggtaagacaactggagtgcggaaaccatccccttcccagaggctaccatgtggtggcccctaggagaggatgacccacctactcaccttgacttattttggtcaagccatgcctagcattcccctaccagtccttagtcatgacctctatcttaatacaatgccacaacctagttggccccatgtaacaactcatgggacaagcggctgcctctgagcagctttgcagacacgacttcgacccgagccaattgaccatagtagagtctcataagttcaatctttcttaagactttgatacctagacaggtgatgggcatatagacctccccaccagggttcgtatttggcctaggccggagaaacactcacccaccacccacacagttttgatgacttgcattccatgttaagcaaaccggtgaagtgagggactccttagccacgatgctaatcacgtaaaatgctaatatgtcttacttcctccgtttcatattataagactttctagcattacccacatacatatatatatatatatatatatattaatgaatctagacatatatgtgtgcctagatttattaacatctatatgaatgtgggcaatgctagaaagttttataacctgaaacggagctagtatatctttagaatggagggagtgtcattaaaagaaaatctgaatttaatactttccactaatacaccaaaaatctgaattatgactaaccatgtaaagaaaacaccattactccacataatcttgcaaaatcatattcacactaatacccacctgtattacaccagttattcacagcaagcatgcattaattgtttccatatctgagttcatactgatatctactccattaataacccccattaaagccattaataacccagcaaaatattttccaaaattacctctttgaaaaaaagttcatggagttttgcacaggaaaattactgctgctctgtgtacaccagccggagtacacccagccaaaaaacaccagcgcatcaccataatgtgttcatattacttttagctgatacttaaattacagtacatgctcaacatgatgtgtgtgatgtcgttagatttgtgttcaaaaagtactttttcataatgttagttttgtagctgttgattgtatactataaataaactaatgatcaacgtataatatgtcggagagatgggcttcaatagacgtgggaaaccacaagtctctgattgactagaggttctgggtgaacttgatgtgctcaagagtgcttgggagcaagaaatacaaagcaagtgtctgggtttctcgaaggataacaactatacatataaagtggagaaactggagtagggttattattcatcccgagggcctgaaccagtatgcaaatccttgtctcctgtctactttatcgcaaactcgcgtatactttagcaccagcgttccctatactatacaaataccgttgtcgggtataggccattgatagatacacatcaacccgttttgcttaccatgagaacacatgtactccttcccgggatgctaatgggttatcgcagtaagacagctagagtgcgaaaaccatctccttcctagaggctaccatgtggtggccccctaggagaggatgacccaccctactcaccttgactcattttcggtcaagccatgcatagcattcccctaccagtatttagtcacgacctctatcttaagacattgccacaacctagttcctaggtggctagctagttggccccatgtaacaactcgtgggacaagcggctgcctccgagcagctttgcagacacgacttcgacccgagccaattgaccctagtagagtctcataagttcaatatttcttatggctttgatacatagacaggcgatggacatatagacctccccgaaagggttcatttttggcctaggccggagaaatgctcgcccatcacccacacagttttgatggcttgcattctatgttaagcaaaccggtgaattgagggatcccttagccacaatgctaaccacgtaaaatgctaatatgtcttatatctttagaacggagggagtgtcactaaaagaaaatctgaatttaatactttccactaatacaccaaaaatctgaattatgacaaaccatataaagaaaacacaattactccagataatcttgcaaaatcatattcacactaatagccacctgtattacaccagttattcacagcaagcatgcattaattgcttccatatctggggttcaaactgatatctgctccattaataacccccattaaagccactaaaaacccagcaaaatactttccacaattacctctatgaaaaaagttcatgtagttttgcacaggaaaattactgctgctctgtgtacaccagccgggtacaccagccaaaacacaccagcgcatcaccaccagaaacagccgcgcggacggacacagccaccaccaccggggcacgcgcaacccgtgcgtccacgct

SEQ ID NO: 62709 - DNA, 717 bp, Oryza sativa
  unsure (1)..(717): unsure at all n locations
caaggggttgnnanctggttgaccanttngcttggnaccctgttccggacgatccacctgctccgtcgtccggccccagaagctcccgaaccagaagagcccctcttgctcgatcagcgccttccacacgccgccgtcgtcgtcgtcgacggcgaagcacctctctttccaccacccctcctcgtcgtcgccgccgcctccgttgatcccgccgccgaatgcgccttggaatagatcgtcgtcgtcaaatagctcctccagctgtttcttcacgcctgcagccgggtcgaccgtgctgcagcctctcttggccgccgccgccgccgccgatgatgatgatcttctcccgtgccatctccggaggatgatcctcttggacttgacaaccaccttcttgggcagcctgacgaagaggaacacggtgatctgcagcaccaggcacgggcagcagcagcacaccaccaggcagtccatggccaccagcccgggtggcctggggcccgccgcgcacgacgacnacgacatnggcggcggcagtcggagacagatcgatcaccgtcttttggacagtggataggaggaggagggagaagaagagatcgatcgagcttagctattagctatagctagcccatgcctaactgcatcgtggctagcgtgcctggaggagtgagaccgagggtgctaagttagggtgcttgagaagctcgagtggct

SEQ ID NO: 62710 - DNA, 651 bp, Oryza sativa
cggcacgccggcgtgggagacgttcgccgtaaggcgtaacccaggcggtgtcctccgatccggaccttcgattcgacgagcatttgccggatttctcccgtgatatttgcggtgtatacatgcatgtggcgtgtgctcggttcgatcgggagctagttggcgacttgcctaaccccgatcgcattcaaataaattgccgtcgctatcaccaaatgatgcgtgcccatccccaataatcccgagctaatcaagccgcggtcacctttccggaatcgaggtccaggcagtagcagttaagcgttgcctttttgaaaaactcgatgaagttacggccatgtacgcaacgataagcatcagttttcgtactccattcgttagttcggcgtacgaccactgataattttggagtcacatcagatcatcattttgcccgtgcaaaagcgagtaaatccaatccaaaatactcaagtatccaagggatggagtactatttatttttcctactcttcacatctcggtacagtaataaaatgagagtgggtcaagttgatagtagtactcctattttcctactatgaagtactatggtttaaaattcttgggtaccgagctcgaaatcgcctataggagtcgtatacaatcacttgccgt

SEQ ID NO: 62711 - DNA, 596 bp, Oryza sativa
ttgaacattagtgaactatttatccaaccatatgtgtaatctgatcacatactttacatggtcgaaatggcatctccaaaatatttgcctaatttgaacaggggactttttgcatgataacagtgcaatgcctgcataatttataactaaccagccttgcttgatttagcagcaactgatctcaaatccatctctcgtacgtctttacaacttctcttcatcttttttagggtgccagatatcacatgtatggtggattggtggcccatccaacaccaacagaagcaaattaaagaacagaaaggaaagtattggtggcatattaattaaagagattcgtttgctttgatttattgcaatgccacctgcaggagtctagtacattcatgtacggacgtaccatatgcattgagttggtattgatttggtgaacacatcccctgtattgaagtttctgcaggcactagttcatataaagccgtgtttagttgcaaattttttcttcaaacttcaatttttcatcacatcaaaactttcatacacatataaatttccaatatttttgtcacatcattccaatttcaaccaaactttca

SEQ ID NO: 62712 - DNA, 663 bp, Oryza sativa
acccgtgcggttcacatagagataggataaaacgagtcgatttgtgtggaaaaagaagaaaatggcgcgtgctttgacgctttgtagcattgaccctccttcctagggtcttttcctgcaaattccaaattggagcacatgattttggtgcatgagtatctaaaaacatcagtagtattctatattcttaagtcttaaccccgtagaaatcaacgtatcaacactcaagatcttaccactgtacaacctggctccataacgtgtgatttgttgggctcagaagcaatagcagctgttattggatggtttcgcagtacaaacgcccatgcttttatccatccgcgctcgtccgagcacgtctcattaactaactcactcactcaagtgaggtcaaattacagaagctcaagtcaaatgcttatctaatctgccgatactgtcgccggatgatgccattacaccccttcactatcacgcagaggctgtccaaaactatcaaatcgtcgtgacgacgcgagacctctcgctagcctgacagactggtccaacccaaccatatttttctacgactcgagccggaaatccaagaaccgagttcaccgcgcttctccccttgcacggtcgctgacaagtggtgcccacgtggaccggacagtacgcgtt
